United States Patent 8,216,786 (GENETIC POLYMORPHISMS ASSOCIATED WITH CARDIOVASCULAR DISEASES, METHODS OF DETECTION AND USES THEREOF) - sequence listing, part 6

SEQ ID NO: 1160 - DNA, 106118 bp, Homo sapiens
cacgttctccttggttttgttcttgaggcaagacttggtgtcgaggatctgctgcctgagccgctgcacctcctcgaaggagtcgcggttgtccagactgaacaccaggatgaaaacgtctcctagagggggcacagagagcagaaaaggagaaggtgagggtggccgcccaggggacaagtcgggctgactttgaggccgcgcggggcgcgctagcctctctaagcgcgaagcgcactactcggcgcgcggcagccggaccggcgctcgcggggcgccctggccgagggttccccgcccttccctcccgcacctgcccggcccccggctcacctgtgaggatggagaggcgccgcatggcggggaacgggtggttgccggacgtgtcgaggatgtcgagctggtagacctcgccgcggatggagtagaacttgcggtggaagtcctcgatggtaggcgtgtaggcgtcctcgaagcggccggtgaggaagcgcgacacgatggccgtcttgcccaccttggacgagccgaggatgaccatgcgatagcagttcttggccgggatactcagctccgagtcgctcgggcacatcttcttgatcatcgcggccagtttcattgggcagaggggccgcgagggcgggcgcggggccgagagaagggcagagagcggctgagggtcgctggggtggcacgcggggtgagcggctggagggctctgctcgggctgggcgcggctcgggcttggggctccggctccgctcgggctgggctcgggctaggctgggctcggctggggttctcccaggatctgggcacaggccgcttgctctggctttggcgcccggccgccgcccttatatgcagcctgctcggctgccccgccccggccctcccagctcggtgcgtcacgccccgcggggcccgcctcccccgcaccggctcccagtcccggcgacctcgtcacccgctgccgggctcctgctctctgggcgcgggggctggggggagcagtccagggtcgggctgaggctggaggcgctcggactccgcttttccactgccgcgggctcggcggccgcaggggcgtcggggttctggtcccggcggtgcccctgtccctctgcgacttcgggcaaggacccccattcctgcacctcccgcgcgcgtacacttattttctttggttctcagtttccccagagaataggaatctagtaagtaacccagtaagcgcagcagcgtttgctgagtgcttgcgcggaccgtatattgcagtcctcagagcacagccccagccccagcccccttccgctccggtccccagccgggctcttgttcccgggaggcgaccgccgggcggacgcggggtttcagggcctcaggcgcggagctcggcaccgcgcgctcgggccgccagagggcagcagagggcccggccggcggctcggggaggctgtggccgccgcgggcagagctagaacagaggctaggagcaggcgggtggggagcggcagggatggagcaggggtctcagggcgccttgctggggcccaacaggagcggtccccaaccccgcgctctgctgcaggcctcagcctgctcctttctcccagccagagatgctctgtggtatggagggctctgcagccagcggcccaccccgtccatcatagcattttgggcttttactgtgccgcgcgtgggccgacgttctcattgtctagctgagagacctggagctcaaagccacagcgagccaggaaggccctgggagcacagcacagcctcttgctttctcctgggcctcagttttctcttctggaagatactgattctggttctgtgattaaggatgaaaatatgcaaatgctttaggagggcggggcctggtaataacaatagcaacaataacagtagtattgacccatgaggcctggtgggggtactctcaagagcacaccaggtcgatcagtaaccaggagtggggtgatgttgctgaacattggcaacaggctgtctggagccagctcctcagccctgagctcttgaggcagtcactgctcctcaaggcaacctgtgtgctcagtgttttgctttggccacgtctgacttacgagaaaactagggagccattagctggcaccaccggcccagctgtcaggtggtggtctgcaggcagtgctgtgagtgccataccacccaccccatgcctacccacctccctcccacgctggcacttgctgtaggggctgctgcaggacaccactaacttgtttctcagcccagcttggcccccatcctcagagtccctgcatctctcccaggcctcactcttactgtcagatatttcaaatgcacgcatcacacagtgagcatccaagggctcatcagtggccctggcctggctctgattcctggtgtcacttatgcagcagttatccgacaggctagctggggctggagccccgccattcttggttcctgcccccatctgaggtatgtctgccagagtctgggagaaggggagaaggaactgagtcgcagccctggatatagggctgcagtggtgcagggtgttcactgcataaaggagccagttgagggtacatgggggggctcagttaaggtacggacctgaaccaccttcagactgagcaccgccttcctgtgcctcccacagcggcactgcatgggcagccgggctctaacttgggatgactgatggccagggctatagtgaaggtggaccccacacagccattgcctcctggggctctagtcccaagagggtccatttgatatgagtggagggcccgagggtcaaggatcacagcccagctctcccctggtcagtgtccaggctggccccttaaatcaggaacatgacactggcaggcactgatctagcctgtgtcctcagccacagtgattcctggtaccatctgtgcatggccgtctgccctacggatgctgggttgtgaagacccaggcccacctgccattcccattctgaatgccccagagcgcctcctgtcaaggaggtggcctctgggactttactcctcaagcagcaagccaacttccttgtttccgccctcgtcttttcttttaaaagggcatctctttccttttattacaaaagtaataaatgctcatggttttttaaaaacccaagccatttcagaaaggaccagaatgaaagaagcactgggatcaggcctctctcggccacacccaggacagcctagccaccaattctgtggggtggcatctcctgatgtccccacatgggcggactcccaactgcatgaaggaagtcttaccccggtgcagcctctgccacccagctctttgttcatgcaggtgccctttttccttcttctggggtttgcctgtgtgactttatgccaggccctaccctaggctggctaatcagagtggccggggaggactgggggctggaagacaaacaggaacaactcgcaactcacagaaccatccgccccgtggatcccggagtcccacagagagggagcacgtgtactgggcttcccagcactcccgccgcctgggccctgtcagccatcgcggcatttgatgtccaggttgatcacagtcccatgctgtatgcaataaataattctgttttctgtgtgtttggggcatgagacaacaaacagcgtatatgaggctatgagcctgtctgtaaatagtatttacctgcagtgcagcaattttgctgcttagaggggaggggaactgtttaaaatatttgacaatgtcgggggtgatctgggggtgggcaggtggacccaccccccccccaccagccccaggcaggaaatgccagccacacagcctcatttgagggcaaagagcaattagaaggttcttgagagctgggccagaggagaatgctgggcaccccatcagagctttgcctgttgtggtgtcctgagacagagtccacacaaaggccagaagtggctacttcaggtgacaggaacccagagcaccctcgggcctgggcattgccgtgctggcccgtgcggccagagcccatctctaccagcgccttggacagaggaggccctgaggcacgcttctatcctgtgtggccctggtacgccacctcctgaagaggaggaaaggggcaaatagagctggctttgcgttccctctgacaggctcccctcatcaagctgagattttaactctggtagattcctcatcagtgatgagctctgtacccgacagagcagacccttccagcagaagccagttcagcccaaggctcccggctctgccccaggaaccaagggtcaggatgcacggagctttgctgcccggctcagcccatccatcagcaatatgtcctcaaaggccgtgtgtgcagaggtgctggcggagggagtgagcacctgtgcaagcaggagcaggacggaggcactggatatggtcagaccggacgcctctcatgcccctcaagccctgagacagattctggattctagaaagcaaagagaaaaccttgaggagctccatgggtgataagggaggcactgcctgagcacctgctttatacacaaggcagtcatgactatgatggccattttacacatgaggggccgcagggtcagtgtgtgcagtgtccgtctggcccagtgccacaccatgcctttccttggtctcgctctgtcacccaggctggagtgcagtggtgtgatcttggctcactacaacctccgcctcctgggttcaagcgattcccctgcctcagcctccagagtagccgggagtgctggtgcatgccaccatgcctggctaatttttgtattttacctcaggacctttgcattgccactcccgatgcccggaggctcttcctccctcctgcttcttcttgaagttgggtcttggctcaaatgccacctcctcagagaggcccacttgaccaccctagcgaaaacaggtcacactgccatgtgtcccttccaaaatttcctgtgtgatggttgtcactgatcattttctggttcatactattcacactgctccattttctcttaagtttttaggatactagtctgaatcacagaacaatactgcttttctttttttcttttttttttttttttttttgttgagatggagtctcgctctgtcgccaggctggagtgcagtggcatgacctcggctcactgcaacctctgcctcccgggttcaagcgattctcctgcctcagcctcctgagtagctgggactacaggcgcctgccaccgcacccagctagttttttgtatttttagtagagatggggtttcacatgttgaccaggatggtctcgatctcttgacctcgtggtctgccctcctcggcctcccaaagtgctgggattacaggcatgaaccaccatgcccggctgaataatactgcttttctaagttagaaatggtcacatgcagtattggcaactttatatggtccaacttgatatgacttggctatagtagggtgcacagatggaaagtttacagcttgaaggttcccctctgtgcacacctgtggcagcaccacatccaagcacaggacacctccagttctgaaaagctccctcgcgccctcacctggctaagcctctgccgactacactggcttctaccaccgtagatccgttttgccttttgtgtctggtttcaatgcatcgtaggtccacgacatccttccacaggtaccggccactcattcctttccttgctgcaggggagaccattgcgtgactaagccacgacgtgtgtgtccactgtcccgctggcgaatgctgggggtttcaggagacaggatgcagtggggatgggtgttagttggtgctcccaggcacttgtgtctgtggggagacccagggtggaactgctgcatcataagtggccccccacctacggaaatgcaccatttctccccaaggaaacaatccagccaatcccaaatggcaggactgcatgagaggtggccatccagggggtccagagtacactgacaattaaaaaaaatgatcggggctgggcgcggtggctcacgcctataatcccagcactttgggaggccgaggcgatcagatcacctgaggtcaggagttcgagagcagcctggccaacatggtgacatcctatctctactaaaaatacaaaatattagccgggcgtggtggcagacacctgtaatcccagctactcaggagcttgaggcaagagaatcacttgaagctgggaggtggaggttgcagtgagctgagattgcgccactgcactccagcctgggcaacaagagcaaaactccgtctcaaatataaataaataaaaataaaaataaaaaattatcatcaaggtgggcatgtaagaagatgcacgtgctgtgaaaaacaggctagaagttcctcagtgggtccaatgtgtgagttaccatatgacctaacaattccacacctaggtatttgcccaaaagcaatgaaagcgtgtctacacaaaaactgtccacaagtgtttacagcagcattcttcacaacagcccgaaggtgagagcaacccaagtgtccattgcctgatggataaacacagcatctccatccacacagtggaacactgttcagcagtaaaaatgacgagtgctgaggcatggcactacgcagctgaacctcaaagacacagtgccgagtgagagaagccggacaccaatggacaaataccgtgattccatttataggaagtgtccgggagaggcaaatccatagagacagagagcggcttggtggcgattaatgctggagaggagtcgggggtgacagctcaggggtacaggggtctctctggggagtgacgaaaatgttttcatgattgtggtgatgcttgcacaactctttggataaacaaaaactcacagaattgtgtgtatggcttgtgaattgtatgtatgggtgaattgtatgtatggcttgtgaattatatctcagtaaagatgttaaaattataatagaaatgaaaccataaaattggccaggtggcaggactgtgtgctccaggttgagaagcgtgaatctcgccccctgatgaacaggtactggttccagcccagccctctcacgacacccggcagccacctgcctgttgcagagggactcaggatctctccagctcccctggacccgcccaccatgggggctacccttttgttccccattcatccccaaatcctggacattctcccccttacacatctctcatgttccctcttcccacctcacgcctctgtccagggcctagcaccatcaccactgcccagaacaactctgtaggggcctccccaccctgggggcctcctcacagtaggagaccctgtttccaccctgcagccaaggggaacctgtcactttcctcccatacttcatttgtttcttggaacctgagtccctcaccaggcctgcctgttgcaagggacactcgggagccctggaccctctcctgggtcggcccaccacagccgtggcacatgctgttcccttgggcgggaaggctcctcacccaccccactgcctcacctcctgacacctgctcacacccagatctgacttcaaaactcacctcaccagcgagaatgattctgcagagcctgaggacgcagatcgatcatggcagcgatgagaggaaaacatcccgccctgtccccatcctgcagtggcttgtcccaaggggtggcgtgcccctgagggcagggcatgaaaaccatgctcatagctgagtgagtcccctgcctgtgtcatagaaggactaactcaatattgttggatggatggatggacggatggacggatagatggatggacggatagatggataggggtgtccaggtggagggaatggcgagagtagacgcaggaataagcggaggtgatctgagacctgaagacatcgcaggagcccagatggagggaaggaggccgcggtgggacaggctctggggagagaataagtcctgggccccagggttaatgggccaagacttccttctgaggacaacagggggttgagggggtgtcctgaccccatttgcatttggcagggggggtggtgtgagggtgaagcgcaggggtgagtggggagtgggcaggaggtgggagccctgaggggaggggcccactggactgagccaggccggttgccagggaaccaggcttcctccggctgcacacacagctgggtgctgagtaagtggtacctaaaaataaagccccccagtgggggctgggactgatggggagtggaggtggggagcagggaactgcctaggaacatgagcagtgctcaggctgagactttctggcacctcccacccatggcccggatcccaggccgagcatcctggctggggagacagggaaggaggcccagagagagaaggagccagcacagctgagggatggagaggctctgtggcccagaccctgaaggccacctgcctgggctgtggggcccggtcaactgggcacctgggatagcgaagacacaggtgagggtcagccttgcccagcaaccctggcaccatcatccactctacctccatatgcagagtgggaagttggggaacctgcccaggtccaggggcgagggggctggggctggggctggggcaagaggagttcagggctggcagccctgcctccaccatgtgccctgggggccaaggaagtgggacaagaggccgtgtgatgaaagggtcaggttcactcctcggaagccctgtggcttctgacagctctggcctggggactcctgtgctggggggtgagtctccttgcacccgcctccagccctccaaggagagggccaggcttgcctggaaggctcaggaatgcggcccgggaccccatcttggcggtgtgagcacgaagatcctggattgagggcgctttgtaaatatccattcaggccgtggctttgcagccctgagcgaaagtaacgggaggtcaagggaaagccggccctcggccactgtctctgagcttgactgaggacccctggagctggaggagggcggtgatctgcctgaggtcacaggtggaagaggagaggggctggaacaggtggaggcctctccccgcagaaccctaatccccacacggcctccgggagcccctgactggccttcggggctcacagagagaccctgagggataatgttgaccaaagctgaagggctgagggcctctagcaccccggggagaatcaccccaaagcccaccaagcatagaagtcctcgacctgccccagtcagggggcctggagtcctgggggctgaggggtgaccctgccaccagcagcagaactgggatgaaaacaggaagtggcggcatggatgccaggaggagagggggagggtgtcccctctgtccacctcaggagtcccagtggcaatggctgagcctacactcctggtcactgtgccctgcctcccccagatgaggcttacccttgcagggcccacccctcacccccatacagacacatagggtgcccagcatgtgtccagctgctggtcagcacaaggccattcatttaggaatgacagtgtcatctgcccagctagactggggtggccaaggacaacatgcccacacctctccaccctcatgctgacggacacggggctggatcctccaagggaagaggcagcagaggggctgtcttgggtgtgctggggcaggggtgggagcaggtgacacaagacaccaagtctcctggagatgaaaccatggccatggccaggtgagcccctgacgcctcctaagtaccttactgggaggcctggagagaggtgcccacccctcagctctgagatttcaagacagaaaggctggagccagccttgctcgggagctatttgacctgatattcgtgccccaggcctgctccttccccacacagacagacagaggctggagcagatgttggggtcagggtgcctttattggtgaatgggaatgtgtgggttggagctcaatggccatatgtcggcacgtccagggtccccaaggcagcaggttccaaggcactggggcagcccacgccgggggcgagccctgagcagcaggcaccattctcgccctgcgcagggcctgccacttggggcaggccaggaggctggccaggccttcagcaaagctgttgcagctcaatcagctcctcttgtgggacccggaggctttctgccggtagatctcagcggtgaagggcctgccgggcagcggggagaggcttcggtcagcaggtcctgggggtgacccactgcccgcaccagagctctgcgtccatcagcttgagggtgtccagatgggaccgggatccccttcatcccccagagccactggggcaacactgacttggagccttcagagcgcaggcgggagaggggaggggagaggggccggctgcctgctgggtcctgcaggccgcattgtaagctaccatggccgctctgacctgggagccctggagtgggcctggctgacggcagcctgtcctgagcctgccctggccacaaggaaaggttctagagggagagacagggccagtcgggcagccacgcccccacccgccgcagcccctactcactcttcgtataggagagccactatgtaggtgagggccaccagcaccgtcaggagcaggcccgtggggctggcgtgcctgaaaggacagaggcaggtcaggcctggctggagccagggtctctcagggccacggcccacctgcccaggctggcccttcctgccgtgaccctggccctccggccgacgctgggccacttgggccgaccgagcccaggcagcactgccccttcctgagtctggcttttgtgccaggaccagggtccccatgttctcggtcctgatccatttatcatcattgtctgcctgtctggcctggctgggttccctcagggtggggcctgctcactctttccgggtctccagccgccagcccagagctgggaacgcagccccaggcggaagagtcccagtggctagggctgttcattcccgcacaggaggagattctggggcaaagtgctcccgtctcccagaaaccatgctctgaggaacaaaggctgttttctagaaatgagtccagggtcccccaaagccagtttggtccaccctgagtccccagcccctggccacaggtgcaaccccatggccacgccctgggaggatctggctgtggggaagggggcttaggagctgccgccccgcccagccctcaacacctagcccagcttgggctctcccaggtggtgggacagcagccccacgcccaggagcccccggtcaccccagcccagaggacgggaggccccaggcagagcatacagcaggcccaaggccggatggagcatcgccaggggctctttgctggtgaccagctcctgaccccgccacaccagtaagcagcggcagctcgtcagtgacggcaccaaggagcccgggcgcagctgctttgggtttccagaaatagctgccgtcaagctgtcccccaatctatttctatagttacctctgatcccacagctcccgcaggtgctgggctgctgccagggaggagggagggagggaggaagagaggaaggagagggaggaaaggagctgtctggcgggcacagagggcgcatgggcaggcctgggccaggggctgtgccctccttggctgcccctgtgccaagctgccccctccccagccaaaccatcacaagaacctcaggcagggctggatcgaggtgagggctggaggacacctgtggaccccgtggggaccctctgccctgcccactgccttccacccctggacctcacactggtctgcctgtctgggagctgcaggaggcagggcagacgtaagcaaagatccaagcccaggctccaaccccaggcctggcaaccagcagcgaccccactgtgggcgccgagggggacaggagtccctgattgcacaacacgaagcaggaggcccacctgtccctcacagccaggccaccacctctgccatctgtcccctggcatcgggctcactgccacacagcctgctggggtcctacatgccggggagctcagacacctggaagcccatctccggggccctggcaggtgagagacagatgggccgtgggaggcctgtgggggtccccgctgtgtcagcgtctggccagataatggctcatctctaatgagctcctggaccattgatgccatctctcagcacgctgcatggctgatgtcctctggaggcggcttatgcgtcccccagagccctggcctggctgccccgagcccaagggtgactctcactccagggcacaagacactgctggggacactaagccactggggaggcaccgaaggttggggggttagggagggattcgtgcaggagggaacacttgacgttgggtttggaaggactgacaaggggcataagtgggagggttctaggcgagggaacagtgtgtgagtgcatacatgcatgtgtttgtgcacacagaggagaggggggagccaggtgtgttgggaaccctaagcctgcagggacgacctgggtgggggggattgttttgagtttgggctcatcctgtggccccagtgggggtgctccatggccggtgagcctgggggcacatagtctgggccttagcaggcagagggaccaggctagaaggcaggtaggacgtgtccctggggactgcctggcctggacgtggggtgggggtagggtgggtcccagccagacccacagccccccttctagcttctgctgtctccaacccccgctgctacggtcccaactgctgaaggtgggagccaggaggcaacatcttgcgcttgacattcactgtttacgattcactcctttgggatcctcaggtcttgtggagaacctgtaaattctaggccagtggttttcaagtgttaaacaaaagcagtggaacactgtctgccaaaaaaccttctatggaagaaaatggctaaactagaactgctggggtgggggctgggtatgaagccgagggcagcgcccgctgtgccatccttgaccgcaggtcctctgacccgccgggggagcacatctccataccttgtcagtacccgtacctggctgaggccgacagcagttctaggcttccctcatggcacggggccccctctgtgggaaggggtatctgccacatgggcagaggctattggggcacagggagttctgtcagctgcgggtgagctgggccctggcggctctggccaacccctcctgcggggaagatgggtcgggtggtcccagccctgatgtccccgcacaagggtccgcaaactacggcctaggggccaagaacgcctgttacatttttaaacggttaaaagcaaaaggatcaaaaagaatgtttcatgacacgtgaaaagaatctgaaatttaggcttcagtgtctgtaagtggagctgtgctggcgccaaagacgcgcatccattttcctgcgtctgcagctgttttgtgtggcaggaccagggctgagcagctgtgacctgcctgcagcctttgagcctccacactccagccctctttggagaagctgaccaccctgttctgggatgttgtttctgttaccatagataagacgcttctgagaaagggagaaccagggcgcctaggcccccacaaatgacacgttcttcctttctctctctccaggggccctggcccccgcgtcctgagctgcaccagctcctctccgggaggtggccagcagggcagaggggtggcaagcctggtactcacatgatggcccagcccaggtagttggctgtgcttccccagtacatggggttgtccaggatgttgaaggggaacacggtcactctcgcctccttgaggatcccgaagtaatcacctgtggatgaggcaaggcagggtccctcggctattcatcagccctggccacaccatcactgagggaggccccagagcgggctgtggcgagacctgcaggtgagacagggccctgccctccaggagacttcagagagttcaacaatgggcagagtcagagggacccaacaggcacgcagacagcagagggcgtggggcctaaggactaaggtgctgagcaccgcccctgccccactgctcctcttctcgagcactctgacccagccatgctggccttcctcttcttcctggctctgcacacgctgttccctcccctgcgatgcctttccctgctctctgtacagagagcgcctttcctcctcaggcccttcgccctctgctcatggcgcctctttatgcagacccttcctcttcctgtcctacctcccactcttcctcgctctggtgagttcctctccctctaggggcctcagctggttgctaagggctgctctgctccacaccccaggctgtgtggctctggcaccagggcctggccacagcacgcctcccgttgctctgggaggtcagctctggtattgttttctcactcagctgcccagaggagctagacccagtggagagagggtgactattgaacagcctgttccagacaggccagccatgcacccgtcagccgcacagccacaaggcgtcccccggcagagctgctctgagccataagggagtggccggggtcacagtcacagtgtctgtcccaggcccacagaggacagtcccactggacacagagtaaccgctccataaagggtgtggcttcgttcctcccagccttctgtccccagaaacccctcatttgtctctcctcccagaggacaatggagcttcatccaaggcggaaagtagggcagctgcccgacaatgggcagcatgggcaggaggggtccaggagcttcatcaccatctggggacacggggcagggcccaggaccactggaaagttctttcttcccaggaagcaggaagtggggcacagggtgtgcgtagatggcacagaaacccaattcgagctgagtcacagcaggaagtgaccacctttgcctacataccgcgctgctggtcctcggtgtttctaggccatgtctgctggcagggccgccaggaggctgtggccactggtgtttgcaggctccttccctccctctgactgtccaggacccccagcttgttcttccactgctgaggggctccacccaccatcctggctctccttacgctgcctctgcagccctccctgtccagatccacccgagcactggccactggagggcccccgccgctggtctcccacaggacctgattgcacagcccggagtcccccttcccatggggccctcaccgccctcacatcctggaagggcccctccacagctcctcctgagccccacctctgatcctggctccatcggtccaacctcttccttgctgggaccccccctatggctcccacctctctggggatggagcctcagccccttggatggccttcaaggcctcggctcatcctcctgccctgtcccaaccgacagcacctgtgcggccagtccagctgccccccacctccagctgccagctactctgccctcaacctccctctccttgcaccaaggcttttttctctttcctacctgcccgcacctgcccccacctggcagatccagacgctcctggctgctgtcccccttcctggaccaaactccctacagcgtctgcctgagcaggaagcactgaactgcctgtgggtgccccccacagtcccagagaggcctggccatgggcgatccagaatgctgcacccacagatgccacttcctccctcggggggacccctactggcaggcacaagctccttgagaacttggagtgccctgtgacagcccacggtgccctgggggctgggcccaaggagctgtagccggcatctgaggatggggatggcaggcaggcccgggagctcctcaggacaccgttggtcccaggaggctactgaggccactgaagccgagtgacttccaagctcctgcactggccagggctgatggggaggaagacgtgggccttcccacccatgacggagagcgggcaatgcggccagctggaccaactccctgctcactgggaggggctccccttggacagggactgcctccttctctccttccaggttccgaaggccccctcttgtcccccacccctgcccccatctcccctcccaccccgacccctactgcctttcccatggctgcttttctttcccagattccaaggagctggaagttgctgccatcatcagggtcattggtgggcgtctagccaggccagcactgggctcacagcctgaaagcacctcagccacaggcagagggaaatggagaagggataaggtgcctccacccctcacccctccccagacctacaccagccctgcctgcggccaaacacggcacaaaccacaatcctgcctggcctgagagccacgcgtgccgggagctgccagagaggtggctgactcaccaccacctcaggcttctgtgcaacaaggcctgagagtcttctgcaagggggagctggtgctggagctggactcaaggagtcctgcacccagcccgggccgcagaacgggcattgagtgcatcttcattagctggagagaagcagcaggagctgccttcactccccaggaggcagccgctcagcacgctggggtaagaggagctgttggagcccagcctcctgttctaaccacagacaagccaggcctggaggagcaaagacgccccgatggagggggcccctagcactcccaccgatgtcacggatagcagggcagcagccacctggccctgcacctccctggggctccagcggtcctgctcagggtcaccccagccctcagggtcttacctaggaaagttccagcgaaccccagtgcaaagaagctggagagcacgagcacgacgcccagtcccaggagcgcgaggcccaggctgtaggccgcgggggtgtccaggctctccatcctgggctggctcagcatggcctgcgtgaagctgtgggcaggggatggagagggaggacgtcatggccagggaggatgtcacagcccgggaggaggccgacctcatcttctcgccctctccccagggacccttagagagtagccagcccagggctgccaggccaggcaggcagcaggtggggtccagtccacctgggaggtgggtgacagtaacagggaggggcccaggcctgtcagatttttaaattttttcaagagaagccagaaatcctgactcgtatgtgaaatatcctaatttttagaaatagacaattcatgaaagccactttagaccctgcatgtgagcaggctggattcagcccgaaggccaccagcttgcaaactctcatcctgtccaatgagcaactcatactatggaggaaagtgaggctcaggaaagacgcaggtgccaggttgcagggcaggcccaggtgtcccattccccaacagactcagtgccccgaggcctggggcatgctctgtgctagggattgcgcttccacagcccctgtgggtctggccacatcctgggtggcttgacttgcatttaaaggcactttgggggcccttaatgtcctcctccacacctgaattcccccactaggctccctttggggccaaaccactgaaggccttgtaaaaaggtagtggggtccaggtgtggtggctcacgcctgcaatcccagcactttgggaggccgaggtgggcgggtcacctgaggtcaggagttcaagaccagcctggccaacatggtgaaaccctgtctctacccaaaatacaaaaattagctgggtgtggtggtgggcacctggaatcccagctacttgagaggctggggcacaagaatcgcttgaacccaggaggcggagtttgcacaccactgcactccagcctgggcaatagagcgagacttagtatcaaaagaaaaaagaaaaaaagaaaaggcagtggcgtgaccaaaagggggtgactatgacagcagtgggtctagaggctcaggttctccagttggctccggagaactgaggggctggtgcagggagggcacaggggctaggcatgtgctgatgtacccaggcctcatcacaggggagcgggcgctggtgggaagggggccctgggtgctagatgagaggcacactcacaggaaaggctgtgtgtgggagcacggacatgtgtgaccaaatgtgctcttcccatgctcacaataatcacaacacagaagagacatggagatctgctacctcacgcagggcagcgcctttcacacccagtctgtagacggcatctcccagcagggccagcttaccatccaccccaccacccatccttcctccatccatctatcctctatgcacccacacatccatccatctgtccagctatccatccttccatccatcaatgtatcctctatctgcccacacaaccatccatccatccaccatgaagtatctttgtttgctaggctctttcaagcagattgaagcccccatcttcatccactcgttccattcattggtgaattcagattgttgtgaaactccttatgctgagctaaggacatacagacatgtctttatgcctccctggaactccttcctccagcttgactgggagctcttggggaacagaagttgctcctccttccctgcgtatccccccagcacttggcccaggccacagaatggatgtttagtgcatattcatcgactggagagaagcagtagccgctccttccttctcctcccatccccaagagcagagaaggagccagggagaaagggagaagggcctgtggacaaagccaccaggacccggtggcagaggcgggcacaccgacctgttaaacagcggcattcgggtgtcagggcaaacccactgccggtcatgctgcccatacccccagctctccacccaccagtgccctgccctgatcctgctgctgcccgggctcagggtcaccccgcagctccaggccgagcctctgggattggctcagggtcacgggctgccatggaatcaggtggccacatgcacacccagtgtggtgccacgatccaggcacaccttctcccctgcctggcaccctccactctcctgcctgcagatggtggagtgggagggaaaggaagggtgccggccctgctcaggagcatggctcccctgcaagcatctggctccttggctgccactgcagtggggaccagaaaacagacaggggttgggaggggcgaacaggggagagcattccagaaagaggaaatagcagggaggtgtgccttagagtctggggcagggcatggagcagggaaggtgcaggcctcggcccggcagggtttggaatgcactctgcctgctgtggaaaatgcagaaccagggagacccatccaggtgctgcaatagggggtgggcgcagaggccaggcccgagacgctggagggtcactctggacggagactctgtcgctcttaccccctcctgcggagacccgagccaggcctgggtccataccccatgctcagggttcctctgccagaattcatctgcatcacacaagcaggcagcagatgaaagggaacttcctccctctggtgtggcccaaaagcccagctcattcagggcccagcttccctgggggcatggctcagtaggcaaatcagatctgcttggaagcagattcctgatgaagggcagatccggggccagggagcgggtgggagaggccccagatttgccccagacctgaccctcagtcccccagctgctcctccgcctacggccccagtcctggggcctttcctttcctttctctgagatgacagcctgggctggctcctggcacaatgctctgtgggtcatttgctcagagtcggcagaggaactgggctgagctcctccctggcgttctcaccaagtggccccttacccagtcaaatacactctgattctagattccaggtttactggaatctcatggcccgaattaggcaatcgacagtgttctagctcctccattaagccaggaaagcacagtccgtccattccacagggaaaattagtggatggatgagtagctctgtgaccacaagctccctaacagaatgaggtaatataggacgcaatttcccttggaagtattccgcactaggggtggggaacggagactcattcatttgccttgggttctatttttaagacctggattgaaccttcagtcattaatgtgatttgaggctgtctgcactctgctcccataaaatcccggaaaccctggggtggaggtggggagggggcatcactgccctcagtgtccccgccctgtccccagccagcagtcctgggccacacaccaggccagaggcacacggccccacctgggacaggcctgtcccgtttctatctgcagccgaccagaaacacttccctgactttgatcatcctggggtgtctccgcaacgtcgtccacatccatgtgtggcctgagtgccatgtactccacatccttcaccccaggcttggagtgactcgctctttccactccatctcagctacacgacgctagccatgaaatgagtcgtctgatgggctcatttcttttccaagacatattaaaataagcatgtaactactaaaacaaaaaatgttcatctatgcaacccccgagaccatcaaagggcttgaatttcgggctttgacgctgcactaattctgagcatttgaataacacgtcacctttccaaagtgtttccagaacccatcaatagctgagagagagtctgtcttgttttacaaacagggaagcagatggtagaaagcaggaggggcaggatggctctcctgcctcctcacgacctgtaaacagtgggataggctcaagcctcacgggcaggccaaggacaacaggcagcagtatcccagcacccctagcacctgggaatcccaggctgacacccactctccttccagacttcctggccgtgtgtgctttggggatggggagggtgcctcttccctccttcccagccacagcccctcaggtgccagaccagcctggtctaccagggcctggacccactcttgccgaactgcagcccctctccctccttccttcccagcagctgggggcccttgtgcccaggaaagcctatgccagcttccctgtcctaagtgtccccccaccccttactctccagctgccctcatggaccccgcccagtggctaccccaggcacctgcctcgaggaaatcactctggtgaagggatttcacaaatagaattcaggtcctaatcagctggccttgagttaatcaaaagggaggtgaccctgggtaggcctttccaaaagggtctagaagccagagagaccaaaagccaaagccacagagctgcctgctgtgctgcggggaggccaccaggagctgggcctcaaggacccgcgtcctgccagcaacccgaaagagtggaggaccacgccttgggtgagctcacacccagcaggcaccttgattccagcctggggagtccctaagcaaagaccccgcccccgcatccagcctcctggacacagaaactgtcacatagtaagtttgtgtggtttaagccctaagtgtgtgggaatttgttacacagcagaaggaaactaatacacttggcttcccagtccacagactctttaaaaattctggcctgttctgccaagacagcaggagtcgcttttttctgccatggaacgctgcacacgcccagccctccattgctccatcggaagcaaactgtcccatcagctccatgccctccctccttcatgcagccgctcaacccccggcctgtcctgaccacatccttgagcaggtccggccaggcactgggtgggatgcagcagtgaccaggacatgtagtcaccaggacagagggccacctgtgccagcctcctccagggccacagtccccaaaggcctggcctcagaatcatcagggagtttttgaaaacagacttccctaggggagaggggctctggggtgagtctggtgtcccacagggttgcacctgccccacggcctctagtatacagagcgctgaggtgagtccccacctgccctgcccctgctgcccagcctgtgagtgggggccgccctctcctgggactcatgggccctgcccagccatctgaagagccggctcactcctccaggccttggtcgtaaggcttcttcagccagggctccgcctgcaccccacccacccagaccaccttccagagaccaccctgcccctccaggtgcctcctagcccagcctgggaatacctccaggttgaggaagattcctgatcgacagccacactccgaggccaggatgcagcttcttagcctggctgtgcccgccacaccagagcacacaggagcctctcccctcagaagacccagagggagccctgggagactccaggcaattccgatgtgcgctggagcacagttccatcccgtgactggtgaacgacaccaggagctcgctgatgccctaacaagctcggctgtctcctcccacagccaggagggaggaagggctgcagcccagtcctgtgaagcccgttcgagccctgcctggccatccacgcctcgcccacccccgtgggctttctcgagaccagccttgtggctcatcagagggtagcggtccagccaaagctggccaagttcagctgtgcagggggcagctcaggcaagggacttcaacaagtgccccggagcccatcagccttcctccccattcacactccacagccagagcaaacaggtctgtgctaatggccccttcgggactggatggagcacacctgcttccagataacagtggctcatcctgccccgggcctcccctgaccacctctggatgcactgctggtgcagacctgctaacatagtgacctactctcccctgggacccgctggcaggtcagctgctggtggcctctcggacatcccatccatgacccaggcttggctcaagcacgtgcctgtgttctctgcccaccaaccgactcctgctgggtgcagaggcttttgagcacagcctggaccccacaaagcttgccatctcccatggagaacgatgccacaccccaaaggtccagaacaggcacactcatggggacagaaagcagacgagtgctgccagggactggggggcgggagatgactgctccaggcctatagggtgaggaaaaagctccgaaactagtcaggaggaagggctgcacaacatcgggaagctgctaaatgtcactgaattgtaaagcttaaaatggttcataacagtttatgttatgtctattttactgcacaaaaaagaatacccacctctagacagccactgaagcgaggcatgcatgggaaagggtgtgggggtgtggggtatgcaggagctggtcccgagggtcctgtcagagcctggcccaacagcccggtccggctccagcacctgccacctgtgtgcctcacactggcaggtgtgggcgggaaggatgggtcaccagggacatggcaggatagggtgcaggcaggggcctggaggggaagaacagtgggggagagagtgaggaccagggcacacctctgcctctgaacacaaaaggtgagaggagaaaagcagcccaggacatcctttctctcctccccaaaatccaggggtggccagttcaaccaaaagtcatggccctgctggctgggcagatgccaggtgaggccaacgctgatatgagaggagggaaagctgggagccaccatctgtaagaagctgacttcctccagctaccccaggaggactcccaggccccgggatccaagaacaaaccagacagtgctttgctgctgtctacggctggaactgggctgtgggtgggcctgtccccctggtctcctaggtacacacagcactcggctggggcctggaggaggaaggatgaccccttccagggccctctactctctgccttgaaaaggggtggatgacgggggcagacctccagggtcaggcagatcacaggctgtgctgctggaccagcagggaggtgatggggaggactcaaggaagcctctggggtttctagtgcaagatgagattgcgcaggaaatcagaactcagcagagactcagagcagctcccggggcagggctggcaggaggggctccatcaaggcagctgccttgtggcgctggccggtgtttctgggcagtcacctggcctggtctagctgctcctggatctgtgtgcgctgtgggctgcagcccacttctcctgctttgtgccggccctgatggtggtcccggcatgctctagggagcaggagtggtggaacagctcagcgtgccagccctgggctgagtctcaaccctctgcagccctccacctgtcttcagcctcgctgttcctgtggggggactccaagctctgagcgttcagtcggccagcaccagccccctccctcctggccgctggggagtgtggatgcctgggggctggagggcacagacccctgactgtcctgccaatgcagccagggccccatcctgggtaaggagggacactctgccggtggcccaagaggcagcatgggtaggaaagaggcccatctcccgtcccctgatgctcccataacccagcctgggtggtgccggtgcctgccaggttcctctggcctaaatggatggaatcttttctccctaagccactgctgagctggaagctgcctgttctccaatgctggtcagcgcttcatgagctgtaaaacctcgggcaaccattgcttctttccaagcctcacttcctccatctgcacagtcagagtcttctctacccagagactataaatgtgaaaatgctccctggggccggagagcctagaagattgtaagcatgcaggctgtgcagacgcacaggccccgaggcggtgccatgggccaaaccccttgccctccgaggggtgaaaagccctctctggggaagcctcttcacatcattcaacccagggcaggtgccaggggacccacccctctgaggaccaagaccgtgggatagccacccaggcctagagaaagcaggcagccctggcccaaagggccaagaagcaaaggccaggagccaggggtccagtgcggaaggctgacctcagtaggaccctgaccacgctgctcacccacattcctgtggccaaggccatgacaatgacgagaaggcagcaagggtgcctggccacggagggggaaggcctaggccaccctcggtgagtgtgtgaggggcctgaccaccagcaaggcctgccccggctccgcacgtgctggcatggagcattcgcaggccccttcctgtgtgcacccagtgcctgcaagccaggctggtccgacggagatggggccacgggcaatggggagagccaggctacacgcgccccatccaaagggggcagctgtgcctcggccccagtgagcgctccacgtggggtgtggccaggcacacacagaacttctggtctgtctcgacaagtcaaaaatggggattctctggtgcagctagtttctcattttttggagaaccacgtggtccatgtttagtccatgagctgccgtgcgcaatgattctcagggtactgtgggaggtgagaccggggcccagagatggggcagctgccctgcacagcctgcatccccaggtcgcctgcagccatcacattccacgcaggtgggccttgtctagcctggtgtctgggcagagaaattcgctcccaagtgcagtgggctgtgcctcatcatctagttccagttcttcttctctgaccttttcatttgacagcaggaaggtgcctgtcccaagtccagagatgggcaaagaagctttcttttaaaaaaaaaaaaaatgtgagacggagtctcgctctgttgccccaggctggagtgcactggtgcaacctcggctcactgcaacctccgcctcctgggttcaagcaattctcctgcctcagcctctcgagtagctgggattacaggcgcatgcaccaccatgcccggctaatttttgtatttttagtagagacggagtttcatcatgttggccagggtggtctcgaactcctaacctcaggtgatccacccgcctcggcctcccaaagtgctaggattacaggtgtgagccaccacgcccggcctcaaagaagctttctgacgctgattcaaacctaacctggagagatggtcaggcctgacccctgagggctcccgagccagcatccaccttctgactggacgcttcctggaggagactcctaaaacagccttggctacgtggcagaggctgggatgtgacctggggaccacccaggcattgtcccttgccccccattcacatacccccattcctgaggtcactggggctcctctgctggccagagtctaaacggctgggaggggtagggtggcttgctgtggcaggtggctttgagagctaacccctgagtgctcagacacaaggctcccgcgtggtgagggatgaggtaccaccagtagcggccctcccgctagcccaggggttgtggctccccagtgagagagctgtgcttaccagtgcgagcgcaggaagttcaggagcaggatggtgacgcttagagagtagcaggccaggtagggggatccgaaggccctgctcagcttgcgggtcttgtgttcccatcgtgcaacctaaaccgtgagcagagaacaagaacgagatatttcctggggagactccagggtgggggtggggagcacatgcctctctctgcttcccaggctccaaagcccccatttccaaagaagaagaattacacgggagcaacaaccacatgcaccccagctgcacattatctgccctagagcaagttccacagggattttcacacttgctcagttcatctggacggacaacaaggtccttctggaaacaactcttcaaccagacacagccatgaacccaccaagaggcagaaagagacgtctggtggagaagatctgtccctggggagacacatggggtctgacctcaggccctacctgggagctgctgagtgcatcccacagactctaaaagggccccagcagaactgccagaggagcccatggctgcaggagcacgcggccttcagagcacaggcccaaatttccgctgggggcctcacaaagtgtccatcacaggcgcaaagcaaagcaaagaaaacccctcaccctcctccctctgcccaagtgctcttctcaaggcacagactttcaaacagtgacttttagcctcagaatccttttactttgttttttttcaaactaatcacatctggaatctcaacatctggccaccaacggtggagagaagggagctcttcctgcctgcctgctgtttccacagtcctgagctggttatcgcccgggcctggcccagcacactgaggaaggaacggagaggaggggagggggcaaggaggatgcaaaaagacaagcatgcagcctggggtcaggggctgggctctaggtatgtgagcaagttgtctgtgggcccagagtaggcgcctgtgtgtgcacaggaagagcctcagaggcctgctcccagccacctacctccaccccagccccagcgatgactgctgcctgctccacttcccaagtggacctgcctttcccagcagttgcggcaggagagtgattagcgatgatttcctcaaggccactgactcccagaaggtggctccctagtgagtcctctggcccctgtcctcagagctccttggcagtggcaggctagggggcagcagatggcggggggcagggtatgccaaagtttacaggaaggagaagtgaaggaggtagctcccgggccttcccctcaaccagctgttggcactgcagccaattctcccagaaggtaagcaggccctagtccaggtctcagcaggtggccgctgctgactctgtgggaagctcaaaaggcggaaggaataagcgctgcaggggtgaggagggggctgcggtgaccttgctgggaatgtgtggggtggggtgggggcagaagaggagcagtctgcagagagcaccgcgggggcccaggaccacagcctgctttgttttgttttgttccaattctgagataaaattcaaagtagtttttagctatgcaaccatcaccacggtctaagtccagaacatttcatcaccccaagtagaaaccccgtcctccccatcccccatctgccggcccctggcaaccactcatcgctttccgttgctatggattcacctattctggacgtttcatataaactgaatcacacactacatggtcttttgtgtctggctgctttgactttatgtaacgttctcaaggttcgtctgtgccacagtgcgtaaatgcacttcattccctcttacggctgaatacgactccagtatataaagattttgtccaccggttcagcagctgatggacacttaggttgcgttagcagcactgtccacggtgaccaaggccaaagccaagcaacatacgggcgcttgctaggaacaatcgtgcccaagtgttttgtggatgtgtgttttcagtgctctcaggtatacacctaggagtggaattgctgggtcacatggtaaatctatttattgaagagctgtgaaactgtttgccacagtggctgccccattttccagccccaccagcaatgcatgaagattctagtttctccacatcctccccaacaccagttattttcccttttcaaaaattatagccttcaggggtgggggacactgggcatggtggcttacacctctaatcccagcacttcgggaggctgaggtgagagaattgcttgagcttaggagctcaagaccagcctgggagacatagtgagaccctgtctctccaaaaaaaaaaaaaaataataaaaaaaattaagttagccagaagattgcctgagcctagaaggttgaggatgcagtaagccaagatggcacaccactgtaccccagcctgaagacagagcaagaccctgtctcaaaaacaaagaaaagaaaaaaaattctgtagccatcctagtgggtgtcaggtggctttggtctgcatttccctaatgataaagaaatacctttccagctgggcgtggtggctcacgcctgtaatcccagcactttgggaggccgaggcaggtggatcatgaggtcaagagatccagaccatcctggctaacacggtgaaaccctgtctctattaaaaatacaaaaattagccgggagtggtggtgtgcatctgtagttcagctactcgggaggctgaggcagaagaattgcttgaacctaggaggcggaggttgcagtgagccgagatcgcgccactgcactccagcctggcaacagagcaagactccatctcaaaaaacaaaaacaaaaacaacaaaaacctttccttcaagggttctctctgccatcctcagcctcccatacagcccccctcccccaacagacccaggccacacctgtcccttagcctcggaaagagctgatgctaaatgagctttcagaacaatctaacgacaacagaaaagcatcaagcaagactaacccatgtgggaaagaaaaagaggaaaccacgccttgcctcccagcgaactggtattcgatggggctgttattccgaggcaatcgataaaccagcagccagcaggactcccagaacttccttccctgcctggcagcaccaccgtgtcctcactgggagcccagctgctcgtttcatccaacaatgagcgggtgccggacgcagtcgcctcccagggccatgcatgtgagcccttagtaggcagcggcgtggcccagcactctgctctcactgctcctggtttttgcctgtcttctagatttccagaatcctagagtggggattcatttgcccaacactccgtgaccctggctcaaatttcctctccccggcactgccaggaccctccaggtaaatgtaagcttcagataaacaacaacctggccaggcacagtggctcacgtctgtaatcccagcactttgggaggccgaggtgggaggatcatgaggtcaggagttcgagaccagccaggccaacatggtgaaacctcatctctattaaaaatacaaaaatttagctgggcacagtggtgtgcacctgtagtcccagctactcaggaggctgaggcaggggaaccgcttgaacccgggaggcagaggttgcagtgagctgagatcgtgccactgcactccagcctgggtgacagagcgaaactctgtatcaaacaacaaacaaacaaacaaacaatgttttggtgcaacctgtcccatgggactgcttttaatcctaaaacagtctgtgctgttgacctggaaccctaatgcaaccgggccctgggtgtgtgtttgctccattcagtagcccagcctctcccacaccctggcaaggagttcccagctgagctctggaacacacaggtctcctccccaaatgccggctccttttctttttttgcaaatctcacccacagcctctaccctagggcagaagagacaggcccaaggcaagtggagtgggaggaaaacaggaatggggtcgagacccagggacaccatcctggccttgacattcgccaaaagccgacagcacttcataggcaaatcactcagctgcccgctacctaaactgagtcagctgcaaagtacgaaaaacaggacggacagtaccccccaccccgatccccggccagcgtggaaggaggggtagagcaggtgagggatgaaaggctcctagccctggcatgtggcccaggacatgtgagagcgcccgtctctccccctatccgtggctcagagcagggactgtgtctgatttccttctgggtcccactcagatgggaacggcctctgcccatgcacatgcccgtggtgcccgtctggcctgaggtggcagctccggcctctgtctccacgccaggacccatgcttcttccctgccctttccagggtgctattcttggtgtccttggactcagaggttgtaactggcagcccaagatgtgttctggtcaaactcatagcatgtttaaaatatttggatcaacaattaaacactcagcgtttttcacataaaagccaaggcttctcaaatcttggcaatgaacacagcctcccaccccacaaggcctacaccagcccagctatgcagtaagggcccaagaagcacgacccccttctgggaacaagaccctttcctagagacttcctattggtctctcaaatttcctacgcatccttgaagtgaggccgcagaaagtcgagttttttatttttgtttatgtttttagacggagtttcgctcttgttgcccagcctggagtgcaacggcgcaatctcggctcaccacaacctccgcctcccgggttcaggtgattctcctgcctcagcctcccgagtagctgggattacacgcatgcgccaccatgcccggctaattttgtatttttagtagagacgggatttctccatgttggttaggctggtctcaaactcccgacctcaggtgatccgcccgcctcggcctctcaaagtgctgggattacaggagtgagccactgtgcccggtgagggtagaatttttaaatccctctttgaagtgagacacggctccttcgcactcactgaaggactgatgggcaagtgtccaccccagtgcccagcagggcagctcgtggctcccagcgccaggttctgggctcaaacaccggctcctctacttgcagcttggagcttgggcaggttatttcctttctctctgcctgtttcctgatctgtaaaatggagctaataatactctcgactgcgtcacagagctgctgtgcggattaagcgaattcctgcccatgaaatgcctggaacgatactacaccaggcacatgggcgcatggcggtgctgctgtttgttttgttttggaatgggcaaaagggtgagagtcaagaggctaagtccaagctattggcctgacaggccccggcaaagctgatgaagaaagtctgttgtgaagcagtgtccccagggagaggacaggcagacagacctgtgccacactgggctcgccggctgccaggcctctcccctctgcggccagcccttgatggactctcagaagctcctcctctctcaccttgtccttccctggctaaatctgcctaatacccagctgcagtggtaggtcccatctggattccacagccaggacccccccaccacctggcccagggctcccagcctaggcacctgggggtctagaatgccccaagcaaagggctagtgcttcgcattggtaatgaatgctggggaggagctggtgtttccacgagctttgccaagggcccacggaaccactgaaggagcccatcccttttgtttagaggacgtgggccgtgcgccagcacagaggggctcatgagctccaagcttccttctgccttcctgcttttgcctcccgaaccgcccccatctcgcttctacagctggacccacccctctgcctgcctgactggccccctttccagccccaggagccgcagccagtgccttctcactcctgaactcctgccttgcggctccggcaagatgtggctgtggcctaacagttcacactgtgtccacctctgcctgcactatgctgaatcccacgtggggctaccacccgaggaggcactcaacaagcacgggtctgtgtggaatgatggatacatcagcgctccgaggccttctctcctctcctctttccctcgccttgcagggagccaggaagggagggggccactagctgggctccatgaagagaggaggggccctaaggcccccagggtacctgtaggtgacatacaaatgtctgagtgagacgtccccggggcagcagggagtctgcccatgactcctgtctctccctcatcccaccctggccccccagaacctatgagaggtcagggacctcagaggcggtggagcccagccctccattggccttctgaacagaaactcagggctccactggcatcaggaggtgggattcaggatcccccagtcccactggagttgacaaggatggctgaggctgccaaggctactgggcatcccctaggccggccccgatggcccaggcccagcagcatgaggacagcccatcgaggcatttcctccccagccccagatcaaggtcactgtgataccgtcacataagcttcatgtgcacgccaagtgctgtccacaccgcgcatcccagcggggcctggacccctctcccttctcaccagggctcatagtggatggggtgtgtttgtgggagctcagcagagcccagcacaggacccagtcactgccagctaggcaggccctgggccagcaagcaagtgcatatatgaacaggcggctctccgaggtcgcaccgtgtcagccccctctgctctgcacacgctaggcccagccggcccggtgacctggatcacacctgcccttcccaacacccagttccacctgtcctgccaggtgtgcacagccctggctcctttcagatctgccccaatctggccagtgctgctgaacctgggccagggcctctccaggacataggaccagtggcagctcagggcagcatccaaagcgtcccacagcacatggctcaactgcccttccacgtgacacagcctgctcgagggctccaacagtcattgtctccaacagatcaacagacctgcccactccaccagctagtccagtgaatcaatccctgtccaaggtgcacccaagctctcgccctgcagtgagcacactagtgccagagagcaggtcccagcaccagctgcccacttccagacaacctgcacccgaggccccagcaaagcaacatgacccagcttcacacccgaggggccatggcacagcgggggacactcgcctcccccagcctcagtgctcatgctcaacctcttcactccgttttgctccccgcctcctccattatgacggcccacagagcacaggagaaagagcaataggaacatgggctctgagttcaaattctagctccagcactacctatagcatcgtataaagatggaacccaccccagtgtccactggcagggggaggggctgaatgaactgcgctacagccccaccctggagaagggctccttgtagaaaggaggaagatttctatctattgctatggtgtaagctccaggatatattcattaagtaaaaaagcaagtgcggaaggtgcacccatcctgttgtataaggacatgaagaggggctgggggaagatacacacacagacttgcttacattttcaaaaagcaacaggggaaggacaaacccaaaactgatcaaaattattacctacaggtgagggaggagacatgccagacatttacaaatgtcctttgttgactatggaaccatgtaaatgttttgcataattaagagtaagaacagggcaggcacagtggctcacacctgtaatcccagcactttaggtggccgaggcgggcggatcacctgaggtcaggagttcaagaccagcttgaccaacatggtgaaaccccgtctctacgaaaatacaaaaattagccgggcatgatggcgggtgcctttaatcccagctacttgggaagctgaggtgggagaatcccttgaaccccggaggcggaggttgcagtgagctgagatggcaccattgcactccagcctgggtgacagagagactccgtctccaaaaaaaaagagagagaacaaaggaactactagaaatccaaaaactcaatcaataaacctggtaaaaacacagataagaagtttcaagtgattttgaaatacagtattttgactaatcctccctcctgccgcacagcctgaggacaaaagaaccagaaagattctagactgcatcgagtaaatctattgttggtgataaaatatttaataatacagatattattattattttgactatatacacattaattatgttactgtatttaggatccaagcttcctataaaagtggtacaaaaatgaaattgaaaggttgaacaaaaacttttgaagtggaaatattggtatgaattcatgatttatttctatttctaaaaaattcatttttccattacaaaaaattggccgggcgtaacggcaggtgcctgcaatcccagctactcgggaggctgaggcaggagaattgcttgaacccaggaggcggaggttgcagtgagccgagatggtgccactgcattccagcctgggcgacagagtgagactccgtctcaaaaaaaaaaaaaaaaaaatcatttttcctagagaggcctggaacagtgagcaccctagcattcaaactgtggtctccaaatatcattttccactaaaaataaccagagctccttggttaaaaggccgattccagtctactctgggaacagaagatgttgaacctgagactgaaagctatgaaagacgaggtggaaacgccagaagaacactaagaaacacttgaagggtccccagctggctaaaggcagacatgctgaggttgctaggacactaacgcattattctgaaatggttttttttttcttttttatgagacatggtctcagtctgtctcagtaggatttgtctttattcacagacaacaataatcatctatgtcaaaaatcagatggaaaccacaaatagatggatatgaaaatacaaaaaacttagaatactcaagacaactctgaaataaaaggacaaagtggaactaacacaaccagattttgagatgtctgacaaagtgctaaggcaattcagtggagaaaggacagcctttccacagatgccactggaacaattggctatcatatgcaaaaaaaaaaaaaaaaaaaaaaaaagaacttcaatccataactcagaaaaaatataaaaatgaattcaagatggactataaatagaaatataaacctaaatctatatataaatatatcaatctaaatatataaagccttctaaaacttttagaagaaaatagactagagagaatctttatgatcttggattatatgatgatttcttaggcacaatatgaaaagcatgattcataaaagaaaacgtgataacttgaaattcaccaaacttttaaagcttcttctcttcaaaagacattcttgatagaatgaaaggatcagccatagactggcagaaaatattggcaaagcacatacttcttgagggacttatatcaaaaatatatacagaactcttagaacttgataataagaaaacaaaaaactcaatttttttcaatgggcagaaaaacccaaagctaacatcatacttaatggtgaaagactggatgccttccccctaaactcagcaacaagacaatgaaaggacgttcactcttaccactgcaattcaactttgtactagaggttttagccagggcaattggacaagaaaatcaaataaaggcattcagattgaaaagaaatatgtaaaactaactctatccacagatgacataatctcatacattaaaaatcctaaggaatccactaaaaaaatttcaagctaataaatgagtttagcaaggccacaagatacgattgtatttctacacatttgcaataaaaagtctgaaagcaggaatcaaaaaaacaattccatttactatagcaattaaaggagtaaaatacttaagaataaatataacaaaagtacaaaacttactctctgaaaatgaaacattgttcaaagaaacaaaagatctaaataaatggacagacatcccatgttcatggattacagactggataagatggcaatactctccaaactgatctagagattcaatgcagtcacaatcagaatctcagctggcttctttgtaaaactgacaagctgattctaacatccatatggatatttaagggtcacaaaatatccaaaacaatctttttttaaaaaaagacaaaaaacaaaaaacaaaaaggccaggctcagtggctcatgcctataatcccagcactttgggaggccaaggcaggcatatcacctgagaccaggagttcaagaccagcctggccaacatggcgaaacctgtctctactgaaaatacaaaaattagctgggagtggtggtgggcatacgtaatcccagctactcgtaaggctgaggcaggagaatcgcttgaactcgggaggcagaggttgcagtgagccgagatcgtgctatcgcactccagcctgggtgacagagtgaggctccatctcaaaaaaacacaaaaaaacaaaaaaccaaagttggaggactcacttcctgatttcaaacttaccacaatgcaacagtaatcaagacagtgtggcactgacatagggatagacatagaccaatggaatagcatacagagcccagaaataaacttccacatacatggcaagtgatttccaacaaggctgccaaaacaaatgaatgtggaaagaatagccttttcaacaaatagcacaaggacaacaggatattcacatgcaaaagaatgaaggtggactctcagcctcacatcatatacaaaaactaactcgaaatggatcaaagacctaaatgtaagagctaaaactataaaactcttagaagaaaacataggtataaatcttcatgaccctggatttagcaatggtttctcagatgcaacaccaaaagcacaagcaatgaaagaaaaataaactggctttatcaaatatttagacttttatacttcaaatgattctatcatgaaaatacaaagacaacccacagaatgggtgaacatatttgtaaattatttatctgataaaggattgtatctagaatacataaagaattcttacaaaatggctaaaagtaaagagggttggagagaagcagagcaattagaatgctcactccttgctagaatgcaaaatggcacaatcacttctgaaggcagttcggcagtgtctctcttttttttttttttgagacagagtcttgctctgttgcccaggctggagtgcagtggtgcgatctcggctcactgcaacctccgtctcccaagttctagcaattctcctgcctcagcctcccaagtagctgggattacaggtgcatgccacgacacccggctaatttttgtatttttagtagagataggggtttcaacatgttggctaggctggtcttgaactcctgacctcaggtgatccactcacctcggcctcgcaagggattacagacatgagccactgcatccagcccagtttggcagtctcttgaagtgttatgcacacacctaccaccacatgacccagccattccactcctagtatttacttaagaaagatgaaagcagctatccaggcagacttgaacatggatgtttacagtagctttacttgtaatagtcaaaacctggagacaatccaaatgtccatcaaccagtgaataagtaaacaaactacggtgaatggatacaatggaatactactcagcactaaaaaggaactaccagtccatgcaagagcatccatcacccacaaaataactatgctgagtgaaagaagccagacaaacatagagtatactgtatgattccattttcataaaattcctgaaaatgcaaactaatgtccagtgacagaaagcagatcagcagcagcctgggttagaaagggcaagaggggctggggggatctcaaaggtgggaatggatatgttcacagtcttaacctgagtacgtgcctcctggctgtagaaacacatcaaaactcaaattgtaggcagggcacagcggctcttgcctgtaatcccaacactctgggactttgggaggccaaggcaggaggattgcttgaacccaggagtttgagacaagattgggccagatggtgagacccccatctctacaaaaataaaaacattagccagtgcagtggcacatgcctgtagccccagctactctggaagctgaggtgggaggatcacttgagcccaggagttcaatgctgcagcacgaatgcactccagcctgggcgacagagcaagaccccatctctaaaaaaggcaactcaaattgtatgcttcatataggtgcactttgttgtaagttggttattcctctataaggctattttattttattttattttattttattttattttattttttgagatggagtctcgctctgtcacccaggctggcacagtctcagctcactacaacctctgcctcccggattcaagcaattctcctgcctcagcctccagagtagctgcgattacaggtgtgcgcccctatgcctggttaatttttgtatttttagtagagaggggtttcaccatgttggccaggctggtctcaaacttctgacctcaggtgattcactagccttggcttctcaaagtgctgggattacaggctgaaccaccacgtctggcctgtaaggctattttaaaatgaaattattaattttgctgaatgtttaatgtattatattattaaaagtccttacttatggccaggcatagtggctcacatctgtaattccagcactttgggaggccgaggcgggtggatcacgaggttgggagatcaagaccatcctggccaacgtggcgaaaccccgtctctactaaaaatacaaaaattggccaagcatggtggcatgtgcctgtaatcctagctactcaggaggctgaggcaggagaatggcttgaacccaggagacgaggttacagtgagctgagatcgcgccactgcactccagcctgggcgacagactgagactccgtctcaagaaaaaaaaaaaaaaagtccttacttgttagagatacattctgcatttcatatgcatgtgagatatttactgatgaaatttgatgtctggatttgctttaaaacactctagtgaaaggaagcagacaggagtgaaggggaagaggcggagagggggcagaagacagatgaaacaagaatgacatattgtgagagaattcttgaagctgggcattgggtacggtggtgcaggggtcattaaacggttctagtttagtgtatgttgcatatttttgaaaataaaaagttagaaggcaaatccaggcttcactgtttcccagctgtgtgagctcaggcaggtccccaacttccctaagggtgacagtccccatcggtgagcaggggatgcccctgccctcccttgggttctgtgagggccttggtccagtgtctggcaacgactcccttattctgccactgtctccccaagggcctacaatctccttaactgtggcatgcaggccctgtgccactgcactgactgtggcatgcaggctctgatgacacccacagcacagtgacgtcagccgacactggcacagggcctgctgcacaccaggcgctggggtgagtgcagccatgtatcctattcaatctgcatgccagccccacgggggacgtccgatagtgtgcctcccttgcaggacttgccaaggacacacagtgagtaaatggattgtaactcaggtctggcttcagttatgacccctgccacatgctgttcctgaacattctggggcctcccaactctgatgggggaatctgtgccaatctgacttcacgggaccatctcccctcactcagaccccagcctctgtccttggcttcacccaacaagctcaggccaagttcaaaggcctcctctgtctgcctccgggtccgaagcacaaccaggcagtccccaaccttcctcctgcacacgggagccccagggttgcttgttacctctatcaagaactcagcagccccgcaaggaacagaccagcaaaggtgacctcatgggagtgtccatgccctggctggctcctgtgggtttgagcagagggaaatggtacagagctgtcccttcctcacccagtgggaaagtcaatggtgttcctctcatgagggcctgctacacctgcccgtccaccaggtgcgactcatgctctgtgctccctgcatccactgaaatggtccattggccccgtgggacctggtatggccgggagcaggatgaggctggcctggcagtgtcagcccctactcagggcggctctggttcatggtgctgtcgggtctggcccagtctgagtggaaggcaagaggctcacagcccgaaacccttcaccagtgccagcacccagcccgggaagtcagggagtgcggggtctccctcagcaggtaagacggcctcagctgcccttacaggccggggggcacgggagggacagggtgtctgctacgtgctccactgacgggtcccactggagatttcaggctggacgatgacaatacattttgctccttttccctgtctgtctgagggtctctgagccctgcttacacagatggctctgtcctgaatgtggggctgctgctgccctggaaagaaggagggagccagcatgctcagagtccagctcggaggtgggagcccagagctcctcgaatcctgccctgctcctgtgaggaggacccacctgctcctgggcctggccccctttgccttccccttgccctgctactaagaaccccccaccggccagagggcagatgctgtccctgcaggttcccaacccctgccctccatgggtgactgtggtccagcgacagcagaggccagctccagcccaacacaccgggctcccccaagcctagcccagcccagcccaggaccctgagccatccccgtgcccagcagcctgcaggggccttccccatgctggcccaggcctcaggcgagatcccctgtgtgtgtgccactcagctgctgattagtcatgctctgcacgtggccacctcttccatccctgatacttgtcttctgggagaaagcaggaggagagataagatagagtgggagaaagagaaggaaaggcccggaccactctttgctcctggaagctctggccctgagactgggagagacagacaagccttccagcagtatgacctgtgcctagatttcccggggagggagatttgagacatggacagtgcctgctgcagggcccagcatggcgtagaaggcaggtgtctttccttcccgccactcagccttccaggaggatgtttgttgacttggaagacagtcacacagttgtgacttgggtgggacctcatcctcacgtccaacctgccacctccagggaagatcagggcagaaatcaccagggagtggtcagctggcaaacgccctcctcaggaagggacagctgctgccgggacccatggcatgcccgtccttgctgtctgaggtggtctctccaacgctgcaacagggggccagtcaggggcctgggtcccagccctcccagccctcagtgacctgcaggccccacgatggtagagggagggtgctaaagagctgggtacctgagcccaactggacagggaggcagggaggtcactccatcaatacacgctgagcggcttctccaaagacgatggccaccagcggcaaagagagcctcaggccaggacagaggcagtattgtgccattgctgtcacagctctcacttaaataaaatatatatctaaaaatttgcctcaggctgggcaacaaattgagaccctatctctacaaacaattgaaaaattctctgggcatggtggcacatgcctgtagtcccagctacttgagaggctgaggcaggaggatcacttgagcccaggaatttgaggctgcagtgagcttggattacaccattgcattccagcctgggtggcagaacaagactctgtctccaaaaaaagaaaaaaaaaattaataaatacattaaaggggaagaggcagttgtttcatcagaagattcgctgagtcatttaaatagggaggctttctactgcatttatgatgtctgatttatgcgcagctttttaaagtgtcttttctttttacataaaacaaacccacctgtacaaagcaactgaaaaagtagcttaggagtgactccaactattaaccaaatatagcacaaagcgtgatccgccttcttgggtcaatatttacctggacttcagcctgcctcggaaaggaaatttgaaaatatttggcgagtggcagaatggttgtctggctacacaggccgataagcagctggggctcaggtttccaagctggccttttatgggcgagagacattatcaccatcatcaacgcccatgtgctagtagtaggacccactgtcagccagctttttgttttgtttttgtttcttaaagattagtatattttagaaggggggactttaaaaatcatttttaggtcagatttatgaaggtaacacataaagtaaaatgtaccctttttaatgcacaggtctgtgagttttgttgttgttgtttgattttagtaaagatggggtctcgctatgttgcccaggctggtctccaactgttggtcttaagcaatcctcctgccttggcctcccaaaatgctggggttacagctgtaagccactgtgccccaaccaggtctatgagtcttgacaaatgcataccaccaccacatcaggacacagcacttccagccagctccaggctccaacccagagctgggcccttccctgtcccaccccagacactcctgtcctgtgttccatcccgtttccctcctcaagtgtcacagaaatggaatcgcgcaggctgtggcatcctgcacttggtatgatgcctctgcgatgcgcccagggtgtcacatgtatccccagcttgttcctttttgtggctacgcaggattctttggtgtggacgtgccacagtccgtgtgtccctgccccagctgagggactgctcgtgggattttgctactgtgtaactgtgtattttcatttctctgagggccaatgtgctgtcagctaatcacgatcatggggcctgaatcagctcacaaggtcactgtgcaggggaaccattgccctcattcaggggcacagagccccgggcacagccctgcagctgagaagtatcaaggcatccggcctgtgggactccacccctgtatcaccaccctctgtctgccgcagcccctgtgccccacccatgcactggcgcctgaatctctcaggagcgtgggcaggaggggtcctgggaggctggtgcaggaaagactgaccacgcaggtggcagggagctcacagcctccacgcaggaggctcgggagcaggagggcccaccccaggagtgcagggacaggggaggacaaggaacaaaggctgggggcatggaaggacagagacatcttctggaaaagacagaatctgagttgaacctggaagcaacgccccaagggaaggggccaaaatgggcagcagccagccctggccgtgggtggggatggggcaggggcgcaggatggagggtggggcctggagggctcatggaggaaggaagaagagcctcagaggggccttccaatcccagctccaaccctccctcccccgacagaagacccccaacatggggcaatggccgggacgaggagggggctgccccaggtggactctgcgctctatcccagtgcctcctctgcgcctgctttgcccagagcacacaggtgaaagcaccaacttcgggctgagcacagcacacgtgagggagggtggccagccagcatgagttctggcattatgtcccagggggtcaggggaactgagccccaggaagactccctaggcaggtggcagcagccactgtgcaaggagaggagccagtgagtcaggagcaccagctggcctccaccagccagacccccagaacccgcgtctacttgaggacactgtcagaaggagcccaacttccaggcagctgcaggatgagaggccccaggcaggctccgcccctccccatgctgcccctctccaacagggtccccgcagcacagcccacttctccaggcaggctcagggttcagagggtcgtgcagcatgcagcctccttctcaccctctcctgcagtgaccccctcgctcccccaccttggacagcacctggcacagtgcccactcatcactggcgagtgaatgggctcccgagtgctcccctgtgagcacctcaaggcatacaacaggtactcagtaaatgttcgctgattataaatctgcagtgggcagggagtgtctccactgcctggtatttgtctattctcttcttgctttctgtgggcactgacagcagtgactgccagtttcagtgccagccccgtgctgagtccagccaccctggccgctgagtgctcggctgagacggggacagagccaccactgggattctggggtcacagatgcatctgcatgtttattccaacagacaggattgttgctgacgttagcagaattgtgctccgcctgctgctatatagagcacccatatgaggtaggcgccaggcccaagactgggcattacagaagcaccccatcctcccagagccctgcaaggaagatgtctccctcacgcacggacaggtgcggtggtgcctcaaagtttcccgagtcagctgaaccacctgatcccgagccccagctctttcagctcctccagctctacacattcctaaaacccaggctgcccaccaaacaggaagcagggagcatcgtggaccgtggcccgcagcacctgtccccacttagctcccaggagagaaggctggcaggcagccccaagaccaccggccgcagcagcagcggggcatgggcaggctcggacatggcgggcctcatcccaaggcgccagttccctgggcccagctccagcgagccagagcccacacactgaacttgaaacatctgcccagacctgggactgctgcagggcctaaagcagcggtgagcacaggtttgttgaggcttctggggataaatattttgatatctgtgctccaggaaaggattctgagcttcagagatgaagcaacctgcccaagaaggctcctcagcgaccggggcctgcccagggtgtctgcagccagcacagctgtggcctgggctgccaaggcagaaacgtttcctcatgagccccttgcccagagagaaacggctgctacccctggccccaaggctaaaacgacaggccacagacatgtgagcccaacacccagggctcatctgcctggtactggcccctgaatatcagtgcctgagccagaagggcacagcccaccttcctcttttttcttttttctttttctttttttgagatgcagtcttgctctgttgctcaggctggagtgcagcagcatgatctctgctcactgaaacctccacctaccaggttcaagcaattctcctgcctcagcctcccaagtagctgggattacaggtgctcaccaccacacccagctaatttttgtatttttagtagagacgggatttcaccatgttggccaggctggtctcaaactcctgacctcaggtgatctacccgcctcagcctcccaaagagctgggattacaggcgtgagccactacgcctggcccaccttgttcttctttaaggcaaacaccgtgccaagcaacctggtttgcctgattgagctcccgctcagttaatccagaaacaggggcctacgtggcctctggggactggcttgggatagagggtgcttgctcaggtcaccccagatgagccttctccatatcctcagctcaccacgggctcctgggattacctcccgccacctccaactaccctcctggctaacgctttcctctcaggccatggggagagcaggctgaaccatgccaaggacacaaacagattgagggcagggccttcgtgttttggtgggattgtctttcatggaggaaaaacaggggaatgggttatgccctccagtaatgacagtgaccacaatcctggtgtttctagaatctttcagtttcagggcttttccacatgcacaagtccatgagatcctcgcctgggctctgtgaagtagccaggattatacatgtgatcccatctcacagatgagcaaacccaggttgagggcagcctgcagggactgggccgccccctcctttgcaccgttcggccaccgttgcaggagcagggcccaaggctgcagggagtaccccaggggatgggcagtgaagctgccgttcctgcacactgccgggtctagaggactctgaggctggaaggggcatggggacatcattcttctcctctccagctgccttcccccagagcatggcctcctcgcatcagttacttaaatcagttacttaaacccagtgtggttcccagaccagcagcaccaccggggaagcatgtcagaatgcagactctcaggccctggcccgggccactcggccacattctgcatctgcttccgatccccaggactgtggagaagccacgtcgtgtcctacagagtcctgagggcctcgcatgtgcatgtgaccactgaccgtccactgccagggcgttcttcccaagtgcgaccatggggactctgctgagcactccacactgtcctttccttcgtctgccttcctcaggcatacggcagtgaatcctgcagaagtctcaacaggctcagtaccaggacccagcccttcaccacattcagtggcccttccaagcatgtggccccagaccaggagctcctgcggcactgggaaggtggctgccctttgaaggggccacggaaggcagcgcacgccacctggatcccgggccctctgcctgaagcacagctgcagtgactttcatgaaggcatgaaatgctctcacgacaaagggcaaaatccagcttgtgctttttttttttaagatggagttttgctcttgttaccccaggtggagggcaggggcacgatctcggctcactgcaaacttcgcctcccaggttcaagtgattctcctgcctcagcctcctgagtagctgggattataggcatgcaccaccacatccagctaatttttgtattttcagcagggacagggtttcaccatgttggccaggctggtcttgaactgctgacctcaggtgacctgcttgcctcagcctcccagagtgttgggattacgggcgtgagccacggcgcccagccagctcatgccttttttgacccaaaatagaacctctgagcttgaccatgcatacaatttgctagatgactgtcagtgacttgcctccatgtgggaggagagaactccaaggctgaggtcccatttcgaggcatctgagaacacagccttgctagacgtcttaatgcctcctataggactggcagcttagagggcagacgtggtcggtgaggggggcactggacgggggtcaggaaagttgagcacctagtgcatgcagaacacatcctgtggattattacagaatcctcctgacaatccacgaggaaagaactttattttatataaggaaacaagaacatggaggcacccagacagtgagtaactggcccaaagccacacagctgggaagcaggaagcccagcttgtgtttctttttcttttcttttttttttttttagacggagttttgctcttgtcgcccaggctggagtgcaatggtgtgatctcggctcactgcaacctccacctcccgggttcaagcgattctcctgcctcagcctcccgagtagctgggattacaggtgcccaccaccacgcccagctaattttcgtatttgtagtagagacagggtttcaccatgttggccaggctggtcttgaactcctgacctcaggcatcccaaagtgcagggattacaggcaggagccaccgcatccggcctccagcttgtgtttctaaccatgaagtccccccactgccccgattcactgcacagaccacagccttggtgtcctcaagtgtgacgggcaggggctggcacaggtgctcatgaacatctgaaccagctctggcttcctttagtcctccgaacagaaaagacgtttcaaaatggaggcagaacagggcggctttctccacttcccaaccagcagacacgggtccaagagaatcttccctgctgaaccaggaccatcatccatgtgtgaaattgggggcagaaaggcgggcattttagccaccaaactccagtttggagactgaccccagctgcagcattcttaccaagggacctggacatgttattttggaaggaaggagaaaggaggcgaacaggccagccgttctctccagagggagtccaaggtgggcccgggcccgggttaacttggacaaggcacttcctgttccaaagggccactcagcttcccgtgcaggcggccaccaaggagctgtctggcctcacatccctcagggtccttgccgggccacaccctatttaaaacctgacctctcagggcagtctaggaatcatggcgtgttgagcggggcagccgggacctcagttgtcctgttctagagcattctgatggacctcacccgcccatgcaggtcacctgtataaggacaaaggacaaacacaccttgaagcccctcaccgtcctggcgtcccagcccacctctcacccaggtctgtccagggtgtgcccggaggtcacatgccccatggtctccagcacgttgcatgctcctcacagtgttcctgccacctggaggagcccattgcctgcctacattacaggtgctgtcaggccatgctgaagatcctcctcttgtggccgccgtccccacaagtcccagccccagggccattcctatgggcccactggagaagccacagcccatgccaccaggctgggctccttgtcctgcatgctgagtcttggcttcaactcctacaccagagacggcctcctctgctctttctgcggggccgggtccagcccatgactcattcattcatgccattccagaacaaaccctacttttgcctgcttccaaacttttgctcaaaatgttctcttttgtgataatgaagttgtgctgaggtaggaaatgtcctccgttttagagatgctatgatggagtgcagagggacaggtcacagcgttcgtgacgtcagctaccaaggcaggatgtactggaatctaagggctgatgtttggaggttcgtcctctctacttttctgtatgcttaaaatttgtcaatttaaaaaagtaccgctctgcctgaaaaaccaattcctttccttgcctgtctcttcctgctaaaatctctttccttctggaaggaggccacgactgaccttccatcttctgtccctgggccaccttgcctgggctcactcccagcacagcatctgctgagccctgaagcctcttctgtacccatcttatgtcctcaagcagcctataaacttgccaggtggggccgagcctccccacacctccctggggcgatgcacagacgctctggctggatccagtggcctgggctagaaggcggtgtcacctgaggccaatgaagccatcactaacaggagaagaaaggagatgatggcacctgtggagaagggcatgtgtgggccacggcatgtcctgatgcctgctggacaccactgcccctgggtttggccgggctttgctctcccgtgtcttggtggctagccaggcagccctgaacccaccaggcagaatcaaatggcctgagcccctcccaggagcagcagggctttctccaccacattttcagaagcaggcttggttcaaactggtgccaggctggtggggggtgcagtgggcatgatcaggtttaagtgactctcattgtttctgacatttgctaataaggctgataaggccccgggaagaaaattacaagataacgggatggcatcagctgggctaggaagagtggcctggccacctgccacccatccagcccccaggcctctgctcacaggcgcctgccttcgtccgaccctggggagcctccctgtccaccctggggctggcctagcctatggccaaagagaggctgggacaaggtggggcattagtagcccaacagggcttgcaatttggaagcaggccaggaaatcccaaatagctctcgaccattgctgagtttagatgacaaccaaggctgcctcattatcttcacagctgcagtcaaagcaaagttggttcatttgctacgtgctgaccctctccatttaaaggacagaaaagaaagaggtggccgtggctggacctctgcatgcactggtgactgcaggatgaagctgcccatcgtcagaagagctccagggggcctgcgcccccgaagagctgggctgcccactggtctccagctccaggcgtgctctcgagccacatgctccgcctggggggcacccaatgttccctattagcagctccgctgttactgcaggataattaattcaatcagaaataattgaacaggcaaggagctccgaggtgctatttctcacctgctgaggcagagagaaatatttgcaaaccagccccaactgcaagcaaatgccagccatagtcctcccaaagtgcagagctcccgacccctctccacacacagatctgttcttcaggtagctatggagggctgccaagtgccaggccctggggcactagggcaagcaggcgaggcgttcagggcctctgcccaagggggcctcctgtctgtgccgcatggactctgtgtgatgatgccagagatgcgctcgccaaagaacagggtgctgggagaaagaataacctggagcgagggcagtcagggaggtgaccttcacactgtggcgtgcaggatgaaaagcagacaccacacagaacacagaaagaagggccttccaggcagagaagcattgtgtgcaaaagtcccaagttcagcctggcttatctcctgcatggctcccccagccctgcctgtgtgtctggaaagcctccctcctcttcctcctcctcctcctcctcatcctcctcgtcctcctcctcctgtctggggcacagccacagggccctaccctgtgcatctccttcctcatgctcaaggacagaactcccaggacctccaagcgcccgtgaactgaaagcaggtttatctcggacttggtatttaagtgtaaggtgtctgcatgacaggagccagaacacgctagtgaggggcatggaaaatctaaatcacaactgaattctgtgggaaatgtgaagatggagaagccagaaggaaggagctaaagagcaagaagaaaattggaaaacacagagaacgtcatcaaatcagagccagtgcgcaggccaccccaaagaaatctgatggcagccactctgctgcacgcacagcagcgggatgttctatccgaacctccccccacctcccgggatacccattaggttccagcctccctcgaggggaaggaatgacttcctttggtcctcaagaacactttgaggtagctattgtcatggcggcagtccacagatgggagctccaaagctggccaagctgcacacagccctgctggcgtccagcctggctctaggtgaggccaaagcttgaatgccctgggctgggtaggctgggccaagccgtgctgcccctgagggctgaccatccagtggggagggacagcgtgtatacaacatgccattctagaatggtccctgggctcctaggggtcttctggagaccaggggtctgggggaggaagagggattccaaagctctaggctgcactggagatcatgtcacctgggcccttgagggacccagaagctcctcgaggcatcagaacatcaagtctgtggctaaattcataccagagtctgtgacggcttcacggtgagcacaggtcttttttttttgagacgcagtttcgctcttgttgcccaggctggagtgcaatggcacgatctcggctcaccgcaacctctgcctcccaggttcaagcaattctcctgcctcagcctcctgagtagctgggattacaggcatgcaccaccacgcctggctaagtttgcatttttagtagagatggggtttctccatgttgaggctggtcttgaactcctgacctcaggtgatccgcccgcctcggcctcccaaagtgctgggattacaggcgtgagccgccgagtccggccgagtacaggtcttgaaggacaggaggtagagcctgtctgggcagtgtgtggagggtggcaagtgtccacactaggtggtgtgtgtccagaaggcacagtgaccaggccacatctcctcagcaggaccctgaccaggctgtgagaccaaccctctgcagtgacaagcagccatggaattctttttttttttgagacaaggtaacccagattggagtacagtggcacaatcacagctcactgcagccttgacctccctgggctcagatgatcctcccacctcagactcccaaatagctgggactacaggcatgtgccaccatgccctttttaacaaaatttttatttatttatttgtttatttttgagacggagtctcactctgtcgcccaggctggagtgcagtggcacaatcttggctcactgcaacctccgcctcccgggttcacgtgattcttctgcctcagcctcctgagtagctgggactacaggcacatgccaccacacctggctaatttttgtatttttagtagagatggggtttcaccatattggccagactggtctcaaactcctgacctcgtgatccacccgcctcagcctcccaaagtgctgggatcacaggtgtgacttttatatttttttgtagagatggggtcttgctatgttgcccaggctgcttccaaactcctgtgcccaagcaatccacctgcctcactcaacctcacaaaatgctgggattacagtcatgggccactgtgcccagccaaccgtggcattttttaccttttattttagaacacttttagattttcaggaaagttgcaaaaacagcacagggcaggcctgtgtgtctccactcagctccctgaggctaatacctcacaaagccacaggccacttatgataaccatagctgtgacaatctgtccatcctcttgggcaaaagcagtgcttttcaggcgggtctggggctgccacagcttttcagcccagcagacgggaggcacgtcctcgtctgggccactctgtacctgcacacacattcagtccctgcaagtccgcagcttccagaggccatgccaacagggggtgggcagcgtgggcgcagggagggagcacacgctgctcaacagcagggaggagcatgaaaggcagggtgctgacggaaatggatccttcttcacagggtggtgagactgtccctgaaaacagttcctccctgatagcgggggggatcagcagggctgggcacagagactctctctcctcgccagtacagcctggattgaaaataccatgttctgtgctcactgtgctccccaccacccccctctggaacgtgtcccgtgaccctctgaggacacagacgttcgtggttctctgtcacccaaagggagggacaggacagaacagcacaatctctgcctgttccagggcctgctgccgctcggtttctctggggacgatcttcacagcttttctgtgccaccgattaggtcgaatttgaaacaagagtccatttgagctttgcagatgcacagctgggacggaatttggggtcccctgtggcacttgggtgtcaaggggtgtgtgcacaagccacacctgaacggtctgcttcaggaccccccttccccccactccccgcagctatcgagggtatgccacagcacctcctaccaccacacagttcaaaaccaaacaagaacagaagtgtcgggctcaggctgcattcggatcccatcatttattgtcatgcatttgtgtgattgttgtagacttcaacagtttttagttgacaattacttgtattcattcattttccagcccgcttattctagttcaaggtcgcaggtggctagagcctctcccagggcacaaagcctggacaggacgccgttccatcacaggacacactcgcacccacacctggtcagactgggaccacttagatgtccagttcactgaatgtgcacatctcggagatgtgaaagaaagcagagtacagagaaagcccacggagtcgtgagagcacacaaactccacacaggcagtgggtgcagaagggaatcaactttttatcatcaacgttgtaactaaaggacgttattccagaccctgctgcagatcttgcatgtacctgcccacgtgtgcagattggtggtatcaggtggtttaatttagcactgtgcatagtaggaaaagttggaaataaaccaaatgaccatcagtgggagaacgggtgcaaaggtcagcacctgggaaatgctaataaacgttaattactgttgttattatgggaccgtaatcctcgactgttgatgaaggaaatgatgttgaacgccatgcagaaggctgcagagaacatctcaggaagggacccaagacaccggaaaggggttcaggggaaagggattcaaggggcacattgtcactatctgcctttttgtgctgttggaattttcatcacgcatcagtgttaactgcttaaaattttaaaattttgaacataataactgcagactaaacctgtcccagaggcaaggggcagagggccacacacggtggtgagctggagctgacaggcgcctctgaggcccagcagggtggagaagctggcgcgggcttgcaggcctccacagcagcccagcccagtccctgatgagaagacaagctggcgtgggagtggtcgggcctgtctggggctgagatgctttcactctacgtaggattccaactggcctgtcacaggatgccccgaacagcagataagcagcagcaaaacaggaggggcacgggacaggcaccaggcaccataagcagcaatgtgacactggaaggaggggccagaaacactgaacaaggagagtcctgaaaaagtgtagcaccctcggccaccagcgcagggcatgagggccgtgtgtcccagctctggtgagctgctggtcagcgacccctcgtcaccatgacacggttggatggaggagggcagggaacctacctgagactgagacggacggttaattttttaaagagacgatacaaaaaaacttcaggcatttaaagttccactgaaggctgggcgcattggctcatgcctgtaatccttgcactttgggaggccgaggcgggcagatcacctaggtcaggggttcgagaccagcctggccaacatggcgaaaccccgtctctactaaaaatacaaaaattagtcaggcacggtggtgcgtgcctgtaatcccagctacttggtaggctgaggcaggagaatcacttgaacctgggaggtggaggttgtctctacaaaaaatacaaaaattagccgggcatggtagcgcatacctgtaatcccagctactagggaggctgaggcaggagaattgcttgaacccaggaggcggaggtggcagtgagccgagatctcaccactgcactccagcctgggcgacagagggagactctgactcaaaaaaaaaaaagtttcactgaatactggagaattctctgatgcaaaatgggttcctcccgagggtcctgggtaaatgggtatttcatctgccatttgggattctcatgtctaataagggccttgcctgaaacggccaccaccgtccctcccatccctgacccggtgctgatccccgtgaggagacacctctgtgggtgagacgctgctcctcacccgcggcgcacccaagccccatcagggcggtggggagtccacccccattcccggttggggggtgtgggtgccacggagacctgcaggctgcagaaatgcggccacggtggccctgcgtggagatgcccctctcatggaaatgtgcttgatccataattaacaagggggcaaggccatgctgtcgttttcttttttaatcactctgctgtcgtttcgacatggagacccaagatctaaaattaggccactggatcccgcacctgactttctgagctccccagggcaggggcgtgtctcagcgctgacagtgaagaggtgtcaaatctgtgctcagggaacaaccttttctgaacacactgctccctgcatccctcatcccttgccccctttcccccaggccaggagccttggctggagggcggcccagcgccccgtgagtccactctcctctgtagagtcccaacccctcactggcctcccagaaaccccaatcgcaaccttttcttcatggaaaccagcatgcaggtttccatttaggtgtgaaggtgcctggccggctgggggattaggaaggctttgctgtccccacacacggtgtcctcagggacctgtatccatggccaggaagaagttaatgtcactgccttcctctattcaggccccaaagtttggggcagggacaaagaacaaggtgtcagggccccaccccaccctccaggaggggtgatctggcagctgggtggggaaggcgtcccacctcaccgtcctggctcagggcagtgtccgcccagaacttggctgcggggatgcagggcgcctgcacacttcggactttccctgtcctccctgtaactatccctgtcttctgtggaggctgtgagaagccgacaagagatggaaagagcgtaggcaaccacacacacaggcccttaccagcggccacccgggtctgcttgtggtgccactgtcccagaatgacccctcacatgaaattgtgctccagcccctcactctggatccccccaactctgcactttttaagcccacagtggctcacaagcccacgatgggcccgcgtccacccaatggccagcactaacctgacccagcaccccctgctcagttcagctcccacgcgtggccttctcgcaggacagccacgtccagcaccttcagcaggttctccccggcagcacttggcagtcagatgtggccagacggtcccttccaggtctgtaccctacgtggaaagctgagccaaatctagaaacttctctggacaactctcctcagttccctactatgtcctctgcctgtcctgaaagctgccatgtccctgccacgacaggagaggagccgcacttgggggaaccactcgccctccctccccgctgcccggcagtcacagccctcccacccagagcacacccagccaggggtggggtggggggctcctctgggcaggagggtctggaggcttctgcgggaggaggcactggacctgagacctggcccgtgagcaggaactggctgtgaaggccagcagaggccaggctcggggcctggtagccgggatcctgcagccaacagcaaccctttcagcacctgctccgttctgtcctcttgtctgtttctctcacagacataccttgtgcagagaaggtgtttggttttcagtacaaagaagacagcgttagagacccggccccctcccctcagccacaaggcagtgggaggctggcctctgtccctcggtaaacaagggtgcagttcctgacaatccatgaagagaagatgctgccccagatgttcacagcccccctcccatgtcctactctagagagagctgtcgtggccccaaaggcatgaacgtggccctccgtgcacggcaagcagtacaggaacgtgttcggaaggcagagtgcgcggccaacagcgtgggcagcttgcctccctgctctggctgcttttaagccagcaaacgtgagctgcgagcggcacaggctgaggcaacggagccgcttccctgcaaggtttcatcagtgacggccagagtgaattcagcagatttttaaaatttttattatttttatttttaattttttgagacagagtgtctcgctctgtctcccaggctggagtgtagtgacaggatcttggctcactacaacctctgcctcccggcttcaagcagttctcctgcctcagcctcccgagtagctgggattacaggtgcccgccaccactcctggctaatttttgtatttttagtagagacagggtttcaccatgttggtcaggctgatctcaaactcctgacttcaggtgatccacccacctcggcctcccaaagtgctaggattacaggcacgagccatcgcgcccggccagcagatttttttaaaggtcccacagcacagaagtgaaagggagcacatagctactcattcaaggccatgcacggcctccactggggatgcggatgggcaccagagtgaccacacacacatgcatgagcactaatgggcacagctctaaaccctgcagagggaccaactcactggattctcacgatgatcctacaagcaggtactcccactatgcccatttaacagaggaggaaactggagcccagagtgaggacatggcttgtccatgtcacccagctgggaagccatggagctctgcagagcactgtacccacccccaagaagaagggcgacacggagggatggggccgaattagggaagagccagagctgcctggagacagcagtgggacactttctgctacggccagagcacggggaagcggaggagatgctcaccagcacctgtcacagctcagcccggcccacctcccgagcctcggctcccacctgtcacagtgtgctgccctggacaagtgccctccacctcaacagtttcccctgcaaggtgaggaggaactttccagaactgccacctctaggcctgcatcacagaagagggtgggggtgccatgtccctacctgggcaggggcagcattcacacctgagtgagtctgaacctcccttttcctttggcccctccaggacctatgctggtgcttgggttccactcagaaggtggcctgggctcccctgaaagccaatttggtcacatcggctctgaccacggcccatccacccagaccactaaagcctgtcacgatcatcccagggcccagccagcccctgtgctgccctccgatcacacagaagcaaatgctcgccctctggggcggaagccacctgtttttctgcctcccatcctctgaatatggcatctgggtggggcaggcagagtggctcccatagaaggagggggatgcgtgggtccctgggcttctcctccaggtctccctctgcctgggaagagccagcaggcttgaatgctccgctcctttcacagatgatgtggctttaaggaaacatgctctgaggccttgaagtgctgcgcactgtgccgggcaccaggcctccatgatgagcggaacacagccactcctggggaagggcacaagcagcagtcacacgtcgcactgaagtggctggatggacgccagagagtccagaggcaggtgagggggtgtcccccagaccatgagctccagagaacagggccaggtcctgctcaactgagcatccctaaaactcaggaacaggtcttctgactctcagagcagccctgcgaggcagctgtcattgggagtctcattgcccaagagagaagggcctggcccaggtacccagcaaactggatgctcagccaaggccggagccttctgcatgggagccttccttccttccttcctgctctctctctctcacttttttttttttttagacggagtctcgctctgtcgcccaagccagaatgcaatgggatgatcttggctcactgcaactcccgcttcctgggttcaagaggttcccctgcctcagcctcccgagtagctgggattacaggcacgtgccaccacacctggctgttttttgtatttttagtagagagggggtttcaccatgttggccaggctggtctcaaactcctgacctcagatgatccacctgcctcagcctcccaaagtgctgggattacaggtgtgagccgctgcgcctggcccttcctgcaaatttctgttgcctctgaacatgcatggggctgtctgaagcctcctccctccttcagagaggccacatgagccactccaagcaactgggactgagaggaaggttaaaatgccctttgtctgctggaagatccttggagtgggagctttgctattaatggggaaatcaaatgcgtctgcagatgtcgtggctcccgcagtgctgtggcccactgcctctcagtgggaaagcaaggttctcatcttcagccaagcacaggatgcagaaaagagacagagaagccctcagtcttggcagatccgcaggggctctaagaggacataatttgcctctgatgcctcaaatctccctcaccttgctgagctgcttctaggttgctgccagaggattcagtcccaggtcagatgcctgcctggcatcccttaacccctggcttttcccccggagcctctgcactcagcaatgcccccaaccactaccacccatgcaccggctcccggcctctgggcagcctgttagtctttcctgcctggctgattcttgccgccacctccccagcctgaccctcacgcagggacacaccagagcagcagacctacatagagccgacacctctggccaccctgtactgggctccactggcccttgtttctttgtcccttgcttcattatgaaagggacgtgacatgctgacaaaattacacatggtaaacagacaggaaacacaaaatggaagatgctggtgcacgcagaaagtcttggaggaggagagccaggtgtgtggttgagaagcccccgctgcctcagaggctcctggctcgctctgggacccaggcggtaatgaggatgcctaagcaggtccctgcagcctccggagtcaacttcctgctcatggccaaaagcccacagcgcccagaacagtactttccattggggcaaatgcccaggagatgtttgctgaatgaataaagaaccaaggcaaagctcagcaggactgaaatggggtgggcccaagccagcaccaaggagtagagggggacattgcaggggctggtgacaatgacaggccactctcccagttccatgtagagccaggcgtccgggactgtcaggtgttcccgagggaaaatactggctcctggagcccatggctgccaagctgagcttcaagccggcctcaccctccccagggtttactaggaggaaatggcatctctaagcgaatggccagggagggccagggactagctagggacagaaccatgcttggctggctgggctaaacaccagaaccccaagagcttggcacctgcagtagcttcctgctgcaggacagtcagaggagccagctggaggcacggaaagaaagggcagtggaggctgggcacaggagcgtatgcttacagtcccagcactttgggagggtgaggcggcagaatcgctggagcccaggagtttgagaccagcctgggcaacatggcgagactcccgtctccacacacatacaaacacacacacacacacacacaaatttaaaaattagggctgggcgtggtggctcatgcctgcaatcccagggctttgggaggctgaggcaggtggaacacctgaggtcaagagttcgaaaccagcctggccaacatggtgaaacactgtctctactacaaatacaaaaaattagctgggtgtggtggcacacgcctgtaatcccagctacttgggaggctgaggcaggagaattgcttgaacctgggaggcaggggttgcagtgagctgagatcgtgccattgtactccaacctgggcaacaagagtgaaactctatctcaaaaaaaaaaaacaaaaaacaaaaaaaattagccaggcatggtgacgtgtggctgtattcccagctacttgggctgaaatgggaggatcgcctgagcccaggaggcagaggttgcagtgagcagagatggcgctactgcactcctgcccaggcagagtgagaaccagtctcacgaaaaaaaaaaaaaaaaacaaaaagaaagggcagcagagtggaccggagcctggcttgacaacgggtttgtagtgatttctgagccctcctaggcctcaggtgctccatgtacactataacaaggtcccttccagccgacacccctcccagagcctgcccccaccacctagcaggaagcaccactccaaggtcagcccacccaaccagggtcctaagagaagcacgaaagaattcttagcaagtctgattggaaaggtttccatcagcaagtccttcaccatttccaaaatgcatcccatcccaaccctgctctctctgcatccctgccatggttgcagaaaccttcacaaaatccaaatcagacctcgtctctgctcacttcaccccgtcgcagcttcttacgctcccccccatttttacagacaaggaaactgagtcccagaggcccggtatgacccgccggggctgcacagctagcaagtgtgctggcgaggctggtcccagccccttctccacgcctggctccaagacataggacttcagaaaaggggaccctggggagggctggaggcagtggggtctgaaggaacactacgttaggacttcccatgcaagccttgccagtgagatcaacaccactgtacccatttcacagaagaggaaactgaggctcacagaggctaactgacctgctcgaggcaggcagaacaggactggaagccaggcagcctgtttaaagcgggtgcctgcccctcagaggcctgtcggggaagggaacccgctgtgaagggggccagccagagcctgggcacctgtggagagggacaggggtcagaggcagtccagcactgagctccttgaaacgggcctgtgagtcctcagaggtgccaaaggctggtggggccagatgaaggccagttctggctggtaagggacgtccaagtaggggtggaggaattgtggcctctggattgggtgggcatttgtggttatcagtgagtctgggccaggattcccaggaaaccctaggcacagaggggagcccgagaacaggatggcaacagaagtgtgggggcagaaaaggcccaccatgcagccccacgccctcccagtttctgagtggggaacctatggttcagagcagtgaaacggcaagcccaggccaatcagtggtgtgactggggctggagccccgctgcacggctgcgagtggcccggtgctcttcctggcctgagtgggccccacctgagtgctgggaagtcagaggtggacaaagcctctgaggcctaccggctactctaccccacctaaggcctccaccaggcccgccaagacccagtctccaagacagtcacagcgaagccacggcctgacctggccagaaagatccccggtgacctggctggggcatgtcctttgcacagcaccccatgtgctgtacactgtgcactccttgaccatcacatggtcaaggcaggcatcgggtgaaggcagacagggaggcctccagtgtgccaagtacgatggaaaggctgtaggccccagcctcggggacaccagaggcaagaacatgcctgggtgcaggagaaatgtgccctgggccaggccgagctgcccgcctgggaggcaggagcagacaccaaggggccgccccatccccgccactcgccagccggggccaggtcctggaccagctcttggcacacatggtctcatttcatcaccaaatgccacagcagaggctgtggcagaggttatcggaaaaggagacagaggtacctatccagaaaagggtaggcagctaacctatccaaagccacatagctaaggagcaacaggggctgcctggggcccagaagctgtgctgtcttcaccacaccggccccggggaggggttagagaaccgggaatgggggcgcgggcccctggggatggtggaatttggagccacatctgtgcagacatcatcaccttttaaccaaactggcccttgaggaatagccctgcctagccaaggagcagcatggtgaccgggtgacaggtcccaaccaagccacccttcgcgtccacaccagctgcatgtctacacaggctccctgctgccctagccacaggggcagggtgtccagcctcccctcgacactcctccccacctccacctcaccccaccctcacctacacgctgcctgagcttccgcttgtccttcccgctcccaagactgcctttaaccaaccatcccctgggccctgggatccctgaaccctgggcctggcctgacacacgtctaggagtcagcaatgtgtgcagtgtgactgaagatagcaaggaccccggccgcgccttcctctcccctctctcctcccttcctccagaccccacactcaaatcctatttgcctcaggttccagggagtctcacatgatgggcaggacccacacacaccacagtcatcaaacattcactgggcaccgtggggcagggcccagaggacaacagccactcccagctcacatttttcaggcttcaactctgcctggctccctgtgctgcacacggagtgtgtcacatcctcacacgacccaggaggtggaacctacaggtaaccctctttcacagttaagaacgccaaggcacgaagcttagcacagtgaatggccagccacagccggaacccaagcggtgaggctgcaagctggaagctaagtccccctgagtccctgcctgagcccaacctgaagaagcctggaaaggtatcaaggacaaaacccacagagcagttccacaacagatgccctggggtggctgcccgagggggaagcggacggtaaggctggaggtaggaagagggaacagacgagggtcactgacgctgagctggctccaggcaccacccactccaggcaccatcccggcccttgcaacagtgagccaggcagctgtgcctgggtcacagatgagaataccaaggctcggagaagccaggaaccttgcccaggtccgtcttgctatcaaaggcaggacagacctgtgtgctgagaggcccagagatatgaggggggcacaaccgcaccgggctcccgaggatggcaagggggacagactccagtgggctcaaggacatgggggtaccacttccacgtggctacctcacgcggacgccccacgtgcggcctgacccacaggaagtccagtcataatattgacacaggcagggcacacagcagccgggaagctgggctgttgcgaagttggcgcagggcatgtgagggcaccccaggctccggtgggaggggcctcaggaccggatctgggccggatccacgagaggcgcttggagggcctcttcctgccagcaaggctggcgttccggcccattggagtcggccgtgctgcagctcggggctgtttttccactttcctgccatgatgcatccatgtaccaggcagtgagaggcatagggggcatgaagcacagggcgggaccagctctgcacacacggccgaggccctgacaagtcaagtgacttctcgggccttcagctgctgcttctgtaacaccagtgctgccccttaaggcagatcggatccgctggatccatgtgttgtgtctcaggcactgagctcactgcagcggcagccacgacagtggcaggagtgttgatgatgactatgaggctgaccaccgtgacagtcacagtggaggcacggttagcactgagctcctgatggggagggcactgtccctcgccacgggctgtcccgcccctcaagacagctgcactcccttgatcccacgctcaaaggctgttggggaacatgtgccttcgagcagacaattgcccctggccgggcacggtggctcacctgtaatcccagcactttgagaggctgagacaggcagatcacttgaggtcaggagtttgagaccagcctggccaacatggtgaaaccttgtctctactaaaattgcaaaaattagccgggcatggtggcacacactggtagtcccagctacttgggaggctgaggtgggagaatttcttgaacctgggaggcagagcttgcagtgagtggagatcgcaccactgcactccagcctgggtgacagagcaagagtctgtctcaagaaaaaaaaagagagagaaatgcccccaggtcccaccagacccttgcccagaggaggccatttccccatccccctgccccatgtggcttctctgatgtcaggcatgtcccacgtccccacccacctgacaaggaacctgcatgcagccatcctttcctcgcagacgctcccttttccatgcctctcaattcaaagggaaggaggcctcaagtggctgctggtgactctgacgcctgccttggacacttaccttgtgactaggacagcctggccgaggctccaagatctgtctcagcagcaggggagagttggagggtgggcgctaggggtgcaggaagccccagcctgaggagccggcagactaagagcccctgaggccctcggagagaagcacgttgggggttcccaccagctgctccttaacagcacctccacctcccagggaggcttcctgacctcaggtacatggggcttctgggcagacacctggtctacatgggtgttgttattggtgccagccattggtggggccaaacctggcctctgacccctcagcccttccaataaccgcatccgcaggggccccctctcagccccacctcgcagggaggtaccatctctgagttccacggaaatgcgaagggggaagccccaggattctgcagcaagaagcacagggtgccccttaggaagaaggggcagttttggcctgagatagaggaaggccagaaaggcgactaaaaatttcatgagcaaagatcattaatagcaatagcaacatcgcccatccacgctggctttattgctttattacaaccatgctgctaccgtaagcgggtggcaggcaaagcgacaggtgtactgggaccgctgtgtgcctggagcccggctgtccacaccaagctcctcagccaaccctgaggaagggacgctatgctcatcttagaggaaagaccaaacgcctttctaagaacgcacatggccaggtctgaggccactagggcagccagctccagcacagccccacccacctcacccaggagtggggcacagtctgcccgcctccccaggagggcactggctcctggaagaggggagtctctagcactcggcctgcacagggcttgtgaggccctcacagggcggggctgtggcctgggcagctttaattctctagagcccctgcccagcccctttaggcctggctgtcccctatgttcttcctcctgagtcttgggaaggagccctcttggctaaggtggttttgagagcaatcccaccagccccagggcggaggcatgggtgggtcagggggaaggagaagagccacagacgccaccggaaggatgcggcatcgaacaccaggtccttgggccgtggtggcggcactggtcccacagttgcttcccaccaatggctcttacccctctgggactcttacctgcccacattccactcctggcagggagtgaggaatggagatggagtatggggcttgggtggggggctgcctcccctctgcccccagtggaatcttcatccccaaatccagctgtttccaagccctcttccccatctcccttggattaacagaggatccagaatggaaaggaccttgggagataatttacctcctttgattttagcccaggaaactacaagcaggagaggggaccagaacttgccaagtttacacagcagggcggtgcagaacagaattacacataataagggcacagaggccagagagggcagaggcacttcagcaacatccggccagctcacagaaacccccaaacctcagtctccttggaaactccagctaagtcccatgagcagcccgctccatctgggaaggcgggtacccccagtctctcttccctctgctcccacagctgcccaagggggacagtgcctagcagctgccaacgctgtcctcaccagaggggctcacacccaccgcccatgccaattcaagcaagaggctgtgacgtcagctggacaggtgggactcagcctggtaggggtgccctggccagggagggccttgggagaaaggcctccaggaacacacacccctgcactgcacacaccgggtggggtccctgccttgggtcattttcagcatgggatggtgggacaaatgtcttcctaggagggtgagcccagcagctgcctggaacctcttgcacacctgcagagccctgcgcctgcctgccagtgccttgcgagacaacagctggttttgaaaactgtggctggggaatctctgcaggctccacctcccaccctctgcgtccatcctcaggaccctcctaattggctacttcccatcaggcaaccagattctccatcccccttcccccaggacctttgagtcaggctgctctgcccccatttcagcttctcttgagatctctgcccactgcccagggcacaccttgcctgtaagcgaagggtccccacagccagcccaggctcaccagccaccaacacctgcaggagagagaccacacctctgcatcaggccagtgtccccttttttgaataaaataatggaatcatctcaaggtccagcagtaacacaaacaagggaaactcccctggaacagaagctcagtgttctcagcccagcatcttctgaaccgggaggcccagtgggcagcctagcacttaccgtctcctatctgagcccacctaagtctcactgtgccacgcctggcaggaaatggggagggcggggagtcaggacaggtggcaggaacagggctgcctctagggcaactgatgaaccctggcagcagcatccgtgacactggagagcccaacaccagctgccactgtgtggccctgtggcattggccacaaatgagcacatccatcagctcctgagtctcaagctgtccctcccaggctgactccgcacttctggagagaaaggggccgccagctacagaagtactctccaagatgtatccctagaggccatgagaattttctaggcaagagtttctggggctaagtgaaagtgcttggcctaaagctgggagcagtggctgaaagaggcaggcctgggtgtttccactcatgcaagagctcttctggagatggagcagccaggcagctcccgcagctgcttctccttggagcccaaacccttttacacccattccctcctgaaggccttgttgcacctctgagcaaagtggggcagaggctgctcctccagactcaagggaagggttttgttttgggtcaccaagtaggttagcagtgaaatgacacaaaaactcatgccttggaaattgtccatggaatttcattcagcctccaaagaagacccaggaatggggtaaagcaaataacacagccccgctgggctgcatctcagttcctgacagtgcaggcctggggcctggcagggagttttacagggagagaaagaaggcatgagaaagtggggaacagccaagcgggttgtgcgtgatcccagtagagttgggggtgagtgtgcctggttgcatggcttcctggggacgcctcagggttcctcctccaggaaagagggcacccttcaccatccatgcctcacagcaccaggccaggcccgggacatccacaggtgcctcagaccccacccctagtttccaagagctctcagtctaggcaggaggcaaaacacacactttcaacctcagttcccggggctagggctcagcactgccgcagggttcaggaaggcacagggaggagggcccagccatgtctgcacagagccagggctcagggaagccaggctggaagagccaaggcagccaggtgaaggcgggaaagctggcgaaggggaggaagcagaaagtgcaaaggcactgaagtacggagaagaacgcgtctgcagaacagtggtggctcaggtggcccaagctctgggagataagtttcaggagatgcacccaactgggcgcaggggggcaggtcgcgaacgaacctcaccagccatgcttagcctgaaggccaccagccgggtccacagaaaggtggaagtaggaggcccaacctactgggaatgcctaagaaaagggaaagtaactaaggcagcctgggtcccctgcctcctctcctcagtgtgggagggatcccgagagatgtctacaccaaaccctactgcccagggccgcacgctgcctttcggttagggtgattctgctcacactagcagtgtccaatagccttcatcatgctgtaaatgccagaaccaaaaataaatcatccagggaagacacgcttgggtcccacccagccatctctggagtatgaggaacctacagggagggatgggccggctcagtggaagagatcggctcagtggggatcctgcctgccaggctccaggtgggagtgcgctccctctcccctcccttttgttcctgtccatgtcactcccagccatcctggcacaggctgtgagctgacccagttcgagacaccttgttgtacactttgtcaccacgttgctcaggcaccacaattctaaagttagccctagcctgatagcagaggctccccaccaggccagtgccagcagcacacagagtaatgctgctgcccagctcagctgccattcagaggcaggcagtgccccaggggcagcagggctgttgccagctaaaagcccacgtccactgcctggctctgaaagatcccacactcatgtgccgtggaacggcttgcacttgagacccaacatcaaggggccaggggagtgagcgtgggcactggggacaaggcactgactgtccccagccatggagctgaagctagacctgccattcgttctgcaggagtccagctgtgagcacagcccagacaggagcgggggagagctaggagggccacagtatcttaggtgacactggtctgaagagacaagagctgtgctcctagagccaaggtctcagtcaggcctgatgagccagctggctctgctcaaagaaaaacccttcttgtgccacaggctccgccagtaagcccagctcagctcagctttcccgcaagtgcaagaggccctggcagaggacgacgctttctggtccagaaacactggcttggagcccactggatatgcggccatgccctgggagccagatttctgagccagatggaagcaagggtctcagacagtttggctcatgcccccatcctaacttctgacacacacacactcacacacatgcacacactcacacacctacacacacacacacatgccaccatccttgagcagacagtccagattgcaggtatgcacttggggtcctccctcacaagccccaggcccacctgtagtccaccttttgtctacactcatatccctttccttggcctcaactcctgcccaccctgcccctatgactcctccaaaaagcccacgtgggccaagtgctgccctgcctatggcccaccatcacctcctccagcccccacgaccctgtctccccacgcattacctggttatgctctctccgtaactccttggttaataagttgtgagctttcttattaaccaaatgctgatttttctatgtaacatctaatgtccaatctgaccttgttaatccagtgccagcccaggagggcagggtcccgtcccggcacagagctgccccagagccaggacttggtaaagcgcagggattgcagcatttcagagctagatggggcctcagctgagcgtcctcactttacaaatggagaaaccgatgcccaggaaggggatgtgaatgacaagggtacagggcctgggctgatcccatagcacctacaaggtcggctttcccggcacctggagggatcccttggggcactcagaaacgagccatagaccgctggctggggatctgaaaatggaaactgaggcagcagcagcagcaaactcacactaagggtggtaggcaggtgagggagctgcaggtgaggaggtgactgaggtgaggcaggagcacccacaccttttcttccttctcctcctcctcctcttcctcctcccaggagccaggagaagcacacctcaccttgcccacagcgccacctaccgtctggccaccctggggtgcagctgctgccagtaccagccagcaggtcaaacatccaggcccaggaaaccccaggcccagccagcggcccagcgcagcaagtggactctcacctcccagaaaggaaaagctgcctcttcccaaacaactctccagactacagtggccaactgtcctgttctgcccaggactgacttgggttccagggaaagagactctcaggctaaaagcaggaaagtccccggccagagggacaggtcagcgtcctgatacagacataaggcctgctgcccctctataggtatcctctgcagggccaagggctggggctttggtctggttgacagtgagtgtcagaacacctgtctgcagctgacctgtcaaatgcctttcctctctggagcacatgtgcaggagccacccccggcccaatggagcgagaggtcttgggcagggtgcactgtgggagagaggggcctcagaggggaggagctgcacactgaccttgaggatggacttgggtgtccccaagcaaagacctgcacatgagagccaggcacccagggagagcagaaagcagggtggccacgcagggcttggaaggggacaaacaaaggcaccaggaagcaccctcccaaggctggaggaaaccggcgtgaccccgtgtgcatctgccgtcttggcaggattccttacagctccccttcaggtttacggggtcccagtgaggaagggaagtcagacacaggcaactctgcctagaaatccttctaggttggaagtagggttccaacttgctatgtctccagcagctttgatgttggttacatgcaactggtcttcaataaagttaaaataccaaagcatgtgcacactttgctcttgtaaataactgctcaaggcagctgctgtgcctcccatgctggctccctcgggacaacacagggcatggcagggcagggcaagcaggggggctctgggagctggagtggcacaggctgcctatcttatcttcactgggatgccaggaatcgctgagcctgctacaaatgactgctgctctttacctccatgcagtgctttatttcacagagtcggggtgtgcatagaacctggcacaatggagcctcaccttgtccaccaggtgccactgcagaaaaccagtcaatgggcaatccacgctcacaaagccaataaacactgcctggacatccatttctgccaggcatggtgctgggcacaggcactgagctacaacaggtgccctaccctccttgacacagaaggtcaggcagcagctgccacccggagcactgcacatgccaggattggggacacagaagcagagcaggctccgcttcaactctcttaggatgctcctgggaaggggacagtgagagacaaacagtgacagcaggtatggcaggctgtgctgaggggtaggtactcagaacgcccaggcagccatggccctcaagggacatcaggcaatgtctggaaaccactcagatggcctgggcttggggtactactgacatctagtgggcagaggccggggacattgctggacacctgtagtgccagggatggccccaaaagtcagcaaccctgagtcagagagggcagggtgaggaggcatgagggaggggacacctgacaaggaccactccaagctgcggtaacaaaggtctgtgggcagccttgcacaagagaagccagatcacccagaaaggcccaagacctgggatgactgaggatacaggtgggaggacgcctgccagaagggcctcccgggacaggggaaaagttccatttcctggaaaacctggggacctctgagcatggccctcaagggtggctagagaggagcagtggggagactggctgcaagcagctgctgctggtgatctggcgggggtgatggcacgaagccaggtagagtccgcgagggtacagatccgggggcaggtgagaagagggagtccatcctggtccttggaccactgccctggcatctggagtgatagggaaagaacagaacattggggaggtcttggcaggggctccctttggagactggagactcccacgtagggccacagtgcctggacccaaggtcctgaagccctgaggagtccaggccacagactgagactcagatgacagagggaaaagcctgtcagtccctctgtgacaccttgatctttgtttcctgagcccttatcacagtgttcattacaaacatatctgtgctctggaaggacagaggtcattcactctctgaggacacacacagtgcctggtgcatggcaggttctcggtgactattcgctgagcaaatgaacatcaggtggaggaagcagaattcacaagaacagcaggaagagagccagaaaagcatcgtggcgcacaggaaggccggtctccaggaagagtgagggtccgcagtgtgaactcccccaaagacccagaaagagaaggccgggaaagcctcccatggtctgaacaaggaagagcaggaggaggccttgggaagaaatgttccaacagagtggaggagatgccagctggccaggtggagggaggggtgggagcaggtggctcacctaggaagcctgggagggaagagggaagggacggagtgggtgctgatgagcagaagcgggcagcaccccagcccaatgctgggaaaacactccctagagccacagcccagaaaggcacacagtgggcctggggccaaggcccctttccagtgcccccagctccccaggagtccagactcacacacagtctgttttgttttgggtttttttttttttctgatacagggtctcactctgccacccaaactggagttcagtggcttgagcacaactcatggcagcctcgacccccagagctcaagtgacccacccacctcagccttcccagtagccggtgctcaccaccacacctggctaaattttgtatttttacagagatgacatttcaccacgttgcccgggctggtttcgaactcctgggctcaagcgatccgcctgccttggcctcccaaagtgcttgggattataggcgtgagccaccatgcctggccttctcacactgtctggagcccaaggacatccgtgtctgacacaggcaaaaccgagctcttcctccacaagcctctcctcccacggttgccccagggcagccaacggccttgcctcccacgggtcactcaggcccaaccatgggctggccaagccacctctctcagctctccctgatcactgctcccacctccgccagtcccactgtggtcaagctgccatctggggcctgctggcctctcagctccacctttgtctcttctcctctgtccttggtgcagtgaccttgaaactctgactcagatcatgccacctctgcaatggctcccagctcagagtccagggaatgtctctccccatggcccgcaaggcctgcaccaccgtccccagccacctctccgtcctgctcctccattctccctctgcctggctccagcggcagctgtcccttaaaacctccgaggacactcaagagtgccccaggacttttgcacttgtgttttcctgacagaatgctcttccccagacacctgagggccctcctgcatgagaatcaggtttctggtgaaaggacacccatcagagaggccttccctgaccaccacccctgtctgtccctccccttgcctgctgtgtcaccggcagtgctatacattcattcaccactgaagctgctgcgtgagggccaggggccgggatggtgcccagcgcacagtagatgctcaataaacatttgaagaatgtatgaatgaacctcttcaagcttcagtctccaaaggggatattaacagcatttgctgtgaagattcattgaaatactgcatgacatgcactgggcacaacacctgagcatgagtcccgccaccaccagccagccctccgcagcaactgcagataaaaatattcaagagccaggcgtggtggctcatgcctgtaatcccagcactttgggaggccaacgcgggcagatcacctgaggtcaggagttcgacaccagccttgccaacatggtgaaaccctgtctctactaaaaatacaaaaattagtcaggcacagtggtgcatgcctgtaatcccagctactcaggaggctgaggcaggagaaccacttgaacctgggaggtggaggttgcagtgagtcgagatcgtgccactgcactccagcctgggcaacagagcaagactctgtctcaaaaagaaaaaaaaggcctggcgcggtggctcatgcctataatcccagcactttgggaggccgagtcaggtggatcacaaggcctggccaagatggtgaaaccccatctctactaaaactacaaaaaagttagctgggcttggtggcaggtccccgtaatcccagctacttgggaggctgaggcaggggaatcgcttgaacctgagaggcagaggttgcagtaagccaagatcatgccactgcactccagcctgggaaacagagtgagatgctgtctcaaaaaaaaaaaaaaagaaaaattcaggaaaaaaataaaaacaaaaagtaataacataaaaaataatacagtgtaactacccagcatgtacactgtcttgggtatgataagtaatctagagatgatgtaaagtatatgggagggtgggcatacgttatactcgaatacaacattgtttcccatcagggacctgagcatctgccgattttggtatccacggggaactggaaccaatctcctatggatacccagggacaactgcattgataactattaagttatttaagtgcttccctggttgtggcctgttggcctgtctttgtttttgttttttaagacagggtcttgctctgttgcccaggctggagtgcagtagtgtgatcacagctcactgcagcctcgacctcctgggttcaagtgattctcctacctcagccaacccagtagctgggactacaggtgcacaccaccacacacggctaatttttgtattttttgtagtggcagggttttgccatgttccccaggatggtctccaactccttggctcaactgatccacccactgggcttctggcatcacagagctgggcctcgtcatcccattccagatgccgtccggatactctccccggcagcagcccacggaactgcaacatgtttcttaacttttctccttttgaaaccactttgaagagctcactccctctcccaccaatgaccacaaactgttccagtgaaaaactatctcaaaatgagactaatcaaaagcttatgaccaaaaaaaaaaaaaaaaaaaaaccgtatgccaaacacacagacacatgctgtcttccaaatcttactgcatctttttttttttttttttttttaaagacagagtctcactctgttacccaggctggagtacagtggtgccatctcggctcactgcaacctccgcctcctgggttcaagagattctcctgccccagcctcccgagtagctgggactacaggcgtacaccatcacatccggctaaatttttgtatttttagtagagatgaggtttcactatgttggccaggctggtctcgaactcctgacctcaggtgatccacccacctcagcctcccaaagtgctgggattacaggcgtgggccaccgcgcccggccaaatcttactgcatcttaaccactctgccattcatgagccactgagaaccttcacaatgaacttcactttaaaaacacactgttggctaggctagtgggaagtgacctgagggggcttgtgcataaataaaagcgtcctcaggacctgctatgcattcagccagccaagctcccagtgctgggagacccatatgtacctcaatgactgctggtcaacgtcaggcctgcaggaagccagagggcagggacctcctccggctgtaagagcccaacatctccctcagagaaggactgtggacagccaagagcgtggcacacccaacactccaaaggttaggcccacaacgtcttccagcaggggtctttggctttttaaataccctggcctcgcttcctgtggctgctgtaacaaatgactgccaacttaggggctgaaaacaacagcaatccccaatcagttaccactgggccaaaatcaaggtgccgactgggctgtgcttccaccagaggctctgggggagactccattttttgcttcttccagcttctggtgggcctggccttccttggctagtggcttggtcactccagcctctgcctccatggtgacaagagacactcctgtgtttcaatgtccctgtgccactccattgttaaaaggacacacacaatggcacttagggcccacctgggtaactcagggccatctccccagctcaagctccttgacttcatcacgtctgcaaagatccttgtgtgtgtgccatataagagaccttcacaggatgtggacgtctttgcaggaccatttttcagcctccaaacaccctcctcacccttcaccacctcatatctctggcatgctgggtgtgtgcaaaggtgaaaggagagaggaagcatgcaggccaggcagtgggaggaaacgccaggatggccaggcacttcggctgcagccctggctccagaggcccatgtcaggaggctggggccagctggggacggtgtggctgagagtacaggtgctccccagcccagccaaggcttctcaggagaaaggggtgtccgggaggcctgtgtttggctacaccaagctcgccagtctcactcccacctctggacctcccctcgaagcccctcccttgtgggccgccagagcatccatcctcggagtgtgtccagcatgttcaggacagcaggaacagggcattctttggaatgcactgtctttgacatgagcaggctggcccccacccacttctctcaccagatggagaaaaatctcaagtcataaactaaatgaaaaacatgtcctgttctgccctgggatcaagggttcaccttaaatgaaaactgtctggaacaatgtgctgctgacgctgatcttggccttactctgcagattagcctcgggggtgatcacaggacgctcagggctctgcatcagcaagcccaacccccgctgagccccaggaccacccactcccccagcaggatccccgggaagcagcccagaagcaccccccagagacagccttgggagagcgggccaggaaccccaagagcttcaccccacagtctgggaggtgtgggaggcatctcagaaaggctgcagaaggaactgacggccctcccctcccacactttcctcgaagggcccagagcccacttcccatgcagtccacccacccctcggtgctggtgcccgggcacccaaacatcccctggcacccatcacgagctggtgccacgctggtggcttcctttcaactcatgccggcttgctcctgccacccagctcgcctaggtccggaatgcgcaggccgttttgcaggaagcctcatgtgggaaaaataaccatgtttgtggaacacacgaggggtgggagattcacaagcaagtggctttactgtgtgacatggcagagagggaagagagcccctacttcctgggcaacccacttcatgcatgagaaggccaccagactgccaggcacatgtgaccaatggcagccccaccatggcagcgttctcctgcaggttcttgtgagggtaggagggccacccctacagtcctggaccatcctgacgccagcctgggcagcccaatggctgctggatccccaaggcaagacggcaggaagcgcctagtactccacaccagccagcgacagacacgggagggaagagcagagctgtctgtctgtctggccagccagcagcaaccaccgcgatcccctgcatgtggggctcaccaagcagtgagatactcccgtctggacagtgtcaggcacatcacttaccacattccagtagagcggattgaaggtgatggtgatgacggcagccacaaagctgggatccagggggtccacgtagcccagcagccgggtcataacgcagaagtctgcctgcagggacagagctagcatcagcaccacccagacacagcagggcctgtgagcccccaggagtcggagaaaaagttaccctctgggaacacactgggaggcctgggaacatccaagtccggcaaaggttactacagtgtagtctcataaaagggaagataaaaagctgaaacctaatgagctgtgtcatgtcctgggagggcggccgcagaaatgtgcctggatgccagatgaggaaatcagcacctctgaagaggggtgcctggcaccctgaagggaggtgacaccaaccctggtgtgaccgagaccctcctggatgagggttctcagaggccccagaggaaacccaagcagctgagataaatgtgaagagatgctcaacctaccaggaatcaggtaaaagcaaattaaaacaatagtggtgtgcctctcctcgcccacactcgacaggggacaatcttgagtgcacacgagggtgtgagtggggcggggtaaactgaaaaagtgtgtgcccacatcccggccacgccacccgcatacggggggcacgtggacactgcccccgccccgccatcatcttgcatgaaaacgtcaggaacaatgacaaacaacttaggtgtccagcaaccaaagaaatgaagaaaaaaaaaaaaaacccacggcccattcctacagcagctaaactacagcagttaaaagcactaggtcggccgggcgcggtggctcatgcctgtaatcccagcactttgggaggccgaggcgggcggatcacgaggtcaggagatcaagaccatcctggctaacacggtgaaaccccatctctactaaaaatacaaaaaattagccgggcatggtggcgggcgcctgtagtcccagctactcaggagactgaggcaggagaatggcatgaacctgggaggcggagcttgcagtgagcagagatcgcgccactgcactccagcctgggcaacagagtgagactccgtctcaaaaaaaaaaaaaaaaaagcacgaggtctacacacagcactgtgaaacgttctgaaacacacggctgagtagaagagcaggctgcatgattcagcacctagacagaaatttctagaaaacaacataaaatatagtatcaaatattcagattttacaattttttttttttttgagacagagtctccctctgccacccaggctggaatgcagtggcgcgttcatagctcactgcaaccttgaactcctgggctcactttgggaggccaaggtgggagaatcacttgaggccaggagtttgagaccagtctaggcaacatagtgagaccctgtctctacaaaaatgtaaaaactagctgggcgtagttccagttacttgggaggccaaggcaagaggatcgcttgagcccaggtgttcgaggctgtagtgagctgtgatcgtgccacttgcactccagcctgggcaaccctgtctcaaaaaataaacaattaattaatttaaaaataaattaaaataaaaaactttttctaaaatgcactgaaaaatattatggtgtctctccacatgcaactcaaaattttttaaaaatactaaattataaaataagtgtaaagttgtgctcgcttcagcagcacatatactaaaattggaacaatacagagaagattagtatggcccctgcacaagggtgacacatacaaattcatgaagcgttccacatttttggacacaaggaggggaacatcacaccgaggcctgtcagggggcggggggctaggggaaggatagcattaggaggaatacctaaggtagatgatgggttgatggatgcagcaaaccaccatggcaaatgtatacctatgtacaaacctccatgttctgcacatgtaccccagaacttaaagtataataataaaaatttttttaaaaaattaaaaacaaaaaataaaaaaaataagtgtaaagtccatcagagctgtgatctttcccataatggtgtgttttgttctattgcatttggaaatacagtaaattccttcaaagagcgctttgatctcccacattttggggaagcggtggggaggagatggtgcttctgcccagggtcagccagccctggggggcaagcgcagcctccactccaatccttgcttccccaaacgacagtctcctgacataactctgcctgctaccaggtcacttgcagggtgtgaccatgggatgtccctcagacgtctatcagtataaagccatcttctgctatggcctgccatccttcccacgtgtggcctccccacctgatcagcctgcatccctgaggtgcaaacaatcatctcactgtagggccaagggcagggctaagcagatgttaaatgctctaggccgggcgtggtggctcatgcctataatcccagcactttgggaggccgaggtgggcggatcacctgaggtcaggagtttgagaccagcctggccaacatagtgaaaccccgtctctactaaaaacacaaaaattagctgggcgtggtggtgcatgcctataatcccagctactcaggaggctgaggcaggagaattacttgaacccgggaggtgggagttgcagtgagccaagatgcgccactgcactccactgggtgacagagcaacacttcatctgaaaacaaacaaacaaacaaaatgctccaatgcaggcccctcctaagggatgaatgagctgacataggaccaaaggtgcactgctactggaatctgtagacagaatagctgagtgaaagagtggccacggcagcaggtgtgggcatcagtaaacaaatgactaagaaaagccactccgcaaatggcgggaagaaggaacccagggaagcaccacttgcctagctgtggccacagcctctgggaactgcgcagtgcctgcccagcgcctgcagccaacaaggcctggcgctccagcaggtgcctcccaacgcctggggctgtgagcctaggcccacactccccagagcagacactggccgctcatgaaggacaactgggccaggctcagagcaggctgtcctgccctgaagggaggggaagggaggggagggaaggcctgtgatgcagccccaaagcttctagaacctggggcttaacctgaggcctggccttatcttcagcttgatgataacatctattaagcacctccagtctaggcatggtggcctgtaatcccagcactttgggaggctaggcaggcagatcacagggtcaggagtttgagaccagcctggccaatgtggtgaaaccccatctccactaaaaatacaaaaattagccaggcatggtggcgcacgcctataggcccagctactcgggaggctgaggcagaagaatggcttgaacctgggaggcggaggttgcagtgagccaagattgtcccactgcactccagcctgggtgacagaacgagactccgtctcaaaaaaaaaacaaaaacaaaaaacacgcatccaattccaaggccctgtcccttgacagcctggtggggggagggtggaaagctggctcagggaagagtcgtggctttggtcatgcctggcacttacgaagtgcaccaagagtgagttatctccctgcatgtgcacagcagaccctatgagtgggccagcggccagttttcacccatccctcccactccccattccccattcagcccccagccaaaacctggcctcaccctacccctcccttgcctcattcccattaccaatcctcccgtggcccatctgttattccgcctcttacacaaccacctaatccactccctcctccaaccctggctttgccggttgctccccagggcacagcaaaggacctcagtggcctcctgcctttggacttcccccagagccctccccatggacccttacctatggaccagcatgctgttagccaagccaaagaggagaaagggcagagtgtgagtcacagagcagagccccgctcagctaggggaaaggggaaagcaggaaaggcctagggacactgagcctggggccaggaagggacagagggcattttccagggccaggaaaaacacttcccatatcactggcgccccttcaactctacagctaagagaggtgcatcttcctgagtgtaaatgatctctctactacttccccactgggccctgggggaaatgctgcctctcataaggaattcaactcgatgttagtcaccttagctgagctccactaaggaggccctcactctaggggatctaagaaaacacaggacctgtcagtgagcgcagacctatctctggccatactctcagccaccctaaaagtaaagccttgttgttagcctactttccagataaaagagcaaagcctccagaccccaggcagtgaggagcagagccagcctgagcaaggccagccctaccagacagaaagccccataaaaatgggacaaggataaaagtgagtgcttctgggtcttgaaacccaaggaaactgggaaagtgagcaagaaatatgcttttttcaccttctgtgggagccaagatgaaggacggaaactgagcactgaaagattaagcaactaacactgggggaacccagcagcagctgacatccacctgagtctcccaattagggctgaactggtcaaagctggaacgtatccaccccctcccccctctccctcctgtgcccaggtcccaatggcctcaggtcagcctgtctcaggagggtggtggtgtccatccggtcacttcagtcaccttgaggaggatttatgttgcccggagaagcacctgcttcgctggaaagaatgactaatggttcagagtggaattctaggcagcagagggaagcccctcccagctccccgatccccactcagagacatgatagtccctttctcatagctgtcatttccaaaacccccctcaggagggtggacctccctcctgaaactggattggcaaaaaagaaccaaaaatccaggtcagacgtgagcagagtaggagagtcctgggtcccacatccaggctctgcctccgggtgtcagagtctcccttgatggcctccccttcacacctgtgaccaaagggcggtctcccatccactcccagccccaacctccttcatacaacagaggtcccggctttctgctacccagtaattctaatggaacccccactccaaggctccaggttgcagaggcctcggaatctgactaaaggaaaggagctacccaccacggccaggaggtctgctgagctgcaggaatagctcgagtcccacaggtcaccgacgaatagcctcagctgttaacaccccaaagcatgggtaaggaagaggctttatggtaatttactccattgaggggtgcagggttctcgggagcagcgctctgtggtcagggaatgatctgcagtgggtcaacatgtcacattgtgacacatggacaaacagcaggcctggacaggcaaagtcacatcgattccaggccacacaccacacacaacaaagggcaggggaatgggtgggggctgctggagaggggacaggtcctcctgggatccatcacccctgcagaatctgcctgcagcgctgcagcccccactgcccccagagctgccctcatgccctggcaccataagctgactcgggtaacgtttatttagggcaactttgggttagagccctgtgcctggcacaaagacataaggatgagtgtgccagagtctttttcctctaagtttattctctgggccgggcgcgatggctcacccccgtaatcccagcactttgggaggcctaggcaggcggatcacaaggccaggagtcagagatcagcctggccaatatggtgaaaccccgtttctactaaaaatacaaaaattagctggacatggtggtgcacgactgtagtcccagctactggggaggctgaggcagaagaatcacttgaacctgggaggcagaggttgcagtgagccgagatcatgccactgcactccagcctggatgacagagcgagactccatctcaaaaaaaaaaaaaaagaagaagtttattctctggccgtgcccagtggctcacgcctgtaatcccagcattctgggaggccaaagcaggcagatcacctgatggtcaggagttcgagaccagcctggacaacatggtgacactccgtctctactaaaaatacaaaaatagccagacgtggtggcaggcacctgtaatcccagctactggagaggctgaagcaggagaatcgcttcaacccaggaagtggagattgcagtgagccgagatcacgccactgcactccagcctgggcaacaagagtgaaacttcatctcaaaaaataaaataaaataaaaatattttttaaaaagtttattctctggtagaagaggagaagccatttcatattaagccagccccctaaccctgtttttccacataagaggccacctggctcagaggactctggcctttggcagccactgtctgagctgggagcttcaccacccaccgtgagggaccatggcaagcctcccatgaccaatctaagcccaggtttcccttgagtggaatgggggtgatgagacaggccacctgaggttaccttctgcacagaagcaagaacagatgtaaaagtacagggcccactcagggccgaggctggcggcccctctactctgtctgcttaatgtcaactaatacaggtccctctctcaccattcactctctggagggaccctcctgggaagaccccgatgctggaatctgaggtcaggcaagccctgggcagcaaaaaccacctcatggcaggaggggtggaagttagaatgtcacaatgcgactgtggtctctagatcccacagtaaaacgaaatggcaggcagctgctccagttccctagatccataactcctttcaggagggtgaaatgtcattcattcttcaattaacaagtgtgacctgcaccaaactcaaaaggcactgacagctcacgtgctccagcaggggtgggtgtggggcccacgggtaagacggtgcttctcaaggccctgctcgcctccacgctgggctgcctcttctcactcctctgctggttgtgagcttcaccccattttcttttttctttcctttttttttgagatggagtctcactctatcacccaggctggagtacagtggcgcgatctctgctcactgcaagctccacctcccgggttcacgccattctcctgcctcagcctcctaagtagctgggactacaggcgcccgccaccatgcccagctatttttttgtatttttagtagagacagggtttcaccgtgttagccaggatggtctcgatctcctgacctcatgatccgcctgcctcggcctcccaaagtgccgagggattacaggcgtgagccaccgcacccggcccaaacctggctaatttttttttattttgtagacatggagtctcaccacattgcccagtttggtctggaactcctgggctcaagtgagtctcccacctcggcctcctcccaaagtactgaaactacaagtgtgagccaccaagcccagccatcttccttttctttacctttaccttccagggcccaggacagaacctgctaggtgctactgtgtctctgtgtaaatacacattgtattttgaagacaatagtaacaataagccagccaaccttcactcggaagtgaaccagctgccaagctctggcaagggacttgcaggaggcagaacagagtgctgatgagacaaggacgcccgtgccacggcgggcagccatctcccctcgctgagcaccgcttcctagcctgggaggtgggaatggtagaggtgccatgggacgccaggaggattaaatgagaaagtgcaaggaaagcactcagcgcagtgcctggcggggggcatggctagacagacgctggctgtgacaactgtgtcatcgagtcctggtgacaaccctgcgaggcatgcccactcttcagattaagaactgaggtgagtggccaggcgcggtggctcacgcctgtaatcccagcactttgggaggccaagacaggtggatcacctgaggtcaggagttcaagactagcctagccgatatggtgaaaccccgtctccactaaacatacaaaaattagccgggcgtggtggcaggcgcctgtaatcccagctactctggaggctgaggcaggagaatcgcatgaacctgggaggcggaggttgcagtgagctgaggtcatgccactgcactccagcctgggcgacagagcgagaatccatctcaaaaacaaacaacaacaacaaaaagaagtgaggtgaggtatgaagcaaaagctgacagaactaaagggtggaaaagacaaatccacagttcttgttagggccctccatggtcctctcagtgactgagagaatcaaagcagtggacaagaaggctgctggagctggcaaggtcaccaagtctgcccagaaagctcagaaggctaaatgaatattatccctaatacctgccaccccgctcttaatcagtggtgaagaacgtctcagaactgtttgtttcaattgaccatttaaatttagtagtaaaagactggttaatgataacaatgcatcataaaacctttagaaggaaaggaaaatgttttgtggaccactttggttttcttttttgcctgtggcagttttaagttattagtttttaaaatcagtacttttgaatggaaacaacttgaccaaaaatttgtcgggccgggcgcggtgagtcatgcctgtaatcccagcactttgagaggctgaggcgggcgtatcatgaagtcaggagatcgagatcatcctggctaacacggtgaaaccccgtctctactaaaaaattaaaaaaattagctgggcgtggtggcaggcgcctgtagtcccagctactcgggaggctgaagcaggagaatggcgtgaacccgggaggtggagcttgcagtgacccaagatggcgccactgcacttcagcctgggcgacagagcgagactccgtctcaaaaaaaaaaaaaaaattgtcacagatttttgagacccattaaaaaaaatctaatgagaaagaaagaaagaaaaagaaagagaaaaagaaagaaagaaaaagaaaaagaaggaaggaaagaaagaaagaaagaaaaagaaagaaagaaagaaagaaagaaagaaagaaagaaagaaagaaagaaagaaagaaagaaagaaagaaagaaaaaaaaaaacgcaggtggaaaatcgggaggacgcagctgacctgagcagcgccatccagtggctggacctgaccacagcacatggcagccttgggaacagcctgcagtctctggtgtcaccaaaacagatcacacttggggccaccaaacaaaccttaaatttaaacgaatagaaagcatacacagtatgctcccaaaccaccacagaattaaactcgaaatcagtcacagaaagcgatcgtggaaagaatgcacgcgagggccaaatgggaagtcttgggaaatctagaaacattttgaactgaatgaaaatgagaatagaacacatgaaaccctgtgggatgcggctaaggcagggcttctattagtaaggaagaaaagtcccaggtcaggaatataagctttgcccttaagaaattacagaaagagtggctgggcgcagtggctcatgcctataatcccagtactttgggaggctgaagcaggcagattacttgaggtcaggagttcaagaccagcccggccaacatggtgaaaccccatctctactaaatatacaaaaattaaccaggcgtggtggagggcgcctgtaatcctagctacttgggaggctgaggcaggagaattgcttgaacccgggagacggaggttgcagtgagccgagattgcaccactgcattccagcctgggcaacagaggaagactccgtctcaaaaaaagaaagaaagaaattagagaaagaggaatgagttaaacccaaaggaggcaggacaaaaaattaaagataagcaaaaatcaatcaaattgaaaacaggaaaacaatagagaaaaaaaaattacacccaaagctggttctttggggaaaatttattttcccaataaaactgagaaacctccagccagcctgaccaagaaaaaaagagaaaagacacaaaatatcaatatcagaaataaaaggggggacttctctactgacctcacaaacattaaagtaataataagggaatactatgaataacacaaattaagtaacttagatgaaatgaaccgatccttgcaagacacaactgtcaaaattcattcaagaaataatcctttatcttttaaaggatttgaatttatggcttaaaaacctaaaaaaagaaagccttgagcccagatggtttcctggatgaattctgcctaacatttaaggaaaaaataattccaattccacacaatctcttccagaatatggaagagggaggcaatacttcccaactcactgtattaccctaacactaaaaccaggccgggtgcagtggctcaccgcctgtaatcccagcattttgggaggccaaggtgggtggatcacttaaggtcaggagtttgagaccagcctggccaacaaccctgtcgctactaaaaatacaaaaaacaaaacaaaacaaaacaaaaaccaggtgtggtggtaggtgcacctgtaatcccagctactcgggagcctgaggtgggggaattgcttgaactcgggaggcggaggttgcaatgagctggtatcacgccactgcattcctgagtacatgcctgagcaacagagcgagactctgtcttaaaataaataaattaattaaatcaaatgaaaccagataaagaaagaagatccccccaaaaattagagcaaatcaaatccagcaatatatacaaaggataatatgttaggaccagccagagatcaccccaggaatccagagctagttcaacattcaaaacatcaatggaattcatatttacagcttaatgaggaaaaacagtgtcatctcaacagaggcaggggaaacaagctccaagagtttctgtcattgttttgatgagcagccacggaaagcctcaaccctgctctgtcttggctgatgccaaaattactgaagacaaaatgtacggccttgaaaacaccacagagtaactcatctaatataacggcctaatgtttatttcaactaaagtaatacaatcaaaagatttttggaaacgattttggataaaggcaaacatttttccctgaaaggcagtcaagataccccgcatcggccatcggagctttgcctccagggtcttactcgggtgcccatattacacacagggacctgtgtcccctgccccaggtctctcagccttctgaatacaagggctttgccttcttgaggaccacccttaggtgggctgcactcgatacttcataaagctttacacccctcatctcattctggtcttcaccataaccccctcactgtccccattcttcttgacaccaacaccaagctggagacatcatcactcacccgctctggtgagcaggtgattcgctatggaaaagggacctgagacctgggcatgtgcccttgctctgaggacctcagtgtgctctgccagcctgggtgcccgcacccctaggccctactggagtcatcttctgaatcctggaggtgccccggcctgtggacagcaagatgcagaccctgctctcatccatctgccaccccactgccttcaggcagctgcccagctgaggagcaaggctccagaatcctgacagggagggcaacaaggagcaaaagggccttagtcagtggggctgcagcgggcacactcctcaccctaactcctcagcccaatggctgattctttgggttgtttgtttttgttttgagacagagtttcgctcttctagcccaggctggagtgcaatggcgtgatatcagctcactgcaacctccacctacggggttcaagtgattctcctgcctcagcctcccgagtagctgggattacaggcatgtgccgccacgcctggctaactttttatatttttagtagagatgggatttctccatgttggtcaggctggtctcaaactcccgacctcaggtgatccacctgctttggcctcccagagtgctgggattacaggcgtgagccaccgtgcccagccccaacagctgatttttttttttttttttttaaaaacaaaagcaagattctgtacctgctgaagcaggcccagaaaagagctggtggagggcatggtacccagagcagcactgtttggtatgacatggcagccactggtcacaggcagtgccacaagcttggaatgccacaggacaaaatatgtctgatatatattttggtaacaataaaatatattgtcaaaattatttttctatttctttgctattttccatttcttctcactaatttaacatggctactagaaaggtttaaattatgcatgtggcacacgatgtttctactggacagcacagcagcacagggctagcaccggagatcctgcagctcagacgcccatggggtgaacaaaaaccttgcaactctcccaggccagggactgacatattttaaaaccggagattttgattgaggagggagtagagctaccacataagcaaatatgtaatgttgtatgttgtatgtttctttctttctttctttaagaaaaatcccttggcaacaggaagcttaactgcaccaacaaggacagcagaagaaaagcagaatgttagtcaacaagggtcaccctgacccgaaccccagccccagctctctccagctgcacagccctggggagaaaggagaaagagcagagaagcccacccctcacacacccggttagtctcccctgcccactggcaggccctggggcaggcccctagatgggtctgcaaagggacactgcccccttgcattctgcccccccttctacatggctcccccacccacccttctacacggtggcttctgagggcagcccctggaggtgatcatgaccccccatcttgatctgaggattaacagatacaggttcacctggtgaaaatgcaggagctgtaggggtaggacccatcactcatctgactgcatgttgtaattcaatggacagtttactaaagtaatagtcttcttcctgtcctctgctgagcacccatctggccaacggtcctgcgctccctcagggccagcggcccatctcctcctgtgcctcctggagggcttcgcaactgcctccctcctctggggaatcttgccccactgactgacctttcggctctcagatcccaggtccctccctcgcagatacggcaacaggctctcttgggatttcaatcccgccttcccatcagctactcttcaaaacactaactggtattagctccttcagagaactctctggctttccaggcctacaatctccctccctagaatgaaagctcagtgacagaagtgcccttaaacttctgagtgacacgaggccctcagccggccctgaatcaatactggctggatcagtgagtgaataaatgcacatgtgagtaaggaatgaagggagcgaaagaactggattagaagctgcttggggcagagatgtgccttacaggcttcatgaagagtgggtgatgaaaaaggtaaatggagcatctaagaggaagctttgatagaagggagaatgcaagagaggttggaaattggaatccattggaattgggagcctggggagatgccaggacaggcactctctggcctaggactctgcagagggcagcctcagcaggcaagccaggcccccagcttctggggccggtcgcacccattatggccccgaaacggctgggtggtggtctgcagcctgcccagggccggctgggagacaggcagggtccccaccactctcttgcctctgggcaaaagctggcctcctgaccctgggggatggacgggagcaggggccacacaacacactcccaaacatataatcggcctccttcaccctcgcccacgctcagtcacacacagcctcggtcatacacactcacactcactctccggcacactctcagagcatcacataatttcagtgagacacaatcccaaagactaacacggacaacctctgagtctcacacaatctcagggccacacacaggcacacaatcagacgagctcaggaacgcccccgtctctgacacacgcaatctgaggtttacacgcgcgcgcacacgcacacacacagacaccagccggcgctcccgcacgcggctcccccacccccgccacgccacgcccccattgcctgggaactggcggccccgccccgcagcgtttgaggcgccgcaagccttcacgcccctcgggccttgcagatccctctcccagtttccgcggcggtccggtgcggtcagtacctgtctaaaatcaatattgccgaggcctccgcagcagtcaggccctgccaccgagctgttcgttacctcggctcccgggttcccagatctcttcatccgggggccgcctcaggaggcaccacgcgggccccgctgcagccacgcgcccccggaaccggacctatagagccgggtaagtgccgccagtcggggcgctttcccggtgacccccaacatattccggccttctgggaaatgtagttccccgtcaccgcgaagtgcctctttatctgggggctcgcgacagcgtctagaggagccgagaactacaagtcccagtgtgtttcgccgcagagcctgccggttccgctgcagctacgtagcagtatccccttggatccggcctcccgcccagtgcctttggtcgccggctgccgcacccgagcctgtaactgacctggcgtccctgcccttgcctggcggcggtggggctagaggccgggggccgcgggtcgtagctataagcagcttcccgcgcagcctcctgcggacttggacttggcccgggtcacacacgcccagggccccacacgcccagggccccacgccctcttctgaaattcgctttactctgggggcggtgcgcgacgagcactgcctagagcttcccgcccccgcggcgcccaggctctttagctcggccaaagacccctcctccactcattttttccttcattcattctctcattcactctcgagtattttctgaaccagactgtgcgctgagggtacggtagggaacaacacagagtcccccgccctcgcttcctcctgactgagataaaagacaaaatgtgaataaagggttataatatggatgagtactgtggtggaaaaaacggggtgggtcaaatggtacggaaggatgctgtcttagaatgtgcaggggaggtgccagatgtgccaagtgtgagggcagggcaaacaaggcaagacgaatggtatgtacaaaggcctggagacaggacgggcacctaaggaacagagaaaagaccggtgagctgtggagtagtgatggagggggtcaaatggagaagagtttagacgatcgggtcccagaagaaccccttttgtaggccgggtgtggtggctcatgcctgtaatcccagcactttgggaggccgaggtgggcggatcaccagaggtcggcagttcgagaccagcgtgactaacacggtgaaaccccgtctctattaaaaatacaaaaaatagccgggtgtggtgcgcgcacctgtaatcccagctactcaggaggctgaggcaggagaatcgcttgaacccaggaggtggaggttgcagtgagcggagatggtgccattgcatgccagcctgcgcgacagagcgagactccctctcaaaaaagaaaaaagcccttttgtagccaggtgttatgtaatatggggaaatagactgagaggttccaagatttgctcagtcacccagactgctgggggcccagacaggacttctgcagtcagctgcttcctgctccagatggcccgtttctctccaccttggcccacagcacctaccagtgttgagcatttactgagcagccactgtgtgctgctttagaggtagtcccaatcttcacaacatcgctaggatggggcaggccaaccgaggagacaggaaagacactggctttggagcatgcactatctctgtgactgagcccaccttcattttcctcaaaagtaaaagggaaatacatgttggtaaaactcatcacccaggaactggcctgtgggaagtgctcagtaggcattggcccccggcagggctggggacacaggctcagggctggttctctgacttaccactgttactaatgagtgtcgggaccctttccctgctcagtgtccaggcagagctgctagaggcagagccatttctgaaggagccccccgcagcgggagggcttctagcaagtctttcccctccgcctaccacacatccacttcactgatgttccagtcttctgacctaactggtcactcctgttttgttaagcccagaaaacaaatttttgtgcgtttgctttatctgagaacaaagtaaggcaaccgtaagaggtcacaccagaactgatgcagtccgatcctctactccagcctacccaacctgggccacccttcctctgtgaaaagcaaacaccccacccaggagacagacttgcagcttgaaacaagtcagataaaaacctcctgcctggctcacacctggaatcccagcactttgggaggccgaggcaggcggatcatgaggtcaggagttcaagaccagcctgaccaacacagtgaaaccccgtctccactaaaaatacaaaaattagctaggcatggtggtgcacacttgtaatcccagctactcaggaggctgagtcaggagaattgcttgaacccaggaggtggaggctgcagtgagccgagatcgcgccactgcactccagcctgggccaggctgggcatggtggctcacgcctggaatcccagcactttgggaggccaaggcgggcagatcacgaggtcaggagttcgagaccagcctggccagcatggtgaaaccccgtctctactaaaaatacaaaaattagccaggcatggtggtgcacacctgtgatcctagctactaaggaggctgaggcaggagaatcacttgaacctgggaggtggaggttgcagtgagccgagattgcaccactgcactccagcctgggcgacagagattccatctaaaaaaataaaaataaaaaaccctgccaaagatactttggggcacaagtacttgcctgagcctttcaaaagttcccaagtctgagagcttgtagagaaattatccaggccaacctccctcactgaaacattccttctgtggcatcttgggcaaatggaaaagttggttctgcttacgtgccgccagtgatgagaggttccccacctcttgaggtcgcccgctccactgatggacaggggtccattaacccaaagtcatgatacccattaacccaaagtcacccttcctgaagctttaacaaacaaaagttcctttctaccttcagggttatctctctttgccccttgattgagctcttcagatataggaaaccatttatcatggaacagctcccagggcaaacctcctgatggcctctcttttctctaaccccacctccctggctcctgaattatgaatcaggctgcagaaactcccagcaatcattaaaatggggttttagtgctaaaattaacatgtgtttattgggtgcctttgggtaaaacctaaacctttccctactctgaatctattttctgttcataaaacataataatatttatatcatagaatatctcttgagtataatatctcgagtgaggctgttgtgaggattagaggtaataactcgtacaaaagtgcctggcatacagtgggttctaagaaaatgtccaggccaggcgcagtggttcatgcctgtaatctcagcactctgggaggccaaggcaggcagattgcatgagcccaggaattcgagacaagcctgggcaacatggcaaaaccccatctctacaaaaaaaaataccaaaaaaaaattagccgggtgtggtgcacgtgcctgtactcccagctactcgggaaactaaagcggcaggatcacttgagcccaggagagagagacttcagggagctgtgattgtgccactgtactccagcctaagtgacgagagtgagaccctgtctccaaaaaaaaagaaagaaaaaaatgtttctctcctttctatataattgagatctggtggttaaggtcacactcatggacatgctgctgggatttaggacaccactgggggccaggagagctggctgacagctcagggacctgccagagttcctgggaggagatgggtgggcaggggccaggatgggtggccagagctgctccccagacagcaggtactgcaggttatcagaaaccatattgtcactgggagtgctttaaaaccaggaaggtggtgaggggctgtggccgcaatgcccagcacccacttcatagactcaggcctgattgccctcattctacccctggtggctccaggaacaagagggtagccagggtgggaactggggcaggggagaggtcatctggagatgtgtgccctgatcacgagttccctccccactcccatctgccctgagctttggaagaagccccttccccaaggacctactacttgctgggaagagggcacgggagtgaagttacctgaacccagttgtccacagcctaggccagcctgggaaacaccagcaaggatgttggtgctggcagggcctcactgcccctcagtgtccacagtgtccacagagcacaaacccctgccttccagctggcctccagaggtcctaaacaccccaggtatacacccaccacagggcattttcatgtgctatgtcctccgcctgggttgctcttccccgcatttcctcccagtaccctcctcacctcctctgggttctgctcaagttccacctctccaccctgttgaacatgctgacttccccatgctcgccatgggcctctcccaactttatttctctccattggccatatcatttaacaaatgtatttagtgcacttatttattttgtatagtgtcattccctgtccatcccctatcccctataaggggaacttcaccagggcagagattttttgtttgtttgttttttgagacggagtcttgctctgtcgcccaggctagagtgcagtgacgtgatctcggctcactgcaacctctgcctcccgggttccagcaattgtcctgcctcagcctctggagtagctgggactacaggtgcgcaccaccacacccagctaatttttctattttttagtagagacagggtttcactatattggccaggctggtctcaaactcctgacatcaggtgatccacctgcctcagcctcccaaagtgctgggattacaggcataagccaccacccctggcttttttttttttttttaagagacccctgggtttaaaatcctgggcccaagcgatcctcctgactcagtctccggaatagctgagactacaagtgcatgccaccatgcccggctaagggcagggatgtcttttttttgagatggaatctcactctgtcacccaggctggagtgcagtggcatgatctcagctcactgcaacctcccctccaccccgggttcaagtgattctcctgcctcagcctcccaagtagctgggattacacgtacacaccaccatgccctgctaatttttttgtacttttagtagagatgaggttttgccatgttggccaggctggtctcgaactcctgacttcaggtgatccgcccgccttggcctcccaaagtgctgggattacaggcatgagccaccatgcccagtcctgagggcagggatttctatctgtttgtacacagccctgtcctgggcacctagctctggcacaaagcaggcattgaatatacaatgagtgaatgaatactgtagctctgccactctgagttgggtgatcttgggaaagccacttttctgggcctcagtgaccgtgtctgtggaatggggagggtgaccaagtctgttacctaaataagagaccaaacccacctattaagattgaagttcggccggttgtggtggctcacgcctgtaatcccagcactttgggaggccaagacgggtggatcacctaaggtcaggagtttgagaccagcctggccaacatggtgaaactccgtctctactaaaaatacaaaattagccagatttgatggggggcacctgtaatcccagctactaagggaggctgaggtgggagaatcacttgaacctgggaggcgaaggttgcggtgagctgagaccataccattgcactccagcctgagcaataaaagcgaaactctgtctcaaaaaaaaaaaaagattaaagttcctggctgggtgtggtggctcacgcctataatcccaacattttgggaggccaagatgggtggattgcttgagcttagtagttcaagaccagcctgggaaacatggtgaagtcctgtctctacgaaaaaaaaaaaaaattagccaggcatggtggcgtgcacctgtagtcccagctactcaagaggctgaggtgggaggatcacttgagcccgggaagttgaggcagcagtgagccatgatggctcactacactccagcctgggcagcagagtgagaccctgtctcggaaaacaaaacaaaacaaaacaaacaaaaaaacaaaaaaaaaacctaaacatggaaacaatagctaatctgtctgagctcttgctggctgcaggccctgagctcagcacttgaagcacacattttctttaagcctcacaagagccctgtgaggtagggaatgttattctgactttccagatgaggtaattgactcatgtggaaggtactggcccacagtcacacagctgagtgtcagagttgaaacctgtggtctgatgaaggcaaaacattcttccttacaatggccctgaggtcctggatggtccgggcccaatccaccttcccagctcttcttgccctctgtactccagccacactggcctctttgaggttccttccagccacagggcctttgcacctcctgttcactctgccaggcacactcttcccttctcttcttggagatcaagaatggtcccctcatcgtctgccctgcccacctccacatcccctgccagcagccagtacacacctggcacccagatggcactgggtgaatatttgctgaatgaaggaggtcagaattgaatttaagtcccatgaaaatatacttcaaaaatgaaggtggccgggcgcagtggctcacctgtaatcccagcactttgggaggctgaggtgggcgaatcacgaggtcaggagatggagaccatcctggccaacatgatgaaacccatctctactaaaaatacaaaaaaattagctgggtgtggtggcatgcacctgtagtcccagctacttgggaggctgaggcaggagaatcacttgagcctgggaggcagaggttgcagctgagattgcgccactgcactccagactggtgacagatcaagactccgcctcaaaaaaaaaaaaaaaaaaaaaaggaggcaaaaaggctgggcacggtggcttatgcctgtaatcgtagcactttgggaggctgaggcgggcggatcacctgaggtcaggagttcgagactagcctggccaacatggagaaaccccatctctactaaaaatacaaaaattagtggggtatgatggtgcatgcctgtaatcccagctacttgggaggctgaggcaggagaatcacttgaacccaggaggcagagattgcagtaggccgagatcgtgccactacactacagcctgggtagcagagcaagactctgtctcaaaaaaaaaaaaaaaaaaaaaaaaagcagaggcaacgtaaagctattttcagacaaacaaaggctgagagaattgatcaccagcaggcccaacctgaaaagaaataccatgggcgggttctgcaggcagcaggaaaatgatcccagttggaagcccacgaacacaggaaggaatgaaaaagacacatacgtgtaggtaaatctagataagtattaggtgcttgtaaaaataaaataatcttgtggagtttaaaatatttaccttggtaattgagagaaaaggcagaaaaaaatcggtaagactatagatttgaacatgattggcattcatagaactctcctcctagcaactgtagaatgtaccttcttccccagttcacactgaacattggccaaaacagaccctatgctggggcataaagccaatctcaacagatttcaaatgattgaaatcatagtttatgctcttttttttttttgagacggagtttcgctctttttgcccaggctggagtgcattctcggctcacagcaacctccgcctcctgggttcaagccattctcctgcctcagcctccggagttgctgggactacaggcatgtgccaccacgcctggctaattttgtatttttagtagagtctctcgagtagctggtgggggccaccacaccgggctaatttttgtatttttaggtgagctggggtttcaccatgttggccatgttggtctcgatcttctgacctcaggtgatcggccaacctcagcttcccaaagtgcagggattacgggcatgagccaccgcgcccgtcctgccttcaagtcttgaatgctgctctttccccccttcctgtgcacacccctgtggagcagttttccactctgtggtaatggcctgcttatgccctagccgcttctgagccgccacggcagggactgcttgttattgtttattcgcacagcactctgtctgtccgagtagcactaagttggcactcaatgcttcatgcctcctcctgaccccagccctctatctgtgagattaaatgggaaatgctatcttctcatacagtctggtcacctgcccctcccctggccactgttgcttgagtagagttggtcacctgacccaccctgagccagtgatagcaccccaagccctggcccccattgctggtccatggatgacacctgacccaggctggaccttgtttctggggttgaaaaaaatgtattgtctggcccgtcgtggtggctcacacttataatcccaacactgtgggaggctgaggagtatggattgcttgagtccaggagttcaagaccagcctggacaacatggtaaaactccatctccacaaaaaatacaaaaaaatttagccaggcattgtggcaagtgcctgtagtcccagctacttgggaggctgaggtgggaggatcagttgaactcgggaggtcgaggctgcggtgatccatgattgtgccactgcaccccagcctgggcaacagacaccctgtctcaaaaaaaagaaaaagtattgtctagtttgcaaatattggaagattttttttaaagttatcatcttgttttccagtttaatcccactatgtttaagagcataggccgggcgcggtggctcacgcctgtaatcccagcactttgggaggccgaggcgggcagatcacctgaggtccagagttcaagaccaacatggccaacatggtgaaaccccagctcaactaaaaatacaaaaattagcccggtgtggtggcccccaccagctactcgagagactaaggcaggagaatcacttgaacccgggaggcggaggttgcagtcagccgagatcataccactgcactccaggctgggtgacagagtgagactccatctcaaaaaacaaaacaaaacaacaaaaaagacctgaggccgggtgcagtggctcacgcctgtcatcccagcactttgagaggccaaggcgggcagatcactgaagtcgggagttcgagaccagcctaaccaacatggagaaaccctgtctctactaaaaatacaaaattagccaggcgtgatggcgcacgcctgggaggctgaggcaggagaattgctacaacccaggaggcagaggttgcggtgagcagagatcgcgccattgcactccagcctgggcaacaacagtgaaactccatctcaaaaaaaaaaaagacttgaaggcagccctgattagagctaaggatggggtagggcctcaccaaaaactctttccttccagtggcacatggatctgcttaatgttgaagtcttgtttaggattaatccctcagggttgaccctggaagcacagaaggacagccaagctgctttctaaagctcagtgcctgcagaatagtacagttcccatttccctgcatactcaccagcacagagtattagtccaaaaatgtttatgttacttcaaagttgaaaaattagttgaaaaatgttatttgcctctttcccacatcattagtgacgttttcgcatgtgcttttcatttaaattagaatagtgctttatttgcactacttaccaacacaacttctctttgtgcctttttttcaaaaacacccatggatcttaagggccgggctcggtggctcacgcctgtaatcc

SEQ ID NO: 1161 - DNA, 30850 bp, Homo sapiens
gggtctgggaagggggtgggtgagcacaccgtcattcctgcctcttccccatcccccatagcctgaagggtagaggaaggccaggaaggacttcaacccaattcggatcccgtttctcccccgtgccccccccaccccccgccatggcacctccttgcttttaggataaactcaactcctggtgacctacatgaccaagctgggtccagatgttgtcacctcatctccctccacctaatccatcactttctgagctccagcctccctggccttgttttattttatcctatttatttatttatttatttatttgagacagagtcttgtttagtgcggtggctggatctcagctcactgcaacctctgccttccaggttcaagtgattttccttcctcagcctcccaagtagctgggatcacaggtgcccaccaccatgcctggctaattttctaatttttatatttttagtagaggtggggtttcaccatgttggccaggctggtcttgaactcctgatcccaagtgatccacccgcctcagcctcaccaaagtgtgggattacaggtgtgagccaccgtgcccagccctatttatttatttatttatttattgagatggagtcttgcccttttgcccaggcaggagtgcagtggcacaatcttggctcactgcaatgtccacctcccaggtttaagcgattcttctgcctcagcctcctgagtaactgggattacaggcattcgccaccatgcctggctaattttgtattttaagtagagatgggatttcaccacgttggccaggctggtcttgaactcctgacctcaaatgttccacctgcctctgcctcccaaactgtgggattacaggtgtgagccaccgcacccagccctatttatttttgagacacaatcttgctctgttgcccaggctggagtgcagtggcatgatctctgtgcactgcagcctcaacttcccaggctcaagcaatcctcccactcagcctccccagtaggtgggactacaggtgcccgccaccatgcctagctaatttttgtattttttgtagaaatggggtctcactatgttgcccaggctggtctcgaactcctagactcaagcagtctgcccactttggcctcccaaagtgctgggagccacttcacccagccctcttggccttgttttagttgcttctttcggcctcttggcctttgcacttgttgttccttctgcctggaatgctttttccacccccctgttggcctagttaacttccatccacccttcagatctcagctcaagggtaccttccctaaccctcccagaccagttgattgacttagctcccattttagagttattgtgtcagactttgcccccaccctggctctgtgctagatcattcaatgtccccagcatcaactgatgtggggcagaacacagaggccacagggggtgtttggtgtagattggaatgatatgcaggaggtggaggaggaggggccagtgttgaaccccagcccctccagcctctcatacacccttacccatcccggggctccaacctggcctttttcttctctttcagcctcttgagcaacccctgtggggaagggaatgtcagctggacagaaatctgtgctccttcctcagctccttccctcccaagacatcccagaggatctactggtcttggaggaccaacaccaagctcaggctgtattagcaggaataataagagcaatcagcagctcctaattctttgttcatttgtttttttaagacagggtctcgtgctgtcgcccaggctggagtacagtggtgcgatcatggctcactgcagcctcaaatttctgggctcaagtgatcctcttgcctcagctgggactacaggtgaatgttaccatgtagaattggggacttgctatgttgcccaggctggtcttgaactcctggtctcaagcaatccttctgcttcagcctcccaaaatgttgggattacaggtgtgaaccactgtgcctggcccaaactcccatttgtaaagcatcaatcatatattctcctatactattcatttatttatttaagagatgaagtctccccatgttgcttaggctggtgttgaactcctggcctcaagcagtgctctctgctcagcctcccgagtagcttggactatagctgcgcactgccctgcctggctcctgcactctctattggcttcccataaacaacccctagagaaaggttatttcattagcttcatttgacagactgggactctgaggcccaaagagggtcagcaacctgctccagatcacccagcaagagtgccctttcagctttgagggtccgagagtcttggctctcccctctacctcccaccttcactggctgccttacccgaacgttgtggacctggttgggaccagcagtctccggttctgtttttccaggcatccgatctgtgggtcgttatgggtggcaggttggggggttggattctgccccacttttagagcctcccaaatgccccaggcctttccacccctcaagcttacctggatccctgaagttccccatggccacgtggatgctgccctcggagctagcacttcccacccggggccttcgaggaccctgttctcccgcaggagtgggtagtcagagaggggaggcaggcaggcaggcaggcaggcagaccgagggagaggcagacaccttcccattatcctccctccagcccctgcctctgttctgccctcctcctttttctttcttccctcctcccctttcccaggtgccccctctcacctcctcctctcctccaagcagcaccagcttcccatcaagcagggtgaagcccccaatgtcccagacaggcacgttgggtgtgggggcctcagggatctgtggggtagggggctccagctctggctccggctccagctctgggaagaagaggaggcactgggggacttaagagacgttttctctccctcaggctaccctttccattcccgaaggctcatggtgggttccctcctaggtgccccccaccccagcagccgtatcagactgtatgaccttgggcaagctttcatcgctgtctgggccttgtccccactaaccatgggtagcagacacaactcacctaccatgtgcccagtaccctgtataccactccacacaccttcttgcattgaatcctccaaaagccattcaaagggctatgataacaggctcagagaggttgagtgacttgctcagggtcacacagtttgtgagtggttgggctgggcttcagtcacaagcattcttctctctctctctttttttgtttttttgttttttttgcattcttctcttaaccaagacattatgtgggtccaagaggttaaaaaacaggacaggggctgggcaaggtggctcatgcctgtaatcccaacatttgggaggccgaggtggggcagattgcttgagaccaggagtttgagaccagcctgggcaacataacaagaccctgtctttaaaaaatagcctgatgtgcctgggctctgtggctcacacctgtaatcctagcactttgggaggcctaggcgggtggatcatctgaggctgggagttcaaaaccagcctgaccaacatggagaaaccccgtctctactaaaaatacaaaattagccaggcgtggtggcacatgcctgtaatcccagttactcaggaggctgaggcaggagaatctcttgaacttgggaggcagaggttgcagtgagctgagattccgccactgcactccagcctgggcaaggaagtgagactgtgtctcaaaacaaaaacaaaaacaaaaacaaaatgggaatataagcagtgagaattaaatgagcttccaggaaataggagggctgaattagccctcccagattgcctgtctgttcccttgtttttaccaccaggagcaataaatgataactcccgcttattaacggatcacttaaaatatgttgggcctggggccgggcgcggtggctcacgcctgtaatcccagcactttgggaggctgaggcgggcggatcatgaggtcaggagatcgagaccattctggttaacacagtgaaaccctgtctctactagaaatacaacaattagctgggcatggtggcgggttcctgtagtcccagctgctcaggaggctgaggcaggagaatggcgtgaacccaggaggcggagcttgcggtgagccgagatcgcgccactgcactccagcctgggcaacagagcgagactccatctcaaaaaaaaaataaaaaaaatgctgggccctaggctagtgttacattcctgagccctaattcttgtgatatccattactcttctagatccccctgtgtgacacttagcaccatctgtcattttttttctttcttttttttttttttcttccattgagatggagtctccctctgtcgcccaggcgggagtgcagtagtgcaatctcagctcactgcaacctccacctcccgggttcaagcgattatcctgcctcagcctcctgagtagctgggagtacaggtatgtgccaccatgcctagatacttttttttttttgtatttttagtagaaacagggttttgccatgttggccaggctggtctcgaactcctgagctcaggtgatccacccaccttggcctcccaaagtgctgggattacaggtgtgagccatcatgcctggcccatctgtcattttcttgttgatggatttcctgtcaattccactacactgtgagctccatggggcagggagggtcatctgtctctttcactagtgtgtcctcagtgcctaaatcagggcctggcacatacaatagaagctcaacaaacctctgcttgaataaatgaatgaatatgagcaaataaaattatatactctccaaaatggagatcattattctcactgaactgatggagaggctgaggcttaagggctcagaacaaagacacggaagctagaaggtaggagagtaggaggcaggctgaagatggatatccaggtaggaaaggatgggcctgagccattgaaggagagacccgttggggccaagagccgtttagcctctggacaatactatcacgggtttacattcactgttccttcctcagatggaccctctgcccacaggaccccggcaactcctcctaccctctttagggggaaagagggaacagggtagctgggccccagcggcttcctgctgggcttttgcactccccacaacttcctgtgtctgtatggttgatgctccggaggcagacaaaacccaagcatccggcttcccagcccggcccaagctcagggtgggggaaccatgtacctggggcctcctgctccggctccgggtctggctccggcggtgggttcttatgcctcccccagagggccttggagagtcgaaggcgactggtccgtgactccttgggaggcgcagataggacccgacggaatatcgagcgaggggctggctgggtgctgaccatgggctcctggtggctcagggccctgccccagccagcaaagcggccccagcggaaccctccagccgccttctccccaccgccccctgtgtgccagcggtaggaagtcagcggagaggtggctgtgggctgggtttgggaggtccggcttggcgacggtgggtccatggttgggggggggggtctcctgggggacgagagagtgacagtagtgcccagtgtctgtccacatactgccctcatctcggccccctccccaccctcagctctgcctccaggaatccccctgcccccacctccactccctcccttaccttggtttcctgaccagccccagaatcagcagccgtctgcaccccgcctggcttcctccctcggaacccaactccacgtgaccctctctgtcccaccccaccccacagccaggctgggagggcacagtgcgggcaggttgctggaggttcgagggaggagaagagaggaggtgggttaccaggcttctagcaagaaggacccagactgcctccctgacggggaggcagcacttgcccctctctctgagcctccgttgccttctctgcaaaatgagtacaggctgaacaaatgctggcgagaatacaaagcacctagaactctaatccacagttggccggagtgtagacccattcactcatgttgggaaacggtttggcaggatctactaacactactagctggatcttctctgactcagcaattccattgctaggtagacgtccaatagatatgcccccccagcacaatgcataatagccccacattggaagcagcctaagtacccattagtgggagaaggaataaattgtgatctcttcgcacagcagaatatcatacagcagtgagaacaaactaaagaatgatttaacttgggtgaatcacaaacaatgttgagccaaaaccaaaaccaaagccataaaatgccagtaatctgagctattcaggaggctgagggaggaggatcgcttgaggccaggagttcgaggctgcagtgagctgtgatcatgcctgtgaataggcagtgcactccagtctgggtgacatagggagacctcatatctaacttttttttttctttttcccctccctgccctcgggagaccccatctctaaaaagcaataataaataaatttaaaaaccccaaaacaatgaagagtatacactttgtgattccatttacataaagtcctaaagcaggcaaaaccatgtctaacaagcagggtatcagtttcttttggaggcactggtggctgggaagagggtacaaggggggcttctggaagatggcaagatttattattactcttattattattaattgatttatttatcgagaaggagtttcgctctgtctcccaggctggtgtgcagtggcacgatcttggctcactgcaatctctgcctcccggattcaagtgattctccctactcagcctcctgagtagctgggactacaggtattcaccaccatgcctgcctaatttttttgtatttttagtagagacggggtttcaccatgttggtcaggctggtcttgaactcctgacctgaaatgatctgcccgccttggcctcccaaagtgctggtattataggcgtaagccaccgtgcccggcccttattattattattatttataaatgaggtctataaaaataatatagatctcataaaataaaaatataatatttatattacatagtaatataaataatattacattatacataatatgaatattattattttttgtagatgaggtctgtcatccaggctggagtgcagtggtgccatcatagctctctgtaacctctaactcctgggctcaagagatcctctcgccttagcctcctgagtagctgggactacagctgcatgccaccacacctggcttattaaaaacaatttttttgttgttgttgagatgagggtcttgctttgttgcccaggctgttcttgaactcctggcctcaagtgatcctcccacctcagccccctaagtagctgggataataggcacatgctaccatgcctggcctattttttttttaattgaggtaaaattcatataacacaaatttagcatgttcttttttttttaataagatttttttttgagacagggtcttgctctgttggccaagctggagtgcagtggcacaatcacagctcactgcattctcaacctcctgggctcaagcgatcctcctacctcaggctctcgagtagctgggactacaggtgcatgctacctgactaatttttaactttttgtttgtttgttttttgtagagatggggcctcactatgttgcccatgcttgtcttgaactcctgggctcaagcaatcctcatgcctcagcctcccaaagtgctgggaatacaggaatagcatcagcctctgtgcccagagagacgaagccttgttctgtcacccaggcaggagtacagtggctattcccaggcatgattgtgggtcactgcaaccttgaattcctgggctcaggcaatcctcctgcctcagcctcctgagtagctgggactgcaggtgcatgccaccatgcctggctaattttaatttttttttttttgtaaagagacagggtctcactatgttgcccaggctggtctcctactcctgggctcaggcagtcctcctgcttcagcctctgtagtggctgggactgcagatgtgtgccaccacgcttggcttaacatgttctatttcttgagctgggtcctggttacatggctgtgtgctgttgtgaaaattcatcaagctgtgcccttgggagcactttcttgtatctctgttaggcttccacagatgtttacttgaaagccagaggtaagtaaatgccattctgaggaataaatgagtcagcataaatccggtccaggagccgagtaccagctggcccctctccctctgtgtgacctcagacaagtcatttcctctctctgagcctcgttttccttatttgtacaagacgataatatcagtttcaaaagattcatgtaagcctttgtctagtcaacaaatgtttcccgagtgcctattacatgctaggtgctggagaggccgcagagaactaaccaaacttggtttctgccttcctggagctcacagatgatggaggtagataagatcctaaactcatacatgagacatttctagctggtaaggaggacctagaaggaaataggctgcagtgaatgctgagcaaaaatgccactctttgagctggaaaaatcagggaggacttccctgaggaggtgacatttgcagccatttgtatctagcagatggagtccactatgtctgtgtaacaagcattccaaaagtgccagtgaattaacatgtccctgagagcagccctcacataataactggtgggaattagtgtataaataccccagctccctcaacccttgtgtgggatgactcaggtatgtgtcctatgctctccctcagggcttcgaagtgagactgagctctcttgcctacagtggaaacttgcttgaaaacacattattccctggctgcctccagttccctgcatcggtacctgggttgttcacctctctattttttctttttctttttttttttttccttccttccttccttccttccttccttccttccttccttccttccttccttcctcccttcctccctttctcccttctttcctctttctttcgttctttctttcttcctttctttctttttttttctttgagacaagctctcactctcttctccaggctgctgtacagtgacgcaatcatggttcactgcagcctcgacctcccagcccaagcaatcctcccacctcagcctccggagtagctgggactgcaggcacacaacattgtacctggataattttttctttttttgagacagggtcttgctctgtctcccaggctggagtgcagtggtgtgatttcagctcacggcaacctctgcctcctaggcccaagtgatcctcctacctcaagtgtgtggcaccactcctggctaattttttgtatttttgttagagacggggttttgtcatgttggccaggctggtcttgaactcctgagctcaggcgatccaccctcctcagcatcccaaaatgctgggattacaggcatgagccaccgtgcctggctatgcctggataatttgaaaatttttttttgcagagatgagatttcactctattgcccaggttgttttcgaactcctgagctcaggtgatcccctcgcctcagcctcccaaagtgctgggattacagatgtgagctgccgtgccctgccctgggatctcctctcaataaactacttgtactggaattattgtcttaaggtctgcttttgggaagacccaaactaagacaatgcatgatgatgcatgaacagagactttgtttccatgctgtctttattggaggtctgtggctggcagggtccttgggggtggctccctcctggatctcttagagacactcctggcaggtcttggcttaacagtctggaaaaagacaagggagtgtgaggcttgggggtggttgtggtatgtggctgggtctgccctcctggtggtggaaccctggatcagggaggggacagtggcccaaagtgagagagtgaggacaaagccaactataggccgagatggatgtgctagtcaatagcttaatgaaatggagtggcagtatgtaggtagcacgagattgtccaggtgtgattctaaaattgttttagtgatggcgatcaagggctgggatgaggtcatcaggtcaaagttgtgctggcataagagttgtcatcaggggttaaggagtcagggacgaaacaagcaacctcagagttgagattgtctggacagagaattgcaacacaggattaaggactggacagaggttgtgaaggcaaaaggtcacagcctaggttcatgttgtgtggacagagggccttcgggtaggggcaggggtgaggtcaaggttcggcgggccaggatgaggtggtgcagcctgacaggttgtgacttgggtagagaagtcatgaaggccaggctgaggttgtgagggcagaggggctgttggcaggtgtcagggtccatgccttggctggaaaggtagaggtattaggagctggggaaaggacaggctggctgggtctggggctgagctgaggctgcataggcagaagtcacaggatcagggatgttgcccgcagagtgacccgcaaaggctgggcctaggtttcctgaatagacgtgccgccgggaagttgggggcctggctgaggctgtgcgggcacagctgttacaggcagggggcaggggcctcgtggagcttgtgtagacggaggggcggcgggccgtgtagtgcaggctgcgaagactcaccgcggtgaagtgcggccaggtgcgcagcaggtcgaagagcgcgtcgccggggcagtcggtgcgcaccagctggcggtggcccagcagcgcgtagtctggccgcaggaggccggcgcgcaccgcacaactcgggagcgtgtcgcgcaccgtgcgcagagcggcctcggtgggcagcgccgcggtgtagttgcccactatggccacgccgaagccccgggagttgtggccgagcgtgtgggcgcccacccagtgccagccgcgtccctcgtacacgtagccgtccgagcccaccacgaaactgcagaggggagggagaagcaagcaccatgcggcgtgagggggacccgggcccttatccgctcccctccccgattctgttggtgtgccaagggccaccgaccccaagacccgcgcggtcgcgctgcctgtgtcccatccagctctgttccactctcacaccagctgccactccaggaccgttcggtttctctggatccgcccttcagtactggcacgcccctttctgcccttctcctccccacctctgccttttctcaagcccagttcttgcccaattcagagagcttttctgtttttgggttttttttctttccttccttccttccttccttccttccttccttccttccttccttccttccttctttctttctttctttttttgatggagtttcactcttgtcgctgaggctgaagtgcaagggcgcgatctcggctcactgccacctccacctcccgggttcaagcgattctcctgcctcagcctccggagtagctgggattacaggcacccgccaccacgcccatctaattttttttttaatttttatttttagtagagacggtgtttcgccatgttggccaggctggtctcgaactcctgacctcaggttatctgccctcctcggcctcccaaagtgctgggattacaggcgtgagccactgtgcccagccttctcccctcccctcgccacccctcccttcttcccttcccttcccttcccttttggagacggagtttcgctcttgtagcccaggctggagtgcaacgacgcgatctcggctcactgcaacctccgcttcccaggttcaagtgattctcccgtctcagcctcccgactagctgggattacaggcatgcaccaccacgcccggctaattttgtatttttagtagagacggggtttctccatgttggccaggctggtctggaactcccgacctcaggtgatccacccgcctcagcctcccaaagtgctgggattacaggcgttagccaccgctcccggcctccttcttcttttcgagacgggttctcgctctgtcactcaggctagagtgcagagatgcgatcataactcactcaagcctcgaactcctgggctccagcgatcctcccaccttagcctgccgagtagctgggactacaggcgcgcaacaccatgcccagctttttttttttttttttttttttttttgagacggagtctcgctctgtcgcccaggctggagtgcaatggcgcgatctcggctcactgcaggctccgccttccgggttcacgccattctcctgcctcagcctcccaagtagctgggactacaggcacccgccatcacgcctggctaatttttttgtattttttagtagagacggggtttcaccgtgttagccaggatggtctcaatcttctgacctcgtgatcctcccgcctcggcctcccaaagtgctgggattacaggcgtgagccactgcgcctggcctttttaagttttttttgtttgtagagatgggtggtgtgggggggtgtcttcctatattgctcaggctggtctcgaactcctgggctccagcgatcctctcttctcagcctcccaaagtggtgagattacaggcgggagccaccgcaccaggcctccttgtctgttttaggccatctctgcctggccccagacccagactctgccacaggtcccgctcctctcccagatcccgcctcctgtactagttctctaccctgactggagtcccatgatttagctattcccggtccctattaaggccccgcccctagcctaagccacgccacctctccaactttgctctacctatcaggactcctccttggtcttgccagctttcctcgggttcaagcccggtcccctgcatcaggctccgcccactcagaccccatccccgaacgtgggccccgccccctccccggtcgggcccctcctacctgtagccgatgtctccccagccttgcgtgtcctggtggtagcgctgcatggagcgcatgttggctgcgcagcgcgtgaagtccgtgcagggtggtgcaggcacgtaggtgtgatgcacgtacaagaatcccagcggcagctgcagcagcttcgggcggccccgataaggcgccgctccccagcggcagcgggggtggatggccgggcatcctacaggcaagggggttgaaggctggggtcaggaactgtttctctgcctgttcctccacccgcattaaagcgcacatacagaccatccctcagcctcctctcagatttggaaagggtccagtctcaccccacattggtcctccctggggaccaactaactatactcaactaaatctattttatttttattaaaaaaaattgggggtgggccggacgtagtgggtctcacctgtagtcccagcagtttgggaggacgaggtgggtggatcacttgaggtcaggagtttgagaccagcctggccaacatggtgaaacccggtctctactaaaaatacaaaaatcaaccaggcatggtggcacatgcctgtaatcccagctacttgggaagctgaggcatgagacaacttgcttgagcctgggaggtggaggttgcagtgagccgagattgtgctattgcacaccagcctgggtgacagagcaagactctgtcccccccaaaaaaaaattggaggtgggggcaggcatggtggctcactcctgtaatcaatcccacactttgggaggcgaggtgggtggattgcttgagcccaggagttcaagaccagcctgggcaacatagtgagacctcattttctagaaaaagagaaatcagatttcccaaagcaatctacagattcaatgcaatctctatcaaaatatcaaagtcatttttcacagaattagacaaaactatcctgaaattcgcaaggaaccaaaaatgagcccaaatagcaaaagcaattctaagcaaaacgagcctggtatcacattacctgacttcaaattatactacaatactatagtaaccaaaacagcatggtactgttacaaaaatagacacatagaccaatggaatgaaatagagaacccagaagtaaagctgcacacctacaaacaataattttcaactaagtcgacaaaaataagcaatgggaaaaggactgcctattcagtaaatggtgctaatggtgctgggacaactggccaaccatatgcagaagaatgaaactggacccctaactcttaccatatacaaaaattaactcaaggacagatgcgctagctcacgcctgtaatcccagcaattttggaggctgaggtgggtggatcacctgagatcaagagtttgagaccagcctggccaacatggtgaaaccccgtctctactaaaaatacaaaaattagccgggcatggtggtaggtacctgtaatcccagctatgtgggaggctgaggcaggagaatcgcttgaacccaggaggcagaggttgcagtgagctgagatcacatctttgcactccagcctgggcaacagagcaaaaactctgtctcaaaaaaaaaaaaaaaaaaaaaaaaaaaaaaaaaaaaaaattgctcaagatagattaaagacttacatgtaagacctgaaactctaaaataccagaagaaaacctaaggaaaacgcttctgaacattgggctaggcaaagaattcatgactaagacctcaaaagcacagagcaaaagaaacaaagtagacaaatgggacttaattaaaccaaaaagcttctgcacaccaaagatataatcaacagaacgaacagacaaccttcagaatgggagaaaatatttgcaaactatgcactggtatgggactaatacccagaatttacaaggaactcaaacaattcaagaaagaaaagaaagaaagaaagaaagaaaaagaaagaaagaaagaaaaagaaagaaagaaagaaacccactaaaaagcgggcaaaagacattaatagacatttttcaaaagaagatatacacatggccaataggcaaaggaaaacatgctcaacatcaccaatcatcagagaaatgcaaattaaaaccacaatgagatatcatcttactctaatcagaatagctattattaaaaagacagaaaagccgggtgatggctcacgactgtaaccccagcactttgggaggctgaggtgggtggatcacctgaggttaggagtttgagaccagcctgggccaacatggtgaaactctgtctctactaaaaatacaaaaattagccgagcatggtggcaggcacctgtaatcccagctacttaggaggctgaggcaggagaaacgcttgaacccaggaagtggaggttgcagtgagccgagattgtgccattgcactccagcctgggagacaagagtgaaactctgtctaaaaacaaaacaaaacaaaacaaaacaaaaaaaataataataaattggaactatcattcaatccagcaatcccactactggatatctacccaaaggaaaataaatcattatattaaaaagatacctgcattcacatgttgatcagggcactattcacaatagcaaaggtaagaaattaacttaactgtccatcaaaagagaattggataaagaaaatatgatatatattacaggcctggatggctctgggtctgagagccctggacgaaggtcaggcccaggtttccagctagggtgattgccaggaggttgtctacagtggtcggcaggaaatggaatactactcagctgtaaaaaatgacataatgttggctgggcatggtggctcacgcccgtaatcctagcactttgggaggccaaggtgggtggatcacgaggtcaggagatcgagaccaccctgataaaatgatgaaactccgtctctactaaaaatacaaaaaattacccagacatggtggcacatgcctgtagtcccagctactcaggaggctgagacaggagaattgcttgaacccaggaggcggaggttgcagtgagctgagatcgtgccactgcactccagcctgggcgacagagagagactcaaaaaaaaaaaaaaagaaagaatgtcttttgcagcaacatggatggaactggaggccattatctcaagtgaaacaagtcaaacacagaaagacaaataccgtaagttctcacttataaatgggagctaaataatgtgtatgcatggatgtagcgtgtggaaagatagatagtggagattcagaagggtgagggagagagaggagggaggatgatgacagattgcttaatgggtggatgtatgttattggagtgatgggtacctaaaagcccagacttgaccactatgcaatctatgcgagaaacaaggttacacttgtaccccataaattaatgcaaataaatataatgaagcaaaacaaaatgagatgaactcctattcatccttcaaggcccaactctggcatttcctcacctgtgcagctgtcccacccacccccgaccagatcccttattgccccctctggactctcctagtcctcaacttccctgaatatacggggtgggggcgtctgtgtctgtaatgggaaggatcacagggtgtggggaacttcctcacccaggaaggcctcagtgaattccttggtagcattggcagccacctgggccagctgttcttggctcatgcactgaagctggaggtgtactggctccagcctctgtagaaggacaagggttccccacacctgctgggccaggatggaggctgaagtcagagcagcaccgttctgccgtcggaagttgctgcggaaccctgggtctctggccaccccagccccatagtactggctcagcaagtggctgagggatggccggggctcaggagtccggctcaggtagtctccaaggatgaccccatccagggcgccattgaggaaggccatggttaacagagatgccttggggtccaaaagcgtaaaggtccgaggggcagagagctggtcccagcagccctcagttcccaggtctggatggctctgggtctgggaacctcggaggaaggtcaggcccaggtttccagccagggtgactgccaggaggctgtccaccatggtcggtggggacttggctttggcatctggcaaggaagcttggacatctggacagccttttgtagcatctggagtgttggctccaatatctgcagtggtgacatctggagagccatccctgagtcctggggaggaggtggctcttacatctggagcaatggccacaacatctggaaaggtatctccagtctcccaaggggcagccatgctgtccaagggcaaatttatgaccctgcgcccttgcagccctgcctccagccccgccagcagaggctccacagccacggtcgagccatcaggtgccagcaccaccccatattccttcccttctcgtacgtcatgtcgggccacctccttggtcaggcctaacagctctgggcttagtgggcagggatccaactctgtagcattgaggctccatgcccccagcaggaagtggtagaggcgattgtgggggccagagtttggagctgacatcagccacgcagaagctgtgtgtctggtcttggcagctggcactttctgctccagctcagccagggcctggatgacagagtccatgagcaggggcagggaggctgcaggaggaaagaatgtgttagcccagccccacccattcctgagcctccttgtattgattccacatctacccaatgctcccagccctccatctgataaccccatgacccccaacactatccttgtgtagatgaggaaagtgaggtacacagactattgcctgttggttaaggagctcagactgtctgtgagtactggggagccatggcagatttatgagcaggacagaggtgtgacgaacctggcattctaagactcctttcttaggcttagatttgtttggctgccataaggaaatggatttttggggtgccaggatagaaaaggggagacagtgtggaggtgagagatgaaggtggcagaaggtaggtagtgacattgcagtggacaaaagtggaagagtccccagatcgtgagagggagagatggatggtcttttgtgatgaattgaagttaaaaattggggatgttagagggaaaggtattttgaaagatgcctgggactggctgtggtggcttaggcctgtaatcccagcactttcggaggccgaggtgagtggatcacctgagatcaggagttcaaggccagcctggccaacaccgtgaaaccccatctctaataaaaatacaaaaattagccaggcatggtggtgtgtgcctgtaatcccagctacttgggaggctgagacgggagaatcacttgaacatgggaggtggaggttgcagtgagccgagattgcgccactgcactccagcctgggtgacagagtgagactttgtctcaaaaaaaaaaaaaaaaaaaaaaatgccagacgcagtggctcacgcctgtaatcccagcactttaggaggcagaggcgggtggatcacctgaggtcgggagctcaggaccagccggatcaacatggcgagactccgtcactactaaaaatacaaaaattagctgggcatggtggcacacacctgtaaccccagctactcaggaggctgaggcaggagaactgcttgaacccaggaggtggaggttgcagtgagccaagaaccccccactgcattccagcctgggtgacagagtgagactccatcataaaataaaataaataaaataaaattaaattaaaataaaataaaataaaataaaatagcctgggaggcagggggaagagcaggatgggcttgtgccatgttggggaaatgtcagtggctgaactgcaaacctagaaatgctaagttaggctcagagctggttcagagatgggttatcaaataatagctaactttcagtaaacatttactatgtgctagctactagtctaggtgacttatatattaataatttaacgcagttagtcttcacaactcttgtgaggtaggtccttttagcccctgtcttagtacattggtgctgctataacagatctctgaggttgggtaatttatgaaaaacagaaatttggccaggtgtgctggcacatgcctgtaatcccagcactttgggaggccgaggcaggcggatcacttgaggtcaggagtttgagaccagcctggccaacatggtgaaaccccgtttctactaaaaatacaaaagttagccgggtgcggtggcgggcacctgtaatcccagctacttggggggctgaggcaggaggatctgttgaacccgggaggtggaggttgcagtgagctgagatcatgctgctgcactccagcctgggcgacagagtcagactctgtctaaaaaacaaaaaaaaagaacagacatttatttctcatagttctagaggctgggaagtccaagatcaaagcactggcatttgggacttcctagcctgcagaactgcaagaaagtaaatttctcttctttacaaatttactcagtttcaggtaccctggcctatatagaagcacaaagggactaagatggtgtccctttacagatgaggcatctgaagcacagagaggttaagttacctgcctaaggtcacacaggaaggaagtggcagaggcaggatttgcctttgttttttttttttttttttgagacggagtcttgctctatcatccaggctggagtgcagtagtgctcagctcactgcaacctcctgagttcaagcaattttctggcctcagcctcctgggtagctgggattacaggtgcctgccaccacgcctggctaatttttggtatttttagtagagatggggtttcaccatgttggccaggctggtctcgatctcctgatctcaagtgatctgcccgccttgatctcccaaagtgctgggattacaggcctggccagtagtagaatttgaatccaggaagtcttactcgacacactctcctggtctagaatctaggttcttctccagtccaccacctaacctgtgtagctttgctcttctctgcaaaaaatgccctttctggcttctcccccaaatcatttctctttcttcctagcctagctcttatgtctcctcctccaagaagccttccctacttttgctctccaggccccagattccttcccttatccttgccttgactctgtggagctgggaatatctatgtccccatgctggagcttctttgagagcttgagtctccagcctcactccatgcagggcaagacatagatgggacagcagtacgccttctgcagagccaagaggtttggtcccaggactctgccccctgactcacctgtccctgggtctgaccacagtagcaatccgagtaggatccagaggacaccctgggccattgttgcaggattccagcttccaaggggtatttctggttggcctcggcagagaacctcggcagtgctggagggagacaggcacagagaactgagcagagcctttgaccactgtcaaagtccagcggcgaatgacagacctgcctctcgtagagctgtgggcgggaggcagcagggacatggggcagcgtaccctgggtcaaggtcatctgggcatcctggtctcccccagtctcttctgtccctcctaggctgaggtcagtggtcagtaagccaggcccatccccagaggggcctggagaccaggtggttcagactccataaactctgcccattctccagtgaggtggaccgaggcaacccctcaagtcctgtccctccccatagtgacggctctgtagccgctgctggccaccagaggggactctcagctgccgcctgctgtactggtaagaccggctgtgttgagggagaggagagaagcagaggcctgaagttggcactgccttctgcttttttttgcaaccaacacttcaggctcaggcacagcatcggtgcgggggctgaggacagtgtttgctgaggcctgaagttggcactgcctcctgcttttttttgcaaccaacacttcaggctcaggcagagcatgggtgcaggggccgaggacagtgtttgctgaggcctgctctgagcccatggggaccaggggctgtcacctctcatccagttccagcccttgatttcaagccaccagcagtagctgagagcaggggttgagcttgagtgttcaggaccctggcattgttccaggagctggcttctggactcacctgggctgacagtgaaatgtccttcctcttctccgggtgcccatgactgagacctgcagaatggacccatctcccctttattctggcatcagatggggcaggttgacatgactgggctgttgtgtatgtaaattgcttccctgtggggctcccacctcaaaaccagcccggggagtttccaggagacccaccagctggagactcagccagggcaggcctgggaatgtccagcctgagccaggcctgggattcccctgggggccacccctggggcctcctcaggtgtcctctttctggggacctcccagaaaaaagctgggcacatagtggaagctcaggatgtagggtgctaagtgatagagtgaatgggggacacttcccatgggagtaagagacaatgtcctcctccaagctcgtttcccaggatttggggataggagctttgcctggtagaaccatatgaaggttgtgggctgaggcagggactaggttgaggcatcctctttgccgcaaaatttaaggcagtgttgaaaatctaagtcatcaataactttttttttttttgagacggagtctcgctctgtcacccaggctggagtgcaatggcacgatctcagctcactacaacctccacctcccagattcaagcaattctcctgcctccctgcctcagcctaccaagtagctcaggttacaggcatgcgccaccatgcctggctaatttttgtatttttagtagagacggggttttgccacgtaggccaggctggtcttgaacccctgactcaggtgatccacccaacttggcctaccaaattgctgggattacaagcgtgagccaccatgcccggccgataaataattttaagacttttttagaacagttttattattattattatttttaaagatggagtcttgatatgctggccaggttggtcttaaactcttggcctcaagcaatcctcctgcctcggcctcccgaaatgctaggattacaggcgtgagccactgcacccagctttattttttattttattattattattttttgaggcagggtctccctctgtcacccaggctggagtgtagtggtgcaatcttggcttactgcagccctgcttcccaggttcaagtgattctcctgcctcagcctcccaaggagctgagattacaggtgcccgtccaccacttccagttaatttttgtatttttagtagagacgggatttcagcatgttggccaggctggtctcaaactcccaacctcgggtgatccacctgtcttggcctctcaaagtgctgggattacaggctttttttttttttttttttttttttgagacagagtctcgctctgttgcctaggctgcagtgtagtggcacaatcttggctcactgcagcctctgcctcccaggttcaagctattctcctgcctcagcctcccgagtagctgggattacaggtccccgtcaccactcccggctgatttttgtacttttagtacagatgtagtttcaccatgttggccaggctggtcttgaactcctgacctcaggtgatccacccgcatcggcctctatttttaattttttatagagatgagggtctcgctatgttggccaggctggtctcatctcctggactcaagggatcctcctgccttagcttcccaaagtgctgggattacaggcgtgagccaccatgcctggcctagagcagttttaggttcgtgacaaaattgagcagaagttacagagagttctactccctgccttgacacatgcacagactctcgtattatcactatccagcaccagaatggtatatctgttacaatcgatgaaccttcactgacacatcattatcacccaaagttcatcatttccattagggtttgctcttggtggtgtacattctatgggtttggacaaatgtataatgacatatgtccaccactagagtgtcatacggagtacagttgacccttgaacaacatgggtttgacctgtgagggtcaacttatatctggatttgtttcaataaaaattacatggactgtgcctgcctctcctctccccttcctcctcttccacctctgccacccctgagacagcaagacccctcctcttcctcctcctcagcctactcaacatgaagacggtgaggatgaagacctttatgatgattctctacttaatgaatagtaaatatacttcctcttccatattttcttccttctcttccttctcctttcttcccttctccttccttccttccttccctccctccccccttcctccctccctcctttctttcttttttctttctttctttcttcctttctttctttctttctttctttcttccttccttccttccttccttccttccttccttccttccttccttccttctttctttctttctttctttctttctttctttctttctttctttctttctttctttctctttcttctctttctttctctttttctctttctttctggcagagtctcattctgtcccccaggctggagtacagtggcgtaatctcagctcactgcagcttccatctcctgggttcaagcgattctcctgcctcagcctcctgagtagctgggattacaggtacctgccactatgcccggataatttttgtatttttagtagagatggggtttcaccatgttgggcaggctgatctcgaactcctgacctcaggtgatccatccacctcagcctcccaaagtgctgggattacaggcatgagccactgcacctggctcgtggattttttccaataagttacatggagtgtgtctgcctctcctctctccccttccacctcctccacctcttccacctctgccacccctcagacagcaagaccaaccccttcccttcctccccctcagcctattcaacatgaagacgatgaagatgaagacctttatgatgacacacttctacttaatgaatagtaaacatacttcctcttccatacgattttcttagtaactcttcttttttcccaggttcaggtgattccctcgcctcagcctccagagtagctgggactacaggcatgcaccaccaaggctagctaagttttctatttttagtggagatggagttttaccacattggctaaactggtcttgaactcatgaccccaggtaatccacctgccttggcctcccaaagtgttgggatgacaggcgtgagccactgcaccccacctgatttccctttaaagcttggagttggggcagagactgccttgttttaagccaggggcatgtcatggatggcaggctctttccttagggtctatgtaggatttgtgaccttctggggcaggacccttcctccagggagcctctgtggttaccccttgctccccttactcctcccagctccctgacctgctgttcttcccttcaacctaggctgtgcttacagtgctggaaggttctttgtccagttttgtctccccaaatctaggagatgctgagtttttggggctgtccagaagtgcccagcacagactcaagaccaagtgagtgtcagggagggattgctaaatgcacaaaaagcctgatgaatgatgtggggccagtttggggtcaggatctgaaacacacacatgtacacccacattcaggcactcacacaccaatgcatcagggctgggctgggcctgggaggcagaaagaaggctggaaatcccacaatgaatcacctctaccccaggtttccttcaacctcaggaggcccacttgtcagataaatcaaggccccttggccgggtgcggtggctcacgcctgtaatcccagcactttgggaggccaaggcgggcagatcacctgaggtcaggagttcaagaccagcctgaccaatatgatgaaaccccgtctctactaaaaatacaaaaattagctggtgtggtggcatgcacctgtaatcccagctactcaggaggctgagacaggagaattgcttgaacccgggaggcagaggttgcggtgagctgagatcgcgccattgcactccatcctgggcaacaaaagcaaaactctgtctcaaaaaaaaaaaaaaaaaaaaaaatcaaggcccctccaggctgcagagagactagaggggtcacaagagtagccactgattatggagcagggccggctctcatgagttgtagcattggcacagataggcagagcctctggccctagatcttaagcaaggctgggatgaggccagaggagaaggaacttggggcagggctgggcttgggctcaacgtcagagtcgacagcgttcactatggtggcactaatgatgctaataatgaagaccccgctcgctactactgttacaggaatggggtcccgatccagaccccaagagagggttcttggatctcgcgcaagaaagaattcagggtgagtccacagagtaaagtgaaagcaagtttattaggaaagtgaaggaataaagaatgactgctccataggcagagcagccctgatagctgctggctgccttttttttttttcagacggagttttgctcttgttgaccaagctgaagtgcaatgacatgatctcggctcactgcaacctctgcctcctgggttcaagcgattctcctgactcagcctcctgagtagctgggattacaggcatgtgccaccacacctggctattttttttttttttgagacggagtctcgctctgtcgtccaggctggagtgcagtggcgccatctccactcactgcaagctccgcctccctggttcatgccatgctcttgcctcagcctcccgagtagctgggactacaggcgcccaccactatacccggctaattttttgtatttttttttttttttttttttttagtaaagacagggtttcaccgtgttagccaggatggtctcaatctcctgacctcgtgatccactcgactcggcctcccaaagtgctgggattacaggcgtgagccactgtgcctggcctaattttttgtatttttagtagagatagggattcaccatgttggccaggctggtgtcaaactcctgacctcaggtgatccttccgcctcggcctcccaaagtgctgggattacaggcgtgagccaccgcgcccagcctggttgcctatttttatggttatttcttgattataggttaaacaaggggtggattattcatgcctcctcttttaagaccatataggataacttcctatcattgccatggcatttgcaaactgtcatggcgctggggagtgtagcagtgcggatgaccagaggtcactcttgtcgccatcttggttttgatgggttgggctggctgctgctgctttttttttttttttttggaggagtttcacttttgtcgcccaggctggagtgcagtggcgcaatcttggctcactgcaacctccactccggggttcaagtgtttctcctgcctcagcctcccgagtagctggaattacaggcgtccgccaccacacccagctaatttttgtatttttggtagacaatgtttcaccatgttggctaggctggtctcgaactcctgacctcaggtgatctgcccacctcggcctcccaaagtgctgggattgcaggcataagccactgcatccggccgtgcaggcttctttactgcgatctgttttattagcaaggtctttatgacctgtatcttgtgccaatctcctatctcatcctgtgacttagaatgccttaactgggaatgcagcccagcaggtttcagccttatttcacccagctcctgttcaagatggagttgctctggttcacaggcctctgacactactaataaaaagtgctgtgtgtggggctctgagctaaggttttatgtgcctgtgcctgtggttattttttttttcctttttttttttttaatcactgggatttgttaagcaatgttctacagcagaagtcagagaacctcagcttatgaactggatgtctgtttttgtaaaactgttttttgaggtgaaattcacctaacacaaaattcaccattttattatttatttttttttttgagaccgagtctcactctgttgctcaggctggagggcagtggcgggatcatggctcactgcagcctcgacctctggggctgaagggatccccgcccccagcctcccaagtagctgggactacagatgtgtgtcatcacatccagctaattttttgattttttgaagagatggggtcttgctttgttgcttggactggtctcgaactcttgggctcaagtgatcctcccaccttggcctcccaaagtgctgggattacaagtgtgagccatcacacctggccaaaatttaccattttaaactgtgtggtttagaggcacttagcatatttacagtgttgtgcagttgtcacctctatctagttctaaagaatttgcatacccctaaaagaaaaccctgtcctcatcagcagtcattcctcattcacccttcccctgcccctggcaaccacaaacctgctttctgtctctatggattcgcctgttctggacatttcagatcaatggaatgtcacactatggccttttgtgtctgtctttttttttttttttttttactcagcatcatgttttcaaggttcatcatcatagcctggatcagtgcttcattccttttcagggctgcataatattccattgtgggaaatgatcacgatttgtttaggtgattgaatgtttattggaacacacttccttccattcatttacatttctatggctgttttcctgctataatggctgagtcacaaagcagaaactattgactatctggccttgtccgcatcagcagtcactcctcattccccctcccacagcccctggcaaccacaaatctgctttctgtctctatggattcgcctgttctggacatttcagatcaatggaatctcacactatggccttttgtgcttgtcttttttttcacttagcatcatgttttcaagcttcatcgttatagcctggatcagtgcttcattccttttcagggctgcatagtattccattgtatgaaaggatcacaaattgtttaggtgattgaatgtttattggaacacattcccttccattcatttacgtagctatggtggctgttttcctgctataacagctgagtcacaaagcaaaacatatttatttactatctgggctttttttttttttttttttttgagatggaatctcgctctgtcgtccaggctggagtgcagtggtgtgatctcggctcactgcaacctctgcctcccaggttcaagcaattctcctgccctgcctcagcctggctcttttttttaattctttttttttgagacagagtctcactgtgtcacccaggctggaatgcagtggcacgatctcggctcaccacaacctcacctcctgggttcaagtgattctcctgtctcagtctcccaggtagctgggactacaggcatgtgctaccatgcccggctaattttttgtattttttttagtagagatggggtttcaccatgttagccaggatggtctcgatctcctgacctcgtgatccgcccgccttggcctcccaaagtgctgggattacaggcatgagccaccgtgcccggcctatctggccttttaatacaaactttgctgacccctgccgagccagcccgcctggattcaaatgcctatgctgctgcttactggctggagaaggtggctttatctctagtcttcattttgtccatctctaaaatggaagaatagtaccaactgcaaagggtgactgttagggttaaatgagttgatacttgtataaagtgcttaaaacagtgcctagcatggctgagtgtggtggctcaagcctgtaatcccaacactttgggaggctggagtgggcggatcacctgagaccaggagttcgagaccaccctggccaacatagtgaaacctcatctctactaaaaatacaaaaattagccaggcgtggtggtgtgtgcatataatcccatctactcaggagtctgaggcaggagaattgcttgaacccgggaggcagaagttgcagtgagccgagattactccactgcattccagcctgggcaacaagagtgaaactctgtctcaaaattaaacaacaacagcaaaaacaacaaaaatcccacacacacacacacacaaaaacacgtggaatgcacttgatgagtagggagtagaggatggtgatgtcctcggttcctgttgtcccacccgcctgccccagcctccccagcaaatgtttagcccagcccatgggaaaaatccatttaattattgtcatggctggattcccatctcctagaggagtccagactcatagtcatgcattatttctccatctggggcacctgtccaagcccaaggcttccctgctggcccctggtcttccagtagccagctgggccttagggctgggcctggagccgatctggaaccacagccaaatcatgaaagccaaggtcagccagcccccaaatcagtcgagcccaattcactaaaaagagactcaagtcatgacatgagccagcgaccgtgcggcccccagctggggcttttctgccattcccagtgggcagaagttgacttcaattgcatctttctgggacatcagaggtgagatttaatctctcaggcaactggtcctggaactggggaggacggagtttagtaatttgagatgtgggatactgtagagatatggtgagcttagctcttgccagtatgcgaggggccaagactgagtgtggggggatggggccatatcttagcgcttcctggtggaatatttacagagcacacacgggctcttagctgtcatcaccctgcttcagagaatgacacagggcaaagggctttaaacatatcttctatagaaaatcccaaacatattcaaaagtagagagaattgtaaaaaacccctacgcataccgatcaccgaattgacatcttcaaatcacaattcatcttgtttcttctatactccacccattgtctctcttttgtgatattatctgctgttgacgatcattgccaggatctattaattcattagtaggaataacataatgacatttgagtgataatattcctccttcatgtattagctgaaatacttctttttattattattattatactttaagttttagggtacatgagcacaacatgcaggtttgttacatatgtatacatgtgccatgttggtgtgctgcacc

SEQ ID NO: 1162 - DNA, 24817 bp, Homo sapiens
tggcgggcacctgtagttccagctacttgagaggctgaggcaggagaatggcgtgaacccaggcaatggagcttgcagtgagccgagattgcgccactgcactccagtctgggtgacagagcgagactgtctcaaaaaaaaaaaaaaaaaaaaaccggctgggtgtagtggctcacgcctgtaatcctagcactttgggaggccaaggcaggttgatcacctggggtcaggagttcgagaccagcctggccaacatggcaaaaccccgtctctactaaaaatacaaaaattatccgggcatggtggtgcacgcctgtaatcccagctactcaggagactgaggaaggagaatcgcttgaacctgggaggtggaagttgcagtgaacccagattgcgccactgcactccagcctgtgcgacgggagcgagattccatctcaataaaaataaaaaataaaaaaaataaccacatacttttcttttgaggagagggggactgcccttggccccaactactctctcaaagacctcattctctgctttcagtatgtggagaacaacaagaatgctgacaacgattggttccgactggagtccaacaaggaaggaactcggtaggtagaccctcttgggaggtgtggggtgggagtcttatatgagttaggcaatttggtatcctagcgcccactaccaaagctgccctgtcacatgttagctgtctccactcccacagcgccagagttccccagttcccatcctatgagtctcccaggctggtggcctaagccaagatatcatttgagtactggaagaataggcaaattggactgaggtttggtctttgttacaggtggtttggaaaatgctggtatatccatgacctcctgaaatatgagtttgacatcgagtttgacgtgagtgtgatagagtgggaaatatgaaggttagtagaaggggagggattagatgatgggtaacaagctatcctttcttgaagggaccaaagaaaactttaaaaatgggagagaaaagctgaggtttgaggcaagcataagttatatttactcatctccacatccagaatcctggtatggatgtgctccttggggagttttacttaacatttcagtttaaccaagaaatatgtatgtctgattatattagttcctttctatcctgattctgttttattaaggttttataatttctccagattcctatcacatatcctactactgccccagaaattgcagttcctgagctggatggaaagacagcaaagatgtacaggtaggactgaataggagatggcaaagagtcaaagaaagccttaaggaagaacttcgtggcgggagggagagcatcaggaagaatagctaatggatgcttggcttgatgtctgggtgatgggatgatctatgtgtaaatcaccatggcacgtttacctatgtaacaaacctatacatcctgcatgtgtacctctgaacttaaaagatgtaaggaaaaaaaaaaaaaggaagaactttggaggcagagattttcccagggtctgctggcctagtggggtgccaggccctcctttgctgagcctaagcaaagtacttagctgaacttgttctcaattctgatcactagtagtcttcctatgcccccaagaggctgctgtgctttatggtaaactttgcatgtcaacaccttcttcatgtccctctcataggggtggcaaaatatgcctgacggatcatttcaaacctttgtgggccaggaatgtgcccaaatttggactagctcatctcatggctctgggggtaagttttgtgtatttggcataaaaggagaaagagggacttaggccctgagcagtacaagaaaagcagctaagaataaaaggaataacagtgatgtcccttaagcatgttcccccagaatctgtctccaggaaggagcttctaatggaacaagaagcattgactggtagtaatctcacaggattttccttgtattgcagctgggtccatggctggcagtggaaatccctgatctgattcagaagggcgtcatccaacacaaagagaaatgcaaccaatgaagaatcaagccactgaggcagggcagagggacctttgataggctacgatactattttcctgtgcatcacacttaactcatctaactgcttccccggacaccctccacctctagttgttactaagtagctgcagtaggcattgctggggaagaaacaaacacacaccaaacagtactgctacttagtttctaaggctgcacagggaagggaaagactgggctttggacaatctagaggtaatttatatccgcccccaggtggagcaacatgcgattctggaggcacgggggtaactgaaagtgagtacatatagtctttctggtttctggagataacccatcaataaaagctgcttcctctggtagcctgtggttctcattgggagctgttaacagagggcaagtgggctgaaacctgaggcacatgaacagctacgccgggttgggttgggaaagagtcggaaataggggatgctctggtcaggagtgggaatgaaatgttgactgttccccctgctgctcagatctacctttgtcctttagtggtgagccatgctttgccctaccgtgttagcctgcaagaagtggttttgccggaccagcacttcccgccctccagggatcttcccagccctctgtgaagtgctagatgcttctccactggtctgcgggctggacccaggcctgcagtttgccatacttgcgcccctgctgtttgggaaggatctgtgctgtaagcctcgcggccatactacgactgtcagatctccatccctatgggctataggatggggcgacggcaccctatacctcagggacttgctttggagtcatggattaaagacctctctgggcagcgttgagaaccagcgaccctaaacttggctgcgtttccatggtgtcgatcgcggagccgtgggggcgggctcacgcaagcgccaagggaccggtgggaggagttcgggtgtggatgcgcaggcgctttgagagacggtgaagccggtggccggtggccgggcgggaccaacaaagatggcggcggcccctgcggcgggagcgatctgggcaacggctgcggctaaagctgcagccgggcccacgggggggctgcacgggggtagtagggggtggccctgaactggggcctggccctggctggcctctcccgccgcctcactgggggacaggtacgggccggggcgttatggcatggcggggtgtgggggggcgcagagggaagactgctccagacccgagaggacactctccacaaaggcgcgtggggcccggcggggcctgggagaactgggctggagggacagcatccctggaccgcggggaatacgccgccggattccgtagccaatcagcggtctcggcctttctgccctcgaggggggcggacccggctaaagccctgctgtggtgggagaagtgcagagattaagggtcaaggagttgttcgtcctccatccccgactactgctttctgaacctcgacaccatgtcggaggtcggaggtgggggagggaatggatcgtaagtcacccatatagtctgcttcatttgcagcccagagaggcagggattcgaggatggagggctgtcttttgggctgttattcttgcatctacactaccatttggctagggtcttaagtgacccgaggcacatcctactttactagccgggtatggggtcccatgttacgttagagccgagataggagttatcactggcttttcagtaaagatgtgttctgcagggaggggtcgggagtatagaaagggtcaaagccatgggctgcttatctttcattcatttgtttacccaatagatactaagtatttactttgtaccaaacacgatgccaggtactggggatacgatggctgattcgatagatctggttcctgccctcagtgcgtatactgctccccactttcgttgatgtggtagtggtgatgactgagccaaccacctaatgtggaaatgagaggacagcaagattgtgggtatggaatggggcaaagcaataagggaaaattagtgtggcagggttcagtacagcagcctgggttcccatttccccccatattcaaatgctgacactctcttctcctcccaggtccagcctgtggtgtccacaatgccccaggcctctgagcaccgcctgggccgtacccgagagccacctgttaatatccagccccgagtgggatccaagctaccatttgcccccagggcccgcagcaaggagcgcagaaacccagcctctgggccaaaccccatgttacgacctctgcctccccggccaggtctgcctgatgaacggctcaagaaactggagctgggacggggacggacctcaggccctcgtcccagaggcccccttcgagcagatcatggggttcccctgcctggctcaccacccccaacagtggctttgcctctcccatctcggaccaacttagcccgttccaagtctgtgagcagtggggacttgcgtccaatggggattgccttgggagggcaccgtggcaccggagagcttggggctgcactgagccgcttggccctccggcctgagccacccactttgagacgtagcacttctctccgccgcctagggggctttcctggaccccctaccctgttcagcatacggacagagccccctgcttcccatggctccttccacatgatatccgcccggtcctctgagcctttctactctgatgacaagatggtgaggacttgccacacacatggccttcatgcccatgttcctctgtgctttcctgccatcctctgccttttctgtcccccatttccctgaagttcctttctcagcccttcattacagcagtttggacatgcctctcccttgcttaaatacccttgagcctcctagacccttttttgggttgttggtgactcttcagcatggtgtgccatttcggtccccaggggattaccccaactatttagaattcttctttgggtccccaggcccttcctttcccttgcttgcaccttctctactgggactctgcctaggcctaattaatctctggagctaaagagaggcaggcacagaacatcttagcaaacgtggttgcacattttctgagctaagtaagctaggctgattgcaattggagccagcaggagaagggcaagaaggggccacgggggcaggagggggttttgggggcagaaaggtgggagtggtgagcagctgggcaaccatgccggtgctgggggagttgccccaggagctgcaacgtcagctagctgagcagaggagtaagtgggcaacaggtgggacagccatggctgagtccgtggtacattcagctgtgatgggcttactgctcatgaccagtgaggtagggagactagaatacctagtgaggggaatagggtagagtttggggatgaaacatgcatgggatgggggaggcagtgggcagcatgctgttgaaaggttaaagtgccaggtaggatatataggaacttgccgattgtactctgaccttccaggctcatcacacactccttctgggctctggtcatgttggccttcgaaacctgggaaacacggtgagagctattctcctatctttcctctctaaaaggaatgtgaaatggtgctgggggtggggaaaacccacgagcttggggaaggcatgtggaaggagagctctgaagctcttctaaggcttcctgggcagtggtctggagagataacagcagtgtccctactgctccccagtgcttcctgaatgctgtgctgcagtgtctgagcagcactcgacctcttcgggacttctgtctgagaagggacttccggcaagaggtgcctggaggaggccgagcccaagagctcactgaaggtggggcaacaactcctgctccctctgttcaagtccctttttccccaaccacttgcaggtccatctgccactggtggtggcccccaacccttaaatctggcagttgtatctacttttcccagtgcctactttcctaaaggttattttctaccctctgagccaccttttgcttgcctcttccagacattaacctttgtttgccttccccactcccatcccaacagcctttgcagatgtgattggtgccctctggcaccctgactcctgcgaagctgtgaatcctactcgattccgagctgtcttccagaaatatgttccctccttctctggatacaggtgggagagctggaggctatgggatttctctctggccatgtctgggggtagggccaagcaagggccctggcagcattgttctgagccttgagatgttcttcatccaggaagtggggaccaatatctgggcagggaatagtgtctgtggactaggagaggagtcagttgcccatactctttgtctggctgtagccagcaggatgcccaagagttcctgaagctcctcatggagcggctacaccttgaaatcaaccgccgaggccgccgggctccaccgatacttgccaatggtccagttccctctccaccccgccgaggaggggctctgctagaagaacctgagttaaggtaagggtcgttccctctacctcctttccccgtagtttatcagcatcattcacacttcatagaactaaactagtaaagattgaagatgtagggtccagggaaaccctttagtatagaaaatagtatgagaagcaacatagaagtagaaggaaggaaggaagagggggagtctaagggagcagatggaggcagaagatcatgctagggatgtcaccaaattgaagaaggggataattcatttacaggtagaggaagacagcatattcttcccttatgtacattcctttcttttcctctcacctcggatttccctagaaagttcattgaggcattattcttttgacttttccttgaaatttagggaaggagcaggggtgtggatggggagtagggctctgtaggttgtttcagtgggtgttgggggtgcccagtgttcctgctgtctcatgggtgctccccacttcctttgatctgtggtagtgatgatgaccgagccaacctaatgtggaaacgttacctggagcgagaggacagcaagattgtgggtatggaatggggcaaagcaatgagggaaaattagtgtgtgaggggggtacaggcttggggggaaaaatcgatactatcaaggggtatgggaacaagactggatgatgcaaatgtgaagctgtgtgaagagttgattaggagtgttggtagtgggaaaggaagggtcaagcaaaggggcaggaagagatggaaatccaagaaatcatctcataacatccaacaatgaccttttctcctgtccctgtgcttctgtctagacctgtttgtgggccagttgaaaagttgtctcaagtgccaggcctgtgggtatcgctccacgaccttcgaggttttttgtgacctgtccctgcccatccccaaggtgggattccagaggattccggggtggacaggacaggggctctgtgacccaagcctacccacccccagagtgtgggcgggaaccctgtgggtttctggagcagaactgaagcctggattgattgagaagagttggaaaaggaaattcagaacatgttgacctttcttccccttttcccccagaaaggatttgctgggggcaaggtgtctctgcgggattgtttcaaccttttcactaaggaagaagagctagagtcggagaatgccccagtatgtggaggttcacaagggatacagtaagggtgggagacctggggggactccatgtggataaaagggattgcatgatgtcttcatatggggaataatatttatgtatctgggtttgtgttggagtctcagatctgttctagtactcctagagcaaaggggagaagccaagaggatccagctgtaatgaagagcatactaaatttgtatgtggatcggggtgtcagaaaagccaattgaggttaggagcatattaacctaacactgtttgccatttattcaggtgtgtgaccgatgtcggcagaaaactcgaagtaccaaaaagttgacagtacaaagattccctcgaatcctcgtgctccatatcctaatcttcagattcttacttctcttaggatacctcccatacattctctttcctccatgtttccagagaattgaattttccttaggaaaagtctgccacccacttttccacaagatgctcccagtgtgtcgggagtggggagaggacagctttcaggatagaagaagttcccctcagaggcccactgcctcccaaatgctccttaaccagggcttagatctgaatcgattttctgcctcccgaggctccatcaaaaaaagttcagtaggtgtagactttccactgcagcgactgagcctaggggactttgccagtgacaaagccggtgagtctggtggggaaagtcctaaggagccaaaggagtgggggcacagctctgattatagaacttgatcatctccaaccccgcaggaagtcctgtataccagctgtatgccctttgcaaccactcaggcagcgtccactatggccactacacagccctgtgccggtgccagactggttggcatgtctacaatgactctcggtgagaatagcctcctatttacatcctgccccattcccactcagccctgacaccctccccttctatgaagctccaggagagcagagtgccaggtgaaaggagaggtggaggtcttgcctgatcatttcctggatgctctgaggttcggtcttgtagggagaagggagtaaacaggaatgaccacaaccctttcccgatctccttttttcctagtgtctcccctgtcagtgaaaaccaggtggcatccagcgagggctacgtgctgttctaccaactgatgcaggagccaccccggtgcctgtgacacctctaagctctggcacctgtgaagccctttaaacacccttaagccccaggctccccgtttacctcagagacgtctatttttgtgtctttttaatcggggaggggggagggggtggttgtagctccattattttttttattaaaaaatacccttccacctggaggctcccttgtctcccagccccatgtacaaagctcaccaagcccctgcccatgtacagcccccagaccctctgcaatatcactttttgtgaataaatttattaagaaaaaatgatgtgcttatttgtatttttgcttagggggtgatagagaactgagccaaattggagtcttcttgggacccaagttccctctctaacaggtgggggcgctctcagagccgagggggaaggtttcggggatggtgctggacccggacctgtgtcccccagcagtgaaggttatgtactgggaggaaaagaggaaaggcatacttgagtgaggctgcgtgcaggctctggggcgactggtttggtcggcgatgggggagtgccactgttgacaaacactgggtacgttgccgggcggccctagctcccgtaggcccggtctgttgctaacatcaaggagctgtttatggagccgcctccccgtggactggccttaagtgtccctatctattctccctacgaccaaagctcctgcggccttccctctagggttgtcaccctagctggacctggtaagcttgtgctggggaacgctaactccagcattaagcgctcgccgcctcggtcctgaggagggcagtgacgggtacggccgctcactcccagctcggcgctaacacggttaacctccagctcttacagctgccgtcgctccgcctctgccagttcaatgttttattggtgaacgtgatccggggccttccaagtcccgccaatccagatgtaggagaggtagggttaggcgcgtgccgcgagaacagagtggacggagcgtaggagagaccgaaaaggctgggggtgggagtagcggatttgaagcacttgttggcctacagaggtgtggcaagcagagcacctcagaactcaggcgtactgcccgccgcccgagccctgcgagggccgatagcgagggtgtggcccttatctgcacccagcagagcgccggcggggtacggtcttaggacctcgatctccttctccctcattttctctcatccctacctattgtgggtgagtcctggcccctggacggggacctcgctgttccaccagcccatccgtgcacacttagtttcccctaaagcagtgagtggccgggatagaactcaaaaccggcggggcttctggagcgcaggttgtccccggtctgcctgtccatatcgccccctttcccccaggtttccgcatgggccggaccgtggtcgtgctgggcggaggcatcagcggcttggccgccagttaccacctgagccgggccccctgcccccctaaggtgagtgctccacttgtgccagagggagcttcatttaatgctcttcccatttccatcaaaagctagatggatcctggccctctgaatatgcctcttcccctcccctcctgacctctcgccggcggctacaggcggtgctgcagtgtctctccctcttgtcgccaggtggtcctagtggagagcagtgagcgtctgggaggctggattcgctccgttcgaggccctaatggtgctatctttgagcttggacctcggggaattaggccagcgggagccctaggggcccggaccttgctcctggtgagaggcttgtgggatgtctaggagaggttgtggagggggcttccattggggaatagagtttaggggaggaagtatgtttggtgggtcagatcttcccttagtttctcctcttctgagggcatgtggagagcaggtttctgagcttggcttggattcagaagtgctgcctgtccggggagaccacccagctgcccagaacaggttcctctacgtgggcggtgccctgcatgccctacccactggcctcaggtaacaccagcacctccgctccttttactgtgccctcatcctcatatgccttccatttctttcttcttttctttttttttttttttttttttttttttgagacggagtatcgctctcgcccaggatggagtgcaatggcgcgatcttggctcactgcaacttccgcctttcgggttcaagcgattctcctgcctcagcctcccgagtagctgggactacaggtgcctaccaccacgtctggctagtttttgtatttttagtagagatggggtttcaccatattggccaggctggtcttgaactcctgaccttgtgatccgcccgcctcggcctgccaaagtgctgggattacaggcgtgagccaccacgcccgacctgccttccatttcttcatctccctgtcagccttcccagcaaaaggaagccaaatgagtggaaatgaccccagcgcctggagctggggaggtatgtcaggagcttccccctcactatgcctttctccatgcagggggctactccgcccttcaccccccttctccaaacctctgttttgggctgggctgagggagctgaccaagccccggggcaaagagcctgatgagactgtgcacagttttgcccagcgccgccttggacctgaggtgacacttgcccagaggccccaaacctcttccctcctaaaccagctgcagagctccctgttcaaatctaccacctaggggctcttctgtatcatttggggatgccctcttctcttcataccccaccccctcataattcccaaaactcattattgggagtgaaggccttcatttccatccgtcacagtgggaatgtcccccaacccaaaccctatcccaccctcattccctaccaaataggggctgtggaaatcagtcagtgtagattattttttcgctccttagtcctagtctcacccttaaggtggcgtctctagccatggacagtctctgccgtggagtgtttgcaggcaacagccgtgagctcagcatcaggtcctgctttcccagtctcttccaagctgagcaaacccatcgttccatattactgggcctgctgctgggggcaggtgaggggggattgattcagagggtgaaaatattaagtactgccaaagtgagggagtggggacaaggggtgctattcaatgattctttttttcttttttgagacggagtcttgctctgctgcctaggctggagtgcagtggtgcaatctcagatcggctcgctgcaacctccgcctcccagattcaagcaattctcctgcctcagcctcttaagtagctgggattacaaacatgtgccaccactcccagctaatctttgtatttttttgtagagatgcagtttcactatgttggccaggctggtctcaaactcctgacctcaagtgatccacccgcctcggcctcctaaagtgctgggattacaggtgtgagccactgcatccagcctcaatgattcttctttgcttcctctgcagggcggaccccacagccagactcagcactcattcgccaggccttggctgagcgctggagccagtggtcacttcgtggaggtctagagatgttgcctcaggcccttgaaacccacctgactagtaggggggtcagtgttctcagaggccagccggtctgtgggctcagcctccaggcagaagggcgctggaaggtaggggaacccctggagtgtaatgaacctgtcagtgtttccatctttatccaagtggcttaactaggccagggccgataggactggagttcctcattgtttttgtgccttagaagctacttagacatgggctaccccagaatcctaggccctatttgtgaaccttcctcaaagagcctatgcaagtctgtggatagaagtagtacttataagtggcttagagataggggaaagaacccagcttcactgaacatttcagaacagccacactggcctgtctggtccacttcctggagtacacagaggaatgattttttgtgaagtctacatagtcacccaatctcttcatcctgggtcagtacacagtctccccggccacatgggtgcctgggaaactgagagtgaggcaccagaagtctcttttcactcatcaaattctcattttctgggtctctcaaatgttttcatgctctcaggtatctctaagggacagcagtctggaggctgaccacgttattagtgccattccagcttcaggtaatggaatagccaccttccccttccccaacccctaccagtgagaagcaaaagctataccttcctgggtcagcaggaccacaccatgcccctgaactggtcatctctatgggagtctaatcccaaagaggactgacaactgtaatgggaatgccttctgagtcaggcctctgcctgatctctagtgctcagtgagctgctccctgctgaggctgcccctctggctcgtgccctgagtgccatcactgcagtgtctgtagctgtggtgaatctgcagtaccaaggagcccatctgcctgtccaggtatgataaagggacggagaggctgggcatggtggctcacacctgtaatcccagcattttgggaggccgaggtgggcagataacaaggtcaggagttcgagaccagcctggccaacatggtgaaaccccatctctacgaaaaatacaaaaattagccaggtgtggtggcttgcacctgtaatctcagctactcgggaggctaaggcaggagaatcgcttgaacccaggaggtggaggttgcagtgagctgagatctcgccattacactccagcctgggtgacagagtgagactctgtcccccccacccccccaaaaaaatgggaaggagagacagcctcagctagagccctttccttctgacgcatgaatgtccttctctccagggatttggacatttggtgccatcttcagaagatccaggagtcctgggaatcgtgtatgactcagttgctttccctgagcaggacgggagcccccctggcctcagagtgactgtgaggaggaggaaactttgcctagtggcatttccagagggctcctctgtgctccattgtaggcaaggccagactgatcagtgctatattccctccttaggtgatgctgggaggttcctggttacagacactggaggctagtggctgtgtcttatctcaggagctgtttcaacagcgggcccaggaagcagctgctacacaattaggactgaaggagatgccgagccactgcttggtccatctacacaaggtaagttgggataaacttccctcagctctccactgaaggccttgaagacagagactggaacatttgtcactgtatgtcagccaaggcctaggacatcaataataaacttttccctgcatcctctcctctcttctcagaactgcattccccagtatacactaggtcactggcaaaaactaggtaagttgggaaaacagctgggctgaggagggccaaggacatcagacccccagctaaaacattcctttcatcctttccttccagagtcagctaggcaattcctgactgctcacaggttgcccctgactctggctggagcctcctatgagggagttgctgttaatgactgtatagagagtgggcgccaggcagcagtcagtgtcctgggcacagaacctaacagctgatccccaactctcattcatgaaaataaaaattgctggagcttggcttggtctggctgttctatcacctataggcataagaatgcggggcagcaaagaggcaaagtgtgcctgggatgcagaaagcaggagcagatgcgagacaaagtcctttattagaaaatatatcaaaatcccagccccctgagccaggaccagaagagggagctattccagcataggcagaaaatgcccagggaggggcttccttcaccaaacaacttcccgggaaccataaatagaataaatattcacagaggtccgaggagaagccagatcactcttctctccatggaagagggaggggcttggggtccagccctgctcctactctaggggcagggactcctaggaatcgtcacataaaatcatgacatcaaggattcacagtcataagccctacaggagaccctagagagagggacccctcaggtctacaggagcccagctccagtccagcagtgagggagaggcccctaccccctagcacggcaccagagttcagttccctcacatccctctgagaacagtgaggagctgagggtggggagaatacaaccccatgaattcggtttcatgattaaggtagacaggaaggaggagtcagtgtgaacctcggagggctgtgtggttggcagtagatagaggcccaggcctggctgggggccggcgttgcagcatctcttgacggaaggcttgggaggaaccaggtgggtaacgtggcccagaaggagcccgaggaccccgagggtcagtcccaatgtctgctgtgatgttggtataaagaggccccagctctcgagccagcaactggtatgtcagtgagttcatcccatcttgcgtccaggaattctgggtacggaccaggaggtcaaatctgagggttagaggttggagactaagacccagaaaggaacagccagaaatctagggacctttaggattttcctggctaggggtacagaaccctgaggatccagtaacaattcccaggcagtccttccttcttcctacctgtggggattttcctcattgcccttatctcctcggtgcttcaccatcttatagtgtcctacagatgtggggggccgagagatcttcatcccagccaggcgcaccctatgggaaaagtgagggtatcatgggggatccagagtagagaaaagcaaggaagggattaaatgtttctgtacacacaaaaaaacaactattacttagtaggcaaaagaaaaaaaaagcccaggacagaagtcaaacagaaagaaggaaatggctgaagagaatataaaagctggatgtatccaaatcctcagggcccagtgccagtcaccctagggcctttaaacagttggcaacctattcccttggcttcctaaagggctcctaggagctgcccttgcagtctaggaaggacgcagagagaggccattctgtcaaaagaataagagaagactgggagttgctgagaatcttagaatagtgactgagctaccccagcttctctcccacatcccccatgttaagaaaaaggtaggccaggtgcagtggctcacacctgcaatcctagcacttttggatgccaaggcagaaggatcacttgaggccaggagttcaagaccagcctgggaaaataatgggaccttgtctctagagaaaaagaaaaaaaaaaaaaacgaaagaaagaaaagaaaagggtagaaccaggtaatcaggaccttaaaagaaacaaactccacttctgacacacagaagcatggagtgcagatggcctgggaaggaactagaagaatacttatgtatatttacaattcactgggtatttcacacacatacagaggatgagaattcacagagatgtcatcacagaggacacagggggaatggaggcaattggtcctgcataccaagcccaaatattcataccacagacatgaaattgggtcagctgaggctgaaggtcagaatgtttcacatgctaaaaatgagttggccctgtgccaatggcacaggccttttacaaagcgattctgggaacatggagcagagcccctctctcctaaccccataggaagtggcctggctggaaccccagcagaaggcaagactaagctgtctctgggcccctttccagttctggaatccgacgatactatttcctattgatcttatgtcctctcccaagaacaaactaaccaggagactgaaggatgacacaatgggcagtagcatgcaagcctgacctgggtatcctaaaaagactaagggaaaggaatgggctcagtgcaggaccagggagctaaaggttagtgttgaagggctatggtcaaaggtggtcttagaggacagggatccagactggggtcaggagggaggaagtggcaggaagtctgacctggtagcaatgtcgtcatcctcaccaccccagccccagtattcattggggaagccattcatcttcaggtactggtcaggagtaagtgctgagactcctccgaagtactgggggtacgggaggctagggagagaaagatccttgcataccccgagtcttctggggacacatccccaaccacaatccgcttggctctcctccttccacaggatagtaggcttccctgtttcccagtacccttccatgccctctacctgtatccaaacttgttcatagcaacggcaacatggcggggtccccgggggtcacacacatacagattgtggtcattttctggcaagaggtccacatcgtgcaagaacaggcagtcccactcttcatcacgcagggcctctcgcaccccaacgttcaacagttttgccctgttaaatgttccatttccagcctggaagataatggaggggaaccagactatgtctgtaggtggcacggagaaaagggggctaaagaataaaagtgaaggccgggcgcggtggcttacgcctgtaatcccagtactttgggaggccaaggcaggcagatcacaaggtcaggagattgagaccaccctggctaacacggtaaaaccccatctctactaaaaatacaaaaaattagctgggcatggtggtacacgcctgtagtcccagctactcaggaggctgaggcaggagaatggcgtaaaacccgggaggtggagcttgcagtcagccgagatcgtgccactgcactccagcctgggggacagagtgagatctcaaaaaaaaaaaaaaagaaaaaaaagaataaaagtgaaaagagggaaatcaaagtggggtggagggcaaggagaatgaaaaagaaagactatctttttcatttttccacttagtcatttgacaaatcttgcttgtgtattggtatggacctgatacttaagatgctgctgtctaacatttaatcctgacaattggcaaccaacaatggtgtggtgtggaacagatggtatattagttatcttatgctctttcctcatgttagatgtttaagtatcttgctcagagtcatacatgtaacaagtgacggaactagaattttagccctattgtgtccaattccaactctgcacaagccattcaataaagaaaaaatcacaggagagtgtaggacagtgggaataacctaagcagattaaggaaaagtatgggactaacaaagttggaagagcagtgccgggtgcttctccacactctaacagtctggccttcttaaaattattctagggacccatttagatgaaagtgaagtggcatgtgcttgaggcttccttagaagaaagtcagtcaaaatgaggtggagattgggggtacctggtggatgacatagatgccataagcaagctgctggcgctgcaagaaggggtgcaggtggtagagcagcaggcgcaggtggtgctcccgggcacgatgaggcacaatgatggctgttcgggagcggggctcacaacctgcagggcggtaccggccccctggttctacccggggattccgctccacaatctctgccagtgatggcactgggctaaaggacaccgacacaggacccactgttgggaaggaatggcaagtagagggatcagaggggcaaagagaaaagaatcaaactagggtttgggaatacctctgacactggcagtctggttctggggcttagttctcagggctcactcagaaatctcgcatgccttggattacctatcactgggacagctctacaaaggctggaaggtgcaggatccttacctagccttctcttcttattttagggttgcctaactttctcctgtcttacagggttggaagctatagttgaaggctggagagacttgcaactaattaaaccagggctcatctacaaggaaaacaattcctagcctggggcaggaagagcccataaagggacaagcagtagaaagtggaaacccaatagtctaatctaaactcccaattcagagtctactctatctcaacctcagccctctatctcaacctcagcctacctgcagcctcagcctacctatcctcttctaagttccacttctgccactccatgcctccctatccccaagcctccctgtctccgcaccttgtccttcctttcaccacctccttcctcctgcacttacctaagagaggagatcgttctggacagtagggcagaccttgaggagctggaggaccccctggggccccaggcaggtgactgaggttactgtagacatcacgagggtgagaatagtcaaatgtcggtccctgatctcggccaaatagggcactgagacttcggaagccccccagtgacaggtacatcatgacagccagctgggagcccacaagcagggccagcgtgcaaggccgctccagcagcctccgcaacatcctgggggtgagatctagggagggagaggggaattctgggggtaggcaggaagagagcaagccagcagagaggtcagtaggtagggttgaaggtgatgccaggggtaaagaggaaaaagcagaaaacaaagtcacagaagggagcacacaggtgcacagtcacgcaaggaaacagaatgtaaccaccagtaaccctaccacctgtcacttcagcccaagtttcgctctcctctacctccccccaaaccactcccaccatctactgtcagtcctcacccccaaaaatgtttacatcattcaaatctcatgttcatttcagaaagtctctagagaaccccctcttccaattttagaagggaagagatagactcacctaggttcaagctgtcttcttagggatcatgggggctccagggggtcccggggggacagagatgtgaggcattatctaaaattggaaatgtcacagagggcagagaaaggctccatccagcactccagcagcgaatctgggaccagctggaacagaagtggtaaaggataactagctacctgcaccgccagagatcaggatcagggtgaagctggtttcccagcaggcgaagtgaaggaaagtggttggaaaggaagaggaggagcaggagatggtaggtccctcgcctatctcccgtgctaccctggaatgataagtgtcaggttcatacttaaccacccccgtacccccaccccaacaggacagattggggagtggggacaggacagctaatggaaacattgttttcccccagaccaagaaccagttgaagtggcgacagagtcatgacaggaccgtggagtggcctaaggagtacccagggcgaagtaggaaacaggctccttctattcttcatgtgcctgggtgccaactcctcaggtgcagggaccgtgaccacctgggggctgtaagcgaacagccccggagctcggcggagagtagggtgggggtggcgtcctctaccttttctacctttcccctcttctagcgggggtggggaggagggttactgctgaagagaaagggagagggagagcaggggcagagacagtcaggggtggctggaagggctcacctagaggggcgtggtccgcgctgtggagggggttaaaacccagctctttcggagcacgcccatcctatcccagtctcttgcttttgccctacctactagcaacgtgagcccgcccggcccccgtccatacttccacctaggaccccgtccctgctcaggctcgtctccaggcgttacccaaaacttctcactctctcgaatgcccaaacctttatcccaggcctccgtgtcgacgcattcccagcgcacatacctggtcttttgctgcctgtcgtcaccgccaccccaacagccgggcaggcatcgctgccgccatcttggaagcgggcgctgcgggggcggggtctcgcgtcatggggcggggcctcggggcggagccacccgggctgactaggcacccggtcccagacaccgcgtggccgggggcttgtgagggagcagcgcctgagcctgcccacctggaacgcgttgtaggcgaccccctggggagcgggtgctagggttcaactccactacgcagactgctagtgggatttcatttcctgcccctcagatttgtaaaagcagaagctcaagcccttcattttcctctgggccgagactgatcaggaggctagtgagccggtttctggtgctccgctgacctcgttatcaccttgtggttggctgagccctctcccagtgtgtcagtggcaccccctgcagcctagtgccacttagtatcaattgttccttacgcaggctacagcgttgcggaccgctctagcgcatttttgtattcccgttgtatcccgcaggcctggaaataaaaagcgattagttaataaaacaatgaaacattgaaggtggagggaaagacagcgtcttctttaaagtcaaatgatgtttccccagatattagagtaaaatggatgctccgttaacatgcaatatgtttaccttacgacaaacactaccgcctagcatattgtgttccttagaagcagatattcacgctgaagaagcaatcagagacttgaataactcacagaatctgccccaaaaagcccatggtcttgtgtatcttgtatggagggagggatgtaaacaatataacgtgataaatatgctggcctagaagtggcaactcattcatacgtggagattctagaaaggcttcccagaagtgatggctaatgggaaacctgaaggacttgtctatagcatatccttctgctttaaagattctgttttcatgggagttattttacaattcatgtaggtaactgatctgtatgcaaattctatcctgtctggtagaggttcaattaacctgctgttccccacactgtggggaaaaaaagcagttttggcgtccattttcatattcatttctgttttcctgatccataaatatgtccgttctctagattttctcttgtattaattataacatctgctagtttcttcatgagttaggtaaaataaacacgtgttcattcttttcttaatttcttttttctttactttttttttttttttttgagagggagtctccctcctgttgcccaggctggagtgcaatggcgctatctcggctcaccgcgacctctgcctcagccttcctcagtagctgggattacaggcatgcgccaccacacccggctaattttgtatgtttagtagagacagggtttctctgtgttggtcaggctggtctggaactcccgacctcaggtgatccacccgcctcggcctcccaaagtgctgggattacaggtgtgagccaccacgcccggcctttttgtttacttttttttttttaatttaaaaatttgtgacagggtctcactctgtcacccaggctggagtgcagtggcaagatcacagctcactgcagcctcaacctcctaggctcaagggatcctcccacctcagacccgtgagtagctgagtagctgggacaacagcacatccagctaattgtattttttgaagacacagagttttaccatgttgtccaggttggtctccaactcctgggctcaaactatctgcccaccttggcttcccaaagcgctgggattacaggcgtcagccacagcatcaggcctcttaattttatttctctttttccttccttccttccttccttccttccttccttccttccttccttccttccttcccttcttcctccctccctcccttcgtcccttcccttcccttccttcttttttttcctttcctttcctttttttttttcccaaatacccagtcttcaaggagaatttttttttttttgagtcggagtcttgctttgtcacccaagctagagtgcagtggtgcgatctgagctcactgcaacctccgcctcccggattcaagcgattctcctgcctcagcctaccgagtagttgggattacaggctcccgccaccaaacccggctaatttttgtattttagtggagacgggatttcaccatcttggccaggctggtcttgaactcctgacctcatgatccacctaccttagcctcccaaagtgctgggattataggcatgagccactgcacccggcctatgtgttcatttttatgttggtattgacaaagaccatctccttaaccagactttcaacaggctcctctaaggcctctttttggctaggtcttgtccttatgcgctgtcttgggcctgcctagccagttatagcaagaatcctgccaagtcagtttagggataattccctgcccgcttctccacccttgatagctgatctatctgatcaccctcacctgccttcaggaaagatcctgttaggtcagtttagcaagaatcctcctagccttaatgtaattttccttccatccactgactctgattctgctcattgactattgcaatagtcttccttactgttttaacaagtgtcagaataattttttcttcaacagtttaagggtcataattttaccttcttctgaaaattaccttttttttttttttttgagacagagttttgctcttgttgcccaggctggagtgcaatggcaccatcttggctcaccgcaacctccgcctcctgggttcagccaattctcctgcctcagcctcccgagtagctgggattacaggcatgcgccaccacacccagctagaaaattaacttttaacagatgaatagtgttccaagcagaggaaaccataagtgcaaaattctggaaatgaggaagaaattagggagtttgggaaattaaaactgggcccgcaaggctggacagtagagtgaagggaatgttgagatatgagactggagaggtaagcaaatgccaaataatgaaggactccacaaaccatgctaaaagagtttgggtcttatccagagggcaagaagaaggcattaaagtgctgtaaatagagagtgctatgatcagaactttaggaaatgtggagcactaattgaagtagtcaagaccagaggcagggagactatttagaaagttactgcagaaatccaggaataagatgaagctcatgcagaataggtaatacccgtgggactggagggaagaaagtaactttgggaactttcaggaggcaaacaggacttgaagattgactggatgtgccaagttagggaattggactccaagaggacacccagatttctaatttggaccactgggtggtgccatttaatgagaaacaaaacttaggaagaagcacattttggggaaggggtagagatgacaaactttagacataatgagtttgaggtgcctgtgaaggctcaaaatgagataatgctgggtttaaatacaataccaactttgaaacccattggctgtgtactgagcaatacactctggatttcatctgtaaaatgaactctagccttaaggggttttgtgatcattagaactatggaaaacttttgagcacaaatagaagccaagacaaagccttgattttttttattataattttttttttttgaagagacagtctcactatgttgcccaggctggtctcaaactcctgggttgaagtgatcctcccgctatggcc

SEQ ID NO: 1163 - DNA, 44587 bp, Homo sapiens
agccatgaacacaccactgcactccagcctgggcgacagagcaagaccttctctcaaaaaacattgtgtgtgtgtgtgtgtgtgtgtgtatagatgccatctaattctaatatgtagaattagattttaattcttaatctgtcctgaatggttaagatctgagaattgagatgttcaggaaatggagctttggaggaagggtgcaaacacaaacaaaattcatccattttgccaaggtgcctacttgaatgctaagcccctaattgttttttattttatttatgtttaaaaaaaaattttttttttgagacagggtgttgttttgtcacccagactggagggtagtggtgcaatcacagctcactgaagccttgacctcccaggtgtaatgatcctcccacctcagcctcctgagtagccttgactacagtgtgcaccaccatgcctggcttgcttatttacttacttatttatttatttatttctgagatggagtttctctctgtcgcccaggctggagtgcagtggcaggatctcggctcactgaaacctccacctcccaggctcaagtgattctcccacctcagcctcctgaatagctgggactacaggcatgcgccaccatgcccagctgatttttgtatttttatagagatggggtttccccatgttgcccaggctgatcttaaactcctggactcaagcgatctgcccaccttggcctcccaaagtgctgggattacaggcgtgagccaccatgcctggccctaattctttttattatttgtagagacaaagttgtgctgtgttgttcagtctgtcttgaactcctggtctcaagcagttctcctgccttggcctcccaaagtgctgggattacaggcgtgggtcaccatgcccagactaagccccctaattgcatttgattcatcagttctttacagcagctactatatggctggcaatgcattgggggctttcatgatgataaaagagctcgtctttgaagaattaatgagaaagtaaaacatattcacatgggtccattaatagtttgtattggtgagtgataaaatgccaagattggttatgctgacaacaaatgctgtaggaggctggtgtggctgggttggagggccctcatgaagcatgaggaaaatttggattcatgggaaaaaaagagaacatcatgagtaaggcacaggaatgatgtcctgagtgtatgtcctctgagtggaacaaaaaagagacaggtggctgaaatggaggttctgtggtatagctgaagtatgggtcctgatcatgaagaaccatcaggtgcagcctgaggagttggaactctacgaggagagtgagatgatgagcagtattttagccttaggaatcaggacaggactcatgcagtttatttgggtgctcactagagtccatagagaattcttgccttcaggatcagaaggcatagacacctttgtggaaagatgttaacctgaatcttttcttgtatcttttcctagaataagctttccgatttgttggcacccatctcagagcagatcaaagaagtgataacctttcgggagaagaaccgaggcagcaagttgtttaatcacctgtcagctgtcagcgaaagtatccaggccctgggctgggtggctatggtgagcagcgcagattccagggctgggggtgggtatagattttaagagggaaggcaatatagttggagaggtcctgagtcactgacagcttgtctctctctaggctcccaagcctggcccttatgtgaaagaaatgaatgatgccgccatgttttatacaaaccgagtcctcaaagagtacaaagatgtgtaagttcagccttttctctctttttttcttttctgagacagtgtcttgcgttgtcacccaggctgaagtacagtggcacaatcacagctcattgcagcctcaacctcccagctcaaacaatcctcccacctcagtcctccaagtagctgggacttcaggcacgctccaccatgcctggctaattttctaattttttcgtagagatgaggtctcactgtttcccaggctggtctctaatgattctcctgccttggtctccccaaagtgctgggattacaggtgtgagccactgtgcccagccaagttcagctttttctcaaggggtaaaggataaacccatttggttacttgctggagtagcactttggagttactgagggctgcccttagccactgtgctggttttatctcagggctgctttctggagagctttacagatattgtctcacagctgcatttgcaagcaggaaatacttctgcttccacttctgctttctctccttttttggtagaggcccttttagtcttctgatccttacccttctgggtttaggaagttttgctggcagtaacatggactaatgccctttatataagattttgttcctttgttgagaatttgttactggcccaatggcaaagggttcaataggacttaatagaaatttttcatgaagtcagttaaagtgagagtaaggctgcctagccaatgcaggtattacgtagggcagtcattgcatgtctaaccacatacgtctaccagttctgacttctccattgctggttttgagctggaatgattgcaggcaaaatttattaagttgcatatctacacaagcctttcctttcttccatccttcatcaatcaacaaacatttattaactactctttttaaggaaaactacaccttcctgtgagtgaaatgtgtcccagaacaacaggcacttccttatccttctagcaacatggaattaagcatgacagtgttttgatatatcccaccattatcccatcactttacagttgaggaaactaggtcttaggctaaataaccttcccagttaatacataagaagagaggggacttgaaccgtaggcacaatgctatttctataatttaaggctgattgtttccccctaagggaaagtttttaagtttgcttttggtcagggtgggcatattttgacataaggcattgtctcataaggcagttaagtttcttagtctttagagttccacagtgatacttaagagctctcctctctaccatggttttatgcacagaatgtctgcttttatcagttttacatattagattgtgtttaaggtctactttgaaaaaagtttcaataagcagcaagtggtcaaaagaaaaaaaaaagttttggtacttaaaacagtttgagaaacattgctatgagagatagagatagaatccagagtctctatcttagtggagtttggtctgattagggtaatagactaggttgtatatacatagaagctggtgatgatagaaaagctgccattgagcggagcctaagaaacaccacgggtaggagaatgtgagcccataggaaagaagggttctggagtcaccactgttatgtacccggatcacctgtgacaagttcttctttaatcctcccagggataagaagcatgtagactgggtcaaagcttatttaagtatatggacagagctgcaggcttacattaaggagttccataccaccggactggcctggagcaaaacggttagtgaatccttcctccctccctccctccctcccactttctctctccagcatggggtccacaggtttcttagacttcagcactaccaaagtctgtgagggaatgctagttttttcagtggaagggaggaagaaaaggaggagaaagaaagggtaaaaagagtagaggaagcaaggatcagaggagaaggaatattcagtggtattcaatttcaataaatatgttagggacagtgattggtgctggagcaggagacacacacaaatgagttacactatcccagcctttaaggagcttaaaaataagaatgcaaaaccccaatacaaatcaccaagccaaatgctataataaagatacagactagagtatgaggaagagaagagtgcttctcactagaagagattgtactttgaaggtatatactcttctgtgagacttgaaagtagtatagggcagtgagaagtgggatactacaaaaggcacagcttaaacaaaatacatgcagagtaaatgtagagattggtcatctctggcttcaataaggggaaatgatcagaattttaggagaaaaggctggaaaggaaggtaggctgagactttgggatgaggtatttgagcaagggagtgataatgattcaatttgtctttaaaagagtctcagtgtataggttagggataaggactcatgctcagattatgaaagtggtcatggtgtttgggggatagtagaaaaacatttgcaggagatagcaccaagataatagagatttgataaggtcgaagaagttggaatcctcaaagaagattgaatagtcagtcttggatagtaacatctttcactgaaatagggacaaggggatgattgtacagggagaggagcggcaggaaatgatgaaatcagttttgaatctgttgaatcagaggtactggtaacacactaaggaagatgtcaagtagatttgtggaaatagtttttagagctggaatcaggtgagttcaaaggcaaaatgtgatggtcaagaaatagaactgagagctggatccttgggaaagggtgagaaggcataaagccaagttgggtatgggtaggacacattaatcattgcctcaaaggctgtggtggggaccccatgtgcactggcccatgtagggcactactgggaatggtacagaggggagcagagaggatgatgatgttacctgcacttattgttccaggggcctgtggcaaaagaactgagcggactgccatctggaccctctgccggatcatgtcctcctccccctccaccatgcccccctcctcccccagtctctaccatttcatgctcatatgagtctgcttcccgctcatcactgttcgcgcagattaatcagggggagagcattacacatggtgagtgagcacttggacacgaacagtaggtacaacaagttgtgtgggccagaccccaccaaccagaaccgtctgtaaactacaaccctggcttgtgtggtggagactcgtttggtgtgtcctgttcctttaagggacggcaaagctggcttaaatggaaattgaaaatgatgatcacagttggaggaagccatctgccccatgggaaagtgacttaatattaggtagcatatatagaggaccctcttgtgccaaggcacagagctggcggttttccccagagctttttccgtggcaccacatggcctctgggaaggcattgtgttagggagttaacttcctcagaagatgcatactggttacatggaaaatttgcatgagagtgacctaatgttggtataaagtagatacccttaacacagctggtggaagtctgagttgtccagccacttctaggaatctatgatcatagtagctaaaaatggtgtaacaacctaaatccaactgtaagagaaatggctaactaccacatgtcctcttgatgaaatgttttttatttttttattttttttgagacggagttttgctcgtttcccagcctggagtgcaatggcgcgatctcggctcaccgcaacctccacctcccaggttcaagcaattctcctgcctcagcctcccgagtacctgggattacagccatgcgtcaccatgcctggctaattttttttttttgtatttttagtagagatggggtttctccatgttggtcagcctggtctcaaactcctgacctcaggtgatctgcccacctcggcctcccaaagtgctgggattacaggtgtgagccaccacgcccggcctcttgatgaaatgttgtgccaccattacatgtttttctacagtgaaccatgtaatgtttaagaaaaaaaaaatctagtatgtaaattacaaccacaaggaatggtggagataaaaaggccattcagtatttgttatacagttaacatagatctggccatgttcaaagcgaggcgtgtgtcagcctgctgtgggagatgatgaattatttttcccttaaaacataaaagaaatatatttttacttttattttttattttattttattttttttgagatgggagtctcactttgttgctcaggctggagtgcagtggcgtgatcttggctcactgcaatctctgcctcccaggttcaagcagttctcctgcctcagcctcctaaatagctgggactacagcacctgccaccacacccggctaatttttttgtacttttagtagagactaaaaatacaccatggtagccaggctggttttgaactcctaacttcaggtgatccgcctgccttggcctcccagagtgtgggattacaggcatgagccacagcgcctggcctagaaagatattaaactacaggttaacatgagaaagtttttaagtgtcaatagttgaactaaatttgttaacaatctgtatgattataaccaacaaaaccaaatatatgtagaaaacaatattgtagagttgcaaatgccaacactgactgaggaggtgggggaagtagggttagctgtggggagtgagggtatttttttcttttccttttaccaaattttctttactaccactcatttttctttattgctttaaaaattatatatttgtgcacatacatttgatatgtctttctagacatagaggataaggatttacatatccttatcctcacccacaatatacacacattccatgttgttgttaatggaaccatataatttaatcttggggagaagagaaatgataaaagtacttttccaaaactgcttgcaagagaacatctcaaaggctctggttttggctttgaattttctgttaaggatgtttaacatgacgatagcagctcaaaggtctggtatgaaggacaggaacaaggtagctgttgttcttacagccctgaaacatgtatctgatgacatgaagactcacaagaaccctgccctgaaggctcagagtggtccagtacgcagtggccccaaaccattctctgcacctaaaccccaaaccagcccatcccccaaacgagccacaaagaaggagccagctgtacttgaactggagggcaagaagtggagagtggtgagttaaaaatacctagacaggggcaggtatttttattattttatttttttgagatggagtttcactttgtcgcccaggctggagtgcagtggcgcgatttcggcttaccgcaacctccgcctcccggggaaaaggagtaggaacaggaggttaaatggagcttagctagatgagggcagagttctggcttcaattgcaagaacaaaaagtttgggatagcctggttattttttgttcggtgtgtgctttgtgatgagaatcctgggatctctctctaacaggaaaatcaggaaaatgtttccaacctggtgattgaggacacagagctgaaacaggtggcttacatatacaagtgtgtcaacacgacattgcaaatcaagggcaaaattaactccattacagtaggtgagtctttgtcgctgtcccacgcaagccccgtcccagagcccgagaaggctaataccattttacctaccctatccttaaagattcctaaatgtatattactttcctttaaagttacacgttgacacactccctttcttctcctagataactgtaagaaacttggcctggtattcgatgacgtggtgggcattgtggagataatcaacagtaaggatgtcaaagttcaggtaactcgatattttggctccttctttttgtccctgaggaattaattcaaagagacatggtagacccacagatgttgctttggtgggaatctgattctacaaagtctgtaagctgagctgctttggacgtggcagaagaagggttggctcttcaagcaagttcttttcaggacccatcccaacccacccgagtatccagtgtcttgcgcatctgtgagcttttcatgtagttgctgagtcacgtgaaacaggaaaccttttcctgcgacttactgttgtccttcccaaccactgggactcagttctctttgtttactctgcaggtaatgggtaaagtgccaaccatatccatcaacaaaacagatggctgccatgcttacctgagcaagaattccctggattgtgaaatagtcagtgccaaatcttccgagatgaatgtcctcattcctacagaaggcggtgactttgtaagtttcttgatctctttagtatgatgttaaaaacagaagggactgaagatttctggcattgaagaaagctattttatgaacattctgcactgagcaggtaaaaacccaataatgcacaccaaaagtacacagaaatgaggtagtcccatgtagtggagccccaaaggtaggtgctttctgcctaagtggagctcaaggtagcaaaaaataatggggatgagccatggcaccttgtcaggctggtgctataaagccatatgtactgttatttacaccccatagacttaatagtctgtccaagatcgctgaacactagaacatagcatggctctgtgggtttgtctcttgctacattgtaccgtgctcctggggttaagtggaagcaagcattgggagaaatgtgtgagatttagccccagctgttctttagctcagatttaaacctgctgtctcttctttatttgcagaatgaattcccagttcctgagcagttcaagaccctatggaacgggcagaagttggtcaccacagtgacagaaattgctggataagcgaagtgccactgggttctttgccctcccttcacaccatgggataaatctgtatcaagacggttcttttctagatttcctctacctttttgctcttaaaactgcttctctgctctgagaagcacagctacctgccttcactgaaatatacctcaggctgaaatttggggtgggatagcaggtcagttgatcttctgcaggaaggtgcagcttttccatatcagctcaaccacgccgccagtccattcttaaggaactgccgactaggactgatgatgcattttagctttgagcttttgggggttattctaccaacaaacagtccattggaaagaaaacagtccctggaattaacagatcagaatgttcacactggttaatctttttttaacaatgagcatgaaggtagcagaagctggtgtgtttccagatggttcttctaaccaaactaatttttcactgttgacaagcgaggcaagggttgcactggaccaaaggctgaggcttggccatctagcattccatacaaaattgtttcctataagcattccttttattctctattctatcctgggtctgcctcaaccgtgagataggagagtctctggtactagctgctgtagcagtgcccttcatccagggcagttaatggagtcttggaccctttctttctctgggatccctgcccagcaccttcctatagagatgactttaaaaggaaaaaaaaaaaaaaaaaaacccacatgatttcaaggagtctggcattcctgaatccttcttccctgccaggtgcctgtcacctgtcttcactgcctccttttccctgtcatgctcatcagcttatggcttctgtctaagcacctgaacagaggactgaaacctccactgcaggctggttttaggtcttgaattatgtaagaatcttgcacagcactgctaatgtaaatttcagttgtttttccctctaggacaaacacttaccaaaatatgcaacttttttttggtgggaagagagattgtcctgtgatttctacccatttcctgaggcctgtggaaataaacctttatgtacttaaagttatacagaaaatagaataaagttaataccaaacttgcttagttgtttacctgtgatattggctgtacagaaatgcaaaaaatactgaaaacaccaaggataagaaactactctttattttagacaacctcataaaattattttcacatcccccccaacttcttgctcttaatcctcatcttttagttgaagaataaggcttaagagagagaaaggaaaaaccataatggctaaacttagcagcaccaacacggttctttcatcaaggcgtagctcatcatttctccaaactgacatgctacagaaatgtcttccaaaaagcgttaagttttcacagagtggggactatgatttccatgctcaaatagtgtaggaaatggtagattacgttagttttgtttactgtaacaggaattctcaggagtccttagacactctaatgtgggttgatctccagaaggagaaagggagtgtgtagtattttccaagctttttgagcaaacaatccttttctcatggaacacatcagaaacagtttggagtatgctggtaaatgtgttttggggatggaagtcagaaagcctgatctttttcatatggttcctcctattctctgctaaagccagcaacagagtaagttgactctagcatcaagaccactagtcatattaagaaagggcaggttggtcgagaatggaataggaagaactagctgcctcacttttcactttcgcgcctacattttcttcgctccctaagttatacaagatgtacatttcctctcttaagcaacttaatttgggtgctacttccctccttttgtgacagcaactaattcatcactacctgaggagacaaagtgggtgctgcagaagcaagactgtaggccagtgggatttgtctaataattgatgataagatgatagcacagagggcaacgtactgagagaggaaggcagccttaagaaatgatgcagaaatagccaagcaagatttttccaagcactggttaaatcaccagcaaaacaaagcatttatgtgagtacctcaggcctgggcacctctttgcttgaaatatggcaagacttggaaaaatgtttgcccttagaatctatctcactactttagttagttgtctcctttgggcctgggcacagttctggcactgatctggaacagactcccttttctaaaactgaacttgaccacatcaaaagtttgtaaaacaatctccatggtaattaaacttgcattcaacaccatatggtaacagaagatggcaaaggataagattcagatcttagatctttccaagtagggcatgttagatgatagaaggattagttgcaagctggatctgagctcaggcttgggcatgaaggaaactgtctcccatgtggtttggaagagttaggggctccctgagctctattgtgaactatacgggtttcatccaaggaatggtatgatgtgggcataaaaccattcttcagacaactgaagatggtccccttctgtagccagaaacactagctgtcctgcattgtccatttcctttagccccaggcggtcctgcagaaggaaaggccataattaattaaaaagcttaatgaagttttggagtaaaatggtaagtacgttaacttgagatatattttcaaaatgcagtttgtcctgagtattaaaattgaggtgtattttcaaaaatgccaaaaagaatatctcctacttctttttctttctcttttttctttttctttctttctctttcttcctttcttttctttcttctctcctccccctcctcctgtcccccccgcttcttcttcttcttcctctctctctctctgtctctctttctctttctttctttcaagacggagtcttgctcggttgcttaggctggagtgcagtggtgcgatctcggctcactgcaacctccacttctctggctcaagcgattctcctgcctctgcctcatgagtagctggaattacaggcgcatgccaccatgcctgggtaatttcttgtatttttagtagagatggggtttcactgtgttagctaggatggtcttgatctcctgacctcaggtgatccacgtgcctcggcctcccaaagtgctgggattacaggcgtgagccaccacacccggccagttttttctaagtattaaaaatagatatgcaattgagattgctctatacagtgttctagattctgatttttgaaaagctcagagtcagaggactacctataggtgggcaagccatagacgacactgcctcagaatgccataggtaagtgggactgagccaaagacagaacattagctaggtaacttaaaaaacatccaacccaggacaggcgcggtggctcacgcctataatcccagcactttggatggccaaggcaggcggatcacctgtggtcaggagttcaagaccagcctgaccaatatgatgacactttgtctctactaaaaatacaaaaattagctgggcatggtggcgggcacctgtaatcctagctacttgggaggctgagacaggagaattcgcttgaacccgggaggcggaggttgcagtgagctgagatcatgccattgcactccagcctgggcaatgagcaaaactgtctcaaaagaacaaaacagaaaaaccatatccaaccgttaggtaacaaaccctggacactttcatattctggagttgaaaatgtcattacccatagcctagatgctggagaacaacctctggttgggaagataagcagttacgacagtgccagaatggtgcttctgccgtggccaacatcattttgagttttcacagtaaggaagttcttagctgtaatttctcaagcctttttttttttttttctcaaatcagattctagcttccctttttacctcaccacccaagttgaggcacccagtgcaaaagaaaagccaagccaagaggagacaaatgacctctgaaataacatggaggaattctagtagacggtgattggttcagatgtagtacttagcattttggagagtctgtctccaatataaaatccttagggctgggcgtggtggctcacacctgtaatcccagcactcttgaaggctgaggcaggtggatcacctgaggtcaggagttgaagaccagcctggccaacatggtgaaaccccgtctctactaacaaaacaaagtattaggcatggtggcgtgtgcctgtaatcccagctactagtgaggctgaggcaggataatcgcttgaacccaggaggtggaggctgcagtgagctgagatcacaccattgcactccagcctgggtgacaaagcaagactgtctcaaaaaaaaaaaaaaaaaaaaaaaaaaaaaaaaatccttaaagtgtagaaggccccagaactggaggtggcaaattactgcaacttctgcttaagatacaggacctactgctaaacaaaattcaaaactctagtcccactcaacctcctgcaggagcctcccttgtcagtgcgtaatttagaaacaggatttcacatctattaatgtttaaaagtaatgtcccttggccaggcgcactggctcacgcctgtaatcccagcactttgggaggctgaggtgggtggatcacctgaggtcaggagttcaagaccagcctggccaacatggtgaaactccatctctcctaaaaatacaaaaattagccaggtgtgatggcacacacctgtaatcccagctactaagggggctgaggcaggagaattgcttgaatctgggaggcaggggttgcagtgagccaagattgctccactgcactccagcctgggtgacagagcgagaccccgtctcaaagaaaaaaaaaggaatgcccctcatcatgcatggaggcttcctggatttgtagcagactgtacctcagccaaggcagctagttttaaaacctttttatcaaaagaagggaatcagacatgaggtttctcttgttgtttggaaaccataaggtttcaggatgtagtggatttttgtaacccagtgcctaataagctagagcacataatcaagagcctaacaagcttcacccatattggacatgagtcaggtgtttcaggagtacctagtgctctgaggtgtaaaggaaagggctccagcaccaaagaacatagcagcttcaggaactgggagctgaaaaaacaccaacctcccaagatagactccctgccagttacctgtgtgtacagggaggtctcctgtaagggaatggtttccttggcttggccacttctgtaaaatccaaaccactgcagaagaagcaaaggaaagaagctcagatatgacacacagcacatactgccaaaataatttgagactggttagaagctaaaactgccaacaaagtgaacatcataaagctgtaggaagaaggaaaaatggatagggtgcgtctgagtcatctcttcttaagggtggagcccgagggatgagttaatctttctgagaggccgctttccacttccccagaatttctgcttcctaaaattattaagcaataaatgtgaaaaattcctgtgctgagctctagacattcaaggatgaatacataatctgtttccaaaaagctcccagtcttgcaaggcacggaaacaattcactgttgagtacagaggtcagcaaacgtttttgtaaaggccagatacaaaatattttaggctttaagggccatatggttgtaactactcattgctgccactgtaacaaatgcagccacagacagtatgtaaaaagtaactaaaactgttccaataaggacactgaaatttaaattttacataatctttatatgtccaaatacttgatatgtctaaataaattttacataatctttatatgtccaattctttcccccaaccattaaaaaatgttaaaaacattcttttatgttagtgtttggtgttactcgtgggtagcaccaaaacgggtagcaggatggactgggcctgtgggccacaatcggccaatccctggtggtgtgacataacgtgatgagtgttttaacagaggctgatgattctaaaaaagcgatcacattctgcttggaatggggatggcatccttgccttgacagacgaatagaaattgtcaggtggagaagccaaggaagggcattctagagacagaaatatatgaaccaaggcatacgagagaaaaagcacaagtagtacaatatggcttgatcaagagtgtatgaagcgtgcagacaaggcagattaggctggaaaatggggtgaagccagatcaaggcagaccttggaggccaagcttaggaatttatatattttgggctagtgattctgaacattttttgggtctctgatctctggaaaatggattaaaattatagatccttccccagagaatgtaattacataattttgcatagaattttggggttgggggattgattacaatcttcagtgtcccatttatggacctcaggtgaagaactgttttatacaaaagttggtggaagggactgaaggttttttccccagcaggcagctgtattttttcatttcatttcaatttcattttatgttctttttgagacagagtctcgctctgtcacccaggctggggtgcagtggcacgatcttggctcactgcaagctctgcctcctgggttcaagtaattctcctgcctcagcttcccaagcagctgggattacagatggctgtcaccatacccggctaatttctttttgtattttgagtagcgatggggtttcaccaagttggccaggctggtcttgaactcctgacctcaggtgatccacccgccttggcctcccagagtgctgggattacaggcatgagccaccgtgcccggccagcagccctattttaatgccatttactctcctggcatgtggcctaagtagtgtctcacctccgaatctacagggtccacaatggaatcattgaggaatttcaccatcacaaacttcttcagggccatcaggtttttcttgtaggactcattgataccctgaaagaaaggccagcaacacctaaggtcattaccatcagacaccagcagagggagtaaagccttcctgttttctggtctccctgaccctgtgccactgtgtttcttccccatgggtatgggctgttttccagcttcctgaccaggatatacctgtacagcttttttttttctttttttctaaaaaacaaaatattttattttagattcaggggggtacatgtgtagttttgttataagggtatattgtgtgatgctgaggtttggggttctgttgatcctttcacccagatagtgaacacagtgcccaacaggaagtttttcagccctagcctctccctcccagcttttggagtctccagtgtctattgttcccatctttatattcacgtgtacccaatgtttagctcccacttataagtgagaacatgtgatatttggtcttctgtttctgtgttcatttgcttaggataacggcctccagctgcatccatgttgctgcaaagaacaggatttcattcttttttatgactgtgtaatattccatggtgtatatgtaccacattttctctatccagtctaccgctgatgggcacctaggttgatttcatgtctttgctatggtgaacagtgctgcaataaacacgagtgcaagtgtctttttggcaggacaatttgttttcctttgggtatatacccagtcacgggattgcttacacagccttttcttttccttttttttttttttttttttttgagatggagtctcgctctgtcaccgaggccagagtgcagtggcaccatctcagctcactgtaacctctgcctcccaggttcaagcgattctcctgcctcagcctccagagtagctgggattacaggtgatcgccaccacatccagctaattttgtatttttagtagagacagggtttcactatgctggccaggctggtctcgaactcctgacctcaagtgatctgcccacctcggcctcccaaagtgctgggattacaggcgtgagccaccacgcccggccttctataggcttttcttaccatcctatctgactgacatgccactgagcatggcatacaggtacaactatgagtttacaccacactccataggtgtccatcacataggtgagaggcttctagtcagagaaagccaagacaaaataagaaactgcaaattctgggtcgttctgctatatactattctgtgttgttttttgtttggtttgtttttcccttcaaactgtttcaaaacaaaaaaccaaaagactctccagatgagtcaaatataaactgagccatctagtttaccagaacctaccaaaccatgtttgtgtctgggacatactcagtgcctactgtatctctcttttaggtaaatctctagagaaaaatccacccccagactgatccatcaggaaagcttccctcattaagacagcagctgtgaatttccacctcgcccagtcagcaacctgccgagcttatcctgtgtgtttcaacactaggagagggaaagaacttaagggaagaaaggcaaatgaatttcaacctccctaaagggaactgaatctcaaaggccctgcctcccaaaaaaaacagaacttctctttcctagtgtctgcccaggacagtttgggtaaacagtcactgctgatttgtttatgaagacctaaacaggaaaaagaacgcacatctatgggagcccggtttgggtgcttacccgctcctgatttatatctgccaagaagatgctgtggttgcgatacacatcctcctttatggggtcatgccagtattcggcttgcacgaggctgtaggaaaaaaaaagaatgaggtgatcaagctacaggtcagtcagtacgcccagggcatgctcagtgcaaaggccaccaagagactttaaaaggacaaaaggccagccaggcacagtggctcacacctgtaatcccagcactttgggaggctgaggcaggtggatcacgaggtcaggagttcaagaccagcctagccaagatggtgaaaccccgtctctactaaaactacaaaaattagccaggcgcggcggcaggcgcctgtaatcctagctacttgggaggctgaggcaggagaactgctagaaccccggcggcagaggttgcagtgagctgagatcgcagcactgcacttcagcctgtgcgacagagtgagactctgtctcaaaaaacaaggacaaaaggccaaagccctcaagtcccaggccttaccctttaatacagaagacaagacttgcacctaggaaacagtctgtcaacaagacaccttgttgagacagactgttcagcatagtacagaaattataaaagattcaggcaaaggactcatcaatatttgcttctcctgtgacactggggtttatcatacttatcatgctgatatggtttggctgtgtcctcacccaaatctcatcttgaattgtaactcccacaattcccatatgtcatgggaggtgactgaattacaggggtgggtctttcctgtgctgttctcgtgacagtgaataagtctcatgagatctgatggtttcaaagaggggagttgggccagattctgtggctcatgcttataatcccagcactttgggaggccaaggcgggcagatcgcctgaggtcaggagttcgaaaccaacctggccaacatgaggaaaccccgtctctactaaaaatacaaaaattagccaggcacggtggcatgtgcctgtaatcccagctacttgggaggcagagggagggagaatcgcttgaacctgggaagctgaggttgcagtgagccaagatcacgccattgcactccagcctgggagacagagcgagaatccatctcaaaaaataaataaataaataaataaataaatagaaaataaaattaagaggggagtttccctgcccaagctctcttcttttgtctaccgtcatgtgagatgtgcctttcgccttccgccatgattgtgaggcttccccagccacatggaactgtaagtccattataaacctctatttgcccagtctcgggtatgtctttatcggtagcatgaaaacagactaatacagtaaataagtaccagtagagtggggtgctgctgaaaagttacccaaaatgtggaagtgactttggaactgggtaacaggcagaggctggcacagtttggaggcctcagaagaagacaggaaaatgtgggaaagcttggaactttctagagacttgttgaatggctttgaccaaaagcctgatagtgatatagacaataaggtccaggctgaggtagtctcagatggagatgaggaacttgctgggaactggagcaaaggggactctttatactttctttccaatctctctccacttcctcttcccttccagcccccacctcctcaaaatgggcacggttaccccaaggcctcacatggggaaattcgaacaaactctatcccaggttggcagggagagaaatcaaaatttctacaacatacgctccgtagccagagtggaagagctgcccagaggcagtggtcctgaaaacgccactcggtggagcaggctggcgctaaagcccaacagagccagctacgtcagagatggagctctccctcccaggagcagatgagactgaagttaaaggaagcaacagtcagagtgacattctagaatgtgtttatacatgtatttgaaaccttttaaaggtttagaactctgaacatttatagaatgcaaaaaaaaaaaagttcctgaggaaaattagaagtgttatttcagtgaacacacaaataataaggaagcaaaacagtcttattgctgctatggagaaaatctgagtggtctagatagaagaccaaaccagccacaacattcccttaagccaaagcctaatccagagcaacgtcctaactctcttcaattcaatgaaggctgagagaggtgaggaagctgcagaaaaaaagtgtgaagctagcagaggttggtttgtaaggttcaaggaaagaaaccatctccataacacaggagtgcaagatggggcagcaagtgctgatgtagaagctgcagtaagttatccaggagatctagctaagatacttaatgaaggtggcgaccataaacaacaaattttcagtgtaggtgaaacagtcttaaattggaagaagatgccatctaggactttcacagctatagaggagaagtcaatgcctggcttcaaaacttcaaaggacaggctgactctcttgtgagtgcctcatggagctgatgacttgaagctgaagccaatgctgggttaccattttttaaatcctagggcccttaagaactacgctaaattactctgcctgtgctctacaaatggaacacaaagcctggatgacagcagatctgtttacagtgtggtttgctgactattttaagcccactgttgagacctattgctcagaaaaaaagattcctttcaaaacattaccacgcagctgggcatggtggctcatacctacaatgccagcactttgggaggccaaggtaggaggaccatttgaggccaggagttcaagactagcttgggcaacatagcaagaccccacctctagaaaagaaaattctttttaaaagtagccgagcatggcggtgcatgcctgtagtcctagctactcaggaggctgaagtgggaggatggcttgagtccaggaggtgaaggctgcagtgagctgtgatcacaccactgcactctagtctgggcaagagagcacaaccctgtctcaaaaactattttttttaattaaaaaaagtttaaaaacaaactcaaaaaacaaacaaatattacagctcattaaaaagcacctggtcacccaagcgctctgatggagatgtacaaagagattaatgttgtcttcatgcctgccacagcacatccattctacagcccatggatcaagtagtaatttcaattttcaagtcttattatttaagaaatacatttacaaggttgtagctgcatagacagtgatccctttgatgcatctgggcaaagtaaacggaaaacctgatggaaaggatttatcattctagatgccattaagaacattaacgggctgggtaccatgcactttgggagggtgaggagggaaaatcagtggagcccaggagtgtgagactagcctgggcaacataaatgagatcctatctctacaaaaaaattaaaaaattagtggggtgtagtggctcacacctgtagtcccagctgctcaggacgctgaggtgggaggattgcttgagcctgggaggttgaggctatgttgcagtaagctgtaatggcaccactgcactccaacttgggtgacagagtgagactctgtctcaaaaacaaacaaacaaaaattcatgattcacgggaagaggtcaaaatatcagtattatcaggaatttaaaagaagttgattccaaccctcatgaatggctgagggattcaagacttcaatgaaggaagtaactgcagatgtggaaatagcaggagaactagaattagaagtggaacctgacgatgtgactgaattgttgcaatctcaaaaaacagataaggaattgcttcttacggatgagcaaaacagtggcttcttgagatggaatctactcctggtgaagatgctgtgaacactgatgaaacgacaacaaaggatttagaataaatattacataagcttacataaaagcagcggcagggtttgaggattgactccagttctgaaagatgttctattgtggccaaaatgctaccaaatagcatcgcatgctacaaagaaatctttcatgaaaggaagagtcaactgatacaaagttcatcattgtctcactttaagaaattagcacagccaccccaatgtgggcagcaggccacccaggtgccgaggcaagagaccgagggcatgagctgttccggtataataaaatatataaaacaacaagagttatcctagacctagatcataaacatgattatatatgaataccattcatcattagtttgtagcaattattctttattccaatattataataatccttgccctacaatcataacctaggaaaagccaggccatacagagataggagctgaagggacatgctcagaagtgaccagaagacaatagtgtgagccctctgtcatgcccggacagggccactagagggctccttggtctagcggtaatgccagcgtctgggaagatgtccgttgccaagcggaccgtggtctagtggtagcgtcagtgccaaggaaaaacacccactacttagcagactgggaaagggagtctccctttccccgggggagtttagagaagcctctactcctccacctcttgtggagggcgtgacatcagtcaggcccgcctgcagttatccggaggcccaaccatctccctgtgatgctgtgcttcagtggtcatgttcctagcctgctttcatgttccatcctgtacacctggctctgccttttagatagcagtagcaaaattagtgaaagtactaaaagtctctgatatgcagaaataatggcctaagctgtctttctctctctctctccccacctcggctgccaaacagggaagggccccctgtccagtggacacgtgacccatgtgactttacctatcatgggagatggctcacactccttaccctgccccccttgtcttgtatccaataaatatcagcgcagcctggcattcggggccgctaccagtctccacgtcttggtggtagtggtcccccgggcccagctgtcttttatctctttgtcttgtgtctttatttctacaatctctcatctccgcacacagggagaaaaacccaccgaccctgtggggctggaccctacatcccaaccttcagcaaccaccaccctgatcagtcagcagccatcaacaccgaggcaagaccctccaccagcaaaaagatgacttgctgaagactcaaatgattagcattttttagcaataaagtattttctaattaaggcatgtactttttttaggcatgatgctactgcacacttaatagacttcagtatagtgtaaacatagcttttatatgcgctgggaaaccaacaactttgtgtgacttgctgtattaacaatatttgctttattgtggtggtctagaaccaaatcctcagtttctctgaggtatgcctgtagttcgttacattactctctaacttttttgaatggctgaaagtctctgagagagcctgagtagatgccttaatatttccagaaaaccaagttgcaagttcatcggctgagggcaaagacatgggaaaactggacaattgaggaaaagcactctgagatccactgagggtggggtgcaaactgggagcggggcccagagcagacctggggaaggcaagttgctatgaaaattaaacaggatatgtaaagctctagcttcctctgagctggtacgggggaagacggaggccaaggccagggcaacactgaagcattcattgtggcagggagtgtagaggtaggagggtagagcgtggggcaggggatggcagggagcaaaccggaggaaggagaaggctaggaagggctgacagcatctgcaaaggcaaaagggaactagagggtagttttacatccaggaaggagagagagaactattataccattcctcgttgccctcaccatgccaagccgggggcttccccaccagttactgtgcgtattaggatatcacgtttgctttgctaaggttaagttatctgaagaatgtggaagacatcttttggggtctctgcctctcttgcactcttcctgcccggcctactggtttacagggaggtggggtatggttagtaagcacggtcccacttctctggccacagctaatgagagcagagggggagacctgacctgagctggggcatggtcccttcctgaagaatctgaatcgggacaaagagagtctagcctcagactgagacaatctcctaacagaaaattaaacatttggaagccgtgcgaggccaccttccatcatgtgggtggcaggggaagctggtctgcatggagagaaagaagcagcgacacagagagagaagcaacaatggcactggagagagaataccctggctcctcatggctcccaattcttgattctaggccctatgaggctttaggcaccaacagagtattactttcttttaaaatttactttggcttgatatgggtttcttcttgcaaccagaattaatcctccctaataccaggggcaacctgggacagtatcacaaagacaaaatgatttctctttattactttaagccttcaccatctgctctgctaaaacagttctcacactcattcatctgcttgcttgctttcaaaaacatgttgccattttttatgatctcttacctcctctctccctgttctctctgcccttgtgggtttatcactttttattcttctgctaccacttaattaaagtttaaggaggaagtgaagataaacacatcaatctatagcttttaatcagtattttttatttttattttttgagacagagtctcactctgtcatctaggttggggtgcagtggtgcgatctcagctcactgcaacctccgccttctgggtgcaagcaattctctagcctcagcctccggagtggctgagactacaggtgtgcaccaccacgcctgcctaatttttgtatttttagtagagatggggttttgccatgttggccaggctggtcttgaactccaggcctcaagtgatctgcctaccaaggcctcccaaagtgctgggataacaggcatgagccactgcgccccgccttaatcagtatttaggtgtcacttgtcaccccccgacggactgctcacttagcatcactaacagaattctgatcgccaagggttgttttggttcacacaaagaaagaaaagtataggcgttttggaggcaactgggcaagagtgagaataaagagtaaaggaagaagaatgaagtttaaataccatgcaaatccatgagaacagagaatatgtagaatataaataattaagttgtaattagccacagccaatcaaaccaggcaaaggggaaagcttggtgtagcctgagggtaaaaaaaaggagctagaggtacagagtatcttagttttctataataaccatcaggtggtactgctgacccaaaacagctttgtggctatttgtgtagccaacgagtgggaaaagaaaagacagctattagctgtaggtggttacaacatgagtcagtcacaaggctgtatcttggaaaatggcttcaagaatatactgtaataaaaagttgttatttgacaagaatgagacacttggaaaacccacaggatattagttgatcccaaactccagctatcatcaagagcacgtcagacctaccatcaaaacttttttttttttttttttgagacggagtctccctctgttgcctaggctagagtgcagtggcgcaatctcggctcactgcaagctccgcctcccgggttttttaagtgattctcctgcctcagcctcctgactagctgagattacaggcgtgcgccaccacgcccagttaatttttgcatttttaatagagacgggatttcaccatgttggttaggctggtcttgaactcttgacctcatgatccacctgcctccacctcccaaagtgctgggattacaggcgtgagccaccatgcccggcccacaacttctaaggataaagcccaggaatccatttttaatgaatttccctgtggttctgatatacaattaagtttggaaccaactgaacaagcacatactacaaaagtaattctgcatctttttttttttaaaaatagattttaacagagacaggggtctcactatgttgttcagactggttgtgaacttctggcttcaagcaatcctcctgccttggcctctcaaagagctgggattacaagtgtgagccattatgccaggctggccatgctaaatacccaaatacatttgagtagtcagggacagtgatatagggagtagctaatgacataaagaatctgtcctctaaataccaacaataattccttgagcttagtactttctaaaggctttctgtttgttttttaaggatggaaatttattctgttataattacattcttcttacatagaaaaatgcccttgtttttctttctttgttttttagttaatagactttttggagcaagtttaggtttacaatgaaattgagcagatagtacaaaaagatctcatttgaaggccgggtgtggtggctcacgcctgtaatcccagcactttgggaggccaaggtgggtgggtcacctgagctcgggaagttggagaccagcctaaacaacatggagaaacccagtctcttctgaaaatacaaaattagccaggcgtagtggcgcatgcctgtaatcccagctactcggaggcggaggcaggagactcgcttgaacctgggaggcagaggttgcagtgagacaaaatcacgccactgccctccagcctgggcaacaagagcgaaactccatctcaaaaaaaaagatctcatttgaatatcacaaggaactactgctggaatcactgtgagcatgaaagtcagcatgatattttcacacggtgacaggtctgtaatcttttcagctaaccatacataccgttcctgaacaactttggagtacgccccagcattcagtgtttttcggatgaagtcacagatgtgagagctctctcctgggcatcgagggagtccaaaaacacctacagtggtagatgacaaatatccactccttcaataatgatgtatcgaatacccactatgcacaaggcactgtgagaaacaaaatgaacaggaccaaactctgatttcattcacttattcctcatgaaaataaagcgcagagaactaatactatcaccagcttcctcctggtgctgctacactctttcctgcctaaggatctttttacctgctcatccctggaggatgtgttgcatcacatggctggacgcattttcagctctcaggtcttggtcctacacaagtcacatctgaccaccttatctcaaatagtacccacccccatttccttcccctcccccagttatacttcatccttagcatcctcatcaataacattgttttgagtaacacaaatagttctaagcaaaatattggcaataattaatttaatcctcacaaccaccctgtggagtagatttcattatttgccctatatcacagatagaaaactgtaaaaatgaggttaaataccttgtccaaggttagacaataaggtataagccaggattcagacacaggcagtttggccccagagcccactcctttaagcactacaaccactagtgtgtccttcgaacagtatcctgttgtttttttccaagagattgggtcttgctatgttgcctagactaaagtgcaatggctattcacaggcacaattacagcacaccacagtgtcttgaactcctggcttcaaatgatcctccagcctcagcctcccaagtagcagggactacaggtgtacaccaccatgtgcccagctatcctccattttatcgtgtatatatatatatgtgtgtgtgtatatatgtgtatataagtgcatatgtgtgtatatatatgtctatatatgtctatgtatgtgtgtatataggtgcatatgtgtatatatatgtctatgtatgtatgtgcatatatgtgcacatgtgtgtgtgtatatatatatatttcatgaatgcaagaaccttgtctgtcttgttcctggcatataataggttttcaataaatatttgttaaatgaatgaataataaagctgtttttaccaacttacgtttgtataatccttatacttttaaaaagtattttcctacctattatttcactttatcctctgaaaaattcccataggacaggcagggccatattttggtttcttccatctgtgagtggaacctaagataccaaattacttgcctaggagtaatagttaattgggtgagtccaggtttcctgattacacggagaatcattctgctcccacattataccagctaatagctatacccatcaacaacagagatgaaattccattctaatgacacatccttccccaatagtatggaattccgtcaaaatagaaaacctgctgtttctcaaagagtttaaatttatagacacaagagcttacacactattctttgcctaagcctaaattcaagaggataccaccaaatcagagaacagaaaaggtcactcaattttcctaactcctcaaccaccacctgccacgtggctataaccatcttacttccatgcaatcgtgtcaatgaaattggagagaagtagatgccaacctagtgatccaggcctctggaatcctaagtctcttcctatgtctccagcaatgctggctagtttgttaaaagctagagaaacaggattttgcaagaatggctgatgtcttgtgcaaatatagttcctagatttttttttaaatcaggtggtcatgtgggttagaatacagaaaaaagaaagcaaagaggcaaagttaccttgatgttgtcccccaaccgagatcagattgatcatgggaggtgaagggcatctctgagccactgccctcctacggaataaaagggagttttagctccgactgtcagatggaaatgtatcatccacaatcagcatcacagattaagctagtcatcctctgtgactccccaaacccgcagagtttcaggattttcctgatatgggcaaatgcaaatatttctttcaactttcatagaaaataaattaagctccagccaggcatggtggctcacacctgtaatctcagcactttgggaggctgaggtgggtggactacctgaggtcaggagttcgagaccagcctagacaacatggtaaaaccccatctctactaaaaatacaaaaaattagctaggtgtggtggtgagcacctatagtcccagctactcgggaggctgaggcaggagaatcacttgaacctgggacgtggaggttgcagtgagctgagatcgcgccactgcactccagcctgggcaacaagagagaaattctgtctcaaaaaaaaaaaaaaaagaaaagaaattaagttccataaagcttcttacacaggaacattttaggaaatttcccttccaagataggtgacaatcttgaattggaggagtggatttatctgaataaaagaaacaaaaatcaattccatataagtggtacaatataacaaaaaggaacgtacagaaattggcctccctgggagaatcccatagcattgtagccttgctgcaatttaggatccttagcaagtgcctgacacactgttgttacttgggaattgacattcaagaagaagctgttctccacgtcctaaaaaagaagccagagagaagtgagaggatgggactgaaaacaaccactgacatcttctctaagaggtaaactcatttaggttggtatcctcacatgagccactcaagggtgaaagtatcactgtatgatctgctgctgaaaacacaaggcaaagcattttaacagtatatgctatgaaatcagtcagcaacccttcaaaggaacagctgtgaagcgccttacctccatcagggtcttcccaatctctaaagataagacgtaaattccaggtattttcttctccaccatttttttaatagcacccatgcttaagggattgcaacagctgtctcctagccaacaaaacacaatgatggaaactcatgagtccaaatattgtttattgtttaaaaactctgaggcctcaaacagcattatcaaggatgtgaaaacaatgtatagaatggaagaaaatatttgcaaaacagttatctgataagggcttaatatccagaatatacaaggaatctataactcacttacaactcaacaaaaagataacctaatttaaaaatgggaaaagaaattaaacagatatttttccaaagaagatatacaaatggctaaccactggcatgtgaaatgcaaaccaaaaccacgatgagataccatttcacacagactaggatgtctttaataataattttttaatagaaaataacaagtattgtcaacgatgtagaaaaatgggaccccttggacattgctggtgggaatgtaataagcagccactgtgaaaaacagtttggtggtttctcaaaaagttaaacatacgattactaaatgactcagcaattcaactcctagttatacaccccaaagaaataaaaacacacgtccatgcagaaacttgcatatagatgttaacagcagcagtgtttgtaatagtcaaaagggagaaacaatccagcagtccatcaatgaatgaatgaataaaatgtggtatattcacacaatggaatattactgagttataaaaaaggaacaaagtgctgacacatgttacaacttgaatgaacctcagaaacattatactaagtgaaagaagccagactcaaaaagccacataatgcatgattcctttcataggataaataaagaacaggcaaatccactgagatacagaaaactaagctggagattatcaagaagtagtaggagggggcaatagggagtgattgcttaatggctatgtgtgtttttctggggtgttgaaaaagaagtgttagttgcacaacattgcaaatacactaaatgccactgaatcgtaccattttaaatggttaactttacatgaatttttacctcaattttaaaaaacagaagaaagaacattttttgcttagctcctgtttatcaagtaataacaagcttcaaaagtccatacaggagctgggtgtcatggctcacgtctgtaatcccagcagtttgggaggccgaggtgggtggatcacaaggtcaggagctcgagaccagcctgggcaacatggtgaaaccccatctctactaaatatacaaaaattagccgggtgtggtggcacatgtctgtagtcccgctacttggggggctgaggcaggagaatcgcttgaaactgaaaggtggaggtttcagtgagccaagatcatgccactgcactccagcctgggcaacagaacaaggctccatctcaaaaaaaaaaaaaaaaaaaaatccatataggccaagcatgggctcatacctatcatcccagcgctttggtaagacgaggcaggaggattgcttgaggccaagagttcgagaccagtttgggcaacataacgagaccctgtctcaaaaaaaccaaaaagcccatataggataattaagacaccaaatttacaaatgaaaaataagcagaggtacacattcccttcccctatcacaggggatatttggggtgaacagatgcaaagttttctcttcagggccaggactagggtgaggcaaattaagcatctaggacagcggtcttcaacctttttggcaccagggaccaggtttgtggaagacaatttttcaaaactgttccacctcagatcatcaggcatttgctagattctcataaggagcacccaatccagatccctcacatgcgcagttcacaacagcatttgagctctttgagaatctaatgccactgctgatctgacaggaggtagagctcatggtggtaaggctgcaggctcactcacctcctgctgtgtggctagttcctaacaggtcacagacccagggagtttgggacccccgctctagggcacaaaatttaaggaggcactcattctcaggtttatgtaagtgttgaccctgaatttgagagtgagtgcctccttaaatttgcacttcaggagcctcttcatcttgtcctagccccagacttgtttcttctatttcagggaactagaactaggaacaggaagcaaactggctactgagtagaagtggactgagatcatttcccattttgaacttacttattccattttcaacctgcgagaaagcttaagcaccaattttagaacaagaaaaggctactgcctagagaattgtctattccttttatttctctgaaaacaacgttctccacactgagctgtaattgtaggttacttaactgcctctgcctcccctgtaactgactgtgagctctgggaaaacacaaagctcctaccctgtgtcctcttttgaccccactgtagtagccccagggcctgttggagaaccttgcaagtgtttgtatttgctgactctaattactctgaatatttttctgtaacccatcccaataaagatctcactatcacgactctcccaaaactgcttttgtcaagattaatcatctttatattgctaaatccaataatcagttgtcagcctttatcttccttgacccattaacatttgatacagttgatcatgacctatcaacatttgatgcagttgatcatgcccttcttcctgaaacattttcttcacttggcttcaaggacactgcgctttcctgacccctccacttcaccggctatttggttacagcctcctttgctagtttctcctcatttcctccacctccaaatggaatggagtgcctcagggcttagtcctctgtgtacgctcatttcctaggtggtctcacctagcctttaactactagctgtatgccgaagactccctacttaaatctccaacccgtatctctgtcctagactccacactccaaatgcctctacaacatctcctgggtgtctcatgaggatctcaagtttagtaagcccaaaagcagactcttgatctttcccccaccctaagtcagcttgtcctacaggcttccccatcttggtaaaatgaaaacttcacccttccaattgttcaggccaaaacctgtggagtcatctttggctcctttctttctctcttattccaagtctgatctgttagcaatccaccttcaaaatctatccaaactttgaccacttctcaacacctctactgttactctacagttccaagtcatcatctcttgtttaaattattgcaatagtttcctaacctgtctccctgtgaccatccatgacgccctacgatctattcttaatacagcaactaaagtgattctttaaaaatgtgtcagatcatgtcactcatctgctcaaaaagttccccatgacactctagccaaagtccctgcattagtcttactaggcccaataacttctgtacctgcccctcccttccaaactaaactcctaacttcttccccttgcttactcatttccagccacgctgatctgaatgctgtcccttgaacacaccagacatacttccacatcagggctttcccatttactgttccttctaccagacagccaaatggcaactgtcctcatctacctcagttttgtactcagatgtcactttttcaatgaattctttcccaactttgctttattaaaagtgcaagcccccacctccagtttttatcctacaccctactatatttttctctgttgcacatatcaccatttgatatgttatgttttacttgttaatttctttataatctgcttctcctactggagagtaggttccaaaagaacaaagaatttagtctgtttagttccctactgtatcctcagcacctagtaggtgctcaataactgtgttaaatgaatataggttgagcatcctaatctgaaaatgggaaacccaaaatctgaaagtttttcagcgcagacatgatgccacaagtggaaaattccacacctgacctcatgtgatgggttgcacaaaattatttaaaatattgcataaaattaccttccagctatgtgtataaggtgtatatgaaaaataaataaatttcctgtttacacttgggtcccaccccccagatctcttgtatatatgcaaatattaaaaaaaaaaaaatccgaaatgcttcccagtcccaagcatttcagataagggttactcaatttgtaaatgaactgtaggtgcctaacaaatctctgttcaatgtgtgaaggaataaataaaagggtagatgcgccagtcatatagccagccgcagctcacctagcctgaccaagtgagagatgctgcatcctgacgccactactgtaaggattaatcaaggacagcatgtaaaacttcaacgccgtgcgcggctctctctttccttccccttctctctttccagtgaaggggacggctccttccccttctctctttccaatgcagatccttcaaatcctaaaatgtcgaggcagccgcgtgctgtgggaccacgtcctcgccctctacacccgcattttgcagatgcgaacccaggctaggaagagagagaatcgccaaacccttttaaatttctcactcactcacccatcccatgccagatcaccaacggcagcggcgccggcgggtccagatgctgcagcgcccgagaagcgcaggtccatggcaggagagccacagccaagagccacaggcagccgggcgacgccatcttcgctgtgtcacatgaccgcgggcgcgagactccgggaaccgcgctccgcccgcctgggcgtggcgccgccggttgcagatcgcaacctgcgcatcccgaacggatgcccagcctgatgggcgtcggccctaccctggagctttcagcgcgacaggtcccccgccagaccccgctggccgagtggggctctgcgctctcgtagaccgccctctgcggtgaatcaaaataattgctaacatatattcagtgctgatcagatgctatcaggcactattcttacaacctttaactaattcactcttcataacaatgctgtatgcacttctccccctgacaggtgaggacactgaggcactgcgaattggcactgagtaaggtgcccaaggtcacagagatagcaaattggtggttccaaagtcgttgctcttcaccactgccctgtactgcctttgcaagaaacatgcacagaggaaggaagaaagaaggagggacggtttccagccaggaccaatcatggcagggtgtggggtttgttctggatattgaaggagaggtaggatttcaacaagcaaagatgaaattcagaaggactgagatgagctaaggtagagaggagaaagacaactgtgttttctagaaatgtcgggacttcaagacggacgaaagcatatgttggatgcataagagtgagggggaaacccatggccactaactggcctaatctcagctggattatttcaagggtctctcatcaaccatttccttttccattctctcctctttaattcattttatgctctattgccacattcatccctcaatccaccttcataatatcagttccctgctcaagttttttttcaacaaaacatcaaaaaatagtttaaataatttataaagaaattagagtgtatccactatacaatggaataatatgaggccagttttataaaaaatgagtatagggccgggcgcggtggctcactcctgtaatcccagcactttgggaggctgaggtgggcagatcatctaaggtagcgagttcgagaccagcctgaccaacatggagaaatcccgtctctactaaaattacaaaattagccgggtgtggtggcgcatacttgtaatcccagctactcaggaggctgaggcaggagaatctcttgaacccgggaggcagaggttgcggtaagctgagatcataccattgtactccagcctgggcaacaagagcaaaactctgtctcaaaaaataagaataaaaaataaataaaaagagagtacagcccaggcagcatagcaagaccccatctctacaaaaaaaaaatttttttttaattagccaggggtggtggtatgtgcctgtaatcctagctactggggaggctaaggtgggaggatcacttgagcccaggagttcaaggctgcattgagctatgatctcgccattgcactgagctatgatctcgctgttgccctgggcaacagtgagaccctgtctctctcaaaaaagaaaaatgaggtaaatttacataaagtgacatgaaaaatgcccttaatatgttgtaaaagaaaagtcgattacaaacccacggtctgtaatctcttctattccatgccattgggactagaggtaagttgttagttgaaaagtcgattaaaatgcagaatccactgggcgcactttgggaggctgaggcaggtggatcacctgaggttgggagtttgagaccagcctggccaacatgatgaaaccccatctctactaaaaatacaaaaaattagccgggcatggtggtgggtgcctgtaatcccagctactcaggaggctgagacaggagaatcacttgaacccaggaggcagagggtgcagtgagccaagattgagctactgcactccagcctgggcaacaagagtgaaactctgtctcaaagaaaaaaaaatgcagaatcataaagcattatacagtacagtatacagttttgttttaagaaaaataagcttattgtataagcattttattttaacttaagacttacaaattgaagtagtttcaggatttttctgtgaatatagcccgctcaatgaagtttcctgcctttaatgaactatttataatttctttaaaggtttctttaaactggagcaataactgaaagacacttgtgaagcaatctgaatgcaatttttttttttttttgagacagggtcttgttctgtcccccagactggagtgcagtggcgtgatcttggctcactgtaacctccacctcccgggttcaagcgattctcgtgcctctgcctcccgagtagctgggattacagacacaccaccaacatgccccgctaattttttgtgttttttgtagagacagggtttcgccatgttgcccaggctggtctcgaactcctgagctcaggcaatccgcccccctcagcctcccaaagttctaggatcacagctgtgagccattgtgccagaccaacattctttttgttttttatttttgattcagggtcacatatgcaagtttgctatataggtaagttgtatgtcaaggaggttgggtgtacgttttattttgtcactgccataatgaacatagtacccaataggtaacttttcatttccaccctcatgtaggccccagtgtctgttgttcccttctttgtgtccatctgtacttaatgtttagctcccacttataagtgagaacatgtggtatttggttttgttttcctgcattagtttgcttaggataatgacctaagcagttccatctatgttgctgcaaaggacattatctcattccttttttggctgtgtagtatgctatggtgtatacctaccacattttctttatccagtctactgttgatggatacttaggttaattccatgtctttgctattatgaatagtgctatgatgactttttttttttttttttttttttgcgacagggtcttgctctattccccaagttggactgcagtgacacaatcatagcttactgcagcctggaactcctgggctcaagggatcctcccgcctcagcctctcaaagtgctgggattacaggtgtgagccacagtgtttggatgtgaaattattctagatggaagactttccactctcagatttccgacccagagttactttaacaattttttttaacaacttgcctttaacaagcttttccaatgcattcaacttagttttcacagaaacatctcttttctctttatgctcatatttcatgttttcaaaaatttaactaaattatgatagcaaatatcaccgatatattaataaataaataaaataagcccaaaggcatttagtaagcaagtagctcaattgacaggaacagaactacccaagagttctgaaaagcagcctctagccatgtgggcatgctgtgggcataggtaagtaggtaagtacattttagaactgggagagtaagttaaacagggcataagaaaataactatgtatttatgtacatacatatatgatggttgtacaactctataaatttactaaaaatcattggtttgtacacataaaatgggtgacttttatggcatgtggaatatatttcaataaagctgttctttttttaaagaagacatctgtgtatttatatatttgtacattatcactgaaaggtcaaagcattgccaagaaaaaagaggctgggtgcggtggctcacgcctgtaatcccagcactttgggaggctgaggcgggtggatcacgaggtcaggagatcgagaccatcctggctaacacggtgaaaccccgtctctactaaaaaatacaaaaaattagccgggcgtggtggcaggcacctgtagtcccagctactcgggaggctgaggcaggagaatggtgtgagcccgggaggcggagcttgcagtgagccaagatcgagccactgcactccagcctgggcgacagagcgagaccccatcttaaaaaaaaaaaaaagaaagaaagaaaaaagaaagaaaataaatatttaaaaagatctggagaccgttaaaagtaatattcttgagggcagtattacaaggaactttcactttttactttatatacttgtgtttggtttgaaattttacagcaaggatatacaatttttataataaaaatggaaaatatacacacattaaaaattattagacttctagattaagaaaatggagtaaagctatctcacagactctgtttcaaccaatatctaggaaagtttaaaaagttaaaattgtatccacggcaaaaaaacgtcagtatcttaaatgtcagtaagtggtggtcaaggaaataaatagaagattctgggctggagcatgtcaaggcttccagttctgccttcattccatcaaaactcatacaattagatccacaaaatcctgacaattaacacaaacatatccacatacattacaagagagaagaaaagtaaacgctttccttctctttcccctcccatctctggaaaattgaaaatggctactggggagaaaaacttgaaatgggaagtatggaatagaccaaatctttaagatggcagtgaagactcaggaaaacatgctgaactgagagaagttccaaaaagtgaagctatcttttccatggaaatggactacaccagccattagtggggtgaactttggaatagacacttaacaaaacctcagaagtgattgcagaacttaggtattctaacaaaggctgcacatgagcagccctctcccctcttcagacaagcataaaaatcatagaaaaactgcatactgcataaaataacactcttctaactgcagttcagtaggaaaaacaaataagtttcaaataaagtggaaagcaattctggagacaaatagaaaaacaaaaaacttcaccccaagtgctttgagctgtagaacaatttattaagaaaatgacctcaggtcaggtgtggtggctaacacttacgtaatcctagtgctttgtgaggtcaaggtgaatggattgcttgaggccaggagtttaagaccagtctgggcaacatagcaacaccttgtctctacaagaataaaaaaatttaaccaggcatggtgctgggcacctgtaatcctagctacttgggaccctgaggcaggagaatttcttgagcccaggagttcaaggttacagtgagctatgattgtgccactgtactccagcctgggcaacagagcaagaccttgtctctaaaaaaaagacaagaaaatgagctcaatagaataagaactcaaaaccaagataataaaacaacggaaggagatgaatagggaagttgcacatttgagaatccaaagactaataaatacctgaaaacaaggaaccaaatagacatggctaggagtggaattagttttttcttttcttttttaaagacttttacactcctagaaatggaactattgatatggaaaatggttttaaataatcaaaataatggtagatgaaaacacaaagatattaaaacaatcagatagaaatctatagatatggaagacagaagttattggtgtccctgaaattgagaactcattaaatggaacagaagtattcaaaaatataaaaacaaaagtttgccccaaaatgaagtactaatctacagcttgaaaggtcaagacagaaagcactttgatacagaatattctgtcctgaaaaatattgtaattaacttattgaacttcagataaccaggcagaaaaagtagaatgcctacaaggaaaaaaactcaggctatccttacatttctcaacagcaacattccagagacagaagccaatggagcactggctacggaattctgaaagaacaaaagtatgatccaagaatattatacccagccaagatgtcatttggaaataaagatactaggcagattcccacaaatacaaaagaatgcataggaaagagctctctctggccaggcatggtggctcacgcctgtaatcccaggactttgggaggacgaggcaggcagattgcctgaggttgggagtttgagaccagcctgaccaacatggagaaaccccatctctactaaaaatacaaaattaaccgggcatggtgacacatgcctgtgatcccagatactcaggaggctgagcaggataatcgcttgaacccgggaggcggaggttgtggtgagccaagatcacaccattgcactccagcctgggcaacgagagtgaaattccatctcaaaaaaaaaaaaaaagctctttcaaattcttcttgagaaaatgcttgaaagtgaaattcagccaattaagaaatagggcaaaattaagacttcaataattaagaagtcttgggaaaaggatttgtgatgatcattgaatctgtttaaatacagaattaatactgaatacctgtgtgaatcattgctttataccatgtacatattatatgaattaacaatgtaaaatagtatgactaagaaatattgggccctgtggagggaggtaatggaagatagtatagtacgagtgcactctccttgggcttacaatagattctaatttaaaacgtattcttaaaaaaccagacctgggcagttgcccatgcctgtaatcccagcaactagggaagctgtagcaggaggatttgcttgagctcaggagttcaagaccagcatgggcaatattgcaagaccccattcctaaaaaattagctgggtgtagtggcgcatacctgtggtcccagctacttgggaggctgaggtgggaggagttcaaggctgcaatgccactgcattgctgtctggatgacagagcacgaccctgtctcataaaattaaatttaaattaaataaaattaaataaacttcaaataaacaaaacaacataatgtcaaagtcacttttcctaacccttatttgaagtccagattttaaaatttctttttatacttgttccttttttcctttttattcctttaagtttatttaattcaagtaaacttgaatttttgaatctttaactcaattaacttaaattagaattcaggattaacagaattcaattaactttaactcaattctgttaaattcaagtaaacttgaatttaatactttttattttttaataacacaccttatgatacaattttttaaagtacctatgtctatatacctatttatctatcattctatccatataaaagcataaaaagatatttagaatgatgttaatcaaatgttaatagtgactatttttagatggttggacttaggagttgtttttttaaaaaaatatttccccccagctttattgaggtataattgtcaaataatgagatttcagggggttttttctttttcttttgcattgcttagatgatttgcagtgaaaacatattattttcacaagaacaataagttgatttttcttaaaataaagcgtagagcaaaccttcaacacttctccctagtcttcaggatgtagttcaagcttttgtattcaaaatgagaatccaaactatcttcccaaacctacttcccacatttaataataacacaattaatatattaatataaacagtattccctgaaaattcctgctgctgttcctttgcccaaatcattttaccatctggaacaggcttgccatctttatctgtattaaacaaatgcaacccaccccacaaagctgaagttctgttccatgtcttccattgacctcccagagccccacaacattttcaaatcaaatagttaaaagtatccatgtagaaaaatacctacagagttcctacttcctctggatttggtttaaagaggaaccatttagtgggagacaaataagttctctcagtgtaagtcaattcttgactgttattttagtaagcagccactgaagcttattaattttagtaataagaagtgagaaattgcaaagcctgaatttcaacctaactagtactgagagttaataagatgcatatcagttccctgaatagactataattcaaggaacaatgggaacatagagaagtatctgaatgctcatcggtttcaattttcttttttgacatgagaataaagttgcttgctattaaaaagcatacttatgaataagcaagatctagagacttactggcttttcaataaaatgagcagaaatttcaccaagtgactagatatattaagagtaaatacttttggactgccaaacaacctacttttattatctgggccatgaaaaaagactatgatgctgttaccttgtggcagcagtggataaaaagcaacattaagatttcttggtttgttaactgttcagggctacagaactgatcataaaagtgagtaagttatattagacatgccatctatagtaaaaacttttgagaaaatgcttttatatatcttttctttctttcttttttatttatttatttttttaaatttttgagacagagtctcactctgtcacccaggctggagtgcagtggctcaatctcggctcactgcaacctccacctcctgggttcaagagattctcctgcctcagcctcctgagtagctgggactgcaggtgcacaccaccacgcccagctaatttttgtatttttagtagagatggggtttcactatgttggccaggctggtctcaaactcctgacctcagacgatccacctgccttggcctcccaaagtgctgggattataggcatgagccaccaggcctggccgctttcatctattttcttgcccaatggaaaagaatattatttttttttcacagcattaagacaacttttcaagtttttgaaaatttttaccaggtatgtacatacacacatgcaatatttacattttatgaagggcacaaaagagaaaataaagtctcttttcctccacatttattttatttttgtgttgtttttctacacatttcttaagtcttacaccctagaggcaattctgttaacaatttctgctttttagttttcctaatatttatcattaatataattattttaatttgattcaattaatttaattatttattgatttaccacctttaaactatatctccccataatgaaagacacagaaatgagaaaacttgcctttctttccacctctcctttccatctctaaatttttgttaatataataaaaatgtgtaatattggctgggtgtggtggctcacgcctgtaatcccagcactttgggaggccaagacaggtggatctcttgaggtcaggagtccgagaccagcctggccaatgtggtgaaaccctgtctctactaataatacaaaaattagctgggtgtgatggcacatgcctgtaatcacagatactcaggaggctgagaagggaaaattgcttgaagctgggaggcggaggttgcagtgagccaagatcctgccactgtgttccagcctgggccacagagcaagactccatctcggtgggggaaaaaagtgtaatgtttatattattttctgggaataaaaatattttgtgatttgtatatagatggacaaaaaactaaaaactcaaacccagaatttaccatattataatcctctgtatatttgctctagagccaagagatatgattaaacccttagtgatggaaatatattactgtgtcactaagactttgtaactcaaaagggagtcttccacacatcaagatctaatggattgccgggcacggtggctcatgcctataatcccagcactttgggagaccgaggtgggcggatcacctgagttcaggagttcgagaccagcctggccaacatagtgaaaccccgtctctactaaaaatacaaaaattagccagtcatggtgatgcacacctataatcccagctacacaggaggctgaggcaggagaatctcttgaacccaggaggcccaggttgcagtgagctgagattgagccactgcactccagcctgagcgacagagtgagactctgtctcaaaaaaaaaaaaaaaaaactaataggtcttttatgtcttccccccaacttttcttcactttgcc

SEQ ID NO: 1164 - DNA, 173134 bp, Homo sapiens
atgaaataggtgtcttgtccttaagtgggaggaggagagggtcgaggaggaaaacaggggcagttaaaagtgggtagtttctagtttctgttgggtggatgtcatcagttgttattttgaaatactgactgaaatttgagtaggctttgctggagttagattttccacttgtttttcagatttgtgtctttggttggacacccagagcttcttaaagcctgcagcactggaaaaaaaccaaaccaaaaacaaaaaacaataaccttgtggtgattattacatgcacctgcagagaaattcttttcttctctagattttacttagataatccacattcaagttcaatttcggtcaaaccccaaattcgaattgacgtaactgttctgatgttcggaatgcgtgcgatctaaaacgatgccagcgtgatgctcagaatctgttgatccatccatgcttgtcctggcatcttccccgatggtggctgccttagaccctgagcttccaatgttgccttagctggacgatagagtggccacgtgaacattcagtcgagaatccaggtgcacagccaggtgagagtatccagccaggtgagcagccaggacatgctgggagaagggaaacagtgagttctgttggagtccttcctgtcactccatgtcccttggctctctagtggctgaagtaactttagatttttaatgtcattcctacatctccagcttctcaacagtgcttgctcccagcaaaagtcccttcacttccaccacctcccagaggcatgccttctttcaccaactcgcagaggcgctatctcccagacatgggtctccttcccccatctcccagaggcgcgccttcttccgtcatctcccagatgcccgtcttcttgtcttatgagccttctcaggctcctccaaaacttgtttcttctgaaagcgtatttgacagcaagagttctaactgactttttccaaataacaacatccttgatttaaaattcattacgtgttgctgtttgtattttaaaatatcacctgtgaagtcgcagaacctttggatgtattaaaaagaaaggaaaagatgcatctctaaaacctctgaggcttggaaaaaaattcttagatcactaaactttcttgacattcttctcttgccagtggatgctgatgaatgacaaagagctgataggcagggcttaggacactgggaagaatccgtgctccttcatggcagagatcagtctgggccggctctgacgtccccaggaggtggaaagcaaagcaaagtctggttccttctttgtttccatcctttcctcccctgctttctccccctctcatgtgttactacagaaaagaggaaggaatacctgcccaccactccttaagagactttccctatcctcacccgacccctggcattcagctcaggagccctcagtgctcctttccacccaaactcctgtggctaattacaggaccatagagtcagagggaagcctggcgactgatccatcataactgaaacctcagctcaaaaaccctctaaatgtgtctgataaagttatatttcctgtgctttttcagtcccagctcaaggaactgtcaaccttccagggagagagcctgtctgtctatttatcaatcatctgtctacctacctacctatcaatctatcatccatctatctacctatgtatcatctatctattctgtcaatcatctgtctccatattatttgtttatccatctattactcatccatccatctgtccattcatttatctcatctctatatctatcttatctaatatctatctatctatctatctatctatctatctatctatctatctatcttgctatctatgtatctatcatctatctacctatcatccatctatctctatctatgtatcatctatttattctatcaatcatctacctctgtattatttttctacccatctatcatccacccattcgtccatttatctcctttctatatctatcttatccattaactatctacttctgtctatctctctatctctctatttgtctatatctttatatttatcatcaaatctatttatgtgtgtgtacatatgtgtatacgtgtgtgtacgtatacattaagtgtttgtgtattcaaagtaataaatacacataatttaaaaatcctttagttgtttctccttaccgtatcttaagtagatttgtgttttgctctttcctaatgtttaaattttgagatgatgtttggacttcctgttgaggaagatgacagtttatttaatcaattccccacacacataccctccatgctcccccattctctcagtcaggttgtaactctcagtttgattaatttggcatttacattatcattactcacagtggatccatttaatgtattataattatctttgcatttctggacaaagtattcttttatttggaattaataaaatagttattaatatgcttgggtttctgtgtatcacccactctcaaatctctgacagaactgaaatctcctttttttttttttttttttttgagacagagtcttgttctgtcacccaggttggagtgcagtggcgccatcttggctcattgcaatctccacctcctgggttcaagtgactctcctctgtcagcctcctaagtggctgggattacaggtgcatgccaccatgcctagctaatttttgtatttttagtagagacggggtttcgccatgttggctgggctggtctttaactcctgacctcagatgatctgccctccttggcctcccaaagtgctaggattataggtgtgaggcaacgtgcccagccgaaatctccttttttttgagacagagtctcactcttgtcgcccaggctggagtgcagtggtgcgatctcggctcactgcaatctctgcctcccgggttcaagtgattctcctgcctcagcctcctgagtagctgggattataggtgcgcactaccacacctggctaatttttgtatttttagtagagatggggtttcaccatattggtcaagctggtgtcgaactcctgacctcgtgatccacccgcctaggcctcgaaatctccttttaatacacttaaacacaccatgccttcgaatctgtgagttgggcttcttccctaagggagctgctttgtgtggacgctccactcccttgccgtctgactggttgttctctagactttaccactatggcacggctgctggcgttaacttcttttcataatcactgcatgaacttcctttgtttcagtcagtcttccatgggatccttggtttccaggttcctgtgtctttgtctctcttgcttcagttccctcccctgagatgacctatttcctcactcccgccttttttttggtaaaatatatcctctcaatagcaggtaggcagaggataatttttttgagaaattggttgtctgaaaatgtctctattatattctaacatttgaatcatagattggctagttatagaattgtatgttcaaatttattttgtcttggaattttgaagacatcgttccagtgtcttgtaactttgttactgtgagcagtccaataccattttcctgatccactgtgtgtggcctcttttgctttttatgggaggctttcagaaaaacttctctctctctcatcactagtgttctgacattttttaaattatattctttggtgtagatctttttttcatttgttttattggacaccaaaatagtctgttcacattgaaaacctatgtatttcagttctggggagttttcttatactatgtctttcatgacttcctcccctttgatctttttttcctctctaattattattatttagacatggactttggaactgaaactctaatttgtttattctcccaacattttctagctctagttttcatctacttttgggaagtttctttaacattctgaatttttatagcccctggtctagttcatggatggaatgtgaatgtaatacatccttagtgtttctgaagataataattgttgtagcctgggcatggtagctcatgcctgtaatcccagcactttggaaggctaagggggaaggatcccttgagcccaagaatttgagaccagcctgggtaacaaagtgagaccctgtctctacaaaaactcaaaaaattaatcaggcatggtggtgcacatctgtggtcccagctacttgggaggctgagattggaggatcacctgagcccaggacgtggaggctgcagtgagctgtatttgtgccaatacactccatcctgggtgacacagtgaggcctgtctcaaagaaagaaaaattcagtttcttcatctcagctacatttcaagccaacaatagctccatgtggctagtggctaccatactgtgcagtgcagatgtggtacatttccatcacagcagaaagttctgttagacggtgtcagaattcagagtttgtggtgcattttgttcatgacttcatttccaccaatggtattaatttgtcatgtgctataagaaaaagcctagatgcacttaagcatttttgacaaatgaaggttgaatgacatcaagacacactgcacagctggctcttccttgatagttccagtagagaaaggtggtgcatagatcgagtcactgcaccatgtgtgctcatctaaccgtgctgaactcagaagaaaccacaccatggtagttaagacacattgacatggagggtagtcgtttagttttagcctcgtaatgtcatcatcaccataaaatcagtcttgttctgtcagtgttattacttttgtagttttctttgtattaacttttacaaattgtatcttgcttttatagctgtataagaaaaataaagcagaagtttttattttttacttcttcatatttaggtttgataccccctttctttgtgatcaatcagatagaattatttttcctatgaaagaggtctctaaatgatttatgttgggatgcagcaataaaataataatactatgttagtgggtacctattccacattaggtactcttccaagtgctttgcatagatggcgttattcacttctcatatggcttgtgaggctagcactattattgtccttattttattttattttttgtctttattttttggtcctcattttagaaaggaggagactgaggctgagtgtttaagtgacttgtccaaggttatacaccacatcgggggtgaggctgggtgtgacccgggcatcctgactccataacccacttgctgtccctccccttatggtgatagagggacaagctttgtcatcaaacaggcttgggatctagttccagctcttcttctatgattctgggaaagatgtgtaatctttccaaacctcagtgtccttgttgataaaatggagacaatgatgctgtcctcagagattgtcgtcaggggttaaatgaggtaatatacacaaagcacttcacccagtacctggtaattgcaagaattttccagaaggaaaactgagctctccttctgccacctgggagtagggcagttggtgcattccaacagcatattttatagtcaaagcttcatccgcagtagagtgaagaaacgacatggaaggcagaagctgggggcagaaaacatgttccctggctgggcatttccttcctgtcctcatggtgagacatcattgatcactgtggtcactgtgcctctcagatgaccccctggtgggagttgctgccaacctctgagggtccttctcagacagtgagttgggtgctgtacagaaacaaacttgggtggcgcctactccatttccaaatatctctgggctctgggagtttggcccagctcttcactatgcttatttcagaggacaaatagaggtgggaggcatctctggacagcaacagctggtgtggtcagcaaaggcaggaggctgatgctgcagccaggcctggggtgggttggctttggggttgtttatgagatgtgttggccctttcagcctggtaggagagaatgagcaaaagccctagagcaggagcagacatcaggcatgtagggaacaatgagtcagccagcctggtgctcacggcagtgtggtgtcttgctctgatatacacacacaggcacacgcatgccccagggacacactcagtctctttgggttccggacttatttaggacgcagggagaaacaaggaagttggggctccttccctcatcactgaccctccaggagactgagcagacggcattgagggaaggagagcagccagtggcttcattccccggcctgccgtcggctgggggctgctgcccatcaggatggttccctgagtcagagagaggaataacacaggactgactggagggctgcctgcaagactcccagcaccttggggacccctcagtaactccgggaagtgagagcaacttactggaagttgctagtcttagccctccttgagtcacccacactgcggtggcaggacgaccctgtgtctctgctactgtgaccgaccctacctcctggcttctgctgcccatccctttggctgccttgtggtctttaccaaatgcctcttctcttggccatctggtttttgcctctgtctaaaattcttcaggagagaggacctgatacctaagtccagttaatcctgtagtgcctgtaggacgaagtaatttccaccaggcattctcgtgtgccaggccccacacagacagaggattgtagagacgtgctcacccacatcctattcacccactcactcaacaaatgcacgtgatggaggagtgtctgccagggtggtaggctcggtggtaaagagcgtggtccctacgtgcaagaaatctcctgtgtagctgtggcaccaagagcaacatcactgtcactctagggcttgtctgtgtgtaaacaagcaaaattctcggggcaaaaccaaaccaaaccaacacctttattatttgcgcccaccatccattcagacctgctctgtggggctcattcttccaaactttggctgaaatctcagaggtcccatgacctttccggtgacattagacatgtccttcagttgctccctcaagattcatttctgtaacttacatgtgcaatgccatgaataattgaaaaccgatttaaagttgaccctgtcctctcatctagctcgagagggcagtgctggtggcttgtggtggggaaggcacgtggtcagcgtcttcatacttctcacccgcccatgctcagtcctctccttccgcagtccgatgaccatggtttctgctccttcttccccgaagttgggaaaggacagagaaaggagagaggtggcaggagaagtcttccttggtttgcattgttgtgagtgggttctgggatgttcccggtctgtgggtgtttaaggctgatgcttcctctgttggccatcattgatgggtccattggagacagaggctctgagagctcagacccctgcctgcagttttatgatgtaacaaaggcatttcttcttctctggctgatttacgacttcttcctctctcctaagcatggtcttgctggacgggatctgagaaaatcctggtcaatgctctctctgtggccagcctctcgtgcacagggagctctcagccaaactctcagtctgtatcttccaaaaagaagcactgatctctctttttccaaaacctttaactataccctgaggtaaagttctcatttctattggcaaggttgagtctaggctaaagtgcaaagtggaggggaactgggagtggtgatgagaggaccggcatcgaagagactggcccccgcactgcgtcccctagaagggggacaggtaagccaggtgtggccctgaattaggaagtccacttaaaactttagtgaacaatcatcagatgctgattggtggatgtcgctgaaaccctgcactctggaatgaagcaagatctgatgctaagagttctgggttcaagtctccactggtcaaccctctagtgtaagctttatggtctccctgggcctcaggtctctcctctatttttttttttttttttgaaacagagtcttgctctgtcgcccaggctggagtgcagtagcgcgatctcagctcactgcgacctccgcctcccgagttcaagcgattctcctgcctcagcctcctgagtagctgggattacagacgcgtgccaccatgctcagctaattttttgtatttttagtagacggggtttcaccatgttggtcaggctggtctcaaactcctgacctcatgatctgcctgcctgggtctcccaaagtgctgggattacaggcgtgaaccaccgcacctggccaggtctctcacctattaaatagggatattaataagcaatttcagaggacacctgaaagaatagaaggaagtaacaagtacttcgcacactcagaaatacgaagcaaatagtaagcttgttagtcacctgacatattcatacagatgacatttattaaaaacaaatgatgaggcctgtaatcccagcactttggtagagtgaggcagggggatcatttgagtccaggagttcaagaccagcctaggaaacatagggagactctgtctctaattcaaaaaaataaaaaataaaacaaacaaaaccaaatgatgaatagaccttattttggtctagtggaggggataaaagttgcgttggttcctgtttctaagagccaacagtcttcacttatttgtctcctggtaggggtcctgttggggtctctgggtgtcaggaggatgctgggtgctggggcaggggtatgtgggaacccagagtgaggagaggacgactggaaggaaaatggggtagagctgcccccaggcctgcagcgagtggaatccacgagtgtctgtgttttggaaagtgttgctcactgaccttttaactttgcaggattttgattcagatttagaaccagaaagcgctctagtgaggactttagatagcgtcttcaccaaccccattgctctagtgagaagggactttagatagcgtcttcaccgaccccatcactctagtgagacgggactttagacagcatcttcacctccattacttggaggccccaaaagatgaaatgacttgttcagggcttcacagcaaatgcaaagcagagcagagatcagaacagaacgggcggctccctgccctccactggcccatccagggccttaaaggaccctctccctccttcaagcaggtgaatttggtaaacatgtgtgagcattttcatttggagcaaggggaggacaagtgtcgccttctcacataactagaggtttgtagtcatggtgctattttcagaacaaagggcccggacacctgaatggacacatctgaagatagatgcccatccttaaatgaggttactcgtgttcattttaggggagtgtctatttaaaaaaaatcacaagagctccgtatagtcaggaaaatgttccagcacacctgcagactgtcaacagtctgcttatattaattattctattttaaatataatatctaaagttatttccagccatgtgatgaggtaggctagtgactccgaatattatgcagacttgcttttcttacaattgccttaatgtcatctgacttcctcaccctttgtcttactctactcctgcctcagcctcccaggtagctgggattataggcccccgccaccacgcctggctaatttttgtatttttagtagagacagggtttcaccatattggccaggctggtctcgaactcctgaccttaggtgatctgcccacattggcctcccaaagtgctgggattacaggcgtgagccatcgtgcccagccaatcccccaactgtaaaacatcatctcaatgctagctacattttgaggactgacacagcagaagcaagttcttgtggggggcaagcggggaagtaaacgattaagaggactctttttttttttttattccatttttacacatccacctgtttgccatgaagtcacaacattttatcaaaatatacacacagcacaaatacctttaaaatgtatggttggaattctaattcaactcaattgactgctgcaaacagcatgcatgggccattgatcttgaatgatgcctacggaggggcttatgagtcatgaaatcaccagtcatggcacgagaaggggttaaggttcttttcccaggagacttatgcacttcatttcttttcttgttatagtgtgagaatggcagtgagtgactgtgccaatactggagtctgctgagaatgggtggatggaaaggtttttactggcaagggtgaaatgatactatcttttctatcttgacaagataacaagcgaaggtgtctagcaaaccttccctctcactttccacttgtcctcttgaccatggatttcatgcccaatcaggatgaatggatttgtagatctcaagttacaagctatgtttattgtaaagaattcccataaaaacctatccagggctggccccccagccatttacacatccacagataggaatagaataaaacgggttagtgattacttgtctgcggctgagtgagatccgctactagaccaggcaatggggccgtttcagtcttgagacgtctgtactccgtttgcccctgattcaacaagcatttcattgatcagcagttggcgcccaggtgaagagccataatttattgcagtatcaagtcttgaaacctttccaagtgcggagacccatctttcaagtaaataactatggttagtaatgacctaacttcaggagcgtctgtgagacatgtcaggagacgagacacacggcatcgtcattagtgaagtagacttggtttctgctacagataaaagtcacatgggggcgaacgggtctcagtctttattgttgagtgtttctttctttttccaagttgaaaaaggaacccaagcagtgtctcttgaaccagttcccagggagaaggcaaattctttcctgtctctggaggggcaagattcaggatatcagccgctccatcccggggttcatgaaggaaaagttcctgaacatattctggtccatgctgttgatcagtgctctgtcggcaaatgacagccggggcttctcgtttaagaattctttgtcgaaattgctgcagtcaaatggtgatttcttagtcagagtttaagggaagaaagaaagagaagaaaaatcagccattaagttcatgatcttcacttttgttatctaggccgtgatctgcgtatggcaaagttggtgtttgcagagacactaaatggaggcaatgcctacagatgaccatgcccagctctcattgaacatggctgtgatcctgtgtcctcagcttaataataatataaattcataaattcacagaaagactacgactgtagacattcaaatgggatctaatgtttctaatggtttacatgaagcagggttggcaacctttgaaaaagtgatccacctgaatttgacctctgcctcttcagttttcatggaacacaaggtggggataagggagggtggtggggagagggagtgagggggtgtgagcggagggatgggaagagagaaggaatttcacaattacatattcctgttcttttatcaacgttcttggctgttgtcagtcccctgcccttgttaattttattagtaagtatcttgggcttttttagacagcacagactgggacagactcctttcagaccacttggtccattggttttcatggcaaaaaaaccaaaaccaaaccaaacaacagagaaagggaaagcaaacatctatttcatacatgctgttcagtatggtgttcaattcagtgtcccaagattgagaacaaccattatcaacagaaagtgctatgaacacagagaagcgaaatgaagaaccaggcccctcccaccctccaaggggccctggggctgtgaggtcaatggcagctcagaccacaggtcagggaaagtttcctactggcagaactgggaatgtcctttagggtaagcttagatcaaagttttgatttttatgtgcaaaatattaagtcaattttaatctgcagtggaaggtgagacatggtttaatagttctgatagctaaaaacaaggtaaaatttttattttatcacaaatgactaacccacgtattagatgtggttctgtcacaagtaattagagtgcttgaggctggcctgttgggtccttggaacatcactggagcttgggacagatgttgagaacaactattcttgccctgggaatgagatgcacctgcttcttctggccattcgctatcatgactaatagcctgtgcgttctctggggtggaatctgttgggaagtccatgagcctggcccccttcagcacggatatggcccatgtctatccaggcaatcacagggaatggttaaggctggcaaacccacaactttgctctactcttttaaaaatcattatttttagaaattgtgatatacataacttaaaatttactttcttaatgacttttttttgttgtttttctaaaaagttttatttttggagacagtctctcgctctgtcaccaggctggagtgcagtggtgtgaacccagctcactgcatcctcttgggctcaagtaatcctcctgtcttggcctactgaggagtttgaactacaggcatgcaccaccaagcccacttaattttgtagagatggggtttcactatgttgcctaggctagtctcaaacttctgggctcaggcaatcctcccacctcagcctcccgagtagccaggattataggcgcccgcaaccatgcccagctaatttttgtatttttagtagagacaaggtttcaccatgttggccaggctgacctcgaactcctgacctcaggtgatccacccgcctcggctttccaaagtgctgggattacaggcgtgagccaccatgcccagcccaaccttgctttatttttgacttcactttatggtggcccgtctcgcaggtgagccaggtcattctgcctttgctgatgtagcttaatgacttttgccagtgaggacataaatggaaatgtacagacctatcttttttaaagcacggatttagttagtttctcccttaaaccaaagaacacctaacaattacccttaggaaatgtcgttatatgagcactttacagatactttaataaacatcatggaaaaaacagctccaaaattcctgacgtaggatgcagggtttatgtccaagtttgggttacccagactggaccattaagtacgtatgtgtcatgtgcacaacccccatcttgtttaatagtcaccctcacaaattcatattcaacctaaggcgtggacacacagcaatccattcttcatgcaggcgcatcttgacgacagagattaaattttgcaaacaagagtgacctcccctccctgccccaccagcccagtaacatgtgttagagacgtgcattcctcctggagagtggggctggtggggagttggggcaccggcaggggtgagcagctgcggtgacttggacaggcagacggccctgagcggagggagagtggctgacaccaagcggcccatgagcgagtccttaccactttcggccggaacggtgggtcaatctccttccgttcaagttcctcccagttgatctcccgaaacaaagggtgctggcggatgtctcccctcacgcccagcctcttctcaggttctcgcacgaagagctgaaagggagcagagcaggagccctgaggtctccagggatgacccttttgcatcaggaggtcgtggtgcttcctggtgcaccagccccttcttttctaacctcatttttctactcaccttcatcaggactgactaaagtcaacctgtcctggcactctcccttgaagaagcctttctaaatttgctggagtctgacacgttatcttctgaggtgcatagacctgatttgaaaccggctttgccctgtgttattaattggaccttaggcaactgacaaacctgagtcagtttcctcacctgtaaagtaagccaagtgccctcctaacagggctgatgtgacgatttataagacagcaatacacacacaaacacgcacatagacaggcacacacgtgcacacagacaggcacatgtgacggcatacacacatggacataaacacacactggcacacatgcacataaatgtgagcacgtgcagacatacatacacatgaacacatgcatacacatgcacatggacatgaacacatacacctgcacacccactaaaacacaaatgtgagcacacgcacacggacaggcatacacacgcatacacacacgtacaggaacacatgcacacacacgcacgcatttgtgcagtataactcctggtctgttacacccaacagcatagagtcagtgataatttgtcatttgatcaattatccatcactccagtctgatttcttacaaagctgcattcttagaatgattccagcattgtggggactcaggtataatagaaactagtcccagacagtcagctttggactctacaaggcatctgagtgaagagaattaccctcagctcctgcaaacctgctggaggagcaatatttaattcaaggtccatctaataatttctgagctggcacatacatacatatgtacattcctctctgcactgttccttctcctgttctttctgcctaagaagttaaaatgaacactggcaagacaggaaagaaacttggatatttttcaaacttaaataaaacctgtcaagggcattaagaaacaggagagtctaaacattaacttagaaaagtaacaggtcccctgggtgtctggagtagttaccggttattcttacatcagctagatgtttatttatgaagtaaccatgagttatagggcattttaaggagcctaaggttctttaaaacagaaaacatggtggaacgcgtgattttccaggaggctttcccagggacttgacctccattcacacctaaattgcgagtctcttgtttttactgctcataaacatagccagcctgcatgttctgaaatagtgcttcacttgtgttatctgagtacttgaaaatcttcaaaggctccgttctaccaaaaaaatataaagaccaaacaacatgctattgtaaagtgaagttttttcgcttttttaaaaaaaagtaggagaatcttttaaagttccgggtgaaatgtttgtgcaatcacccggtgtatctgattggcaaattcttagcagtctcaacttcctctctcccccttaccatatggggactgctgaggactctctagggaaacttggggttccaaagtacccaattagaaagccactgcacggtggaaataacacgacagctatccgagagactgactacccacgtcgccttggataagttttctgagtctcagtttcctcgtgtgtaaaggaagggctagacaaggtgatctctagggcttggagagttctgacatcctcgggtcctcggctggcattcaaggctctctggagtctgacgctgactcacaggaccttccatttcccattaggaccctctccagtccagacatttctgctcaccgaaaacaccacctgccttcctgtctctgtccctcactaatgacatttccatcttgccatgagataccctcccctagtcgactcctgcttccctcccctcatctttaaattctgccttatctttcagggctcagctttcacccccttttccttgtgaaactttctttgattacctcccctgacagggagctctctctcttctgttcaagtcatattcaggattgatcaccctatcatacatcattcacatcactcatgattcttacgactgatacatcatccactccaaccaatgttctttgagaggcaggcactgtgctagatgcctcagtgattttcaaacaaattctaagagaaacaaattcatcatcccagttgtcagctgaggaagccgagcttcagaggatctagcactttgatgacaagcggcctccttccccctcatcctgatggataatctctcatctgtgtaccacacaacatcttcgctccactggagaattagcacattgtatcttttttccaaggttgtcttctttcctaccacactgtaagctctggaggccgggcaccattgacatatctattccttacagaagctagcatagtgccgtgcacaacatagatgctcagtagatgcctgcagagtaagtgaataagctgtctttccattttgtttatctgcagatcacgcatcttctatcctcattttatctcggttgcctgttttcagcatagaaaagaagcaccaagttcacggtaagatatatttttctgtagactcagaaaatggagtgggtactaaaagcccttcatcaccactgtgcaatccacataggtaacgaaatgacacctgcaccccatacatttatacaaaccataaaacagcaggagtcatcacatggagctgattgatgttttagaagcaaagaggggctgggcacggtggctcatgcctgtaatcccgtcactttgggaggctgaggtgggtggatcacctgaggtcaggagtttgagaccagcctagccaacatagtgaaaccccatctctactaaaaatacaaaaattagccgggtgtggtggtggacgcctgtaaccccagctatgcgggaggctgaggcaggagaatcatttgaacctgggaggtggaggttgcagtgagccgagatcgcaccaccactgcactccagcctgggcaacagagcaagactccttaaaaaaaaaaaaaaaaaaaggaagcaaaaggaataagtgacttgccctatatcccttctcctgaaacaatgatactaaatgataaatgattggtctctgcttcttaaggacatttggatgaaacgagattagatagatggcgtaagtgtctcaggaaggggccaaaacctcgctcatgttgttctaatgagatgcttcagcaaagtaggctggaagtaactgccctgggccgtgtgtgctgcaggctgggttttctattctatttcttccagtgaacatgtggtatttgtaccaagaggatcatgtcaatgggctttcttagcttggatgtgtacctgcaaaatttaaaaatatattttaaaaaattaaatgtgtaatgagaagagcatatggtctccagctctgagcgtcaatattctttccagttttgcacagaacggtaaattagtatatgttctgccttgcagcgactcaacccactgaggtcctgaggatgacaggtgacctcatgggagtggggccaggctggaagctccgcccctggaaagctgcactgaggaaataaaatacctgaagacttgattttgtctgtaaaagctgtcaggacggaggtttacattgatgggaaaaaatagccaggatgtagttgaagtttgtttaagtttattggacagtctgtgcaagaaagcagctccaggctgcagaggacagccagcagtagtgctgacagattgtacctggaacctgccttccctcttcagtccctcctcagatatgtctttctatgaaaggaagagatatttatgttctatatcattagtttcccatcattttcaaacaaatagacaggacatcctggatggataaatgaggaagtaaagagtgttttttttcttttttttgagatggagtcttgctctgtcacccaggctggagtgcagtggcgcgatctcggctcactgcaagctccgcctcccgcgttcatgccattctcttgcctcagcctcccgagtagctgggactacaggcgcccaccaccacacctggctaattttttgtacttttagtagagacggggagtaaagggtgtttctttggcaatcatcaactggacagcagtgtccccactggaattcttgccagagcacagcctctcccagtgggcaattgttcagtgcacgacatgcatccatgccctaggtgggccaatggcaacgggtctggcactgctgctgtcacagatgccatgaaatgctgctatcctcagcttttccggaggacctatgacttctgggtttcataacattttgtcaaattccctagaagacgtttctgagaaagggcattaccttttatttttgcaacaaatggggctcaagaatgtgggggctgttggatcaaagcaaaggaggaatagagataaagctgcaagccagtttatgggcagcagattgcataatggaaattaattttatcagcccaactgcaagaatatgtgtaagagaaagttcatggaagttttactaactcacatgggaaataacaagtccaaactcttctatgtcaactttgaacagcagtgtccaatcttttggcttccttgggccgcattggaagaaggattgtcttgggccacacctaaaatacactaacactaacaatagctgatgaactaaaacaaaaatcacaaaaaatgtcgtaatgtcataaagtttaggaatttgtgttgggctgcattcaaagccatcctgggctgtatgcagggcgtgggttgggcaagcttcatttagaacttctttttactgagaatggtggctcatgcctgtaatcccagcacattgggaggctgaggcgggcagattgctttgagctccagaatttgagacctgcctggggaacatggcaaaacccgtctctacaaaaaatacaaaaatcagctgggcattggtggcatgcacctgtagtcccagcttcatggaagactgaggctggagaattgcttgagcctgggaagcataggctgcagtgagctgagactgcaccactgcactccagcctgggtgacagagcgacactctgtcttaaaaaagaaaagaacctctttcacccaccagtcctcttgtttgcttctttaaactttattatcttagtttctgctctattcaaccaaatttattttcttctcttgtggcaactctttctcttgccactgaaactctgcagatgactttttatttgggtgtttgcaaggcatttagccttagatttagttttgtttttaaataattatagattcacaggatgttgataagacagtacagagatgtcctgggtgctcttcaccctatttctcccaacggttccatcccacgtaatgatagcataagattaggagctggcctggtaccgtgtgtgtatatactacttatgccattttatcacatgtgcagatatgggcaacctccacgccaagcaagatacaaactgttccataactgcaaagatctacctgtgctgcatcctgagagtcacgcccaccctcctgtccccagcaccccaaccccaggcaaccactaatctgacttccatttctatggtgttgccactttaatgaagttatatcaatggactcagagagtatgtgatcttttgagattggctttttgcactcagcataatgccttgggttgttttatagatcaatagtttgttccttttcattgctgagtaggattccagcacacggcttttcaccttttctcctccaactggaaggaaccctttcttcccatccaatctttctctccttggaaatcatcacttccaacttctctccacggaattacttctggttacctctgtccctccttcactctccgtcctggcctgaagtattgcatatcctcaaggtaggctgggtttgtgaagcacagggggaagctggcatttatgggccatgaggggtgttgggggattgtgactctccctccagagcctccaccttgggactcacttggagacagcccctgagtctggaggtgctctcacgcctcaggttgtacagactaagccttgtgctcacttttttccagtgggttttgctggcccaggctttgcagtgcagcctcatgctttggactgaatggcgtcctctcaaaatacacatgttgatgccctaacccacaatgtaactgtaggtaagggctttatggagataattcgggttaaatgaggtcatggggtaaggtcttgatccaatagggctagaagtctcacatgaaagagagaccagagtttatctctctctctctctgctgtaaggacacaacaagaaggcagctgtctaccagccaggaagagagtcctcatcaggaactgacactgctggaccttaatcttggactttctgcctctaaaactgtgagaaagaaatgtctgttgtttaacccactcagtctgtgatatcttgttatggagcccaagctgacacatttcacactgagttcattattacgattgctacatttattgctacaaatgtagcaattgtaatagtgtttgaacctgcctttatataaaataaaaaactttatatccagatcccactaacttattattttttttattttttatttttttgagatggagtcttgctctgtcgcccaggctggagtgcagtggtgtgatctcggttcactacaagctccgcctcccgggttcacaccattttcctgcctcagcctcccaagtagctgggaccacaggcgcccgccacaacacctggctaattttttttgtatttttagtagagatggggtttcaccgtgtaagccaggatggtctggatctcctgacctcatgacccgcccatctcggcctcccaaagtgctgggattacaggcgtgagccaccgtgcccggctcccactaacttatttttactgttgtcagcctttttaaaaaaattggttaattttgagattagttttcattttatctgtgtttggtcattaaaagtgcctttaattgattgttgagggagttttctaagctattgcttgtttggatcatagtcagaaagtgaaagctgaatggaagtggctcaaatttttaaacatcttgttcctttacccctgggctggggatcctgtgagggctttgtcagcacttctcagattcaagatcttgattttccagggagagccctggagttgcctccaagtttctaatgcccaagacaagttgtcacttttattagagaggtggaagtgtattccctttacatttaattctaagtacttcttcaaaagcaaaaaagtagattagtgaaaaaagatgagcctgctaatatttttctagtttttaatttagaacccatggatagcttccaatgttgaaggatcttatcctattcccattttcaatatagcacgaacaaggctaaaaattatttctctaaatgatgattattttttaaccagctgacatatgaaatgccagaaatcaaaacaatgtttcttccaaaacacctgcattcttggtccacttcctttagatgtgctagactcttttttttttgcgggggggacagggtcttgctctgtcacctaggctggagtgcagtggtgtgatcatggctcattgtaacctccaccttgtgggctcaagtgatcctcccatctcagcctcctgagtagctgagaccataggcgccagccaccctacctggctaatttttagattttttgtagagatggggtcttgctatgttgcccaggctggtcttgaatttcgggctgctcaagcaatcctcccaccttagcctttcaaagggcgagggttccaggcatgagccaccacacccagcctagatgtgctaggctcttgattacagtgatgggtctctttgacccaaatatttgctgggacagctcagtatatgtaggtccttattattcttctatgtatttagcatgttgtattgacatgattcatttcattctacaacttgctacgcccatacactgtggagaatatttcgcatcctcaaaaaaggccaactctgagtctgtctagagtccagatctttcttgatggctctcaggtgttcctctgtctccacgtgggtttgccttgggagctcctggctcacaccttgtgattctcagagcccagtttccacctgtaatactgtgcctgtattctcgatggatcctgggctaccacggatagggcgctgaattccgttttgatggtgaattctggagattgctgctaagatggtaatagcctgtactctcagagtttgttagagtgaagaagtcaacaatatttctggtggacagtgggtagggcaggttggggagagctggtctgtaggtattttaagtgcaattgacccttgatgaacctggatttgaactgcaccagtccactaatatgtagattttttcaatcaaatttacaccaagtgtgcctgcctctcctgcctcccttccacctcctccacctcttttgcctctgccactcctaagacagcaagaccaactccccctcttcctcagccctctcaacatgaagacaaggatgaagatctttatgatgatctacttccacttaatgaacagtaaacacattttcctataattttcttaatagaattttcttctgtagcttcttagattgtaagaatacagtatatcatacatataacatataacacatgtgttaattgactttgtgttattggtaaggcttctggtcaacagtaggttattggtggtcgttttgggggactcaaaagctatatgcagatttgtcattgcataggaggttggctcctctaactgctgagctgttcaaaggtcaactgtactggctgatatggtttggctttgtgtccccacccagaatctcatcttgaattataatcctataatccccatgtgtcacgggagggactcgatgggaggtgattgaatcatgggggcggtttccccccatgctgttcttatgatagtgagagtatagtttcataaggggcttcccccttcccgcttggctctcattctctctcctgctgccctgtgaagaggtgccttctgccatgattgcaagtttcctgaggcctccccagccatgcagaactgtgagtcagttaaacctctttcctttataaattacccagtattaggtatgtccttacagcagcatgagaacagactagtacactgcccaagacaatctgctgggcaggaaaccaacagtgagagagtcttgcagaatcagcgttggtacagtatataggccagggactggactgaatgcctgtatctcaagggtttcagccaaacacatctgcaaggataagtatttctgcagaacctagtagagtgcctcattgaagtctcagctttagccatcctccagttcaggggtaggaggctgccagccgaataagaactgtttttttctgctcatcctctttcctctctcagcttctacctggtaaggtctgaagcagaaactcaggagttagaatggaagagaacaagaacacagccagcaagagcatgacaacactgtctcctccagtagtgagcagctgccaatcacgagctctgagcagaggaaaggaagcaggagtcccagctttaaaattaaaatttatgtgatgaggctgggcatggtggctcacatctgtagtcccagcactttgggaggccgaggcgggcagatcccttgaggtcaggagttcaagaccagcttggccaacatggtgaaactccacctctactaaaaatacaaaaatttaggtgagtgtggtcgtgcacctgtgatcccagctactcaggaggctgaggcaggagaatcgctttaacctgggaggtggaggttgcagtgagccaagatcatgccactgcactgcagcctgggtgagggagtgagactgtctcaaaaaagaaaaaagttatgtgatgaataatatcccagactggatggttttaatttccccactgagacagtgtttcataacataagagtgacaataggttgtcttttatctaagagcaggccaaaaagtcatacatcctgtccaagatttcaaccagaggcaggggaagatgaactggactgaatatttctaataaaaaactatgggaaacaaaagactgagtaaaataaaaaaaaaccctctatataacataaatgcccattttctcctgcctcagccttctgagtagctgggatcacaggcgtgtgccactatgcctggctaattttgtattttcagtagagaccgtgtttctccatgttggtcaggctggtctcaaactcctgacctcaggtgatccgctcaccttggcctcccaaagtgctgggattacaggtgtgagctactgcacccagcctaaatgcccattttgtttcttttttttttcccctttattgttttggagacaggggtctcgatacattgcccaggctgacctcacacttccaacttcaatcctcctgcctcaacctcccaagtagctagaagattgatttttaagccacacactgtgcttgtttaatgaaccaactacatctccaggtgagcgtattcaaggtcatggaactggttcctgggccgttatgttataactgatgcacatgagggtttctcttacactcattttgacatttaatgctcataatattggtgcctctattaaaacacagacggtgcacatcccatttaaacccagttcaataataatcattgtttgccacatgcaagttggaaactaagaggaacagaaaactgaccagaagacctaatgctcgtcttatgaagacgctcttggcttcgcttcttaccttcaccagaaggtcctttgcttccttctccagccaccgtgggtaaaagggattgtccatgcggatggagtggaagagctcctcctcatcctgcccgtggaaaggcgactgaccaatcagcatttcataaaggagaaccccgaaggaccaccagtccacagagtggttgtatttctgacccagcaagatctgcacaaccaaaaggcagacaggaaattaacaggaatgaggctgaggagtgacaactcttcctgagcgtctcaaggccactcagtaaatggtcgaggatgatggtgtgcaagaaagatcaccctgaaacccatctcttgggaagccaatgactggagagcagtgtctaaacaatgctgaaatttttgagtttgagtctgagtaaacacttttcagtttcaatttgtacttttcctctgcttataaagaaacaatgaaactatgccattagtttttattttcccatcagtgacatgggaacttaggtggcagatattggacctaagaaagctggtatgtgtctaagttcttcagtggctctggtgtgagcctggaaaccaagcctacgtgctttgctgacttgtactgtcctgagtctttgcataaactctgtagtaatcaggcatccaaagaggtcatctggacagttcccttccttaaagccttgctatctatggctgttcagttcagggggcacaactctaatcactgacatgcagaatcaaattgtgtcctgtgccaggaaagagaacctaggatagcaaagtgctcaaatctaggccgggtgcagtggctcactcctgtaattccagcactttgggaggccgaggctagtggatcacctgaggtcgggagtttgagaccagcctggccaacgtggtgaaaccctatctctactaaaactacaaaaattaaccaggtgtggtggtgggtgcttgtaatcctagctactccggaagctgaggcaggagaatcgcttgaacctgggaggcagtggttgcagtgagccaagatcatgccaatgcactccagcttgggcaacaagagagaaactccatctcaaaaacaaaaaaaaccccaaagcactcaaatctagaaatgaaagatctctaagagctacctacagctcgatagcggggtctgagtctatctgttagggaggaggatttaaagtctggaagcctacctaacattttgaaagattcctatcctttcaccaacccactcttctggcaaaaaaggctttgtatgttgatctttcaatgaattcctttttggacattggaaggtagagggcacgcgccattctgctcagcgtctgacatcccaacaaactgtgcctaagcttctctgagatggtacatggtaggacccatccatggatgaaagaaataaggaaaatgtgccggtgggtaaattaccaacggaaataaaaccagtatgtagaggagacagctgcacttgcttgctcattgcagcttcattcacaatagccaagatatggactctaagtgtccatcagtggataaatggatacagaaactgtgctatatatacacaggggagtatcagccctgaaaaaggagaaaatctctacttgcaacaacatggatgaacctggaaaacatgatgttgagtgaagcaagccaggcacagaaaaacaaatgctgcaagatctcatttatatgtgaaacgtaaacacgttgaactcatagaagctgagagtggcagtcgccagggtctgggcagagggtagggaggagggatagggaaggcgttgaagaaaatgtggtacctccacacagaggaatattattcagccttcaaggtgaagggaaacctgtcacatgctacgtgagtgaaccttgataacattatgctaagtgaagtaagccaggcagggaaagacaaatactgaatgattccacttacataaggtaccttaagtattaacagaagtttttgcccttactttcagtgacaaaaaccgtaactacttctgcaccaacctaatagttaaattctagagacaggaagtggaatagtggctgccaggagctgtggggagggggaatagggagctggtatttaatggggacagagttttggtttttcaagatgaaaaccttctggagattgattgcacaactatacaatacactttattttatttatctatttatttttgaaatggagtctcgctctgtcacccaggctggagtgcagtggcacaatctcggctcactgcaacctctgcctcctgggttcaagtaattctcctgcctcagcctcccgagtagctgggattacaggtgcataccaccatgcccagataatttttgtatttttggtagagacagggtttcacatgttgatcaggctggtcttgatctcctgacctcaagtgatccacccacctcggcctccaaagtgctgggattaaccgcacctggcactatttttaacattactgaactgtacacaaaaatagttcagatggtaaatttcatgttacgtgtattttcccacaattaaaaacaaaaccctaggacataatagtggcacataaaattttttttaatggaaaagagggaaaaaaaatcttcgttaattcatgactgctgctccaaggatgagttgcgggcaagttgctttattagccaaaacaaaatggagaaggaataataggattgaggcactaaacttaaaagcaagacagtcagactctcttggggatgaacatctgttctaccttgtaatgtgtttgggcttagctgggtgcatctgtgaacagacacacataaatacacacacacacacacacgcacgcagaaggtatttttttgttggcgctactcgtatgacatggaatttttctcttccttctctaatgggcctttggaatgaatggcagaattgcagcactgatggccttgaaaagaaaatgacaccacaattccagccattctcccagccctttgggaggctgaggcgggtggatcacccgaggtcaggagtttgagaccagcctggccaacatggcgaaaccccgtctctactaaaaacacagaaattagctgggtgtggtggcgcacgcctgtaatcccagctactcgggaggctgaggcaggagaatcgcttgaacccgggaggtggaggctgtagtgagccaagatcgcgcctctgcactccagcctaggtgacagagcaagactctgtcaaaaaaaaaaaaaaaaaaaaaaaaaaaattccagacattccagtattttctaggaaagccagatgttttgatgtcggtgagcttttttagatggagcagactgatgtgcacggcaaccccatccctgaccctccaccaccccggggcccactcctgggagacagatcagtgctaagtgaggcccaggggtgctgtgaagtctctctaaggcagacttgctaaacaaacagaagaacaatatcaacagcagcacaagagtttttctggccatgtaaaacgtcacaggctctacttctggcttaatcccttattgtgtagttttgggaggaccctttcacccttcttgtttgtgaaaaacgggaatcatatctggcccgcttcttataagcttcttgtgagatccagtgaaaagtagcaaagtcaagatgatttgtcttatgggacaactataaatgttatgataaatatctgctttgatgatgcacttgtccccgtttctgaaaataaagttgcaaacagaattttgcaatgttactgatttccaatataaaaatgctacccactactcttacctcgatatttacatgctaaagtttactttataatttagaaaaaataggctttgccttaaggaatcatctgaaggtagacccagggagaatgataaggaaatataagatgcacctaatacaatctttgctcaatttgctgggccagggacacatgcaatttccgagacttgcccacaaggcggcgtcaaagcaaccagaaacgtctctgaaccacatatctttgtaaacaacttcgttttggcaggacaaacaaaaagaaaatttggaaggacaggagacagctgtggtgcaaattaaggcttcaaagcttggcgatgttggtaaaaaatttcagttttaccttaggaggaagaagtaaaacgcaaactcacacgtgcagcagagtgttcgcctcaggaatactgatatgtgttaggagttttgcagacgttatgtcttttattgataagaacccccctgagctaggcacagttatccctctcctatagggggtgatgattgggcttagaaaggccaaaggtcttacttaaagtctcctagttagtgagctgagagcaatgttctgaatctggtctttcaggattttaccacgtgatgttccttccatagcataatgtgcctcttggttttaaacctcaagctgtcatggtcacactatgctcagttttttttttttttttttttttttggagacagagtctcgcttatgttggccaggctggagtgcagtggcgcgatctcagctcactgcaacctccgcctcccaagttcaagcgattctcctactttagcctcctggggagctgggattacaggtgtgtgccaccacatccagctaatttttgtatttttagtagagacggggtttcaccatgttggccaggctggtctcgaactcctgacctcaggtgatccgcctacctccgcctcccaaagtcctgggattataggcatgagccaccatgcccggcccatgcccaatttttaaagagactgtggtggagaaacaccagcaagggtggcccctttctctctcagccccgggaccttgcctcattgtgatctcttcttgtgttctgctctttttcagtccttgctttgacccaaagaatcagatgcacagctcaaaatgcacaaggaaacccgggaaagcagcgagagaggaacagtggtttcaccgaacgacgccagagcaagcctcatctgttctccttcagcctcagaagctgggaagtcaggtctggacaggcggggctctgccaccatgatgtgcaactgggtgagtgctgccccagcagtcagtgacctcctggggccaataccagtgtggtttccagggaaatccgactttctccagggagctgcttccatgcattgcaatcccatctggatttactgagtgtctagtgtgccatagaaagtatgatgtttccggctgggcgcagtggctcacacctgtaatcccagcactttgggaggccaaggcgggcggatcatgaggttaagagatcgagaccatcctggccaacatggtgaaaccctgtctctactaaaaatacataaattagccgggcatggtggcacgcgcctgtagtcccagctactcgggaggctgaggcaggagaattgcctgaacctgggaggcggaggttgcagcgagccatgattgtgccactgcactccagcctgggcaacagagcaagactccacctcaaaaaaaaaaaaaaaaagtacgatatttccctgtttaactgccttcctattctttgtcaaaatgagtttgcacctccaaagagacatcagcctctctttgctcctattataggaacacagggggaacagtggggcttttgagacgcactttagctctcaggaggtgcagcctagtgagacgatccccagttgagggagcacaggtgtgtttttcatgtgtagctcctgactctgctacgaaatgcatgagcttctgagatttgagttctcctcacaggaacgatgggtgcctgccagatggcctctgtcccagcagttgtgtgttcctgtgttttaattctctgcctcacctagtcggccttccccaggccacagagtcccctccctgaaggtgcttacagacacgtttgtaggtgagacagcagcggaacactcataaagaccctgcagggcagcatcgacttagaatcacacaagagaggctaacatttctctaaggcactgaggagggagaacacagctccagttttgtttggtttttgagggcaaaaggggcaatggggaactgagtgaggtgaaagaaaacttcaccaagtggatggtgggagggcagcctccgaccaggggtgggatttttccaggtggagtagggggaagctggggagggttatttaacaaaagacgcccagaggtggggaattcagtatacacttagagatgaacttttagggtgtttgactttgtgtggtcgtttattcaggaaggagctgagggctgctgctccagcctgtgagtggataagccatggtccctgatggggagaagctcaatggattggtcaggtggatgtagaggtgctgtggttgcacagggaagggaacagcaggtgattcctaaagccggtggcaactttagggagaaggtgactgtttgaggggagggtcacagaccaaggatgtgcaatggcagagaggcacagtgtggcctggccagggaaggtagcacttaattttttttttttgagtcagagtctcactctgtcaccaagctggagtgcagtggcacgatctcggctcactgcaacctccgcctcccgggttcaggcaattgccctgcctcagcctcctgagcagctgggattacaggtacgtgccaccacacccagctaattttttatattttagtagagacggggtttcaccgtgttagccactatggtcttgatctcctgacctcatgatccacccgcctcagcctaccaaagtgctgggattacaggtgtgagccactgcacctggccaaaaccaagatttttaaaaagtcatttaatctcattattttgatgaagcatagatatttttgtagtattaataaatatagttctgcagacaccgctgctgatacccaggcaaacagggtctggagtggacctctagcaaactccaacagacctgcagctgagggtcctgtttgttagaaggaaaactaacaaacagaaaggacatccacaccaaaaacccatctgtacatcaccatcatcaaagaccaaaagtagataaaaccacaaagatggggaaaaaacagagcagaaaaactggaaactctaaaaagcagagtgcctctcctcctccaaaggaacgcagttcctcaccagcaacggaacaaagctggatggagaatgactttgacgagttgagagaagaaggcttcagatgatcaaactactccgagctacaggaggaaattcaaaccaaaggcaaagaagttgaaaactttgaaaaaaatttagacgaatgtataactagaataagcaatagagagaagtgcttaaaggagctgatggagctgaaagccaaggctcgagaactacatgaagaatgcagaagcctcaggagctgatgcgatcaactggaagaaagagtatcagtgatggaagatgaaatgaatgaaatgaagtgagaagggaagtttagagaaaaaagaataaaaagaaacgaacaaagcctccaagaaatatgggactatgtgaaaagaccaaatctgtgtctgattggtgtacctgaaagtgacagggagaatggaaccaagttggaaaacactctgcaggatattatccaggagaacttccccaatctagcaaggcaggccaacattcagattcaggaaatacagagaacgccacaaagatactcctcgagaagagcgactccaagacacataattgtcagattcaccaaagttgaaatgaaggaaaaaatgttaagggcagccagagagaaaggtcgggttacccacaaagggaagcccgtcagactaacagctgatctctcggcagaaactctacaagccagaagacagtggggaccaatattcaacattcttaaagaaaagaattttcaacccacaatttcatatccagccaaactaagcttcataagtgaaggagaaataaaatactttacagacaagaaaatgctgagggattttgtcaccaccaggcctgccctaaaagagctcctgaaggaagcactaaacatggaaaggcacaactggtaccagctgctgcaaaatcatgccaaaatgtaaagaccatcaagactaggaagaaactgcatcaactaacgagcaaaataaccagctaacatcataatgacaggatcaaattcacacataacaatattaactttaaatgtaaatggactaaatgctccaattaaaagacacagactggcaaattggataaagagtcaagacccatcagtgtgctgtattcaggaaacccatctcatgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaggccattacataatggtaaagggatcaattcaacaagaagagctaactatcctaaatatatatgcatccaatacaggagcacccagattcataaagcaagtcctgagtgacctataaagagacttagactcccacacaataataatgggagacttttaacaccccactgtcaacattagacagatcaatgagacagaaagttaacaaggatacccaggaattgaactcagctctgcaccaagcagacctaatagacatctacagaattctccaccccaaagcaacagaatatacatttttttcagcaccacacctattccaaaattgaccacatagttggaagtaaagctctcctcagcaaatgtaaaagaacagaaattataacaaactgtctctcagaccacagtgcaatcaaactagaactcaggattaagaaactcactcaaaactgctcaactgtgtggaaactgaacaatctgctcctgaatgactactgggtacataacgaaatgaaggcagaaataaagatgttctttgaaatcaatgagaacaaagacacaacataccagaatctctgggacacattcaaagcagtgtgtagagggaaatttatagcactaaatgcccacaagagaaagcaggaaaaatccaaaactgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccgctagcaagactaataaagaaaaaaagagagaagaatcatataaacacaataaaaaatgataaaggggatatcaccactgatcccacagaaatacaaactaccatcagagaatactacaaacacctctacacaaataaactagaaaatctagaagaaacggataaattcctcgacatatacactctcccaagactaaaccaggaagaagttgaatctctgaatagaccaataacaggatctgaaattgtggcaataatcaatagcttaccaaccaaaaagagtctaggaccagatggatccacagccgaattctaccagaggtacaaggaggaactggtaccattccttctgaaactattccactaaatagaaaaaaagggaatcctccttaactcatttgatgaggccagcatcatcctgataccaaagccaggcagagacacaaccaaaaaagagaattttagaccaatatccttgatgaacattgatgcaaaaatcctcaataaaatactggcaaaccgaatccagcagcacattaaaaagcttatccaccatgatcaaatgggcttcatccctgggatgcaaggctggttcaatatatgcaaatcaataaatgtaatccagcatataaacagagccaaagacaaaaaccacatgattactcaatagatgcagaaaaggcctttgacaaaattcaacaacccttcatgctaaaaactctcaataaattaagtattgatgggatgtatctcaaaatcataagagctatctatgacaaacccacagccaatatcatacggaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtcctgtttgcagatgacatgattgtatatctagaaaaccccattgtctcagcccaaaatctccttaagctgataagcaacttcagcaaagtctcagcatacaaaatcaatgtacaaaaatcacaagcattcttagacaccaataacagacagagagccaaatcttgagtgaactcccattcacgattgcttcaaagagaataaaatacctaggaatccaacttacaagggacatgaaggacctcttcaaggagaactacaaaccactgctcaatgatataaaagaggatacaaaccaatggaagaacattccatgctcatgggtaggaagaatcaatatcgtgaaaatggccatactgcccaaggtaatttatagattcaatgccatccccatcaagctaccaatgactttcttcacagaattggaaaaaactacttcaaagttcatatggaaccaaaaaagaacccgcatcaccaagtcaatcctaagccaaaagaacaaagctggaagcatcacgctacctgacttcaaactatactacaaggctacagtaaccaaaacagcatggtactggtaccaaaacagagatatagatcaatggaacagaacagagccctcagaaataatgccacttatctacaactatctgatctttgacaaacctgagaaaaacaagcaatggggaaaggattccctatttaataaatggtgctgggaaaactggctagccatatggagaaagctgaaactggatcccttccttacaccttatacaaaaattaattcaagatggattaaagacttaaatgttagacctaaaaccataaaaaccctagaagaaaacctaggcattaccattcaggacataggcatgggcaaggacttcatgtctaaaataccaaaagcaatggcaacaaaagccaaaattgacaaatgggatctaattcaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaccccatcaaaaagtgggcgaaggatatgaacagacacttctcaaaagaagacatttatgcagccaaaagacacatgaaaaaatgctcatcatcactggccatcagagaaatgcaattcaaaaccacaatgagataccatctcacaccagttagaatggcaatcattaaaaagtcaggaaacaacagatgctggagaggatgtggagaaataggaacacttttacactgttggtgggactgccaactagttcaaccattgtggaagtcagtgtggcgattcctcagggatctagaactagaaataccatttgacccagccatcccattactgggtatatacccaaaggactagaaatcatgctgctataaagacacatgcacacatctgtttgttgtggcactattcacaatagcaaagacttggaaccaacccaaatgtccaaaaatgatagactggattaagaaaatgtggcacatatacaccatggaatactatgcagccataaaaaaatgatgagttcatgtcctttgtagggacatggatgaaactggaaatcatcattctcagtaaactatcgcaaggacaaaaaaccaaacaccgcatgttctcactcatagatgggaattgaacaatgagaacacatggacacaggaaggggaacatcacactctggggactgttgtggggtggggggagcggggagggatagcattaggagatatacctaatgctaaatgacgagttaatgggtgcagcacaccagcatggcacatgtatagatatgtaactaacctgcacattatgcacatgtaccctaaaacttaaagtataataataataaataaattaatgcaatttagttattttaaactatatattattgttagtataacctgatcatattcctttttaggcattgataacacacagtctatcttagctggtgacaatgtatatgattcatatataaatagacagatcttggggatgcttttctaacagatcaaaaggcatgaagatatgtaaagagcatgccctggtgatggatgataagggaggaaagcagatggaagggtgtcaccaagagccaggcaagagatgctcatgttctgcactagggtaacagcagtaagggcgagaggacctggagatctgggcggagctggatcaaggggatttgtttgagcttggagaaggaatcaagggagagtctgaattcagtcacaagtttagggcagtgaatggacatgagagggtccaattatagaaggtgttggtgtttgggtggatttgaagggtaagaaagaaaggggaaatttgtataattcctagttttctctctagaagactggatggatgacatgtaattcaccaagaaagaaaaggaaagagtgaagtagggagcaagttcaacagagagagttttggacctgctgtctttgaaggactcatgcatttacttggaggtctcaagcaggaaagtggacgtagtgtctgcagcaggaagaagtgcaggtgggccatattgactctacagcgaagaccacagtcatcaatgaagttgctcgtggaggatgtagagtaagaagagaagaggaccaagcactgaatcacgtggagacaagcacacgtaaaagaaaagaagggagtgaagctgcagagagaagcaagctgtggaagccggattctgcaagaagcagatggaaatcgggaaggaaggtttgccgtggaaaagacccggcacccaaaatctgtagacaggaatacatcagagtaaggcagccacaccaaggtgttgcaaggtgaagaggaaagaaattgagatggctcaggtgaggctgagggagtgacaaaggagactgctgctggggatggcagtgagggtggtctgagcagagtgcatttgggcatatttcagaattgttacaaaggggaattcagtaattgagttgagtccgtcctcttaagtccccatcactcgtgctttgatgagctttggtttcacttcaaatgaaaatggtttatagcatcaaaacctgtatctgtgccaaactgaatgaaacatagatttctacgatcagaaagttatttaatcaataagcctcgctctgtgagttcaacaatgccatgtaagctaaaagacatcattcctcatggaatagaagccaaggctaaattcaaattacatatcacccaaccacagggcaaagctacatagttctaggactcagatggccacaactcctttggcaatgacaggaacttgctgctgaataattttacccaggaaatcagaggtctgccagagtctttatcaaacaaccatctccaatcacacgtttattagttagttcatccatttactcttctagaaggtatctattagcaccttaatatgccaacacctgcactaggtccttagatgtaaaagtgaacaagatcacacaaatctacccatgagagaagatggcatagcaccatgtacactttggatggacatcagtttcctggctttgacattgtactgcagctacatgagatgtgaccactgggggaaactggatgaagggcacagttgggagatatttctggactatgttttgcaaattcctgtgaatctacaattatttcgaaatgaaaatttttaaaaagtgaatatgaatctgtccatgactgcagagcaaatatccagtcatgcagggagatttgaagatgaaaaagcaaccagaacaagtgctgtgccatgggaaagaccaagtgggaggggtgtcactaatctccctgggtgggcagctggggaggattctgtgaaaaggggggaggtgggtttagttgaattgatggatgccttctgtgcaaatgtcacttctttgtgtgtccagaatgtgacagcagtgtcttcttcttattttttaatgggggcaggggtgagttttaactttcacactctttctcatctaatgctcacaataacacaatgacatcagcattatacccattttacagaagaggaaatggaagtcagtgagactttggcaatcactctgtgcttacatcagtggtggcttagaaactcagtccaggtcttctgaccccacagtttcaccacttgacttgggtggacgcttgctccacctggctcttcactagctgttccttctggtaggtctgagcagagtgaatatgttttaaggctgggggaaaggaaatgccaaactctgcaagccttggagagatgtgatttgtaaaagtagcgctccccacaaaataataatagaaacccacatgcatggtggcgtttatgagatacttaagaaaacaggtacaaatcttgaatgaagatatttaaaaccttctgattttcaggggctaaagaagcaatggcatgtggccagggcatggtgaggtgggagcagcctgtcactgcattcctacctctggggcgatgtagtcaggtgtcccacagaaggtattcgtcttggcatctcctaacatgttctccttgcacattccaaaatccgcgatcttgatatgtccatctttgtctaacaggatgttatctagcttcaggtccctgaaaaacaaaagtgaagcaaatctcacattaatcaatataatttggttaacataaaattccataggaggcgagggagtttgtctcattgcagcctgagaggggctcacgagaggcgcttatgtatctatccacttgcacaccaagtggggtgtagacaaagcagattctgcaagggcacgctggctgctatggattctttctctgatttaccaaggggtgcagctcagtataaggaggacagagcacccatacccattggagacccttgatcccaggactttcctgagggtaatgacgaaggaggaaaacctaaaaaatatacttactgtatgccattttctacatatttgtgaatgaattatactgcacctaattccaagtccagttgatgaagtttgttcctaactaatactgaaccccttgagaaccggaatccatccaacgccagaatgtcatgccaacaaacttctgtttccttggagaactagtatcctcttaaaagaacccattccattcttagggaaatgtaactgataatattttttaaaaaacaattaaccgaactttgcttccatgtgatgtcacctattggtccaagggggctttctattgttaccatatgtgacaccccaaatatttgaaaaaaatgacatcaagttttctcttctctcaccaagatcagggacttcgctcctcatgatgtggttttcagacccttttgaccttgtaccacagctgcatgagatgtggccactgggggaaactggatgaagggcaaacattctggcctctaccttccaaatatcttgaatttgtccgttttcttctcgactgacttggctcagaatgaagccagaatcctccagagagacaatctgattggtgcaggttacagcggcacccagagctccattaccatcctcttgccttttgccacggtggactaagatcctgcaccatatttttcatagtttcatcacagtaatgcccaatattgagtttattgtaaactaaaaccttcaggtgtttttctgctttcctttatgaagtgccattatcccagtttcttctcattctgtacttgtgaaattgattttttaaagataattcaggtgcttcccttgatatcaggtttttttttttcccctgagacgaggtctttccctgtcatccaggctggagtgcagtggcatgatgtcagttcactgcagcctcaacctcttgagcaagcagtcctcccacctcagactcttgaccacatgtgtgccatcgccatgcctggctaatttttaaaattttttgtagagacaaggtctcactatgttgccaaggctggtcatgaactcctgacattaagcaatccttctgcctcagactcaaaatgctgggattataggcgtgagccactgcgcctggccagctctgagggatctaggtcaatatgggaaaggttctgaaaggctgccatgtgaagccagccccccatgggggtgaggaaggagtgccaaggaagaccagtgaggacccctggagccagctggagagggcagagaacccagaggcccagggtattctgaggcatgtcatgcttacaccctatggggcatcaggacccaggggagaacttcagagtccacagcctgtgcatgtctctgcaagctttcatctgtcagaggagaagcaggccatcatggcatcaagcagaagagaacatccaggggcaccctttcattccatcatgaggttaacggaggcaaagcttttctatttggaagaggtggagtgggcatcacagttggcttcccaatcccagcattacggccggctggctccgcctcaccatttcccctctggcagcctccaagactcatccaaggaacagggaccatgacacttgccttgcttgtctcatggggtcctgtaacgtccaatgagaatcacgtgaaagcattgaaagtggcttcaaacacatgggttgggcccagttttattgtcaataaaatataatcttaaggttcttcttagttctaatactctaagattggaagttctagattcttctttccacatctgcatactttccggctctgtggttttacatttgacccaaaccagggcttacatcatctttgaagatgccgtcgattttgtggttcctctggcagatggtgagtgacgccaccacacctgcttctccacatctcatgcttttcatcgaccaacagcagccttgcccctgaagctggatgcacctgttgaatattcctccattttcctattgctgtgcctttcctggagtcacttcttccatctgcaaagcctcttccactctaaaaagtctaccttcacagaagaatttttgtttgccatctcccctacttaagtctggtgatatattttttcctttcagctcttgcacttttaattggaataacattcacttggacattttttgaatgtacagcttgtgtcttttcatctgttcatccattcatcatcaatccattctacctctgaagaaaccccagaaagtggctcatcaggtttctgggggttgggacttctctatgtttagtacccactgccatgcttgacaaagacctgcacatccagagcacacatggtctgtgatatcagctgtatgggtggaatggtggcccccagaagatatgtccaggtatgttcatgtcagaacccccagaaccttgtagatgtgaccttatttggaaaaagggtctttttttccaaatgtaattaagttaaagatgtaattaagttaaagatatcaaggtgagattatccttgattatcgaggtgggccctaaatccatcaagtgttcttagaaaagacagatgggggcaagagaaggccatgggaagacagaggcagagactgggtgatgcagccacaagccaaggaatgcctgcagccaccagaggctggtaaatcgagggcttggtgggggcatggccctgcccacatcttgcttccaaatgtctagcttccagaataagccaccaaatttggggtaatttcttatggcagcccttcaaaactaatgtatcagttttgtgaacaaattcagaaaattattatcctatgaggtcaaaagaaagaaatgaattgaatccttttgttaattcagttgccaaattaaaagtttaggtgagtcaaattacacacagacagttgaataatttcttactattcaacttattataaggcaacttatttcttattatgcagcaggccagttttaaagccagcatacttgtctggtgacctatcctcagttataactatttgatgatgactttcaagggtctcctgcaacctaatgagcacaaaaaataaactcatttttttttcttgttggtgcctaagaaggcttaaagaacataacttccatgcatgggcagggtaagactcgaaaatgggtacaatttgttgtgatagtaaagctacttatggacatctattgcttttttttttttgttctgagtgttaataatttacatggtgacatgatagaaagaagctttgtgacacagggaaataaaatgccccgaggcatgtgggtttaggtttcacggggtcccttccagtctaagatctctgtctctctctctctccagtccctcctaatttttattcctacttccccttttttttttttaactttttaaattttttgagatggactgttgctctgttgcccaggctggagtgcaatggtgtgatctcagctcactgcaacctccgcctaacaggttcaagtgattcttgtgcctcagcttctaaagtagctgggattacaggcaagggccactacacccagctaatttttgtatttttagtagagacaggatttgtcatgtcggccaggctggtttccaactcctaaccccaggtgatccatctgccttggcctcccaaagtgctgggatttgcaggtgtgagccactgtgcccagcccctttcatttatttatctccccacccatccatcaccatccatccatccatcccatccatccatccaaccatctgttcaatttacccatcacccatccatccatacccatccatccatccgtccaaccatctgttcatccatccgttgtccatccatccatcatccatacatcatccatccacccatctgttcatccattcctcatccatccatcatttatccatccatccatccaggtacatccattcatccatccatccaaccatctgttcatctactcatcattcatccatcatttatccatcatttatccatccatccatccatccatccatccacatccatccattcatccatccattcaaccatctgttcatccattcatcattcatccatcatttgtccatccattcaaccatccacacccatccatccatccaaatatctgttcatccattcatccaaccatctgttcactcatccatcatccatccatccatctatccatccaccccacacaatttagtcagtgcctaggtacaaaaatattttagatacattgcaggccttacacatataaagaaaaatttaaaaaaattctgctaagagttttaaaataatattctggtgagtatttctcaatttcctgaagattaaaaaattataaaacagattcttaatctatgattttgtagatagaccaaaaaaaattacattcaaagaggctgcttaagaatacttacttctcaaacctcctctaagcctttagttgtgtgactccaaatagggcaaccctcacttgactgcaccctcagaaaatggagagatccttccttgttaagtgaattctacactctgtaagcaccaaagcttcaatactaattatctgctctccagcagctcagccatcctcctcactagatcctttcttttttttcctttctatttttcctcctaatctgcagtgagttggaaatctgacagtaagcttgtaaaggtttgtatgttaaataagtgccaactacattttgagaaaagaagtgaggagattgagatacaatagtgtcaatctaagagcttggacagaagaacgtgaaatgatgtcatacagcagagaagaagaaaattccataagcatttctaggtggctcaaagcaaagacaagcaaaaataagaggtatgaaggggacaaaagagaaagaaaccgtaaggtatgataagaaagagaaaacaggacagtgaaaatgggaaaaggaaggtgaaagaaggaattcaagtgagaaccagcataaaggacagaatgagctcagcactttcctgctgttgagactggaatgtcttccttggttgtaagtcatcatccatgtaatcattgtgggcagcagacctatgtgtggagcttactcccaggaaatcacatgggctgtctcacagcactcggtgcaatgattaaattaactgagccaggaaagccgatatcttagcatttgtttccacaaagcaaaatttacctgtagactattcctttggaatgaaggaactgcagaccaagaatgatttcagcagcataaaacctgggggaaggagaaccaaggttcaacatgaatgttgtcatggaacgaaataaaatcccaaacccagactgacctttttctgacatgctgtgtatggctaaatggcatacacacataactctgtttaatcctaacaaggaagatgttgtccattcattctacacataagaaagtagaggctcagacacctccagcctcagtcctaacagcataaaacagagctggcatcttaagtgagtcctgcctgtatctagtacttgttcttatattttaaacaataatgctcacattgtcattttttttgttgtttttgctattgctaataaaacatacacagacattaaaagtaatagtataggccaggtacggtggctcacgcctgtaatcctagcactttgggaggcccaagcaggtggatcacttgaagtcaggagttcaagaccagcatgggcaacatggtgaaacaccatctctagtaaaaatacaaaaattagcagggcatggtgttgggcgcctgtagccccatctactcaggaagctgaggcttgataatcacttgaacctgggaggcagaggttgcagtgagctgagatcacaccactgcactccagcatggacgacagagcaagactctgactcaaaaaaaaaaaaaaaagtaatagtatagataataggcaaataatttctccctttgttttaaactctggttggcacccatagacctgtatgcaccattctgaatagaactagctggtttattttcgtactgagaacctttagcctgggcaacacttacagcccatgaggtggaaaagaggatattagcagatgcaagataagttacacttcatcttcaatggtgacaaggttaaaggaaatgagtttaccccatcactggtgggattaaggtcggatataagagatagcttcctggaagggaagcttgctggatcttgtggaagaatgcaaaattctccttcctggaaggcatttaggacaggatggatagcgtgggtccgggctggctggagacgacagtggactaagtgaattctttccggcatgaaaaatgcccgatgatttctctgctgcagaaatccagtaaaattacctctgggtgcattgctgaggtttcccagagcaatgatctcagcagagtgctacccactagatgtgataaacagccattccagccagggattttaagaagctggcggaccaaatccatttctcaacccacttcaacctaaaccactcaaagtgttcatgcagatgggagggagggattattgagcgctgagcaaaggaagctagcatgtactcatcattttccaaggagcccagtggcagagctttcttttacttgcatgtcatggggagcaggaagtgggacccaaagggaacagcatgggcaggagtggtggtgagaactgtggatgcaggtgcagtcccaccaggtacacacagcctgccccgtctccaggtgtctcaggctgccggcactaggaaggagaagctttgttctcagatggactaagtgcctcttcctgctccctaaagctttatgcctccacatcaggctttccataagatgcctcagctacaagctccatccctggggaccacccttgaggtctgcagtccatttcactgcttcctttccaaaggttacatatttgcttctgtgctcaggttagttagaagcctgatgaatcgggatggttccttaagaaactaagtagttagttttaaatcacagagaaatgaaaccaaactgacacgaatttcagtttcacaacctgggaaaactgtcgccttgctcgatgtattcccaagggttcacctggccctgggattcaggcatgccaagtgggaaaaaaggaaaaaaaaaccagcaagaactgacaagaacagtggaaaactcccaaaccctttaaagcctcttacgtcgctctggaaaggtcgaacttgtggcagctttggatgtggtacattaagtcccctccgttgaggtactccatcacaaaaaagaggttttcctgtggaaaaacaaaacaattccaacttttatttcatttcatttttatttatttattttgtccaagacagggtctcactctgtctcccaggctggagtgcagtggcgtgatctcgggtcactgcaacctccgcctcctggcttcaagagattctcccgtcagcctccctagtagctgggactacaggcatgcaccaccaggcccagctaatttttgtatttttagcagagatggggtttcgccatgttagccaggctggtctccaactcttgacctcaggtgatccgcccaccttggcctcccaaagtgctgggattacaggcgtgagccgccatacccagtcacagttccaatttttagctctttagagaaaatacaacaaggaggactactttttaaatggattagatcatttcaggggaactaattctgttgtgaaatcacttatcagaagactgtcaaaatcatttaaacaatctatgtttttgagccccaggaagcctggggaatctaggtgggatgccctgtggcatctagatgcttgcgtgttacaacccagcagatgagcggggggcacaagggagagtccagttgacctgctggccagacaatgggatggtgccaggcacttagggcacttagcatgtgccgattgtatacttattgaaagtgacagggtgcagggtgataaggagaatgtgttttggtctctgactccaagggcggagcttgaaaacattcattcactcaacactcagtaattagctactgagcatattctgtgggcgtggcgtggggggagtgggcgggtcatgtcagtcattcctccctgaagcttgcaatcaagtttaaccttatttttctccagtcctgacttaactcatggcagaggcaagccacagtttatgacggagttcttctggcagaggacatgatgtatgtcagtagagctggggccctcgagtggccacagtcagaagtagggctgggtggtcttcaggctgtggtgggcatatcagccaggattgtaaccagcctcagcaactcaatgatgtgagacaatttttttttccaataaatgtatttataacactttagagaaacctgattttttaaagggttgtaatgcatcacagaatcagtaatccataaagtgtgaggaccttcggtgcgtctgggcatgaatttgcatctgaaagtctcacctgggtggtttcttaacagaattaacctttacgttttgatgtgaacccaaccgaggccgtggggcataggaggtaatagtagaaacattgttctggtctgacagtgagactccttgcctggtcaccacagaatggggaaaccaagtattgtggcaattatctcaataatccaggtcaaggtaagcatccgtcttttttcaatgttagtttccgatctgatttactaattccatatatctttaagtgaagcccacccttttctcttctggacaggcccaaattctcagctgacataaatcatgacttaacacagatttcaaacccaatttgagagtcgtcattggctttgcctgcacacacctgctttctcatgctacctcttgctctcatcagcaccacagaaagagcttctgttctaacctcagctttttactcaaactataatggccctatacaagccacaaaggtggaatcttcttttaagtagtcacgagagcaaagcgtatgaaagtgtagagcgaaaccatttccaacagtgcttgagtgaacggtttcttctaagtgtttggatgcttacaaattcctagaaaggctgacatttcagaatttaacactgtcaatttagatgtggagaaagtggtgggaggggactggaggcaacagttcagccccactcccatgcattccacacaccttcccacctattctcaggtctgaatcagacgccacactagtggtgagcattgggggggttgaattggccattaaagtctaagagatcacagggcacagtcagtgtttactaacatgagggtgagaagaagactacgttactagtgattattaattaacagcaatggagatttatagtatgttggatgccccacatttaaccctcccaagagaactgcaggctccacaataaatctgtcaaatatctgttctgctctgtgataaaattagcacaaatgtatgcacatacaaactacacagtccagaggtttggattttgaggagcacattttgagggatggataagccttttaaaagctgaatccaaaatcccatcataaaaggtaaatacaaatataataggctcaaactttcataaacagctggggaaggagagctcagagttgaaggcaacccacagctgactagaacctctgcagaaccgcaagcaaaaagaagtgtctgcctgctggaaagactctgggctggcatagatagaaacaaaccaagaagaatgagactcagagtaattgcaaagaatgtgggcttcatccttactcagccctgggttcaaagcccctctatttataactctggagacgtgacttaacctctcctgagcttcatttagtttgtgaaatggggtagtaatactcctacctcctagggttgctgtgggtattaaacaaaatagtgtgtgtggaaatgaatctctgcattggtcctcagtgggcaattgataactgatggcagctgtccttctaggaagcaatttaaaagccaggaaagacaaaaccaaaaccaatccaaaaaccagcaaatacttcccagaagaagcaaatgaacagttctctggccgatggctctcgaaagaaagaagaaaacagaattagattccctcctgggctgccgtttaggttctggccacctgctgagagaggataccaagcaggctgagagagagagagagagagagagacagagagagacagacagagagagagagagagagagacagagagagagagagagacagagagagacagacagagagagagagagagagagagagagagagagagagagagagatggtggggagggagggagggagagaatgtggcctgtgttgggttaattgtaaatgtcacttactagtctagacctcacgtctttatggcgggtaatacattaaccgaggcaaatgattctttccggtgggtgagaattgaagctgtgatggcattgggggatgggacatgccaaacgcgtcccagtcttgccgactgtcaacaactcctggcaaagcatctgtcgaatggaaattctagtctgtgagaaatgagactgtcgctaatcagctgtgtgatcaggtaaatcccaccatcacagggccttggtttcctcctctgaaaaatgaaccctgtccatgaaaatgagagagtcaccattacctacagctttgttgtgatttccagacaactgaaggcaataaacaatgttgacattctgtagataggtgggtaatcaaagctgtatgactcttatgtttgtgttattgatgttttaaagaaatggtatttaagttgggtgcagaggtgcatgcctgtaatctcagctattcatgaagctgaggctggaggttcacttgagcctaggagtccaaagccagcctgggcaacagagtgagaccctgtcttaaaaaaaatgatgattaaatacaagatcaaagtgatagatttaacaaaatcagttgtataattctcataggactgcgtttgcatacacaaatatcatttggagcagataaaggtcctagagctgtcaaaatatatcattatttaaaacacaagatagttctttaaagggaggaataggacattttgtgaatattctagaattagtaaagggtgaattgtaaaagtggcctcaaaagttatttaatacaacctagcttctacactgctttcttcttacagtgattacacttttcaaaggagagaatgagaataaagagaatggaaaagtgtttagttgtgatgactattcaacacagctaatcaaatattgagtaaacaaggaaatggctggcaaatgtgcatatattataggatgaatgacaggtttatagcattaaagaaataaactcatgatttttatcagactaataacagttaattttgtaaatgcactgagaacttggcaaatatcatgcaaataagatcagatttgtagactccctctccagaaaaacaagatgggaaaagaaggaaaagaataattatagtcatttttttcgaggtatcttttttctccgaaggctagtaaaccaacgtaataaattttacacaagagaatatttgcaatctctgcaaaataaataaaattaagatcaaaatatttatgacaaaacatctaaatttaccatcacacctttcaaagtatcatatgttaaggacacgtaacaaatgttacaacagcgaagactgtagtacaacaagatgaaaaccagagatagaattcaactcttctttgggacatctcataggacagccgatggaaagagttgggaattctgctctgaagaagaaaggggagctatcgttcatatttaaaattaaatgaaagaattcatataaagtatttagccctgtgcctggcatatagcaagaactccttatgtattaactttatcacatacattgttattatttatcacacagggaagaaaagcattaagttgcattataatcagaaaaaggacagccccaacctttgcaagatttggagcgagtgtgcagagggaggccccacactgtgggtccccaggtttaagtgttattaatcaagctcaccaacaattcaattaaatatgctctacattcctatatgttctgtctcttgggaaatataacttcataatgaccaagaaggatcgtgacaaattcaggatccctcaaaattctgcaccagttaattggccatatcgggaaagtctcctcctgcccctttcaaggacagaacctagggagatgtctacacaggcttgaggctgtttaggtatggaattccgaggtcctggggagtagtttaggaacagagacgacctcttggcttcacaggaaggagtgtggtttgagaaaggccaaagggaggattctaagtgaggggctgggcggaacccctcttgcttgggtctaaggtttaggacatggaatgaacaattttccaattaaataagttgtgagttggatttgtgtttaggtatcttgaagtctcaactttactaataattttggattgaccacagaaaagagcactctcctgtgaccagctaggcttatcttctctggagctccatttcctttgctgcaaaatgaggggatctgacttgataacctctaccacccctccctactctaaaattcttgatccatggagtctgtcattataaggaaaacaaaagaacataacaaatcattagttgtcaatggaatattactgagcaatgaaaaatgagttctcaagccacagaaagaaaagaagaacccttaaatgcatattcttaagtgaaagaagcctatctgaaaaggctacaacctgaatagtctccctcttgtctggtttctccatctctggctcaagcatttcccatgattctcatcccttacactctgcagtcataatgagcttccatcttctgaaaactctttctggaagatttctgtatcaccactgaatctgcctatccaccactcactccttcacactgtattgtctgttcctcctccatgacacattccacactcagtttttgattgtcaactcttcaccacattaaatatatgatcctttctctcttgaaattctttcctctcctgtcctccgatactcctaactcctctgttcctcttcttaccaccccaagggatcctccctatcacctttcccccctgctcttcctcctactttgtaaaagagggcttttctgtggtttagcacttgaatttctgcagtacgttgattctgacgctcatatattcccacagtttcccctgaagagtcccatgcgtgtcacctcctcaggatgggaactgtaatcacctcaaatacaacgtaatgttgggtctaataaggaaactccactctgctccactttaggaagaaatcgttgctaggaacaacacatattaaactgctctatgctatttatcagatatttctctaagactggtggtggagaagaggttcctgaagtgacagaagttttaagggggagagacaaggagatggagaagaacgattttgccatcaaggatcaaggcagaggccaagcgcggtggctcatgcctataatcccagcattttgggagcctgaggtgggtggatcactagaggtcaggagttcaagaccagcctggccaatatggtgaaatcccatctctaccaaaaatacaaaaattagccaggcatggtggcacacacctgtaaccccagctacttgggaggctgaggcaggagaatcacttgaacccaggaggtggaggttgtattgagccgcctgggcaacagagtgagactgtcgcaaaaaaaaaaaaaaatcaaggcagagacctgatagctacagtgggtacaagatcatgtgaactctgggatgaaggggaaaataatgaaacaggaggtcagagaggggtgggaagagggtttgtcaaagatagacttctcctctgcagttctattcgggaccagccttcctggcacctgagttagccagtatgatctacagtcagaccatttatctttctttttctcttccgctcccccctgtgcccagcccctgaacattatctagcactctacgggcaaatgaaacaaaagaaaagagcgaaacatgcatcttggtatcaaggaatgtattatttacatagacaaggtattatttaaacagaacatatgaaagaagtcacagaagacacccagcagtacaggagcaaaatcatctttctgggtcacgtaagctgagaagcctgagcgtctgaatgacaagtaggatttagtgtatctgagcgtgatttatagagtaggtagtttgtcagcaaggtttcaaaggagggagagtaggctgggcatggtggctcatgcctgtgatcccagcactttgggaggccgaggtgggtggatcacttgaggtcaggagtttgagaccagcctggccaacatggtgaaaccccatctctactaaaataccaagaaaaaaaaattagctgggcgcagtggcgcacgcttgtaattccagctacttgggaggctgaggtaggaggatcacttgaacccaggagatggaggttgcagtgagccgagatcgttccactgtactccaatctgggcgacagagtgagactccttctcaaaacaaacaaacaaacacaacaatgacaacaacaacaacaaaaaacaaaagagggatagtagattcacagaaggcatgcactttcctgaggcactctcttgaaggagatgtcaaatgctcatgtcttctgggaagctggtgacaatacttttgggactttgtgagaatggctgacaaaggaatgggcagataatatgggccatgagcctggaagaatattacagagtcacatcaagatgagaacagatctgtgagcttaaaaagtgggcgtgtaggggccgggcgcggtggctcacgcccgtaatcctagcactctgggaggccgaggtgggtgtatcacaaggtcaggagattgagactatcctggctaacacggtgaaaccccatctctactaaatatacaaaaaattagccaggcatggtggtgggcgcctgtagtcccagctacttgggaagctgaggcaggagaatggcgtgaacccgggaggcagagcttgcagtgagccgagatcgcaccactgcactccaggctgggcgacagagcgagactccatctcagaaaaaaacaaacaaaaaaaaagcaggcatgtaggaaagatgcggcatttcagatgcactgagtgagtgtcttgttcttttagtccaagaattcctgaatatgtattcactcattgcccgttatttcctgtgtatttggacgagaaaactgtaaggaaacattgtgagtgcaacattaatttcccataaattactgtgtgaaaataaataacatttaaaaggtgttagaattcctaaaatgcgttttacgccttgagagagatgcgactgtgatctgagtcacatatggttacaacttctgtttctcagattatagattaacttgcttccttttttctcttgttctgtacaatgactagagagaattaaacaattgtcagggacaaacacttcctgacttcttttattctttttttctttttgagacggagtttcactgtttcgcccatgctggagtgcagtggtgtggtctcagctcactgcaacctccgccccatgggttcaagtgattatcctgcctcagcctcctgagtagctgggattataggtgcccaccaccccgcctggctaatttttgtatttttagtggagacagagtttcgccatgttggccaggctggtctcaaactcctgaccccaaggtgatccacccgcttcagcctccaaagtgctgggattacaggtgtgagccaccgtgcctggccgcctcctgcctttttaattaatgaatcttgttaaagattaccttttcctttttttgtcctattttccttagaccagatgacagaaaacccatgactatagcacactctgtaaaagatgttaaatgtccctttcccaaaaagaaacactgcctgtaaccaagttcctggaactatgcaccagccttgtatgaaaaaatgtaatcctgctaaaaatgcctgtgtctctccctatggaaaccctaaagttccctcctttacaactctgacttcattcttttggggtgtttccaggtgggccatcctcaaactttgagtttgaataaatgctctttaaattagattctggcctttttgattatttcaggttgacagctgtaaatcgactcatttttgtaaatttgctataaaatctaacatttgccaaatcacagtttggttacatagcaggggaacctgcagaatgtctgagtgatccccagtttctgaaataacaacgtgtaagcgttctcaggatcagaacgccgccagaggacgttaaagaaaagaggcttatctgtcactacagatgggggcagcatgaaaagttaattcttgtcttagtgcagggacacgtctttggaaggatgtggtttccgtgggttttcttttctttgctacaattgtggtaatttccagggctcctagctcaactgaaaggttcatggattgcagcatttttgagagcttcagatgaagcagtttctgaataaaatgcttgaaattaaaaactttcttagatggattttgccttaaaactatggaaataccaggatgacatactttttaaaaagtatcaagttcaaggagtttttctttttaattttaaatgataataatatcttgtagttagtatggtactttctccaaaaaagatccaaacttctctgcaagtgctattattgttattattattatttttcacgttatccttaggaagcaaaaaaggagaaccagtgtcacaaagaaatgttaggtgacttgttcaaagtaactcacacactcatgccctgaagccataaccggaagtagagctttgtgtgttctatgaatagaaagtgaaactcagttttctttttcataaaagaaaaatttcaaagtgatattgaccaagaatgttcaactggtgcatattgggagtgtgggagtcaagggcagtgatgtgaatccaggaacactagcgttctgcctcttggcatcaccctgggaggcctctcttcagaggcctgcaaaaccacggcggcctgccctcaaatccaacctgagggaacgacccagagacagagctgttcctataggatctagagctacttaggtgtgaaatagtaacactacttaaatgtcagaatacagatcggcctttcagaattcaaaggagacacagaggaaggtagactttagttcacttttaatttttaagggaaaattatttccttgaaattaaaaagaaatagcatccttactgtgttagatgcatctttcctttccaaacaaattttagaaataaatcctcttatttttccacagttttatcagagatagaacacagaaactttggatacttgagttattaatctttcttttactgcagcataactaaaaagagggaaactgtttcagtgtttatttttccctgtgtttcaaagttttatggttaattatttttttctaattgttttaaatctacttgtaagtggatagttaaaagatttatgacaactcttcttgtagacaaattttattgtggattttcctatttttttactttttaaaatgtaagtaatggaaactgttaaaaatctaagttggaaatctagtagtgcaaaagttggctggcatccgcactgaagggggtactgagaagggatcgtgcaatttcaagccctgcagactttgtaagacagaaaatgtaaatattaacaacaaagaaatgttagaaaaaaagtaaaagaaagaagagctagcccttctttcctcttgccaagacagcagcctctcagaatgctgatctacgttagaccctgagccagtaatttatgccagagcctggatgatgtacaaagtcattttgatctagcacacagaaaattcattgtgaagattcttttgatttgagcctcattcagattcaggttcagatttcatgaattatcctgtacatctatgtccccagacggtgccgtcccattagggcccctggttttacagctcccagcccctctgcctgtaactcttactctctgtcctgggcaggggtaaagtgggtgcctcagagccctgttgataaacggcagagctgggcttgaacttcggaatccaagtccacaggaattttcacattttgtagcttcctaaatggctttatcatattttcacccttccataggtgatatatccctcatctaggaactttaaaaactttaacaatttaatccaaatgaccctaattaataacaagtgaatacctgtcctcagaatctcctgaataatctggtattcaacaggtgcgctctttggaggcagagagcagatgaataacttcctttaaaaaataacaatgccctggagaagtacatagttaatttatcttatctgatgtctacactagcatacacaggtaactgtcctcccaagaaaggtcattcccaacatgttcccagaacaaagcattatccatatcacgtatcaatcgttgccttttgcattcacttgtggtatttaatcagttactttgacaagcaaggtttgaataattaagacatctcaaaaacaacaactcggggtgttggaaaaggtgattcaagcttcttcctttgtttctttcctctttctaaaaggactcagttccttgagatctgagtcttgagccagtcagatttacatttcatgtaaacattctctgctgaagtttttttttctctcccagcaccaatgctgtggatgcacttgtggctcaggtcttggtaaagcatcccagctgcacggaactcatttatgcctagtgttccattattggaacgctaagcatgtgggagttatttatatcctactgctcaaggtcatcaccaaggtctgatttcaaaattcaaaaagttgcaacctcaggcataaatgggttaaggagatctctcataagagggacagaaacaaatgctgcctgaagctgtgatggacaggcaagagaaaggagcatacctatcttctacaaagtgggattcccaatagccttccccgtaagacatgaaaactgtcatacatgcaaatcaaaaaaaaaaaaaaaaatggggaaaaggcaccaagagaagcacaactgcctaagtgcccagaagcccagtctaaaatgtgtttatagtaacatacacagaaagatataataaaaataaaatcagttataatcctacctcccaattaacaactgttagtttttcattatttttcatgcttatacatgcaaatgttcttgcttaaaaggaaatactatatattctcacttatgatttcataaacaacattctgtattgatgtttaagcatttacatcatcatttaaaatggttatatagtattattttctctgaccatataataatttattcaataaatctgtcattgggtatttgtgttgtttccaatttttcgctactatgaaagctttacagtaaaaatctttatttatggcaaaaaagaaaaaatgtgtttagcagtttgctacaagcctcaaaatactgcaaagggaaaagattacagggagccccagcatgtgcagaaaatctagacaacagtacggagagggtggcagagtttgtctccttgcctgcaggtgacataccttcaccctcccaacagcatggagagggtggcagagtttgtccctttgcctgcaggtgacataccttcaccctcccaggccaatgggtatttatcatctccaggagggagtttctagtacaaaatctcttctagccttcatcatgggaagttccagcctgctccctgcagcaggaagcgggcctgcattctcctaaatagttgaccaggacacctcactcttttctacttcctctcctgcagccacacctttcatgcccaaggccctttctgcccattcaaattcctctttctagtttctctcagctctggtactttgtgtctgccttctgatctaatattactcatactgttagaaatgcagccttgactcttattagagtgtgaagttctcaaggtcgggagctgtattatatacttctgtatcctccacagtgctttgagcacagcatatgctcagtaagtgctttgccatggtctggcttctctttatcttaggtaagtgcatttattcattgatttggttattgcacatatgctgagaatctactgggaactgcagaggtggtgatggatgccccagttgccatccactttcctcattcattccctggttccctcattaattcttcccatggctcaagtctccttagaagttttccctcattcactctccagtcgtcatggcttgagatagaaaatgggaaaagggctgggtgcgttggctcacgcctgtaatcctagcactttgggaggctgaggggggtggatcacctgaggtcaggagtttgagaccagcctggccaacatggtgaaaccctgtctctactaaaaatacaaaaattagctgagtgtggtggtgcacacctgtaatcccagctactcaggaggctgaggcaggagaatcacttgaacccgggaggcggaggttgcagtgagctgagatcacaccattgcactccagcctgggcgacagagtgagactccgtctcaaaacaaacaaacaaaacaaacaaacaaaaagaaagaaaacagaaaatggaaaagcctccgccccttgtgttctttggcccttagtcatatggtcccacttgaggctgctaattagtgcgggtggtggacagccgggatggggtggcagagaggagacaaaccagtaagaagaatcataatgcatgtgcatgaaaactaatcttcgaggatgttcattttagtgttatttaaatcagaacaaaaaattagagatgttctagttaaatcacgttgtagaatatccaaagacgtaagaaaatgttcaaaatagagtgtaacaaatgcagagtacagtgcagtaggtatttacagtgggttgctatttttgtttttagaagtccactgcagagagaatctatagaaggagaaacttcaaagtattaatggcgagtatatcttaagtggtgggattataagtgattttcttctttgagtttataaaaattttctacaatgatcctgaataattttgagtcaggaaagaaaaggataatttttgtttttttaaggaaaaaggagaccaggatgcaagtcctcccagaacggcacagccttctggcaaattcagcataaggaaagggtcccaacaccgagtgggaatgcagacgcatccaacctccacctcccagctcaggggcttgctcactgatgagcccactccaaggctgctttttctgccagccttgaagagaaaaataatagtgtacgtgcgttttgatctattttccaacttttatctcttccagtacatgcagggtagatgaacaaacacttgttacattttcccctaagtcacggactgctgagaagcctggttgttatgctaaatgaaaccaaattctaaaaaacaggaaaacagacaaacaaatctagaagtaaagatctttcccaattgatgacactaaaacattctaagtaatacttccatggtgtgtagaagggatgtttggatggatggcaggtacaccgaaatgtaagataaatatggaggcaatgactcgtgtctcctaatgagggcgccattgaaggtatcatgctgagacaggttagaggggaggtagggttgtcggagcagaagccataccttggtctggaatgtacaaaacatgtgcgtcagaaacggatgctcccaggccaaggaaagaactctcttctctaccatcgtgcactcaacatcatcgtccatcaagaccacatctttctttaaggcctttattgcgaaaaattgattggttttcttgaattctgccaggaagacctagaaggagagggaagaagtaactttattttagaatttggattcccatttcttaaaaaagagacagagtcctgagagacacctgtgttgggtgggaaaaggggttccttctccaacccccatccatcctgcataggccattcctgagacaaaatggagcacttctctggtttcggacatgacatcactatttcatactatctttgtactctttccaagggttcacaaaattattaagcaattgaatggatttttaaaagtgtgccctgcctgctcagggatctgagtgaaggtacaataaaaatccagagagataaagtgcacagtgaagaaagaagagttgagtgtggagaggagaaactgtactcgaaacatcactgcaagtgcacataaatcctagctttacgttttacccagtttttccaggccaaaagaagaatggagggatatagttctccttgtgtacttaaaaaataaacaccggccaggtgcggtggctcaagcctataatcccagcactttgggaggtcaaggcaggcagatcatctgaggttaggagttcgagaccagcctggccaacatggtgaaaccccgtctcgactaaaaaaaaaaaaaaaaaaaaaaaaaaaatccaaaaattagccgggcatggtggtgggtgcctgtagtcccagctactcgggaggctgaggtggggaattgcttgaacctgggaggcggaggttgtggtgaactgagatcatgccactgcactccagcctgggcgtcagagtgagactgtgtctcaaaataaaaaaaaataaataagtaaacaccattttctctgacaacacagcaatgaattattcatagcagaatgtatggcatgtagtaggtcctaaaatgtgactgacactgggttcaaaggataacttgctcagattcttcgagctactagggaaagatttaactccgaagtttactttcccacttgatttcgtggctctcgtatcaaaggacaccaaaatgggaatgaaacattttaggacctactgtgtgtcatacactctgctacctactttacacttacgacctaattgtattatctaatttaattcttagctcatcacactctgcaagacagaagttaacaacatcaacaacaaacactgagttcaaagaataacttgctcagattcttggagctatgagggaagatttaactccaaaatctacttttcccacttgattttgtggctcttatatcaaaggacaccagatggcatatgatggagggtttcaacaattttagtttttgcaaatgatgcagcaacacactgttggcaatggtaagggcatggcatttggatacagaaaattctagctctagttttatttcacagacatttattagctgtggaaatgtgggcagatgaattagcccctctgggcttcagtttccaattactactgcattctctaacttacaggactgttgtgaaagtcaggtaagatgagacctgggaaagtagactctaaaatgatctctgaatcacagttgctaaaattcagtcatttgtcatttgtttctgttattgacttttgggaaaggccgaagtcaatgatgtgacaacagccctgaacatgtaagtgtctaggtttaaaagcgacggagcaggttcgtagcttgatggtagctgacttgatagaagggaagggatgaaacttagatgggaattcaggcaaatgaatgatgctcacatccccagagaacacacaatttgttttcttaggcttaaaatttgtttgagaacaagggtatagaggtcttggtgaggaaacatactttccacataaagccagaagagagagaaaagacaagttttggagtattctcagtgttgtgagaaagagaaacagccatcctgtcttgctttgatatctccccctcctctcctctccgtgtatagggacccagggtcctgatgaaaagaagtagacagctttggacatggagtgggggaaacctggggctcccagctgcaccttgggataccgactaaggcttgtaggtttaacttaatgtcttccttattaaccttattcaaatgtggaaatccacatgggaacaaagaaagataaacatttcattaacaattaaaagtcctcttttagtaattgcttctttcagtaaaacaccctaaaaccagccataaactaagaagccaaaaagacaatttccatctatataatgtgctttcaatttttggtaacaggttataattgcacattaattgctgctaaattacaatgaagactggctgtaacattgcctattatgctcagattagcaccaaatgagcctactgtggttcatattattgtggaactgaacaaaaagaattcctgaatatcagctaccatgtgctggacagagtcgattctgctgaaaggcaaggcatcagtgtttaaatccaaaccccaaatggagctcaatattattcagctgtggtgaccgctcagttgcattttagtttgtttaatattaaataaactgggtaagacatcctgccaaagtctggtgagcagttgtggtgtataatgctgcctttggctgcacagattcatagaacagtcatctctgattaaaattttcctgggagtcccatccaagaatgtaaaacaaataggagccccgttaatacatgagatacccttaatatcaaaaattacctaaaagcctatattccatatcatccctccttaaatcaccagcttgaaaattttctgcagtcaccggtagttggttataatttcttaaattatctcttcttccttcttctcacctccccttttttttttttttgctcctcctctccctctttccttcctctccttgtcatctgtgagtgatggagacaaccccccacctgcatgtatggcaggaagaatttagaggagggactttctccacaatttttttccaggactctcaagctacagttttcttatgggctgaattgtgtctatactgaagttccaatccccaggaccttggaaagtgactgtatttggagacaggaccttcaaagaggtaattaaggttagatgaggttattaaggcaggtcctaatccaatatgactggtgttttcacaagaagagaaaatttaagcagagtgtggtggcacaactgtaatcccagctactagggagctgagacaggaggatcacttgggttcgggaggtcaagaccagcctgggcaacacagtgagacgtcatctcaaaaaaggagaacacttggatgcagacatgcacaggaggaagatgatatgaaggcatggagagagggcgaccattgcaaagcatggagaggggcctgggaagaaacaacccagacaacaccttgatggtgaacttccatcctccagacctgcgagaacatgaatttctgctgtttaagccagccagtatgtgagattttgttatagcagcctgtattagtctgttatcacactgctaataaagacatgcccgagactggataatttataaaggaaagaggtttaatggactcggttccacacagctggggaggcctcgcaatcatggtggaagacaaaggaagagcaaagggacgtcttacgtggtggcaggtgagagggcatgtgtagggaaactcctctttataaaatcatcagatctcatgagacttactcactatcatgggaacagcacagaaaaacccatccccatgattcaatcaccttccactgggtccctcccatgacacctggggattattacaattcaacgtgagatttgggtggggacacagagccgagccctatcacaccccaaggaaacttatacaagctggaagatatttaatagagagagaaaaaaatcacatgcaaactaaaacaacactccaggcttgagaatgaagcaaaagaagagaaaacaaaatgaaacaaacacaaacaccgtgtgaaacaggaagtggctgaggcaccttcctatttctttggtgcccaaagacatcaaactcataggcgtgtgagatgtacactctccaagcaaagtagctttggagacacaggtttccagaaagctgaggctactatgggcctagagccctcggggtccctatttattcagcgctccctcaggaaagctgtctctgacactcacatgcaatcctagtggccctatgagtttaatttctttgaccaggaacttggctcatcagttcctggagttgggccatagcattctcccgtgcattagcttaccttgccaaaacttcctttccccaacattttgtgcaagataaaatcctcaatttttagtttaatctgcagagatggtctttctttgttcagttcaggttctggaagatggcacattttatccacctcatccaacggagactcccaggaaatgccctgaggctctgaaaatgcaagctggtggttaaaaatgaacatggagtaatggaggtcattctagttactgagagcacatgctttctcttctacttcccatgctgaggctccatcatagtaattgggggtgtttagagggtttcctacagttcaggcagctttaatacctttccatctgtctgtgagggcagcaccccctgtctgtgagcctggcatttggattttggagtgtggactatgtctctttcttcaatagactgggaaatagttcaacttaagaaacaaattccaatcagtaaaagaccatatatgcaaaatacacaagcactgttaataatgccacatcaaggacatctagggattttaaccaaattttaggaaaaaaatgattttcaattgtttgcatggctcacaaacacagtggcatcaatttctacaatttacagcgtgagagagacaggaaatgaaatctagcagatttttaaagatctgaactgcatcattcatcccagaattcaagtcaagatgctgcctacgttggccgggtatggtggctcacacatgtaatctgacaacttcgggaggccgaggtgggcggattgcctgagctcaggcatttgaggccagcctgggcgacatggtgaagccccatctctactaaaatacaaagaattcgctgggtgcggttgtgtgcgcaagtagtcccaggtactcgggaagctgaggcaggagaatcccttgaacccacagggcagaggttacagtgagctgagattgtgccactgcattgtagcctgggccacagagcaagactctgtcttcaaaaaagaaaaaaaaaagatgctgcctatgttgatcattgctaagacatagtctccttgactgcctggcaacccctcctaaatgtaacccaaacctttcatttacatttttaagttgatttgaagtcagagaaaacataagagaaatttttaggaatttccccctgcctacaatagtctctatatttttaaatccctaggtttatctttcatactcttccaaggacactaagtattttagaatgtatgctgaaacgactcaggtctcagaaacatgggtcatatccactcatgaactgctttcaaacagtaggctggaaaaactgccataatgtcatgaaagtggctttgagtccttctctttcctacccttaaatttaagtctcaaaggtgcagagtaagaatgtcttctgtggccttcccaccatcaaattttaagacagatttatttctgtgaaaccatttgacactgacagaatgtaacatgctgaaactctaagaaaacatttgtggttgttccctccagacctatcccattttctaacccccacctcctgccttttacaaaggtaaaaggttttagtttcttttctaagaagtgggagcctcttagttggtagctggaggtggatcacctatcagaccaggtaagctgataacttaaatccaagggcattaggttagggttaattgagattaatgactgacagtgattagactgctgatcaggacagctacctctttttcccggtgtcggtaaacatggcggccttgcttcatttttgatggagcatgggagaccaatttcaaccggaccttctctgaagatctgttcagtatctcttaagcagcgagcctggatgacaaacagagagtcagaccacccacccacccaccattgatggaacagctcagcctgctaacgatggggacaaaggccatttaaaatgtttaaatgcatagggtcaacaaagatctccttatcctcaacgttcttttggaaccccatattctgggagagtctatctactgtattttatgcattagccgaacacgtttgcctccttcacacttttctggggctgacaggattctctcatgctgtctacatcattccatcacaaataaggacaggtagttaatggatgggaaaacagctgatacaggcaatgccaagtcttaaagagggtttatccttggatctaggaattcagctaatgccaaaacagtaaacagcaggccaaatttgccctggactcggtgttccatgaggatgatgctagcacataagtgttttcccccaggctattctataacccgaatatattcacataaagctgtcaatgaatcttcaataactttaatgaatttatttgtttctgcaatgctcatgccatgaagaatttaagattttataaagatctgcataatacaaatgcattaaataaatatctcaaagatagggggtgtgggcatggatatgaaagccaagggcaaggccggtgctcagaaatacatcccggcatttcccatagggctgccacaggtgaagcagcagaagtgcatggacatccttgctgagcggccatggcgggaacgtgtccacggcacatgctcctacctgttgagtgctctcaatcatggccagcgcttcagccattagcttctggtttatgccacaaaggttggccacctttgtctggcatctatgatgcacattcatgccacatgctggaaggaagaaggcagatagtgagcaagagtggaagaaccccctggtgctaaacaactctctctggaggtaagacagagccttgcggatagggaggaaagcctaaagtgccacggctgggaggaagttgaccctggctctccctggtagtgatcctcgtgctggaagggaagtgaggtaggaggtgggactcaactctggaggtggggttcagacgccagaccaaattgaagactagctaaaacagggacagggcagaagcagctttccagaagatgcccacctgcgtgccatgtcagtttagtgttgccatggcaacacccagacgttaccaccctttttccaggaacttaatttgcatgtagttaaaagtggtataaataggattgcagcactgccctgagctgctactctctgcctctggggtagccctgctctgcaggagcagtcatggagctgtaacaccaacagaactgtaataccgttggccaatgaagctgttttcttctaccaacagccgacccttgaattcttcctgggcgaagccaagaactctcctgggctaagccccactttggggctcacctgccctgcatcagaagaatattcctgcccactccagtctgggtccaaaacatcccctttcccacctgggccatgaagagcttcccccagcctttaggttgaagcccaggaggcagcctcagcctgcagatggatatcagacggtggagccggagtgtatatgtgggaagggatggagtaggaggaggctagcaatgccaggagaggtcacggcagaacacacctagcaagactggaccaggcatgaggacctcagctttgaaaaaaaaatcacaaactctacacacggtgtggaaacataaagccacaggcttcaccagtgtgggcttagatgaggaggccaacagcaaccgggtgtttgagcacattccccagtttccaggcccctgtacccatgcctcctgaaaacctcgtgtgattatgggaagggtagagggccccaaggattactagatgagaatgttaactaagtggatctcacagtcataaagaaagtgatatttcttgcacgcatgaactgatggcgtaaattgacatctacaacctgttatgaaaggtaactcgaagaaaaagaaccaaagttttctgtcatctttataagtcacataagatgttaaagaaaaagaaagaggagagggaaatactcgagcacctgtcaggtgggtggagaacggggtgctggtggcagcttgcacagcgtggacactgtgtgaccttgggcaagtcatgaacgctctgggggctcccgattaaggatctccagcactggactcatgatctatacaggattctagcttggggatcctacaattcagggtgagtattctgattcatgaatcttgaaaacagtagcatagaatctaacttccattgccagtgaccaagagatccctcttggactggagagcgtgtgcccatgtgactgtgtaaagacaattattagttttagaaattcaaattttgctaatgaaacatcaccattaaaggccaggcgtggtggctcacacctgtaatcccagcactttgggaggccgaggcgggcagatcacctgaggtcaggagtttgagagcagcctggccaacatggtgaaacctcatctctactaaaaataataacaataaaaattagccaggtgtggtggtgcacatctgtaatcccagctactcaggaggctgaggcagaagaatcacttcaacttgggaggcggaggttgcagtgagctgagatcgtgccactgtactccagcctgggagacagagcgagactgtgtctcaaaaaaaaaaaaaaaaagaaacatcaccattaaaatacagaaaaatcagatataaagatttccaaactccagctgacagagtctgtgagtagagagtgttgtaatagaagcaggcaccaggtgctatgacatcatgcagtcttaatcttatctgctgatttgcacatgtgtgtgcaaagaagcttagcacaatgactggcatcgagcaggcgctcaacaaatacaacttccttttcatcttcatcatttattgcatagatgtagatattaaaatatttaggtgaaatttgggcaaccctcacctgtagttttcactggtccactcttcttcaaatagctcaataataaaataaagcagaattttctatgtaaataactattacttttttttttttttttgacatggagtctcgctgtgtcacccaggctggagtgcagtggcacgattttggctcactgcaacctcggcctcccggattcaagagattctcctgcctcagcctcctgagtagctgggattacaggcgcccatcaccacacccagctaatttttgtttttagtagagacagggtttcgccatgttggccaggctggtctccaacttctgacctcaagtgatctgcccacctcggtctcctaaagtgctgagattacaggtgtgagccaccgcgcccggtcaactattaaccattactagaccgagtatataggcatagatatagccagaaaaattcacctgaagcaaaatcttttctgcatatttaaaatctttgttgttgtgttgttgttcttgagacagggtcttgctctgttgcccaggctggagtgcagtggtgcaatcatagctcactgcagcctcaaacccctgggttcaagccatcctcttgcctcagcctcttgtgtagctgagaccacaggcgtgcacaccactacacccgactaatttttttatttttcgtagagatgggggtctcactttgttgcccaggctggtctcaaactcctgggctcaagccatccttccgcattgccctcccaaagtgctgggattacaggtctgttaccgtgcccggcctaaaatctttactatagaaaggatttttttttttcatgattgtgctccaaattccacattgtcggcaaaactcgcataactcacattcgccctatttagaaggtgtcaggtttcaacttcggtagccccagctccattttcttatgcatcaccgtgacaccaagtgaggttgtcagctaggattgaacatagagggatggagttttactttgctccttaaaactgtagccacatctaggcttctctgtgacttgcatggccgcgaagaaaggccaccaccatctccacgagaaggtcctaagtctttgttactaacctatcaggccgtaactcagtttcttggagggcaaagagtccctttggatgactattttcttgggaattattgtggggagaaagagaaggcagggtaaaaggctaaggaggccctacttaagacgacggcctgcaaggaggcaggatgaaagggaggcagagagggagggaagagagctggagaagagggcgagaagagtcgagaaaggaggacgcgggggcatgcggggtgagcggagcaggcggggtgagcacagtggaggggcagggacccgggagtgtcagaagcaagaatggaaaacaaaccagggcaggggagggagaggagaggggacaaaagaaaaaggggaggggagcacttgaaatgtaggtggtaggagagagcggggaacagaatggagcggaaaggaaagagtattcaaggaaagaaatgaaacgaagcaggcagaagagccatgaaataacgcccaggaacccctgggaagttctaagctgtgccgcggcgctgctgggaccagctcttcttgcaagtggattctcgggctcccaggacagagaacccgacctgagaccatcacaggagaaccaagaggcgagaatttctcctgtttctgtggataccgtcaggatgcaggatgccgggacactacgttttgtctctgacctcctaatgaactcttaataccctgcctatccatgtcttcttgaacaggggtgtagagaaaagcgtgtcagtgtcctttggggccaggaacggattcttgaggctaatgttggcctcctgtgatgtctgctttaggtaatgatttgaaaacctaacccctcctgcctccactgagaggtcgctctgggttccaccagacatgtgaacaggattgggatgaagaaggggagaatgcggaagatgctgtgccgccttccatcacgtacctcattgctcaaaagagaggacatacattagtcagtagcactgatcaaaatagggctgccaagaaaaaataaagtggcttatatatttaatacttcatcataagaaaaggtctgtgctcaccaggcatggtgactcactcctgtaatcctagcacttttggaggctgaggagacaagatcgcttgaacccaggagtttgagaccagcctgggcaacatagcaagaccatacctctaaaaaaaaaaaaaaacaaagaaaaacaaaaaaaacaaaaacaggcatggtagcacatgcccatggtcccagctacttgagaggctgaggtgggaggattgcttgagtccaagaagtcaagtctgcagtgagctgtgatcgagccactgcacaccagtctccagtctgggcaacaaagtgagaccctgtctcagaaaaaaagtaaaagaagaagaaaaaaatcagaagctgtctgtatgcaacaggtggttctccttttgtggctctattctctgggctctgcccacgtctctccccaaccagaaagcagagtgccttgtcagttcttgagggtttttttttttcttccctagtccttaatcctagtgtaacagcatctcagcttctaaacgttatcgccttagcaacttggagttgtacagcaagaaagccttgccttgtttccttttttgatggtaggtctgagaaactccatcaataatgaatggcaggttaggctctgctgcgatcctggccttggaggaaagaccagaaaacaggcaatgacggtcacaaccgggccagcctcttactgggcacttggagttcacagcaatggtttagggatggatgctcaagctaatgttacagaatttctgtgcaggaccatgtgtcagccaaatgaatgtgctgggcttgctccttgatgagatgacagaaagaatcttactggctggtgcaaaggagaagggttagggtaccacacagctagacctgttgggattaggaaggggcagcccagagcccactgaggaaactagtagtagaaagaccagtgagaggagaaacactgtcttcatttcccccagggctatggtacggcagaaggtgatggagctaggagtttgaccttgaacctgaactgttgtgctcttttctgggatgtgtgggtgggggtgttgcagggtgcaaggaaaggaacatagtggcttattgccccagaagaccatacttatgatcatgacttgtctgggctgggtgtggaagtggtaccccctacatcctccctccagttccccagaaagccttgctccatcccctagggggtccacgtcgggccatgctcatcccccactggactcaccatcacacttgagtccttgccgtgccagtccccacagcagggtcccacagtgttcacagaaggtcgggctcttgtaattgtagactttaaatctgtgtggcatgtcaattttgaatctctccttgtggaactgaaagaaaggcagaaggtgaaatctgtgtattcctggggccccgactttggatgttcttgcagataccttagcataactaacagagatcataatgaaaacactggcattgtgtgcattttaaaccatcattgtcacttgtcaagccctacagtcatgcctgaagaaggcaggcagcctcagcaactgtacgtgacggggcatgcttgccttctgcatgtagcaagaaccttgcagacagctgaaatctgaggcattcacacagacaggctaaaagctcaggaagactgcatgagggttattttaaaaagtgctaaggaaacagtgctcccatttaaatagatgaagattcccttcctgttttactataaatatttccttttctctttcagtccagaactagtgcttttaacctttggaagatgtaaaaaaaaaaaaaaaaaatgccttctttaaaggaaacatttctatgggtttatcagtattactgcctaatgtgagaagcattttcacacctattattcatgaactgaggtggcaagaggagggagcagttcctgccaggtgcggttaacaaatatgtcacacgcatcatctattacataggtgatatctcacgtaatcctcagaataccccttttgaagtcgcttctattagtatcctcctttgacagacgaggaaatgaagcacagagaaggtaagaaacttgcccaggacacgcagctctagagctgggatatctataagcttggcagtcagaatcagagcccagccattctcttttctgtctcaaaataaatgtgaaggcttatcggggtagggagaggggagtgggagagggatgctagtgatcgacatggaatttttttaaaaaacagttttccagagtttaaatcaaacttattgcaggaacaacaaaacacttggatagttggattcctggtaagaatgtgaatattcttgtgcaggataaaatgctttattttctaaaggtttataatctctgcagaagtttctaattcaacagttcctttgggaaggtgcatagcaaagatgccttattcatcagcacagcaatagatctaacgttcccgccaggggtactggtcagcgttggttctttagaaagcctgtgtagaatcgattaaaaattgctcagcacttactacagccattttcaaccaagaaaaaaataattttcgggactcacttatattccacagtttaaatatggacaattaataggtcaaggtccaggctggaaggggaccacttcgaatcttgaatgcaggggcaaacagctcaagacaccatggctgatgaagacgctatgtacacgctttccagtatgaaaaccaatgagctacatggggctggcgaacacttgaaaggtggtgagttagagttgagatgtgctggacgtgtaaaataatacatcctggagtttgaagacttttgtataaaattacttaagatatctgaatttttcaaatgtcgattttttgttgaaatgatatttgaacagattggattaaataaaatgtattattaaaattaatttcacccattgctttttcctttatttaatgtgggctacttggaaatgtaaaattacacatgtagccctcattctatttatttctatcggacaatactgctccaggggtagaggaacaaaagaatcccaaagatgatgtccccttgagtgaacaagaaatcaaaatatcctgggagaagataatatcacagacatttatttatgtagctgacagtttctcaagactttgtaccaggaactttgttagtcattgaggttaacagtgattcagagatttgcgtttttttctagaaaagctgaaggcatcaagtaaaggaagaagtctgggaggtgaaaatttgatctaagcaagcaaaaacatggtctgagagattgtgatcttaattttagtaccagctctgccacgtacaggtgatcaaacatgaacaaactactttaacctctttgagtcttagcagaatcaccggttagcacaagtttatctccttctgcttctaaatgttaggagaaattctactctggaaaaacccagccacttcgccttctctgaacctgcccctttgttggagaaaatcatactcctgagcaggctgactccgtcaaattcaaatggactttcagctctgctccacagtctgactgcttttcacgagtcaccttgctttctctaagataattatctcatagatcttcctttttcctcgaaggcacttgttgctttctcttttccttcctccagccatcaaactccatgggggacacatgcagtctaagggaagcgcctttgtgtgcccatcaccaaagctccacacccatccccatcagcaactgtcttgccctactcccttccggttaaactgtggaagctccagggaccagtctccaccagagctcaggccctcttcgcttcctgccaacagacttgactgttttgtttatctgtctctccagctttatccatctctccctggccacgggagcacttgccatccttggggtctcatttcccagccactgttctctgtccatcatctccttcatggttcaccttcttcataatatcaacttacaggttgttttcatgtcatcacctcagtcacccttctgcaggtcaatcagactaatgcctccaagatgcccctgacatttctctgatttaagcctgtgaagatctgcacgtgggcctcaatttcaacacctcaactgcacagaacacaacccacctcttcttcttctggtttctgtaacttcatagactctgggtgtaggaggagcggtctctgagcccagtttctcaatgtctatctctgtcctttatcttctacctaacatctcattttagattcctttgtagtcagtcctgaactttctctatttcctcactaggcaatctcttcagcaactttaaaatctacctatatgatggtcactgtcaaatttatagggttgggcccttgtcccagaggaattccaagctcatgtgaaattgtctatttgatgcttcaacttggatgtccacctctccgactcaacatgtccaaactggaaaaattcatctctccttccagtcttcttcactccgtcgtggctctgttatctaccacactgctcggcctcgggcagaagccagaacctgcggcatcatccttatatccacctctttcatctaatcttttggcaaatccagtcatttctaacatcaaaatcacctgagaacctgcccctttgctccacctctgctgacgtctcactggtataaaccaccaacctccccgcttggaggattccttccatctcctctggtttcactttcacatctcaacgcactatttctactacagcatcccaaagtgggctttctactacaagttgcacaaaatacaatcatttttccaggctccaaagaaaccccgcatgacccaggccttggtgccttccccagtgtgggcttccagtctgcgcagcccttgcagctgtcaccacactggtcccatttcagttcctggaacacattggactctccctcagcagggtcttccagcctgtaaggagcttccttcctcctgctcttcacctaaccagctctgtcactcttcagctgtcagtttcaatgttccctccgttggggagattcccggaccacagagtctcagtaggccacatgcttactctccaccttgcaccttgttcactatctttgtagcacttaatataaatcgaagccatacatagctgtttattatctgtttctccaacttcgcaggaccacgtctgttttgtgttatgctgtcattggaagaatgcggtatcttccatgaatcagatacccagtgaggatttgtggaatgaaaaaggaaacggtgggagaaggaagtcaaaagatttcataatgagtgacagagtggagtaatagacattggagactacagatggcaggatgggagggagggaggattgaaaattacctattgggtgtaatattcactcttcggatggtgggttcactagaagcccagacttccccaccaggtaatataggcatagaagaaatctgtacttgtaggccaggtgtggtggctcatgcctataatcccagcactttggaaggccaagacaggtgaatcacctgaggtcaggagtttgagaccagcctggccaacatggtgaaaccgcatctctactaaaaatacgaaaattagccaggcgtggtggcatatgcccgtaatcccagctactcaggaggctgaggcaggagaatctcttgatcctggaaggtggaagttgcagtgaaccaagatgacaccactgcactccagcctgggtaaacagagtaagattccatctcaaaaaaaaaaaaaaaaaaaaaaaaattgaaaaaagaaatctgcacttgtacctcctaaatacatataaatttttaaaaatttaaaattcataatgatacactgcccatgtgctagcccagtttcccccctccattaggtaaaatgtaatttgtcttccgattatacctcaacgtttactctaaaagaaatatttgcttctcaacataaaattatgcctctgttattatctctaaccttgtaaatgccatgttgctgtatcttatcatcatttgcctttatttactcttttactgtcacttctagctgggggtgccacaaggattattctcatataattaatctaaactatgctttctggccactttctatgccatttttctggaaaagtagagcaatgaaaattcttcctgtatataatttgtgtatatttaggaggtacaagtgcagatttcttttttttttttcttttctttttgagatggagtctcactctgttgcccagactggagtgcggtggcatggtcctggttcactgcaacctccgcctcccgaattcaagagattctcctgcctcaacctcctgagtagctgggattacaggcttatgccaccaggcctggctaatttctaattcatcctctggtttgggtaattcagtaagaatcattattgaagaggaaagagttttggggagatggatgttcactgataaatgggaggatgcaagttctggcattattctgaagaattcgtgggctgtaacatttaacgttctgataaaaatcactgcacgtcaaagaggagtgtaaatactcaccatggtttctcggctattgatagctgatcctgtgcactttgctataactttatcaatacacttcttgtgaattgctgcattgcattctgaaaagaagaaaaaaatcacagcttaagattttcatagcctaaggaataactaaataaaaagaatgatggtaatgcaaccaaaaccctcttacttacgtcggcactggtagccctgtttgttcaggcccctgtaataaagcacacgctgatttatttcaatgttggcatcaacatcagcaccaacagcatttaagagatggatgagatctcataaccccctaagatcacagagcagtttctgatcagcagccctgttgtatcatttgccaagagtattaacagagtgtttttcatttgaagctgcgttttaaaaagtttgataattaaataaatgagaactggctgatttatcatccttgtattttccaaacatatagagattaaaatgcatgaatgaaaatgcatgcatcacagactcttcgtagcacgtttccctgtgctagatttaaaaattcatggcctcgctgagctcactacagacgaacaaagacatctgtaacattttatttcctctttctgagcatctgagaatatttgcaaccaacaaagtctcacatgcaggaccgattcctgagtgacatccatgattagagagaaaggaggttcaagtgattagacgaaagcaggctgatgaaaacccgccaagtcgatctggcatgtggataccctggttacacaggagctgtgctttaacagtttctgcagtagcctaaagggaagagtatcccttaataggctaggatgctgagagccagaaacaggagttatttcaagtctccactctgtcatagcctttgctatgtggttactgaggtttaaactgatctgtttgatggctattaagatacccaagagcctcataagcatttaaaccattagctacaatggcagagtgctgcctgctggaaaaagtagcaccagcagggttgggccattaggtgggggaagttttgactataaaactggaaaactgtttgtaataaagatacctttcacttctgtttcttcccacttacccccaatagcccccccattgaggcagaaactaaaatcccatgggcatttttcctgactagacctggcttcctcatgcacctcttttattggatcacaccatttgaaccttctcagttcaggcaaggtccctgacaacgctgaggtagcatttactccagcacaccccccacagtggagcatgccagcgtagaggattaagaagacgcaacaaaatgcataacccgaagcttggagggagatgccaagttactgtaccagacaaactcgtggcagacagagcaaaatgtgggctgtgggaagaaggtggcagtgaactcgtggcacttgacgtggtggacctttgcctgcttgatggcaccccggcgctgatgcaaagcaaagaagccttccgtctcaaattcattcatgtcctttgtgtctacaggaagagagaggggaagaaagtgaagttctgcaaaaggacgactcctattctaagctgggtcaggaggggagggagatgggcaagggatggaggaggaccagctctgagtacctgctgtaacattccaggtactcattatggtgggtaccacactaagcatctttcctcaaattctacaacacagattcatcatagggcatattgttagagggtgaaaacaatgttggattgctggctcaatccttcgctcctctttgactgggctgagcgatatatcctcttcaagtttcaaaaccagagattagaactttgaagggatctatcaacctctctttgtcaccatcaatgatgactcagtcagaaaaggcaggaagtggcaaaggctttcctgtctgtaattctagagaatcacatggttactgacagcctcttgggaacagcatttcagaggtgccaggatgctttatagcaggttgttggagacatgctggagtagactagggggagctgaccaggattttgtgtgaggagaaaggaactttgggacattgtgtcctggttcctgatgtccacagtgatcagacacaccagctgccaaccatatttaccaatgtgaaaaaggccagaaaattaatagctcactgcatttttttggtgtctaggtaatcctgtgcattacctagtcatcagcatcaaaccatcagattcaatctattcattttactctgggctcataaatattggtgaaagtgctttggatagtcactgtttacagtgccctatacctgaatgacatctttccaaagggttgaaaaactaagatagtcaaattatgagaatgctcaggatgcccttgctgaagcccaggtcctcatgaaacaccaaattgtaaggcagtcatggttaaacagcacagtggacacagcaggtgagagagaataacacaaggaacagtaaagaaataaaaatatccactgctgtaacaaaaatgatacacaaataaatatgtgaataaataaataaggataatgaatttaaatcccagagttataattttgtaatagcttgaagactcttggattacttcttctattttgttacaaatacaaaacattgaggtttcatttaaaaagcaggttcatcatatttcacaatgagttaataatattcaaactaaatttcttctattgtggctaagcagtggcagtagcctgacaatgcgtttggggcaaattatcttccaagataccttattgtccaatccctaacagtggctagattagaaacactctaggtagacaaaggaggagctgtgtgggtagaaacctcccccaggaatccagccacatcccaggacacattgtaggactgaagtcttttctgtagtgtccgcagatttgttttatggcaaccccaacttccagacaaaaagcatttccagtaaccctctaacagttccacagatgggacataatactttgcctaatactttaagagtaggtaattttggtctttttacctggaactaggctggaaataatagatttggcttggtaaatgaggggttaaattaaggatcactgagttaatcaccttcttccacaagttctggtctaaatgtccaaatctatttacaacttgtgactagtatagtaggtcatttgtttataacatgtgacttgtttctattttggtccagatgaaataaaataaaataaaaataagtataaatacacttttaaatgcagggaatgaaagtgaattattatggggaccctatacaggtttttactgtaaaaatcatatatgtttatatgtatattaaacatattttatacatatatctatacatatatgtttatatacatatatgtctacatatagtttatatttttataaactataaatatatagttatatacacaatttctacattagactatagtactataatttttttaaaatatcaggaatttctagaaatgaattaataccctgttattttctgtgattttcattattctctatttcaatcattacaaaagaataaatgtaaaaacatagaattctttaattttttttgtattgactatatttatttctctatttactggtttgaatgagctcattggtttttgcaattttttttcttttatactaatggattctaatctatttatgtggtctaacctatcacttgtttgtagtcaatcaaattacaagtttcctgagcagctgtgagtaaactgccttgctgagtgtgctgaagaaacacattattcctcacccttgcatggctaacagtcaagtcagggagacgtggcacaggcacagaacagccaaccttaagaggcaatatatgatggtgtggaataggctccgagatatgtgtacccatattttttaggaggtaggaaaagaaatggcaaaagagaccaagaagaggcagctgaaaaattaagaggaaaacctggacaatatcacatcaggcaagctgaaaagaaatgaagttttcagcattgtatgatagagagatatcaaggaaattgaaggctaagaagcaggaaccacttgtgagaactcataatcttggagacccagagtcttagggtctaagaatagaagtagaagggaagaaaaagaaactgataaatataaactactttttaaaggaatgtgttagggaaagaaaaaaaaactcaaggaggtaaaaaggtgaaaaaaaagaagagatgatgttcaagattggggaagatgcataatgcagtatgtcttgggaataaggaagaaactgcagagagaaggaagagttgaggatgtcagaggtaaagtttattgatagagcaggactgctgggatgagaggtgtgcaaccaagaaagggagcagctgtctctgaggcagaggagcaggaggagaaggcgggaggaagcaactgcatcctaaagtgtagagacaaacagaagacagggtctcggctgggcgtggtagcttacaactgtaatcccagcactttgggaggccgaggcaggcagatcacctgaagtcgggagtttgagaccagcctgaccaatatggtgaaaccccgtctctactaaaaaaaatacaaaattagctgggcatggtggaacatgcttgtaatcccagatactcaggaggctgaggcaggagaatcgcttgaactcgggaggcggaggttgcggcgagccaacatagcaccattgcactccagcctgggcgacatgagcgaaactctgtctcaagaaaaaaaaaatacataaaaaaattaaataaaaagaagatggggtctctaccacttatattggaggcaaggtcaacctcccagaatcagaggagattgaggcatccccagaaaccaaggaggatgggaatggtaggaatagccattgtgtgggaatcaaaaagaaatgaaggagatttctaagtgccaaggtgagtccagctgaacagttcagcaggcattcattgtgtacttcctgcatgcctcaccagaaacttggcaccacagttaaaggaattaatgagacgtgttttgacagtggctgttctgcaaggagttaagagtccagagggaaagaaaatcgatgtgtcagaacagaggtattcacaggatgctgtgggaccacggaaatgaggaaactataccagctaaggcaggtggaggtaggtgaaggagagaaagagggaagttggaaaagaaacgtcctggcagaaatgtttctgtgctgaattctggacaggtaactcctactaatgtgtgggagaaggtatggtggggaaaagccaaaggtgctctctctgggtggaagggaacaagcaaagctacagagctaaggttcctcagggtgtgggtgggggtccagcactagctgggcattgccagagtgcagagggtgaagcagaaacgatcagcagtcacttccagaagatgtgtaggtgtcagatcagtttgaacactttcctgcagacaatttgcagatgctggaacactgcagtaggggcagaggcttgatatggtcagatttgagcttggcatcgttacttctaggaccaccataggagaatggatgggatatggcaggaggtagtaatgatgtaattagatgatgaaatggaaaaaatattgactagacaacacgaacacaaatgattgactgatgcattcatgtggaagttgaaagaaaaggaggctataaaaattacttccaggttttgtggagtgagttattatataattaagtacgatagtaagttacaaaagaaataggttactcgtgaatgtggcaaatgtaattttggatacttagtttaatttgaccccttaaaatgtgtaagtacaggaaatctggtcagagaggtctgctaagaagccaaacatagagtctgaaccataggaatgtcatctaataccatctgtttgtaacacacttagctgtatgactttttctagcaaagccggggagaatgagaggggagaatgcaaggtttggagatcagactatccatggcaaaggggaactaatgagagcagagtgctgacaaaggcttatcatgggagccaggctaggtagagttaatgccagaaagtgggctaataaatagggtaaaagagaaactggactaaaggctagtacttattgtctgagaataagggcagaattgccaggggaggaagatgagctctgaaaaagcaagttctgagtgtgagtccctggaggtggagaattctgagtgatgatatgtgggttgaaggttggttactgaatggatagagaagcacaggaaggtgtgaaatagaaagttggcaggggggcatgagatgacattggggaattctgaagttacaagagtaataataggagaacagaggaagaagagaaaaaatgattcctgctcaaaaacccaacagaaggggatttcaaagagaaagaacaaagtagtctgttatggagagctgagccatttacttcctggtgaggtagaggaggtgaggcttccatggaagagaaacatgggagacatggtattatctcaagtgttatccaaatttgaattccttatcccccaatcattttcctcctctttccatatctcccacttctgtgactcctaccattttcccagtctagctattttaagagatattctcaacattttttcccttcattcaacttacatttttaaggattaattattattattattatttggagacagggtcttgttctgttgcccaggctagagtgcagtggcactatcttggctcactttatctttgaagtcatgggctcaagtgatcctcctgcctcagcctctcaagtaggtgggactacaggcatgtgccaccatacccaggtaatttttaaattttcttgtagagatggggtcactctacattgcccaggctggtctcaaactcctggattcaagtgatcctcctgccttggcccccaaagtgctgggattataggcattagccattgctcccagcctaatttttaaagaattataaagcatttcaactatgtacacttaacaggcattctgtagatatttcatctactctaccatgaaatctctctgcaacagtattttcttttagattgttccttttattttattcctgtagctacacccttagaacagatttttatcacctctccataacataagtgaaattttgtagaccaatactgtgtaattccttgagtaagagaaagtatattcttcccattagttcaaagcatgacccaagactatgcactcctcttgccctccaacatctgtctctgactcttcattctggtttcagcaggagcctgctggtctacctaggctgttctccccacagccctcacacaaggcatattcttgctcaagccttcactttttcctccttgtaaggccatccctcttctttagaaaactcaactcttgctaacctttaatgcccacactgtggaacttactgaaatgaaagcaacacacactgatctcttggttaatcagtatttgtgtggtttaggttataattttatctaattgtctaatctgtaccacctctgggtatatgttccctgaggagaagaacacgttttgcttttctgaatccttcagaagacgatttcttatactaataatgagctttcttaaaagaatgctctcctccttgtcatcaacaaggaattttctagttaggttattccataactttggtttttaaaattagatttttttgacacataaaaatttagagatggagtgtcaatttggatctagatataaaaagttttaaatattacaaagatttattctttttttttttttgagatggtgtctcactctgtctcccaggctggagtgcagtggtgcaatcttggctcactgcaagctccgcctcccgggttcatgccattctcctgcctcagcctcccgagtagctgggactacaggcacacactgccatacccggctaattttttgtatttttagtagagacggggttccaccatgttagccaggatggtctcggtctcctgacctcggatccacctgcctcggcctcccaaagtgctgggattacaggcgtgagccaccgtgcccggccaaagctttattcttaaaacatttcctaggcttatgtcattattgtttacggaatatcattgtttttgcccgattgaatttgctctctcattctaataaaatatttaagttccacaggaatagaaggaccatccatggaattgtttttcaaagcagggatcttaaaatcatttaccaaaaatacttgcattctgatgaaggacactttttctcctttctttctttctttccttccttcctttcttccttccttctttctttcttttgaaggaccctttttctccttccttccttccttccctccctccctcctccttccttccttccttttctttctttctttttctttcttttcttctttctttctttctccttcccttccccttccttccttccttcctctctctcaccctctctctctctcccttccttccttccttccctcccttccttcctttcctttcctttctttcctttctttctttcactgtatcatccacactgcagtgcactggtgaaatcactgctcactgcaacctcaataacctgggcttaagcgatcctcccacctcagcctcacaagtagctgggactacaggcacgcaccaccaactctggctaatttttgtatttttggtagagaatgggttttgccatgttgcctagcctggtctggaactcctgagctcaagtgatctgcccacctcggcctcccaaagtactggaattacaggcatgagccaccatgcccagacaagaccctttttcaatttacattgggtcatgatttaaactaatgggaggaatgtatttctcttattcaaggaattaaacatcattgatactattatttaggtcagcactttcacattttatgcaaatctggttattcggatatcctgcaatcactctatttcagccaactcaaaagttgtactatgtgtactgtatatctacaccttccaagaggaaaaataaataaaatttcagagtacatttttcccatctcagtaattctttctttcttttaaaaaaattttattatggaaaatttcaaatatacctaaaagttgagcaaatactataatcaattttcatatatcaatcattcagtttcagcaattattaactgatggccactctctttcaatacaccctgtccatcctacaccccataccattggattattttgaagcaaaactatggtatcatattattttatctaaaatatttcagctattcactggtttttcttcagatcgaataaatctttcgccttttactaaaatatttcagcatatatatgtaaaagatcagtgtgccttttaaagaaacataaccgcaatattattatcacacctaaaagatgaattcaccatgcctcaatatcatcaaatatctagtgagtgttcaagttttctatgattatttcataatattgttttctctgatgtatttgtttgaatttagacacggaggaattatatatggtaagccgaaactcagaaagcaccataaatgtataaagttaaacttgcttcttcttggtagtaaaattaatttaggaaaaaatgaagtgaatttaccatcagtaagtttacatgtccatgctgtgacttaggattttctaagtagggggatttgattcacatacacagccctgacagcctgtctcagcacatcgtaccgggaaatttcacttctgtggccaaagtccacatgtaacatggaatcaaaaccctttagcaatgtgttttctcaccttttcttgttcctaaaaggacttgaggtgactaacttcaagtgttagcattttgttactaattttatggaatatattgattgacttcttacttattttgtattctactgataatatggtagcttcttagagcacatcatttaaccatagacaatgtgtacacacataaccacacatcaacagtcttttgtatttagactgaattcccaaactaaactaaagacagagtataagagctttgggcatatggattcacatcacttaaaacaagtgctataaatgttttatatttctacgtttttccggcccagatagtgtcttttaaagtcatgcctgagcacctctgagaattttaaaacaattttgtgcctctcttttctcctgattctcttctacaataattgcaaaggtaaaataagctgcatttgaggagaaggccatgccctcctcacccccaaacaggaagaagaaatgtcacttgccactcatttccagaaagtatcttgcattcattagcattcggccttgaggtttcagctctaactggttgggagaaggagagaaacatcagtcagaatgtgaaacaagccctgagttcaatgacatcactggctactgacgatggcaggagatttccaccacagaatacaatcattgttactctccactgtactcaaactcattgtcatcagacgactgtagcaaccgtgacaatcgcctttcttttcttaaaacatcccagcaattcattaattttatttggagagaaaaacttacataaggaagaaataaaatcctaaaacagattctatttggttttcttgccctgtaatgctgcgtatctgaaggactgtcacagggcagacccagatcttcatcatgacaaaagaatcacaggcactgggactggcttccttggggaaaaagctcttcttttggagggaaagataaatcctgcctctttgaggccgcctccaggcccctgtcttcttttctacctgggatgcatgtctaggttaatcagggcattcaatggggatggcttttctctttcacaaagagagattgtatttttaggaaagtcttggatggtccactaaagaaaattctaattacactgatctgggaaggaatttataaatgtatataaatacatacttcagtactgtattattatgtagaagagggcggaacaaagtgtcattttaagggatgatgtaggatctcccataaagtgacataaggagaagaaaggacaaatccaagttcaagacaagctgagcgctgttgttaatctattaaaccatcccactatgccattaacagaccaaaaagaataagaaagaagatgacttgaaggtcattattggtcattatgtccatgggttatccacgtgagccggagtaactaagaaatagcaagtaatgtcctgtggaactcaggattgaatctgaatcgtggctaaataattttctggttatgtgaccttgtgcaagtcactaagtcttgggaaatctctgaaaaacagacataatagcaatgcctatgtcacagcattactgccatgagaattttatgataaaataagcttgcattgctgcaacaactataaattttcatatgagtttcaacagattaatgaaaagaaaagtgcttttgacatggcatgtatgcaccattgttctctggcttgtgaataaggagtaaagatggaggcaaaaatggagatggaagagctatggtaaggggcctgcttccaaatggaataatgaaaattggcaccaggtgaccacaaggttggcagtattcagtacttagtagtgatggaagaaattaaaccaattagctactggaaaaacagcacccatagaaagccacattccagcacattttggggagtgaatgggagacaaccatgaaaacagtcacaaccttgggaaaacaaaaggtgtctctcaatacggcgttgagaaacatgaaaggcaaatttgagagaatcattttctttagagaaattagtgttggaaaagcagattccaatagaagcaagggaaaatataagtcccaacaacctgttggctcttaaaataaaagtaaattaagaaataaccttggcaaaaaaataaaaaagaaaacaaaaaaacccaccaaagcttaaaagtgcaaaaaatgtgctagttggttaaatgagcatctgaatgccaccatgtgcttatgtctaaataatcctagaatgcaaagaaaagtctgttaaggatgaaatcagcaaaatcctaggcaagaaatcatatgcaacttgaagagatacaaatagaacagcaacctgcctatcagtgaagactacttaacaaaaagatactcaccctccgacttatcctttcattaattgagaaggaaacatgaatagaatcgtatttttaaaattggggaattgacgactctttaaaaaaaaaattaggtagaccaaataaactggtcttcctcagtttctcccattcctgcttctacctaataaaataattaggctcactgcaacctccgcttcccaggttcaagtgattctcctgcctcagcctcccaagtagctgggattacaggcacctgccaccacgcctggctaatttttgtatttttagtagagacagggtatcgccatgttggccaggctggtcttgaactcctgacctcaggtgaactgctcaccttggcctcccaaagtgctgggattacaggcatgagccaccacacccggccccaggaacccttttcccaagccaacacacaagtgctgagtagatactgcccaactaaattacctggacatatctaagcatgggcctgagcaccttttaaaaaaaatcttggcatatatttgtctctaaagattactttagtgatacgagcaaagatttttatactttcttaaaaagcatccatttttttaggtcaaaaatacaaaactgacacaaaaacctagtttttaggcttgtatcattcccatttgaaacctgtgacttgaaaatcttctgggaggatttcttaaaatctgagttcttgaaaatcttttgggtggatttcttaaaatctgagtttaaaatcttttgggtggatgtttaaaaatctgagttatagaaagtaagaagcagaaagtcaggattctctcctttggcacagatgatataaacatttgaaaacattttctggatttcagatcatgtaaaagcagtttcttactgatatattttcttttattttgtgccccagaaattttcattggaatttttttaacgctttgattattttactcctccttttaacatttctaaatatttactaccataatccaggtttttgacaacttggtgtgctaagatgaattgtgtatgatgcacttcttagtcaaagtaagctaagttcattacagctgaaaaaaattgtaggaattgtcaaagtatagagagagaagaccaaacattaaatggatctttgttctatcctctcgcattctgatagctttttacttactttaaaagtgtattgatgaagtttaataaaattaagattttgatatcttaacgtgttctgagtctactgggttaaacaagtaatttctaagttaaaaagcattagagttgttgtttcataaatcttgattaagttttatatacaaatattcttcccaaaactgaaaaagtgaatgaaactgacaactggattgatagacaaaaactcatcccccacttaaggggaatttgagatattccaagcctgctttaacagttttaaataatttatcatagtctaagagactttctacatctctttgatgtaggcatcaaagagatctgaagatgtcaatgtgttctacagcccataaagaataaccatcgccattatcaaatcaccagtaggaagtggtagggagcctggtgacccgaggccagtgtaatcacaccctcagattgacatgggagttctgagccagtcatcggctaccatcatgcttatcccttatgtgcatacactttatgcaacgttacccatatttctgtcttcccgttgttcttcctgcacctctcagccagcgagtagagctccacggtggtttcagagatgaggtccacgtttttgcctttcacaatgatctgcatgactcttcccttgttgatatgggcatcaaaagtgctgtcccagggtgggtacatggtaggctttttctggatatacatctgcccgttctctaggaacagaaacgtaaggtctcattattccttcagccaggcctggaaaataattcagttcaactcaacagtagcacctgctccctctgttctctgggatatagaattctgttgggaagacaaaagtagcacataaacaatcagagacaatatgggacagaatgagacagtccccgggtccagatgcaaggtgatgcattgaaccttataagtccagcgttgataattcagacaacaatctgctaatgccttggactggaaattgttaccaaaacaccaggcattctaagttctgctgctcaccgcacagaaagccaatgactgagatgacgagaattgccaaggaagaaggctttagttgggtgctgcagccgaggagatgagagctcagtctgaagtccatctccatgaccaactaaaactagggatttatatagcagggaagaaatgtaactttgtatgagaaaacaggaacttgggaggggtaagtaagcaatcatgatgaaccaggggcctggcgcttcagtctctggatgccatgatctggtgagtttcagttctttaatattttttttgagaggtgtggggatcctttcttgaggaagaaactcagataaaacaaatgtaaattccaagctttaagatcagaagggtccatttctataatcagccaaaaacaactgtctatgggactattgggttggtttcaaaatgttattttcctattcaacagttagttgcttcactctgggtttaaacacctgagcaacaaactttttaaaaaatcttttatgcctttgagattctcctttattaatctgtagtgttgatcctatgactgattaacctcactggccccagcttaaacatagtcaatacaaaactactgtgtgttcatctgaaagacatagtggcgtaatttcagcgcataatgaatgctcctttaagaaatatttacatttttttccatttgacataaatacagtaagagacaatgatctttaaaacataatgagccattatttccttctctaattcttgggtgaagatacattttacatgtaccatgcaccctcagcaaaagctgatgagcaagtcagagaggtggtgctgatctttacccatggagccagcaaggctgaagccgactgccagcctgcaagtgagtaaaggcaggtaggcaggagccctggaaatagtaacaaatctgtagacaggaaggtcagtctaggggaaacctccctaaagccgctctgtgattggcaaagagtttactaattaagaagttttttcttgtctttcacgcacattggattttctctggtatttattctttaatcatttcagaagcagaaacctgcatttgagtgtttgtttcttgtgacataagcacattaagtggcagatttagcaattcagagatgtcgattaagcaaaaggggaaaaatctgcttaaagccaggaaataaagcccttctaactttcgagggccccttctgtccaacacacaaagctaaacagagcagacatttagcatttgttaaattaatatttatttcgggggtatacaaggagttgaataagcttgaaactcaaatgttagataaacttggctaggaaagacataaaccatgagactactaaacgtggaatagaaaggggacattttttgtgggttggtaaaaaaaaaattggactggagattgggctttttagaaaccaacggcaatattaatgatcacggtaacattttacttccacagacctgaagcttccctttccgatacttccttttgatggtaaccattctctgtgcctggagaaaagggccaaaaataccctgagaaggggcaaaagtccccaaagcaaggcactttttacattttcattcgccacgtttgtaatcacctaaacagagggccctatctatgtagagtgttaccgttttaacgactcacaaccccgcagccccgtagcctgtttgtccttgttctgttggctcattgtggaaaatgcagccttacaccccaagaactgaaatgtgtttaaatcctgtagaagtaaatattgaatgataatattcagagtgatttcttttcagaacaagcccaaaataaaatcaaaagcaaaaatctctaaactccctccaactccacaggctaatatttaggaaaaccagtttccttcttttctgacaaggactctcgatccacatggctcattagaccaagttcaaaggcaaggccaaatgcaaaaaaaaaaaaaaaaaaaagccctcaggaagcaaatgtcagggagacctgagatggtaaagagaactggatccaggagacccattaagtcaaaggcggctttgaaaaactcagacgttttacacttcaaagatgtctgtgacatctgaaaggttttaggttgggagcaagtggcattcacacttttaactaaacaggagagaactctgggcagaaaggaaatcaagatgattcagacagtctctctggctttgatgtgttcagagtggctggaaggacaaagtcagctgtgaagcaaaaaggcttttggtgggggatgcaaaatagtaggtttgggaaccccagaatctgaactctgagcatctggcaggaggttctcaaagtctgagtcagtttcttcttgtatctgcaaatgtccctcgctcacaggcctttgcaggacaaccctatataaaataacacacatccctgcccccagtccctctcttctttacactgctttttgttccttcattacctgctgtttgtatttttgtttattgccactttcttctgcaagaatagatgctctaaagggaaggcagtcttcctgagttccttcagcttacttgtttgactttttttccctctatgctctggtcccagcactcttgcagtggtctctccgtaaacacttttgtgtaagtgaactgtgatggcttccatagttactgcaagcctgcatccatcatcattatcattccctacaaagtgtctgctaaaatcaaaatgcacgtagggaaacaagaaaaggtgtgcagtcaggagagttgtgggatctaaactccctcctacttttcctttggaaatccgtggcaaacttccaatgcagaggtgaagatcttggagagtggaagccggccgacgtgaccacagagacattccctacacataagactgttggaatggaacattctgaacccacaaacaggacgttgggtggctgtcccactttccccctcaccttgagctgcctgtatttgaacttgatgaaacatcactattctttcattcagccaagaccttagtgagtgcaaaagtacgttttctgaaatttggattctaatggctaattatagatgctttgtaatatccactgaagattcgccaaagcagcagtaagcagtctttagagttggttggaagattatgcagtcttaatctacctagacttatttaaagtaaccaggcttaaccacatagggctatgttctacttcagctcattagagttccttcccattaactccttatgtaatttcctcaacccagctttctctttccctttgtatatgtgggaaaaatgatacagtgcaatagagcaccggtgggccatcgggtcctggtttagagtccatcacgaaatgtgtgtccatgaggaagtccttggctttgctgggcatcagcgtcctaaatggcaggatttggttccaccagatgatgtcaaatgtcctggaagaccttgcttcatacacagttcatagcaggattctcctcctcctcccccgctttgaaaatcccctcaagcttacctgattcgacatactctttgacgagcacagcacagtaagggttaacagcctcgccctgacaagactggcaggacccgcagtcaaagttggacaagccaatccgaagaaatggcgacatggttgcgccctggaaaaagacaaaagacaaacgctgtttgggggctataaaagatattatttttggtgccccatgtctacttaaccagtgctttatcatggacagccagaacctcacataggtccactatccatgtgaacaaatgttttcacttccccttctgcagaggacactgctggactcacccaaaaccacacactgacttgctgaggggagaggctttctggaagtctgcactcaaccttgcttttgagaagtaactcaagagttagttccattcaacctaatggagttaggcccaatggttggagagtgaggcaaaagttttccaatattttatgtcttctgttattcaagtaggtgcccaggaaacagcacacagtaatcagaaaatgagtttatatagagcgagtctattttagtcacactagttaaatatgacaccgcaaaattcttacatggtctatttatgtgtgtaatgggattggcccaaggcattcggcagctgatccttatttactctggacattttcaaaaaggtctgctttcttcacagttacacacacacacactctaagcctttgaacatcacaaaccacgtagaaaactccaaactaattgactactataaaatagggctttctcatataaggatgaacaaaatacttcataaaagcccaaaaatcagtaattatgctttccaagaggtttagatgatagttatcaaagtgttagctacaaatccaggaatctagtctaattcttcatctattgttccattattgagtgttctggccacttatgtgaactagatacctcttcttttttacctacttttccgaggtcccattaatctgaaactatcatctgatattcagcaaaaaagttacttccttgctccgtctctctttttgatgatttatacttataattttttctaagctttcataagtaagccaaagataagaaacaaagcattgattgtcttttctgcctttgtataaagaaagaaaactatttgaaataataaagacctggaaggagaatcagtaacatacctggagatcttgggcctgtaatacctcatctagctaagacaaaagggatctccagtatgctaaataccagtgttctttgactccacaagagagacaaattaggagcttttgacgggcattaatttcacagatattaatgaagtcctaatttcctgcagagtttggaagttttatctaaaggagatggttgggtaaacatcatgatttgctgggttccgtatctgtcacgttgctgaattagcaggtagatgacttacaaatttgtctttaggaggcgccctttgccctgtgagtttagaattcccaggcaggagcggggctaacagctgtgagttctctggagagagtttctttgagaatcccttctttcctgggccaattgggtcttttagacaaaacttcatttctccacaaatcaggaaaaatcactaagaatcatcttcagttacgggagtttttgccctgttgggactttctgaagatttccttaattctgtttgagtctagagggatcactaactcacaaagccagagttaaagcaccctgaccttttctggtgtcaccctgctattcccagggtgggtttctaatcaggcaacagtagcccagcaggcgtctgggaaatgctgccccaggaagagaagatggaaacctccagggtgaccagggcttccattacagcaaggaagagagttggggcaaaaccctctgtccccctgaaggtcttcctagacaatgatttcttacttaataagcaatgcagattaaacggccgtttcaccagattcacttgcactattctgtaaaggtctgctcacagacctttagaaatgtatgtcagacatgacctgacatacacctgacatctagaagacagaataggtatttgtgtggtaatcttcacacatcattcaatagaaccgcaagctcaggtgtgagtttttcaggcagatggcagcgttttacacccgaactacacagagtgcttttctctgtgtagttcagagcactttttaggtgatcatgatgaaaaataaagaagacacacaaagttagtaaaaagtctctccagatttccaccaataaaagaaatcagttactattctgatctattttccctagtctttttaaattagcaagttttgtgtttttttttttcttacatgctatgatcatcctgtgggtatggaattatatttggctttttaagttaacattttactataaaatttttttcaagtttctctgacattttctcaggcttccttgtcattcttgcatgacatcctattgacagtagctctacgatctgcgttactaaagtctgtagctacatatttagtctgtttccaacttctacatgccagaaaaaaatgcatctttaagatagcatcttttttttttttttttttttttttttttttttttacaacctttcccagatttagggatactgcatcagactggatcaccagagtattacaatattatttatcaagtgttattcctattggtaaggtcttatacatttaaagaaaataaccaaacttaacagtaaagacctacccagggaaatagctatggttagtgtaacagaagtaagtaaacgccattcttacataatatgggtatacaaatttgtaagaaaggcactgtttatgacccaagaaaataaattgcaaaggcacaagctatacaggatacaaaaatcatagttccaactaattgtggaaaaatgtttagccaggtgagcaatttaagacatgcagaataagatactatgtaattgcatgtaccattcctgaaaagacaaaactatatgaagaaaaacatcagtggttgccaggagttgcagcagggaggagcagcatgagcaaattttggggaaagacagaactgttctccggcttgattgttctagtggtcacagaagtctagacttaaattcacagaactacaccaagccaaaagtcaattttactgtatgataattcaaaaaccaaaagaaaagaaatatatgcaattggtattttaaggcatgtgttataaatacagagattatagaggtaaagtaaaaagaatatatatgaaaaagctgcatattaaattaaaatcttaaagtaatcaaattactaaagggaaatgatcagatcttttaaaaaattaaaatagctttggttctgtggtatttaagctcttttgaacatttgcagttaggcaaacacagctgagaataaaataacattagaaattaataatgcattttatttgaggaaaaattaacattttaagtcctaatttaagctgtaaaaagaattataatatttaaaatatataataaaatagtctgggcatggtggctcacgcctgtaatcccagcactttgggaagccaaggcgaggagatcacttgaggtcaggagttccagaccatcctggccaacatggtgaaaccccctctctacaaaaatacagcaattagccaggcatggtggggggcacctgtaatcccagcgactctggaggctgaggcaggggaatcgctttgctccctgcagaggttgcagagagccaagatcatgtcattgcactccagcctaggcaacagagcaagactctgtcttaaaaaaagaaaagaaaagaaaagaaaaatatataataaaaacaataatatgtttttgcccatgcaattatcaaatatttttgaaatgctattacttaatgttggtaaggacaaaatgaatcatacactttcatacaatgctgctgggtatgtaaattaccacatttaacagatatacacacctgtgtatatgtaagtatatatgtgtgtgtttatgtatgtatatgtgtggatgtaaaaatatgcgtatctatccatctatattaagagccaagaagatgtgtaatgaatacacaagaaagaaattaacataaaagattttcatgggttgccttttggtgttcggagcagatagtagggggaaggggatttccctgggtgtttaaccagaaatgagagtttctgtagacaaaaatatgtgctggaatagcctgcctcaggactaagctgtgtgatctgtcctctgtgcactctaaatttcagtcggtctcatcttcactctccattcacgtgtgatctgagagaccaagacagttgccccttcatcagctaagatggattctaaggttaaagaaacaaaagttacccaggggtcgaggattcagggcttggctggcatcacaacctcctaaattcctacagctacaggaaaagccacacccttgttagtctccctaataacaagaataatcaggcgaagtttgagactcttcctaactctgatttacaacccagacccctgcaactctgattggacagggaaccaggcttccaggcattctttcccgataagcaaatgcagaccccaagccagtttcagcagcttacaggtgctgcacactaaatgtcattgtgtcctatcatttgccttttgatgtaaagagccaaatttaggatctaattttaatgctacaactgtgccccaaagtgaacatgggatgtatgttggacatatgtttacccctggcacctgcacttaactcccctcataaatatgtatagatttttccccaaagctttctgaatatatctgactctattgtgtaatatggaacctgggaggcataaaaccagcctgcactttccctctttgaagagagagcaccttccatacacgccaaagactgtctcttcccggtgtgcaaactgatattgccaataaagttcttttctactgttcagccatcctggtggtctattgtgtaacacatggtagtctcatactttatgacaacaatctatgcacaagaagactgactggccaggctgttccgaacaaggcaggggctaggtccccccatagaccccttgtctgagcaataaagtcacgcattcgactctctcctggaaatctccaaggggaccccaaactcaccaggtcccatacagaactccctgccttccctttcaaacttgccttttccttcattttgccagctcggtgctgggtgccgcgacgcccggccctcacccgctgcttcaactttacccttccccttgtgcctcacgacccacttgcttcatctcctgctccaccgattctgcaccacctctcttgtgactcacagcagcttcttaccctgcctcctctgtccagccttggtcacctctcagtctccatccaatctccatgctccagcctgaatgatcttaggatcttgcaaaactgctgctgtttctccaatgtgccatgtgtttcacagcttcagccttctaggaaagctgcaacctctccctggaacgcctccctgtttcactccatcctccctgcccccttcctcatctttcaagttcctgttcagtctctagctcctcttggaagccttccttcccctcctctagagccctcccatcaacacatctccatgggaagttctcagccctggctcctgcagttctctgagtgcactgctagacagcacctgtcatattgatttgcgtcacacctgccatttctacagtccgagtggggttgatcctgtggctcccagctctcagccctctaatgtggggacttatagagccccaccaggatgtcgcctacttgattcttgagatgctacatacactcagaagaggggtttgactccaactacacaattctctctggtctcatctgcaatacattcagcaaaaactcctcagaacgagtgcatttgggtgccttacttccctcatccccagtgaagataaacaatttccctttgtgatcacattcctttggagatgtggtcagcttgtgggataggggaagagacagagtgccagcgcccatgctgctgtatttccctacaatgtgcagttggatttatgggttcacgtctgtcttcctcaacaattccgagagaaggggccatgacttcatcatctatgtgcctccagagctgatccccctgtctgatatatgctagagactctgcatttttgcttagggagttcattttcaaaagcaacattttaccaaatctcttcatctcatgcatttgttttacttgcaagagaatacaatggtcaaattaagtgacagacaattacagagggagtcaagagcaaaggattcagcccagcacttgttgtaaacaaaagatcgatgccctcatacactgaactgctggagttatttaaactctctaagcctgctttctcatttggaaatcactgataatactattactcatcccaaagagccatgaggattaaatgggcaaatacacacaaggtgcttagaatggggctggctcaaagtaaatgctcaataaatgttagttattattattacaactctgatatattttctaatgggccttctcaacttcattggtgtgtaccaaaaagagcaggaggaaagtagaaatagtctttcaggagcatatctgggttaaattatgtgaccttcctctgcactctgctacggagctcccacaaaaccctccatctatctcttgcagagcacttactaccctctgatgtcctcatctggatgcagtcattatcatgatggatatcaggtatgtccatccaatcttccaagcttttgctaccccagctgcaaaacaccatcatgatatgtactatgttatgttatgtgatgttatgttatgttatgttatttatttatttatttatttatttatttatttttttgagacggagtctcgccctgttgcccaggctggagtgcaatggcacgatcttggctcactgcaacctttgcctcctgggttcaagcgattcttctgcctcaacctcccgagtagcgggattacaggtgcgtgccaccacgcccggctaagttttgtatttttagtagagactgggtttcaccatgctggctaggctggtcttgaactcctgacctcaggtgatccatccgccttggcctcccaaagtgccgggattacaagagtgagccatcgcgcccggcccctatgtactttaaaattacaaaggatctttactcttagaggctcactattttcagctttaagtgtgatctcatttgtcttttgtgtgtagcttcgatgcaggtacatgatcaagtataattgctcagtgctttaggtcacacgctattatgtactgaactgagaattctggtcttttgattctctggacactgactcacctatttagctaggctgattcaccctccacaattcaaactcccagaatgcgtttatagagatgctgaggatgtccacataactgaacctgatggggacaaattccatataaatagaaagcaatagaagtataatatactctcatcaattgaaaaaaatatcaagcattctcttcctcagtagcaaatgaaataagaaatagcaaacttcttcatttaataaaatgtttggacagcatttgtattactataatttagtgggagatggctcagtgttgggggagagtctcacagaattaaaataacaatagtcatcacttgtatcaaaacctctcacatgtggaagaaagaacacagattaatcaatagtaaatctgggaatgagaaacaaagcattcaatggtttccaattacatctgctcagccaaatttggtaaacatcaattcagaaaaattttggcaaattaagctacaccaatagcttttgcatttctttatgagatagaaagatttcttaggtaaaagtgactgctgttaaaagaaacataaaaaaaaactttttcacaatgtgcacagaagaaagatgataactagtaaaaaaaaaatcacatagttgggtagcgttttgctttgttgctaagacttctactaagtagtataataaagagattaaatattagctttcaccaacaaaaatgatctcaaaagtgaattaaaatagtaagtatgggccaggtgcagtagcttatgcctgtaatcccagcactttgggaggttgaggtgggaggatcacttgagcctaggagtttgagaccagcctcaggaacaatgcaagaccctgtctctattttttctttttttaattagctgggcatggtggcacacacctatagttccggctactcgggaggccaaagtggaaggatcacttgagcccaggatgtcgaggctgcagtgagctgtgattgcaccactgtactccagcctgggcgacaaagcaagacccttttcaaaataatgataataataataaagtataaattgaagataatattttaaaataacccctacaatacagtgacaaaggaaaccgaaggctaacagtcaaccctcagtcagaactagagatgaaggaggcttcgtggacagaccaagtgttgccctcctgcctgccaacattaacaacactctgcactttcccccaaaaaaccaacaatagtgttgaagttaaaccttgaaatatagaaaataaaacacctgggatgacattattaatcttctgacacaaattttaataggttacatgaatagatagtcccactaaggcatagccctggtcaagttacactgttacttaagaaagctgtcccagtgtttgttgagttaaagcctaattcttaacctgttatttaaaagcctccgtgtattgagttcaagttgcccccttcacacagcacgactctcagtggagtcccagcttcttaacctgttattaaaaagcctccgtttattgggttcaagttgcctccttcacacagcacgactctcagcggagtcccagcctgcctggacttctctcgatttgctgaaggttccctgaatatctgtctctatggctctgttcacgccattccttctgtttctgagctctgccatctccacccaagcacaattaccatctttcaaaatctttctcatgcttcatgaggtccttaaaaaatcctatgagaaagagtgggtgttactagttactcacctaataatattaaaaatagtcatcacattaattattgtaatgaactctcatagacactttgacttatgttatctccataaacccttccagtagctgtcaggtggacaggacaactatggtagttatctccatcttattaatttatagattttatggctggggctcagcaagtttaggtgacttgcctatggttacaaagtgcttggagggcctgaattcaaactcaggcctcagatttcagtccctttccacagcatcctaccacctgccacatctaccgtcttcagccgtattccaagcgcatgtctgccatgctttcttcttacctacttttcactttcatttttctccttccagaatctatagaattaatagctcagatggggacaggtacgggtagactttctcctagatgagaaaggtcccctcttacaggacagagctctcaccaaagcgacatacaaataaaataacttctgatgttgaatatgaacttttctccttcagctcagggtgctgccaccagtactgatgtgaagaagggagaaaagtgggtgaggagggaggagggaggagggtagtgggccaaggtctgtgagtctcaccaagtctggatcctcgggccccagctggcccacctccctctgtgcttccagtctctgtgaggtgcctcctggctgcagcgggcaggctctcactgatgtaggacacagccttgccatccaccacggagttcagccagtcatagaaatactgtttaaaaaggggttaggctttccatcagcttttagcccacattacagctgaactaccaggcatgtgctaggtgactgttgcccaccgtggaaatctgtcatgcataacaggattcctacattttcagagtcccaacaactaatgactttaaaattattgaagtcacttttgaaatgactatggatttattttaagttctttttttttttttttgagggtaagagtaggggaaggtcaattgtggtaaaaacgataattatattaaaactcatcaaatatcctattaatttggtgtgaaagtaatttgcagtttttgccattaaaagtaatggaaatttaaaaaaaggctgggcatggtggctcatgcctgtaatcccagaattttgggaggccaagacaggcggatcacctgaggtcaggagttcaagaccagcctgatcaacatggctaaaccctgcctctactaaaaatactttttaaaaaaactttgccattaaaagtattggcaaaaaccacaattacttttgcaccaacctaataatcccacctcgccgtactttctgttgccttagtgctctctgtggggtcattacgctttcagttgttcaggcaactgccttacaactaattctgatttctgaacaaatccttagcaggtatcttgatcatcgaagatgtcaaaaggaaaaatggaaatagtatatacctggatgtcccagacactcttactctaagtccacgagcaggagaaaagaaaggctcacttgcctctttcctccttgatctccacacagagggtcattcccaggttggtttctttgagggggatctgctggaggccatgaagtatcattttggagaaactcttctcccagggttccataaatcaaaatgctggcatgggggtggggtcaggcttggttcctttcctgctctcaactcctcctttctagacctcagctctcccacaagcagctgccctggggaagaatccttgaaaatgttgtaatcacccacaatctgctggtattattttgggaactgaatgagataaggtatgaggaaactccataaactcctacgtgcattgcacagattaaacgagttaatatgtataaaacagaacaatgcccagcacatagtaagccttctatatgtgtttattttcattatttgaaatgctaaacaatgttccacaattggaaaaatggctgtccaaatcatagatattctttcttcttcttcctcaggatccttggtatttatgacctaatgttctatgattacagtatccacgatttctgatttagtgactatgcatccattcactcattcattcattcaacaaacagttactagagctactaggcactaagtgtcttaggacactgcagtcagccaaagagacaaaacccatcctttgtgcagaggtccagatgcacgagacagacaagaaagcagaagaatataatatgaaatacaccaggtgactcccatgaaacaaactaagcagaggagggaggtggggagtgctgggtggggcggcagggagggctttgctggtcctgaagggtctctgtgaaatgacgttgagtaaagacctgcacgaggagaggactgagtcacacagacaatggcaggtgaacgttcccggccgaaacatgggtgtgaggtcggagctgccaagcacgttctgggaaggcggatgggctgcgtggagttgagcaaggggtagagaagacagacgaggtgggtgtgcccatggggctgtccacaggccatggtgagaacttggagttcaggtaggacaccgcccgaggggtctacgtgctgtcttcagctttgagtgcagagcagacttatttacacctagaaagggggtaccctggtccctgtgttgagaggactgtaaggagcaagtgcagaagaagagagactactgggggcgacttcactcttccagttgatggtcggagggcaccagcagaaggaccctggcagcgtgcagggattccgatatctcttgatgggatgtaccaagccactgaagatgaggggagggaaaaggaggagcagggcggcctcaaggtttggggccccaacccatggtaggaggccatccccattcacaagatgggagcactgcgggaagaactagatggcatgagaagatgagacattttattttggacacgttaactttgagatatggagaatacagttgatagcttttctgaatcaagaattaagacacatgaactaaggatgtaaaagttgtattttcagcagccaggtactgaaacttcttgggcaagtgggtacttattgggaatcatgggactagatatttgaggtctatgtcatataatttccatatctagaaaacagcagtcagtaaaagatataaaaactgtaatgatgatgatgttggttatgaggacaacagcacccatcacttaccgagcagttgctaatcatggtcattatgagaaggctcatattttccctccctgtgttttcaaacagagaggcttgcatccctctaacctatcctcactcctcatccctgtaccccaggaagaagagtgattgatctgatggatacgtttgtaaaagaaaataaaatctcaggccccccaaaccagttatgccaaggggagaggtaagcctggaagccaagtcctgccaccgtgccattctttttccccaggagacagcggtcacttcacaaccctgtgtcacagcattctacgtaagccaggctcccacaatgacaaaaggccccgagcttctcccagatggccaccgtcacacactgcttacgaggaaattcctttctggcccctaaatccttcaggatccacattcccctacaaaacaagcctatgccgattgcaaccctaggactgcaacctaagcttaacttctaaaactgagttctgttttaggaactcaactgacaatgttgatttcaagctcatcttcccaggtacagaagaagggccagctgagatcagtcactcttctcctgactctgaggcaggtgcataatggatttgttcctctgctccctgttctcacacatttaccttatcttatgtaagacatggatttggtaagcgctaattagagcctcactgcctccctcctccctcttccctcctgcttgccccctctccttaagcactgagttcctaaaaccctctttggaaagcacaggtcacaggtgcttctggggctggtgtttttcccgggtgtgtcctcaaactttagctcaataaacctcaactgatagagaaacttgcctcagtcactcattttttggttaacatgttctacatgaataaaccgttcccacccatctccaccctcctcttctcatgttgcaggatctgctgatctgcagaaccatttctgcactatccttggccatgtcataggctggggtggggtgggggcgcatcctcctcggttggcaggggtgagagggtccctgacacagtccagcatcgcctgggacgctgtgaacagacgaccaacttatttgcctgaacgttttagccatctccatcgatctggcctttgttataactggtggacatgcttctccatctccctgtctcctgatctgcctctccgtttgttctaagcacaagcatagccaagagggcttatgtgttggatctcccacaacccacaaaactgtgcaaaggactcacagtgagtaagcaacagcacctgaacccagctttggtggctaagtgtctccacccaaactaatacgttatttcttgttagcaaatgtctttgaaggttaggtcagggaggacatgaatgcatagagttttcgctgtagactgtttctgtctgctcccacctgtccctacttgcaaaggacatgttatgactgtagggacaggctttcctggcaacttgcttaattatcttaagcactattaggatgtttctccttgtacctggggcttaatgatctttctttctactccatggctgtggtttgaagaatgaagaattgggtgatataaacagagatggagtttctcggaataccctaagttctcttctggatgtcagggcgcctgtgcctatctgggtaattttctcagcatgtcataagcctgtgcaattccctccaagcttctgccattcatgcctttagaagtggctgattgggatcaatgaggatttctatggacaaagtctagaaagaagctaacttcatcagataaagttgggaggaactcagcctccctggcatcattttctaaccatggttaggataatcacttactagacacaaagatgctgccttctgtaggagtaaatggaaatgtaggactctgcttcttgtgtcaaaatttactctgaaaagacaaccttctctctgactctaccatcttgtgacccagcagctctaactgagatgctggatcccttgcagtcctcctgacatttcttcctgtcatgtaggtgctcagtgaggaagagcacaccacccaaaacaggggcgtcaagttggggccagggactcaggtgctctggtcaaagggtacctagactgagaaggggatctgaagcccctgggcatgaggctttgccattctcgaacctttgcatggccgagttcaaaaaggcacagagacccaggaaggagttaacatgtgaaggagcttgcagtttgtaaatgttggtgtcatggagtataggccagctctatcagtttccaagctgtacagtcttggacaagtgacttaatctttctgtgactacattatcatatctgcaaaacaaggtatataatggacccacttcatcagggtctatgaaggattgggtctatgtctgtgttgtgatgatttaatgaattaatccatggaaaatgcgtatgacagtgtttggtggaaaagatggctacgatgatcacaccacacttttctaaaacatccttagaaattctccctcatgaaaataccataggaacttgtttcatgggtcatcagacatggcccagaacacctctgaaccacttgccaaggggatgaagtgacacacacatttgttttttgctgttagtcacgaagcatttggaatatctgcctactatattgcaaagcactgcactggatatgcatatgggacagggtcatgttctcaacacatcatggggtaggtatggggcaaacctctccttcctagggcgcggtcagagaaggagccttcgagagcctgggctccactttcttaacctttgatcccatgaatagagacatggctggttcccatgaacttggcgtcagagtcagagcaagaaatggcaaagtgagctgtcgcccttgggtacaccagtagcaaaaacactcctgtcctcctatgctgctgtgacaccacaccccacttcctcccgcgggcgtgtgacacttttcaaagaaaatacagtatttggtagtatcaatacagcaagcggaagcagcagtgctcagtccgcagtgagctaacagttttatagagaatactctacggaagcccgcatgtgccggctctgcccggcaacgggggactgggctatcacagtcacagggggggttgttgcaaatagagggacagggtggactagggaagggcaccgggggaagagaaagaaagtgcagaaagaaagagctgggtctatctgggcagatgcatgcgtttagggcaatgtgaattgctcacatccagttgcagtcagaaacgtcgccagcttacaaatgcaagtgtcgtaaaaacttggctgcagttgtttggggtttagaatccacagaaactctaaaattaggtaatacttaggttcctaggccagccccttcactgaccgttcatctgctaattcagaaaggagccaaaaggaatatatgaaactgaccacccattggcattgttctagcttacgggactctctatttttcctcctcactgtgacgtttcagagttactgtaggctgagtatccactggaggcctaatttctgaattcagaaaactattaagttgttttatgatgtgagaaaaggacatctgtactctcacctgtcagcagggtggagcccacatgttctcagagatggtcctggagaaacagcaacatcagcatccctgagacctctttaaaaatgcaaatcctgcagccccacccagagctgctgggtgagaagctctggggtgaggatggagctttagcaaggccgccagggaacggatgcatattgaagttcgcaaagctgccctggagtcagctccaccaggccaggccagcagctttctcgtttctatttgctcagaatccagcacagtgcctggtggttctaaatcagtggttctcagagggtgatgttgctcctctgagcaacatttggcaatgtctggagacagatatttttggttgtcacaaatggcgggagggtgtgcttctggtatctagtagggtgaggtcagagatacagctcaacaacctacgatgacaggctagtcccccaagcacccccccaaaaccaatagtgcggaggctgagaaaccctgttctaaataaatggcaatgccgagaatatctccccaacccattcctcaccacttctcatcacttcctcatgttcagtgaattctggccccacccagagaatggaagaaggtagattgagggactctgtctctctctctttcccatattcccttctcatttagggaccacacgtggcacaggaattgaccatgtaagatgttcataataagcatctttggaataagtaaatggatgaatccattataataagacaggaaataaatcagttagtggatctgttttttgtttttttgtttttttcattttgaaagctgaaagtgcccttattgatctcgtggtctgccctctcatgtaacagaagagagaactgaggctcagaaaattaaggtgagtgatcaaagctatctacctaattagcagcaggaagggattaggagccagttctcccagcgcctccctcggtcctcttttggccgggccagtgtttgactcttccaggcatcactcagtgaggatctgatttgaataggtgattggatttgctcatgcacagagtattaatattacatatgccgaaggattgtttaatcggccagatgtcggaccctatcagacttaatgcttgtgacttgtactgatttctgagcagtgtagcagcatccagtgcagtagctggcattcaatcagccagtggccgggtgaaatgctcattcttcatactttaaaaggggcttttctatattcatcatatgcatataatatgaagagattaaaagcttagcttctttaagaaaaacatggtttaaaaacagtacttggttatgggatacatagttggcaaatgtcaagcttctactttacttggtgaatttgtcctgagccattcagattattttgtgacaagagacattgcttgaaatgtgcttcggtctacagtcatcccaccccgactgcacccaatcttgacatgtgcttcagtctacagtcatcccaccccgaatgcacccaatcttgacatgtgcttcagtctacagtcatcccaccccgactgcacccaatcttgtctgaaacgtacttcagcctgttcttacaagacaccaatctctcaagagaacatgacagcattttttaactgcaatttcattattctccagagcagaaggtagatggagtgaataccttcatttttaaaaggagtccattatagattagtggcaaataactaataggcaagagcactttacagtttacaaatagcttttcaaagatgagaataactaagaggctgctaaatctaagagatattggtaatttatttcttcactggccctttaccacagagttaaagaagcactattctgtggatcctgttttactgcaatacttgctaaattgcaatctattctaattttctatttttttcatattcccccctgaatctaagctctatgacttcaaaagtaatgtttagattttgtttttttaaaaaataggttttattttttagagcagttttaggttcacagtaaaataagaaggtacagagaattcccacttaacccctgtgcctacagatgcagagctcctcccattatcaacatcccccaccagagctggggatgagtctacatttgcatgttattatcacccaaagtccataagtgaacctcaggttcactcttctatttttttgagatggagtcttgctcagctgcccaggctggagtgcagtggcatgatctcggctcactgcaaccaccatctcccgagttcaagcgattctcctgtctcagcctcccgagtagctgggattacaggcacccaccatcatgcctggctaatttttgtattttagtggagacggggtttcaccacgttggccaggctagtcttgaactcctgacctcaggtgatccacccgcctcagcctcccaaagtgctaggattacaggcacgagccactgtgcctggcctgggttcactcctgacgctgtacattctatggataatgagatggatccaccattacagtggatcacacagaagtttcactgccctaaaaatgccctctgtctcttcatccttccttctcccagccctaataggtattaaaataaagatattataatgggaataatgtggttctggcagcaaaagagatggacaggttaccggaacaaaacagaatgtccagaaacagatccaattacatataaaagttttgtgtttaaagaagatggtatttaaactcaacgggaaagggaaagattgcttaatgaatgagactgtgtctaccagctaaaacctacattaaagctaatataatactaaattcagacagattgaagatattcatccagaaataaaactgctaaaccactaaaagtactaggtaacatagatcaataattatgccctcttggaattaggaatgacttcttagatatgatcccacagacaagccccaaaaaggtaaacatttccaaactattttacataaaacttgtgtgttattaatacacgtaaagctgggagacataattgcaaaatatgtggcaaaatatttaattatttaatatcattaaaaagggcaaatcccctaatgaaaaaatgggcaaaggctaacaacaggcaatttacaaaagtaaagttatcaagggccaataaaacaagttccattttactagaaataaaagataggtaaatcatccaggtctttaatcccttctctgtgattccaaatgccaaaaagctctaaaaatagaaaataattattctgtgatataaactaattttgtagcaaaatccaaagtctgacatgaagctctttacagtctatttattctactgaacatgactcttaatatccttccccagtacatagctttttgggaaaattttgtaatatacagcatgtaactttattacctttataaaatatgaattatgaagcagatctcgccatagcaatttggataagagacctctacaagctttatagaaggaaatgtgtattaaatgactttaaagtgataaggaaagtgtaagaaaatatacttacaagactgttcattgcagcacagtttaataataataaaactagaaacagcctgaagattcaaaaataagatattgtttaaatatataatggcatgtaactataatggaatattttataaccagtggcttattacttattgaaacaaagatatttacagaatatacttaaaagttaaatagaaacatatatctatatatatatatatatagatatatatatatatatataaactcattacaaagataaaaatctgtcagtgggaaaaaatttggagtaaaatgctatctttcagtatactggatattagttgattttaactagttctttttggaatgtgcaattcaaattttaaaaaataattctgtgtaacaaaaagggaaaatgtttttcatatatttattcggtttgaagtcctaacaattttgtgaagtaggatgaattgttcccattataaagaagggaaaaatggatgtgtacagaaattaacactttctccaaggctgccgagcttgtaagtaacctggctcacttctgctgactctgacactagtttctttccactacaagacctctctgttcacctggtcccaggtatcacctggcaccattcggatgcccagttttgataacatttggtaatttaacaagtctctctttcacctaataccaacttatcaggagttccatatgtggaaagtattgtgggtatctaagccatagttcctgtttccaagaatcctccaatcctcataatgggagattcccaatttaagaaacagcaaaaatttataactttactaataagttatttgtttaggtgagggaatatacattttttccatagaaatgttacccatgatgttaaatccacatatgtattaatacatttttttttcagtaccaaatggtgctatgaaaatgtgaaagttaccagtatcaaaatggagtcacttatgtcaaaccccaagtaaaaagacctgggaggttacgaaggaagtaggcaaggaattccccaaaaccaaagtattccagacaagctgccggcctgacacgcctgtctccagccatgcgccaaggccacctcctgcactgagcgctgtttcaaaacagcccgtgtccacctcccctcttggtcttttgaagtctcccctcgccgcgcctctttagacgcacctgagatccatcaaagcggacagatcccgattacagtcccctgctcttcccaaataagctctatgctttggaaagtcagtctgtctgtcactcattttaagctgacgaaaccaactgctgtggatttgccatcgatctatgaggaaatgcccccagcctcccacatggagttctaggagcaccaccctagggcagccatggcagtggatcacaagccctcttccttcctactgagcagtggagtcaggccctacccctggttctaggtcacccttggggacagtaggaagtaagggggaccctggggaagcagatgtgcgtggggaggtttgtgtgtgtccgtggaatgaggaggatgaggagaatggaatgtgtgaaacatgatcacctgtgagggcatttgaaggtccgggcagcccatggctctaatcccccacctgcactgagcctgggtggtcccagacacagattccttcaatgtccctttgctgaggggtataacccccagggtgggcccagccacttgccactggctggaacatggatgtgatggtgtcaaatcaccttggcagtgaccttggcgatgaccttggctatgcccttgactgcctgagcccgggctctgacatgggagggatgtccactgtcttctttcagtcactgttacttgggagccctatgacagcagcagacttgtagactaatgaatagcacacctcataagactttagtaagaagcagacaaggctataactgaaaacatgttctggaagataaaaaattattctaatagtaaaatacgattttattattatgctctaaaaatctcttcttcttccgctccccttctcctcttcctccagccagttctccctgttcttctcccaggcaaaaataggatgaagagcggtatccaaatggggtactgggcttcagtgtcctgtcccagccccacagctgatagcacaaaacaaccccaaatcatcttcccgacacaacactttcctgaggtttgaaaatttgaaattccaataggttttctgggtaagaaccctgggagagaaagcagaattaaaaacagccagagcatctcctccatctgtgtttgcttgcgagctgcaagaggaaggagaggctggaggcaccaccttccctcccagaaacaaaacaatacctacggtgcctttggaagaatacccttccccatcccagttctcgctctcccaagccaggggctcagagtagcatgagctctggtggggctgacgatggaacaatttgacaagcatcagggacagaaagatggggcgcagtgggggtgtcggagtgtggctggtggggatgcagaagaggcggtttgactcctcttgttggttttatactatgggcatttgttgaatgcttgcagggaagttggtgattcttttttttatttctcgctttgttttctaaaataaaatttcatcttgttctaaaaggactgaaaccaataagccattttgttaatctatacctcagtttacctcttaaggaaataaatgaggaggactaacaaaatccgatgttttttcaaagtgttttcaagttccatctctccattttaatgccaccatcttgtgacatatccaagtcggtctcttgtccttactttacagatgtggaaatgggctcagagaggtgaagacctttgctcaaggctgcacagcttgttccagccctgcgggaacgggaactcaggtgccacagaagctaacctgaggacattgcactgcccagaacctcttcctttctcgggatctattctgaaagcattcacaggtctttgagctcctgtaaactaagtgctgttctgtgaggatttttaatggcaactggctgagttggttatggtgagatcttcgtcaggagacctttggctcccactgagctctcttcgctggtccttgctgcagagatatgatgactgaccgatcttattcatctgacacttctctggggctctcaaagacactttcatctcagttgctccaagaaaagaagccacacattttgactttgatacttgcaaactcagggctagggagggcaagctaactttccccttttctggttcctcttccacagcgccccccttccctgcacttcctcctccgaggcctctgcagtttagcgcttcctcaccggggatggtttggaaataaaagctaagtggcatgaaaagaacatctggcctcctgcaaaacaggaaggaaaagaaggagggaagggaattgctctcttggggcttactgcctccaggagcagggaaagcgggaccaaggctcctgctggcttccccaaggatgtgccttctgttccagctgaaacacccttcattgtgcctcactctgtgggctcagaaacaggagtacctgctctaaggtgaggcccactgtgctagttccagtggtccaactcccattgctgccaggactggagcctggaggtgggtgagcttggaggcggcattgtcagaagacgggtatgccagcctgggccaacctgttcataaccaatttcaggtctttccttgctggacctcggggaagctaaagaagcaaggctagttttgtactggaggcattccagacaggaatgacctcttagcagagagagaggaaacgttttacagaagctgttccattgggaaatgtcacgacaaaagctgcatttcaaatctatcataggcatggctcagtttgaaggacatggggaaaagctttttcaaaccaagatgccccctccctggctcctcctgcctttagaacatctagtcggcactaagataatgggggcctttccttgcttggctgtgatgtcacattgacgtcaccaaagtgacataagtctgccagagttgtcctagtgccagctggtcatggactctggaaagtcggagttggaataagactgattttcctagttcagattttaagctgttgacttttacctatttccatactctctagaaatgaaggactttgaatttatttattcatttatttattttgtagatggagtctcgctctgtcacccagttcactgcaacctccacctcccaggttcaagcaattctcctgcctcaccctccggagtagctgggactacaggtgcgccccaccacgcccagctaattttttgtattttagtagagatggggttttaccatgttgcccaggctggtcttgaattcctgagctcaggcaatctgcccatctcagcctcccaaagtactgggattacaggcgtgatgaatttatttttaataattgaaaatgacatgactaagtattaagtgatggttctcttgcacaagggtagaaaccttggtgactgtaatccctagagccctactttcctttctgttggccctaacattctgcctcactatattttcacgactcatcagtgaatcggagaatgtttctgagaacttggaggatgctgacttttctaaattcacctatgttgaccctttagagcaggggtcctccagcccccaggccatggaccagtggtggtccgtggcctgttaggaactggggtgcacagcaggcggtgagtgaccgttcctgcctgagccccgcctcctgtcagatcagccacagcattagagtttcacaggagcagaaaccctatcatgaactgcgcaagtgagagatctaggttgcacactccttatgagaatctaatgcctgaggacctgtcactgtctcccattacccccagatgggaccatctagttgcaggaaaacaagctcagggctcccactcattctacatgatggtgagttgtaattatttcattatatgttacaatgtaataataatagaaatagagtggacaattaatgtaatgtgcttgaatcatcctgaaaccattccccaccccagtctgtggaaaaataggcttctacaaaactggtccctggtgccaaaaaggttagggaccgctgctttagagaactcatcagcgcagcactctgcatcacaaattgcataaaatgtctttcttgagtatactgtgaacactcagttgtgcatttagcagtgcccctgcttcttttcaaaatatagttctaattggctgaaagttctttcctgcactgaaatttacctccttggatataatttcttccattggtcctgattctgccctctggttactctgaataagtggaattcatgtaatgcctctgccacaggaaatcccttcaactaattaagggtggccagcaccctcttctgcctgttcttcttgacagtaaatgataactaaattcctttagttatctttctttgtcagagtttctagacctatggtcttgatcatctttgcccagacacacaaagtttgtcagtttgctttttgtactagttcttgctgccaggatactcagtctatgtttaataacctttttattgtggtaaaatatatacaatataaaatgtatcatgctagccatttttaattgtatagttcagtgacattcatacattcacattgttgtgcaaccatcaccaccatccatctccagaactattttatcttcccaaactcaaactctgtccccattcaacactaacgccccattcctcccactcaccagcccctgataactgctcgtctactttctatgcctataaatttgactactctaggaacctcgtataagtggagtcttagcgtatttgtcctttgtttctggatcatctcacttagcatcatgtttttaaggttcatctgtgtcgtagcaggtgtcagaaagtttcatgcctttttaaggatgagtgatattccattgtatgaatatgccccattttgtttgtttgttcctctgctgatgaacatttgggctgtttctagtttttggccatggtgaataatgctgccacggagtttagtgtacaagtatctcagtcctcattttcaactattttgagaatacccaggaatggaattgctagatcatgtggtaactctgtttaactttttgaggaatcactgcactgttttcctcagagtctgtaccacttcacatgtccaccagcaattcaagaaggtcccacatcttcacagcctcaccaacaccaccttccctttttttggtaatagccatcctaatgggtgtgaagcagagcttattgatttgtgttgtatttccctactaaggaagggtgttgagcatcttttcatgagtgtcaatatcattacaatgcatatccagaataatcagtatttccagatactatttgataagcagaaggtaaaagttctagatgcactgaaggtccataaatgcagaccatgaatgaactgacttttgcagacgttacattctactgccaactcagatagaaatgtcaactaactaaaaccccggagtcctgttcatcataatgttctcatgatttccccacctggccctggaccagttaagctgttgactctgcgtaaaggcttttgccaaagtcagatctgaatttggcgttggcctagtttttcagtctacatgatcattttgattctgcattctactgaccctttgagttttgtgtggtctgctataaatctggcctaacttctaaatcttaaggacatttatttctagaaatgctgatgactagggcagaatccagtaccgaattctatgacctgcccctaaagacccccttttcctggatctgaaggaattgttgccccctaggtgcccactaggtacttttcacgtttctaataggagtgttatgagccattttgttagatatctcattgaaatcatgttctctcactggtctaataattcattagtctggggactctacaaaaatggaaactaggtgaatctggcatgaatttagtaagtccatgttgagacctactgattactttttatcttttttttaacaactaaacaggaatcctcctgctataattcaagcccatttctctttgagtgaacatttaaaattgctagatagcattctctttgcattgattcttactgatgctgcatattaaagccacctccaagcctcctcgtttccatatgaagtaatatctactctttactctttctctaataaatattcatatgcacatttcaaatgattttttttcttctctgtggatagcatctgatttttatgtgacatgattaaaacgctgagcccaaagcaattctgcgctatttaagtttaaggtcaaggaaagcaaccacaccttctcaacacgttcctcaactctgtcagaggcagaagcctgggatgcacacatggaccccggctctaactgtggccagtccttgtgttttcactaagagcaacgaagccaatacaaagctcaatgaaggacagagtaaacatggggaaactgcttaccctctgtgggtttcagcttctttgcctataaaatgagggcctagagattactctctctagtctattttcagcccaacaacctggagtggtgctgacttgccaggctcagtggctgtctcaccactatcctcaggtgaatgcatttgcagatagaagcctgctctcttggagaaatatccttgcattctgatgtcatgggaagaacacataagtcctctcttcagtaataacctgcatacagtaaatactcattgagcatggattttagacaagagctggtgggagaacatgaacttcatccttgaaatactcgtattttggcagaagcaataaaacatgaatgcaacagcattgatagaaactgtagagactttaacaccctataacacagcatctgcagcttcagagtgaacagttctccctcggggacaacagcagaattgtgtgtagttcaacagctggatcactaggtacccgtcaccatccatgtctccgtgttagattctagcacccaggggtatgtcctgggccatcagaagatcagcttaatattaaatttgacgttacgaggtctcttgcctgctttgtgcttctaactcattacctaaaaagaacgaaggtgataaaagctacctacatcctagctttcttaggtgttgttaggaatatgcctgggaaatagagttgcaaagtcaaggtcacattcttttcattgtttctgttattatattcaattaaaaagtaatataaaagggtttctttttctgcttgcattcagaagggctcaaagcaagagggaatccccactgccatcacgtcctttccctgcgttgagtccttcctcagggctctaagaaagtcacaggctgggaagtcactattttggtggagccctgagggtgggccctgccctccctggagagctcagccctttcaagcctggcagggaggcaagggctcctcaccactgtcctttgaagtcgtgttcgttagcccagcagttcctgtatttctgtgcgctcagtaattggtgagcacacatcctgccatgtttacttttaaaaagaaaggaagaaaaagtcacacaggtggagttcgcggagctgaaaacaaaatactcagccctggcggagcagcacaggcttcccttagctttcagctgagcgcagtctggtctctttcagtctccagacagaggaaaacaaaaacaaaaacaaaagcaaaaacacaacaccatggggaaaggtggcgttggggaaaaaaggagggaggaagaagtcagaaatgtgtctgtcatgactaaattaaccacattcattttcagaagaagagttcaggcatcattctaaagccagcagcagcttctgtcacccttatcaattagagagacgctaaccactactttgtggttacctaaggaaagcaaacacacacctccagatgctgaaacactgtcctcgatgatcaaacacacaacccaactcacacagcaggttgctgacaaggcccacggttctgttttccagagaaacacgctgagcagggctgaactgcaagtgctggaaggaaccccagcctggggacaaggactggaggaaactggggggtcggctgtactccttccacaaatgtcctgccactcccatgcaccgcgcatccttcctggctgggatgacagggccttgtttggctgatgctctgagcagacagttgtcaggaccgaaagagcagaaggtgccagcccttcctgttgtgaaaaggaaagacatgacctccaaccccacgacactgagagagctgtctctttctcagatggtttgcatatttcttccaagcaggctaccatggccattttcccctcagcgaggtcaagttcattacatcatgtatcttactatggtacctttaccatcttttgaagagctctcaggaaagatgtttgggaaaaacgatgttggaagaatcaaagggttatgtagaatattcatgggaattttaccaatggggaaaatcaacctgaaggaagttaaactgtttgtgagtcacagttttgagcttaattcccactacctgacatccatcctggaaaggatggtttgtggatggctttatgtttccaccaaaatcaacatcgctcaaggtttttcatcggggagatttgtctgtttaatgacctggtcacactgtcaactgaagaaccaatttgcccattctaataatgcgatgaccacagaatatattgttaacggcaaggagagacactgtaattaactccacagtgattaactctaattgacttaggccaaggacattgataaatggagataactggaaactgggtcttcacttattggttctattcattcacctgcccttagaatctgaatttgtgtgatgactgtttaacctcctctctcgcctaagcagttggagatcctaccccacactctttttttttttttttgaggagtctctttctatcgcataggctggagtgcagtggcatgatccaggctcactgcaacctccacctcctgggtttaagagattctcctgcctcagcctcccaagtaactgggacaacaggcacgtaccaccgcacctggctaaatttttatatttttagtagagacagtgtttcaccatattggccaggctgctctcgaactcctgacctcatgatccgcctgcctcggcctcccaaagtgctgggattacaggcgtgagccactgcgcccagacccacattgtcttaagtcaactctttcttttcctgagtgacaaagtctgctattatttcctttctgttttttttttttttaatctataggggaaaaatagcgggaaaatgtgaatgtaacatttttatttttacgatactgggactctgggagttaatctctaacttgctaaataagaagattatccaattcagttaaaaataatattaattactgagcactcacaaatgtgtgacttcaggaaccacggacatgagaaaggcatttttcttgcacctggtcttcatgtaacttatcatttagaaagggaagagaaggaggctaaattaatttttatcatggctcaaagcactgcactgggcgctgtctgttgctttacctgattttattaaatcctcacaacaacctttgaaaaatggcctactgatccgattttacagaagaggcaatggaggctttcaaaggttaaactggaatattcttgaggctgaaaaaggaaggacgtggtgacacctgctacaacatggaggaaacttggggacattatgctcggtgaaagaagccagacaccaagggacaaatgttaaacagttccactgaaatgagtccctagaggagtcacattcacagacactgagggtagaattgtggctcccgggaacttggaaggggggaaatggggaattcatgcttgatggggacagagtctcagtttgggatgatgaaaaggttctggagatgcgtggtggcgatggttgcataatactgtgaatgttctcatgtccctgaaccgtacacttcaaattggttcaggccaggcacggtggctcatgcctgcaatcccagcactttgggaggctgaggcaggcagatcacaaggtgaggagttcgagaccagcctggcaaacatggtgaaactactaaaaatacaaaaattagccaggtgtggtggtgtgtgcctgtaatcccagctattcgggaggctgaggcggggagaatcgcttgaacccaggaggtggaggttgcagtgagctgagattgtgccactgcactccagcctgggggacatagcaaaactccatctcaggaaaacgagaaaaaaaaaaggttcacatggtaaattttgtgttacgcgtattctagcacaacaacaaaagaaagagttcaagtgaattgtccgaggacctacagctagtaagtgggatggtggggaactgagctcagagatatctaactgcaaatgttaggtgttactcatgatggtgtacaggccctgatgtttattatttttgttacctgcctcctgtttttgtgtatcaattaatagtaagcgtcttaaaacaaaaagggcagtaaaatggggtgccagtgggattagggtaggggagtcaggactgcctcactccacacaccatccaggtttacagtagaagtgccccttggggtagagcaagatgaggttgcagaggaaaggaaatttcagcgtggtgcaaggaatatacacaaagcttagccatgtggaagctacattagttcaaagaaggtgttatacttaggtattttactctctttgaagcaattgtgaatgggagttcactcatgatttggctctctgtctggtattggtgtataagaatgcttgtgatttttgtacattgatttcgtatcctgagactttgctgaagttgcttaccagcttaaggagattttgggctgagacgatggagttttctagatatacagtcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattctgtatgatattggctgtgggtctgtcatagatagctcttattattttgagatacgtcccatcaatacctaatttattgagagtttttagcatgaagcgttgttgaattttgtcaaaggccttttctgaatctattgagataatcatgtggtttttgtctttggttctgtttatacgctggattacatttattgatttgcgtatattgaaccagccttgcatcccagggatgaagcccacttgatcatggtggataagctttttgatgtgctgctggattcggtttgccagtattttattgaggatttttgtgggaatccaacttacaagggacgtgaaggacctcttcaaggaggactacaaaccactgctcaatgaaataaaagaggatacaaacaaatggacgaacattccatgctcatgggtaggaagaatcaatatcgtgaaaatggccatactgcccaaggtaatttatagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaggctacagtaaccaaaacagcatggtactggtaccaaaacagagatatagatcaatggaacagaacagagccctcagaaataaggccacatatctacaactatctgatctttgacaaacctgagaaaaacaagcaatgaggaaaggattccctatttaataaatggtgctgggaaaactggctagccatatgtagaaagctgaaactggatcccttccttacaccttatacaaaaattaattcaagatggattaaagacttcaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattcaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggtgaaggatatgagcagacacttctcaaaagaagacatttatgcagccaaaagacacatgaaaaaatgctcatcatcactggccatcagagaaatgcaaatcaaaaccacaatgagataccatctcacaccagttagaatggcaatcattaaaaggtcaggaaacaacaggtgctggagaggatgtggagaaataggaacacttttacactgttggtgggactgtcaactagttcaaccattgtggaagtcagtgtggcgatttctcagggatctagaactagaaataccatttgacccagccatcccattactgggtatatacccaaaggactataaatcatgctgctataaagacacatgcacacatatgtttattgtggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatggcaagaacaaaaaaccaaacactgcatgttctcactcataggtgggaattgaacaatgagaacacatggacataggaaggggaacatcacactctggggactgttgtggggtggggggaggggggagggatagctttaggagatataactaatgctaaatgaccagttaatgggtgcagcacaccaacatggcacacgtatacatatgtaacaaactgcacatggtgcacatgtaccctaaaacttaaagtataataataataaaataaaaaaagaagatgttatacttaattcttaatgcatccagctcagctacagtgaaagaccacattgatccatccatgatccatttatccattcattcaccagtcttattgtgtgacagccatatgccaaagctctgaggcaggcacgtataagccatgttgtgttattaggacctctgttttccaagggcttacattctaatgggagcgatggaacagctctgaaaacttaagaagcagtacatggggccatataagtaatgaacatctagttgtacacaaaataagtgtcctgggtccttaaggcaagaggaatccaagtgccctgggttggcttctgactgtatcatggagaaagcagtatggagttgggcatgctgcaatgggattcattagagttcccttgggtagaatttatgtagatagggaggaagtacgggatattctggaagggcagaatgcttcatatgagccaacatcaaagactggactaaagcaagaagtctgggcaagatactcacttgggaaattcagaaacagtcgacttatttttatgataactggagtgagggcagggaatcagaaaattcccccatcatacaaaggtttgtcatagcgattactaggttggtacaaaagtaattgcaatttttgccattaaaagtaatgacaaaaactgcaattatgtagcttttcttatcatggtaaaaagcacataacataaaattcatctttttttttttttttttttgagacagagtctcactctgtctgccaggctaggctggagtgcaatggcatgatcttggctcactgcaatctccacctcccaggctcaagaaattctcccgcctcagcctcccgagtagctgagattacaggtgtttgccaccatgcccggctaatttttgtatttttagtagagacagcgctctccccatgttggccaggctggtctcaaactcctgacctctggtaatctggccacctcggcctcccaaagtgctgggattacaggcgtgagccaccgcgcccggctgaaattcaccatcttaatcattttcaatgtatagttcagcagtgttctgtatattcacattgttgggcattcatctccagaacttttacatcttgcaagtctgaaattctgcacccattaaacaataactccccattctccctttccacaagccctgcaatctccgttctacttcccgtttctgtgaatttgactacttgagatacttctcataggtagaacgggcaatatctgttcttttgtatctggcttatttcacctaacataatttcctcaaagttcatccacatgacagcatgtgaaggaatttatttcctttttaaggctaatagtctaatatcccattgcacttttttttctgagatggagtctcactctgccgcccagcctggagtgcagcggtatgaccttggctcactgcagcctccacctcccagattcaaactattctcatgcctccgccacctgagtagctgggattacaggcacatgccaccatgcccggctaatttttatatgtttagtaaagatgggattttgccatgttggccaggctggtctcaaactcctggcctcaagtgatcagcctgcctcagcctcccaaagtgctgggattatgggcatgaaccactgtgcccagcctccattgcatgtttgtagcatattttgttcatccattcatctgttgatggatatgtgggtcgtctccacctcttggctattgagaatcctgctgctaatcgatgtgggtgtgtaaatatctcttcaagaccctgctttcaattcctttgaatatatactcagggtagaattgctggatcatgcagtcattctaagtttttgaggaaccaccgtactgattcccatagcagctataccattttacattcccagcaaaagtgcaaaaaggctccaactctccacgtcttcaccaacacttgttattttttgttttttgatctagccatcctaatgggttcaaggcaatatctcctttgatttgcacttctctaatgggattataatttgtatttgctaatggtaagtaatgttgagcatcttctcttttttttaaatgtttattttaggttcaggggtacgcctgcaggtttgttatacaggtaaacttgtgccacgggggtttgttgtacagattatttcatcacccaggtactaagcctggtacctaatagttatttttttctgatcttctctctactgtcaccctccaccctctgacaggccccagtgtgtgttgttcccctctttgagtccatgtgttctcataatttagctcccacttataagtgagaacatgccacatttggttttctgtttctgtgttagtttgctaaggataatggcctccagctccatccacgtttctgcaaaagtcctggtctcatgcatttttgtgtctgcatagtattccatggtgcatatgtaccacattttcttttttttttctttttttttttttgagatggagtctcactctgtcacccaggctggagtgcctggagtgcaccatctcagctcactgcaagctccgcctcctgggttcatgccattctcctgcctcagcctcctgagtagctgggactacaggtgcctgccaccacacccggctaatattttgtatttttagtagagacggggtttcaccatgttaaccaggatggtctcgatctcctgaccttgtgatccgcctgcctcggcctcccaaagtgctgggattacaggtgtgagccaccacgcccagcccacattttctttatctatctaccactgatggacatttaggttgattccatgtctttgctattgcaaatagtgctgcagtgaacacacacgtgcgtgtgtctttatgatagaacgatttctattccttcggttatgtacccagtaatgggattcctgggtcgaatggtagctctgtttttagctctttgaggaatcaccatactgctttccacaatggttgaactggtttacactcctaccaacagtgtataagcattccattttctccacaaccttgccagcatctgttattctttggcttttcagtaatagccattcggactggtgtgagactgtatctcattgtggttttgatttgcatttctctaatgatcactgatagtgaactttttttcatatgcttgttggctatctgtatatcttctttgaggaaatgtctactcaagtcttttgttcattttctaattttttttgtggttgttgagcttatatagctatttatagtttttcaagtgtattataaagtgtttcagatatacacaaatataaaaataactttttatacatgttttatatacctgtatattcctaaaaacatgtattctgcatacagcatgttttactagttataaaacacaatataaatcactgtttatattctcctgcaactccagtgatcgtgcctccaagattcaggctcagtgcgtgcagtctccattcattcattctcactgtctgcaacagcagggctcaaacctgttagtcttttttttttttttttgtctttctagacagagtcttgctctgttgcccaggctggagtgcagtggtgtaatcacagctcactgcggcctccacctcttgggttcaagtgatcctccccttcagtgtcccaactagttacactgcaggcatgcaccaccacacccagctagtttcttttttattttttgtagacacagggtctcactaggttgctcaggccagtctcaaactcctgacctcaagtgatcctcctgccttggcctcccaaagtgctgggatcacaggtgtgagtcgctgcacccaaccaaactttttactctaagaattattttattctcttaaaaattgtgagaaaaacaaagagctttggtttatagggattatatctgtcaatatttaccacatcagaaaataagaaggagaaaaattaaaatttttttttaattaaaaataatgaaaacctatcatgtaatacgtgaagacaacatattttatgataaataattatgtttttcaaagcaaaaaacattgaaaaaaagtggcactgtttgacacttttgtgatctctttaatgtctggtttaatagaagacagtttctgcgtttagcctgtggctatcagaacatgcagtctctggaaaacttcaaggtacagaatgagagtgaaaaggaaaaatagacctcagtaatactgtgaaatcagttttgactttgcaaactccctgaaaaggttttaatgatctcctggaccacactttgagaaccactgctgcagattccatcggaatagacatacgaggcaggcagatcgcttgagctcaggactttgagaccagcctgggcaacatagcaaaatcctgcctctactaaaaatacaaaaattagctgggcatggtagtgtgttcctgtggccccaggtactcaggaggctgaggtgggaggatcacctgagccctggaggtggaggttgcagagagccgagatagtgccactgcactccagcctgggtgacagagcaagaccctgtctcaaaaaaaaaaaaaaaaaaaaaaaaaaaacaaacaaacaaaagaagaagaagaagaaagaaatatgctatccatcttttcttctattgatgtttcatcttttcctttttttccttcttcttccttcctcctccttctcctccactttcttataactcatgctgctgtgaacatccttgtagatacctccttgggaacatatttgagagtttcgatagaatacatgcaaagcaatagacctacaaagttgcggtatgcacatatcttcaactttggcagttacttccaaatttcttaccaaactttaaaatctataaatgtgtcactaaattatttctgagcacctaaaactttagtcaaggttatccctgggaggcaggacctgaaatgtgactataattttatacattaaaatataattgatagtacagaattatatttggtatggagaaaggtctctagaacaaaaaagtgcagtggaaacagtaaaaaaaaacagagtgtcgcagacatcaagtctcggagcactcattcaagtagtagttcaagtagggaagaaagactaattcacctgtttgctgaattcagctgtgtgaccttaggcaagttactttacctctctgggtctaatgttctcatctgtaaagtgctgctatttcgtgattctaggaattgaaacccacgaccgtcaggaagattatagtctccttgggatacaggactcatatacaaagcaaccaaggccagttggtaccaaagtccatgcaacgttgcagaaggaactgcaactccgaagagagagaactctccagcagtagtttcaggagaaaaatgggggtccaaactgggaattaaagtgtggttggaactgaattaggggagatatgtttggggaagtgagacaatatgagaacagttttcctttctattactttgatttggcaatatttagagggtgttagcttagtttcagggcctggggaaatgctgtggcctctggcattttctgtctacagctggaaatgtaaaaggcatctgtaagccacatccactacatccactgtagaaagaggcacggctcactcatcgccacctcaggaactctgtcaactcttgtgggggctttacagaaaatgaaaatggaaattgtgttaggaaaatgatcccaatatcagacatttctttcaataagtcttttattagaatttactttcattgggaagataattcatttccattaaaaattactaagtctacaaagaatctaaaacagaactaccatttgaacctgcaattccatcactgggtatatatccaaaagaaaataaatcaccctaccaaaaagacacacgcatatctatgttcgtggcaacaccattaacaacagcaaagacatggagtcaacctagatgctcataaggaaaatgtagtacatagacaccatggaacactatacagccacaaaaaagaatggaatcatgtcctttgcagcaacatgattgcagctagaggctatgatcctaagtggtgaatgcaggaacagataatcaaataatgcatattctcacttagaagtgggagctaaatattgggtactcatggacataaagatggcaacgatagatactggggacaagtaaaggtgggagggggggggtctagggttgaaaaactaactattgggtactatgctcagttcctgggtgatgggatcaatcgcaccctaaacctcagtatcatgtaatatactccctgtatctaaaataaaagttaaaaaaaaaaaagatctaatgctatagtgacacatgtaaacctcctcgagaaggatctgttcatgtcacccataatagacattaacacagactggttatttgtatacataacaggaaaaaccacttatcttcctaaatgatgcgtacacaaactactgtgggaacttctatttcagacaacagacattcagtgaataatgcaatcctctggaagagaacactaaacagaaacagattcacaattctgtgctatcatttggatgggggaaaaaagacattcattgttgtgtatgcgtatgataaagaaaatatttaattcaaagtaggatttagagaggttcaaagcttcagctgatttgaatcactttaagggtaaagcattatatcaatttcatagcattgtattaataataaggttttataaatggataccacatggtggatttaaaaaaaaacagggtatgggccaggtgggcacggtagctcacatctgtaatcccagaactttgggaggcaaaggtgggcagatcacttgagatcaggagttcaagtctagcctaactaacatggcaaaaccacgtctctactaaaaaaacaaaaattagctggggtggtggtggatgcctgtaatctcaactactggggaagctgatgcaggagaatcgcttgaaaccgggaggcagaggttgcagtgagctgagatcgtgccactgcactgaagcctgggtaacagagcgagactctgcctcaaaaaaccaacaaacaacaacaacaacaaaaccaggatatggtttaggaatgacctcttcatttacagagtgttatacagcagaagaataacttattcctttttcttatcccatgattaatgctttaaaagcaacaaataggttagcatgagggctcatgcctgtaatcccagcactttgggaggctgagataggaggatcacttgaggccaggggttagagaccagcctgggcaacatagcaaaactcacatctctacaaaaaatttaagaaaccagctgggtgcagtggcatacgcttgtagtcctagctactcaagagggtaaggtgggaggaatgtttgagcccaggagttagaggctacagtgagctgtaattgcaccactgcactccagcctgagcaacaaagcaagaccctgtcttgggaaaaaaaaaaaaaaaaaaaaagcaacacttaatatgagctacctggaagaggcaaattcatagagacaaagagtagaagggggtggcctgggactgaaaggagagggaaatggagagttactgcttactgggtacagagcttctgcttgggtcatgaaaacgttctggaaacagtcatgaatctaattaatgccactgcactttacacttaaagtggttaaaattgtaaattttatgtttattttcactacaataaaaaacaatgaattatgtaagcatttgatttattgctgaatttgccaacaatcttggctttatttttgatcttattcctggcctgtttattttccaatttcctaaacgggctgtcccacacttgttccccttatgtctccaaaaccatgactctgccttctccacctcggcagatgagcttgttaattttaaggaaaaactggaagccgcaagacataaatggctcaacttccttcgctctggttcaacttatcccagtctccatctagttcttccctgaatgcctcatgcatacatgatcctaaccctgtacacactcttggaattgttcttttctttaaccccttgccattcttgtgatttctgcctgtctcccactcccgcttataaacaccctccggttttgcaacctctaacaacttctgccgtggcttctcccgctgctatggccttacctcccttccttcaccaaccagcttcctgaaccatctttgcttcctccccttccattcgcttctctgccctctgccatatggattcctccagccagcactctgtggatctatcttgctccctgcaagagcgctgatgacttggtcatttccagaccctgcggctggaaatggtcttcctcctcaaccagagaccttcttccttttgttccagagacctttctctataccaaatgtaactctgtactatcaattgtattttaattcaatttcttggtcttcctccttgacactgcacaggacactgtcgactcccttcttctctcctgctctccttccctctcagctcactcttcagcttattctgttggtttcacttctttacctaactattttggaatacattttgactttcctcccccttttttttaaaccaacatttctggtcaatctcatctattttgatggctcctatgaccctctacctagtagtagcctcaaaaagaatatctttcttgaactatacattcactttcttcggtcccctgtattcaactccatattggacctttccaggtgatgttccaccagcccctcaaacacaactgaaacaaacatgaattctactttttccagtgtctgtacctctcctctctgtcctgtcttgatcaatggaattaccacttactgagtcttccaagctagaaatattggaaccagctgagttctccttcatcttcatctcctccaaccatctacgcaacaagtcccatggatttttctggttatttttgttgcatttcatcactgctcttcagtcttttagctctggaacttcagacattttctcttaataatttcatgattccaatagatgtttaattacttatccccttgctctttcacgctgccttttccacccctacacgggccatgtgagctgtcttttaaaaaaatctcttccttgctttgaaacatgaagcagattctctttgtctgaactataaagtccagactcatgacccacacaacctctttattacagatcaacttcaaaattttaaggggattccattatggctaaagatatatattaaacaaggcattttaaaaagatgttttggtttcttaaaatggatccttctgaatagccttgaaattgttcaaaagaactctaaagaaaacaatcttcccttacacactactaaagatgtaaacagacatacagtactattttgttttttttaaaaaaggcttagtaaacacaaagaggagttacatactgaaacccacagctgatttaatttgcaaaaccacagcgttagcttgactaaagtaaagatgacacagataaaatgcaaccagaaaactgagataaaagatacaggataaataacttaagctgatggtttagcaagcaaacatcatgggtgtaacatgaagatctgagaagtgacttcggtccaggaaactcactccacagagtccctaggagcagcaggtttttaggagaatcacagcatgctggaatatcgtcatctattcttgcacttgtgaggaggtggtcaccgtgatgcaggaagagaaataagattttaaagttgaagttgaggggtctaatttcttattttactatttttatctctatgttaggaagatttggggaaaattctcagagacagtctttatccttagggtgtaagagaagggggcgacgagaaacttcattcagagctgaactagggctattgattctccggtgagacatttagagagtcccaagtgcatggtcacgcgcagagaggcaggtcccgtcagcggtgacatgtgctgccgttaaaagcagggcagaaggtgagagcttgggcctgggctgcatgagtgggaattaatcaggcaattcttggggttctttctactcattggcctatctgctaacatttcagcaataggcaataaaaagttaaggtttaaaaagaaaagttacgtatcctcattaggaacataaatgaccacagtcagataccttatactacgctcactaggaagaaatattcattagtcaccaactaggtgccaggaaaagaactggcaaaggaacttctgggtaataaaagagccctggtcccagcccttgaggactggggcagataagagctgtgcattgtttgggccagggaaggagggacatgcctttttctagatcatctagtgactcctttgtaattttttttcttttgagatagtctcgctctgccacccaggctggagtgcagtggcagtttcggctcactgcaatttccacctcctgggttcaagagattctcctgcctcagcctcctgagtagctgggactacaggcatccaccaccacacccagctaatttttatatttttagtagagatgggatttcgccaagttggccaggatggtctcgaactcctgacctcaggtgatctgcctgcctcggcctcccaaagtgctgagattacaggtgtgagccaccgtgcctggcctgtatctttttctgttaaccatgattttgtggcagcaagtacaatatcagatatttttcttcactctccatcaaaaaaggaaacatttaataatctaaaaacaggccaggttctagaaattctctttacctcttcaccgtctttgttttattgttctttgagttttgtgtgtgtgtgtttgtttttattgatacatcatattttgcatatttatggggcacatgtggtatttcgttacgtacacagaatgtgtagtggtcaagtcactgtatttgaggtgcctgactttaccttatttgtgtgttatttacttagctattgtctttctactccaaaaaaaagtaggcataggcttgacgagggtcagtacctttctccttctcttctcccctgtattttaaacgcccagaaaaagccctgacatgttaggtgtttgatcagtcaacatttagtgactgaataaaacccagctttccccttctccttgaaaatatccattttctctttgttactgcctaagccaccctaatgggtgaagggaatctcagcagtgcttgcatttttaagaggatctgtgtcccctaagatcctagctgacagcatttcaggtgctggatagaataaggtgtagggagaactttctggagtattttgagactaggtgaggagcggcgtgctacaggcagtcatccttgatttgctgggaagcctactggaaggagaaagaaacccctctgtgctgtttttggttttcacagcttcttcttcccctccatgactgaatctaaaaaccttctgcaaacactggctgggaggcagcgcatcatggaaccatcaggacaaaatgaacccgtagaaagtgtggcgactttgtctccgcccctgagatagtgtttcacggatatgctgcacttcgtggctattctaatttttctccgtattcattttcaggcctaatgcttacatactcagtgaattgttcagcctctgaaaatgtgtctatttggtcaaatataaataatccattttattttctattttagaaaccaagccaaaacaaagtataggtttcttgaaattttaaaaattattcttttgaggccaggcgcggtgtctcatgtctgtaatcccagcgctttgggaggccgaggcgggtggatcacgaggtcaggacatcaagaccatcctggctaacacagtgaaaccccatcttcactaaaaatacaaaaaattagccaggcgtggtggtgggcacctgtagacccagctactcaggaggctgaggcaggagaacggcataagcctgggaggtggagtttgcagtgagccgagattgcaccactgcactccagcctgggcgacagagggagactccatttcaaaaaaaaaaaaaaatttattcttttcaaattgctgactaaaaaattcttccttgaggctgggtgctcatacctgtaatcccagcactctgggaggccaagacaggcagattgcttgagtccaagggtttgaggctagcctgggcaacacagcgaaactgtgtctctactaaaaatacaaaaagttagctgggtgtggtggtgtgcacctgtaatcctagctactcaggaggctgaggtgggaggatcacctgagcctgggaggtgcagcctacattgagctgagattgtgctgtactccagcctggaccaccagagtgagaccctgtctcaaaaaaaaaaaaaaaaaaaaaaaaaaagaaacaagaaaaaaagaaatgtttccttgaataagggtatctttttgaactttttggaatcttgtgcttcaggaccctgtcaaatattactaaacaatacatatctgagacaatcagaaatttgacgtgaacctacaattgatttacatacacagaaacacactgactcaaaagtcaattaaaaagttacaaaggcctatgccaaaaaataatttatgtagatctcacagtatgacagaatagattacttttttaaattctcagaacggctccataaagttgaagttcaaacctccaagttatgactcaagaatgttaatctggccaccattctcgctggtttttaattaaacaaactttcttcttaacagctctttgcaagtgacagtcgtcagtacgtatgtgtgtgggtgtgggcatgtatgttgatatgatagaacttgctgtttttaatgtgtttagcatgttattaaacacagcatgaaagagttgaggaaagcaggaagaagggaggagagttcaagcaaaaagtaaagggagttggagatctgaggtgaataaaagtctgaaaaagcagattaggattctaaaataagcttttaaggtttacttaaaatatagtttaaaatttacaacattgtcagttcaaaataatgctggtaggaaggaaatacattgagccacggacctggcatctggagataccggaaaggaaagagagagggattgaggtggacgctcgtgggtaaggaagaacgaaggagaagcccactcaggcttgtctatgaactcatctgtgtggttctcctgcagggcagcctcataaatgccccggtcagtgctggaccccaaagaaaaccactgtggccatctcctgtctccctcacaagttttccctgaaaagacaacaacttccggagttccatgcggtttttcagccttttccaaatctctctaaacaccaggaggaatgttcacatgcttcagcagagagacgcacgcttcagggcccagcagagaatgcctggagaagaacccagccaagccgactggatcttagcagagctcccggcttgatgattatgctcaaccagagtgagtgttctctccattactaacataagtaatacattggacagcaaaacaaggaaatagccccaaacagtaattgagatataaagggagaaggaagtctcaaaacccacttctcagaattaactccaatgtcaggtagtatttttaaacataagtcagtagataaggtatagtcccaaaatcaggctttgctacatggagtattaagaacacagatcatggcatcaaactgcttgagttcaaattccagttctgctgtatggtagctctgtggctttaaacaagctatttaacctcacttttcttatctgaaaaatgaggatcataataggattaaatgggttaatggatgcaaagtgattagaacagttactagtagacagaaaaagctcagtctatgttagctataattattatatactcagagtcaaaagaacactcatcatgttttcttccaagatttagcactaaaatattttctgtagtgattactttttagtttttttgttgaaaaaaggctatggattctttcaaggtgggcttccttggttggctctcagctgccacctcccctcccccaacaaaacaatagcccctgtcccttgtcaactagatcccagcgcacagtttcactttaaaggcatgcaatcactttggctcaagagtgaagatattcagtcgaaagtgaagtaagtgacagctaggatttcagagcgtaagtctcacagttccaagagtcccggaagcagcaacctcactttgcccagtgcctctcctcctcttctcggtgacagggaggtctactgcatgcctactatgactgagctctactgcatgtctggaggtgcgtgggtgggattctgggtgccctgccttctgagtccaggtcagggctctccccatggggacaggtctccatggcccgtcctgatgttgggccatctctcctaccttgtcactgcctcttccctataagcccctcaccatgacacatgcctcgatttctcttacatcgaatcagattttctgctttactttctatgcttgttcgcgtctcttgactacctagagtgctctcagcctccaattgcagtctaagcccaccgctttgttcctcctcttcctgcctccccaggctccaactctccatgggatcacaccgccttcttcctgtacagggttttctggtcttttccctccgacactcctccactctgtcatttacctatactgagctgacattccaccaaaatttactgagcacttgctatgtgtgggactctctgctcaagccgagggctaggggctagacagacaaagagatgcagagcctgcccttgggagctcacagtgcagttggggagggaggaagggtgtgttagtgctgctgagctgtccatgtgcacagcatgccagggcacgcagaggagggacaccttgacacagcccgtgggggcctttgcagaggaggtgaggtctcaggggttagcaaagtaacgatgtgagcgtgaggaagtgcactcaggcctgggatcaggtgcagagctgtaaaatgcaagaggcttctggggagctacgaggtgctcaaggacccaagggaaacctgagtctggcaggcagggcacaggctgggaagaactcacgggccccgcaaagattcgggattctattttgcaggtgatatggagtaaccaaagagctttgcaggggagtgcagcaatcattttcgtttcagcaagatcctctaccgcacatcttcagcggtgtgaagagcgagactagaggctcaatctcggaaactaaacgaggtcctctgtaggaaatattatggtataaatggctgcaatactattgctcgatggcgttttcaaaggcagctgctgcagcctatccctttccctcccacctgtccttctgcgatgccactgtactgctcgcccagaagtgccctctgctgcccctccttgatcttgcctggcccgtgacctgtttttcacccaaagaccaaagcagcaggaacttcctactttggggccacatatggaggaagacggggtgggggaatctcaacctcctagctgcatccacccaggggccatataagggagtgacctcatctcaggtctgactgcaaccttatgagagggccctagggatgctctgaagaccaaaaccgccaagccaaggctgacccaaatccctagcccacagaatcaagaacaaatacaatggtgctgtttttttaagccactaagtttgggagcagtttgttccatagcaattgatatcttcaaagcaatgctctgggtcaaataaacaatgtcaaataaagaataaactccccgctgacaatttcaggacaatagcatgggtccactgtcaatatatacccacttgtacttcatccttaattacttgctaccaaatcccatttcaagcctttgtcacacttaactgattagggcttaagctttttaaaaagcggttttcagaaaatgtaatcctctgactctatcttgcaaaagactaagaaaatgtggcatgtggattaaaattccctggagtttcgtttgaattttcctatgggtagtgtttagatgaacattcaagcaaatatacgtttcactttttgaaactgcagaatgtttgatgcttctttataatgcgccttcttagcagcatggctgggtgtcttgagatagcacagtacttgaataaatagtgtgatctctctttatgtttacatatttagacccataggtctagtctattttttccatgagaaaatatctatagtattttcctggagaaaagtgactttattttatttcaatagatacatatgctctctgttctgagtacttcaaggctgttctctcaagagaaggggtttgcttgctggttttcttctctatgaaaataataaaattcaaacatgatgctatgtgttaacattttcctctgcgagctctagctatgggaagttgctaatggttgagttttactttattcatttctaaaaggaagtgctcatttatgcttagcaatgttcgccttttttttggtgaaagaaattgcatttattttattttaaaaagaaacaaaaagccctttcttcttgtgatgcttttctctcctaaagcacttttagtcgcagatctcaagtgtactacaaatattaacaaatctccttgtccaggaactagggaagaatcccgggaggaaagtccttttcattgcaatggcaaatatttcagctgcctctgcttcagaacttggaattatgcaagttacttcccactgaattacgttcctcaaaagtaattgcaaaaccacaattacttttgcaaactaatatttacaaagtagagtaattcacgttcttcctatgcaagagttatttatggctactgttcatagtacccctctaaataggtccccagtaaaatgtatgctaatttatttttattgaatgactaatgcagatgaattaaagagttcccattcttagagggagatttcctctattattcaccattaccttatattccagaaacatagcccactgaggaaatccacttgaccttttcagagaaacttggttatcataaccttccttgtgttaccatccccactaacactgtagaacgaatcatgttttgctgttgctacggtattaaattttaattcctcctgtccatagcaaagctaattgtagctgaatgactcccatgtttgtgggactgcacttcggtttattggtgaagggttatacatgccaccagtggttgcattctctgacctacactggctgttctgcagtggttatgacaggacacattaactacagccctaggagcttgaaatgtatccacttctttcccactccagctgtccaggtgaaatcctggtctggatgcgaaaaggacccctcaaaacagctacaaaatattcgaatcagggggaatcctagacatccccctaatgcactcaaccttgtctcccaattcccacttctgggatttttcagtccgacttcactgttgggtgggtctggaaggtgagcatgaccctggcagagcaggactaggtagggtgaatgacacaacgagattcagtggcctctctccagtcttttctcctacaagggacaacctcatgggttcctaatatccttgtgtgccagcgaccacctgtcctcgattactgcaagaaaacagaagaacagaaagatggagagaactcaggaggggaggaacacactgatgaccaagcagacgacactggccaggaagaagtcagtgcacccaagggtttctagggagctggcccggaacacttctcagtcagatcccctaaaactcacctttagatatggacccaaatcggagtgcttagggctctcaatattaatgattagggcctaaaatatgatatgaacgtttggaaaccttcatattggtaactggagggaaataaaatatattccctggctacaggaggcctcatgaacctcctcaatccaaggttccgtctgagctctgtgctgagagttaaagagagaaagagaaagagaagactcggtacatgctctcaggcttactcaagagacaataattgcattaaaatgtcattagggagctccactaatgagaaggatagaagcctcaagctcccagagacacaggaagcagaaagtcagtccacacatcagaggcgacttggaaaagctctaacacaataggacacttaaaaaaatgccaattatatagtaggggcaaatagtgtttcatgaacaggacatagggattctgtttgagaagaggcctccatgaacaaagacagggatatgcttggccctaaagggcccaccatatcttcccatttctgaaaggatagcagaacacacggatggagatgcaatttggggccagaatgcacaaggtgccaagtcttgcacagtaagacgcgtcacccgaattctgcagacaaagatgagtgtagctctcttctctacccttatctgaccctgtgcttacattcctcaggagggaaatgtcccagtgttttccctctatgacatccctgaggtcaccaaggccttctggggtacaagctggaaacctcagcactggctttaacattgttttagctggggtttagctgttgttagaaacccatacatgtgagtgcccattttattttattgctgctgggatttatttctaatcttctttgaaagattatgtttttctttggtttcataatgttggtttattctacttttaagtgagtcccttaaatagtttactactctttccttttaagataaacattcttttttttgtgaatgctttcatttattttgttttgggcatacctctatcatcctaattcttgaatttagtcttttacctttcttactcgtatctattttagtacatttaaaagtgattataggctgggcgtggtggctctcgcctgtaatcccagcactttggtggtggcgcagggggttgggagatcatttgaggtcaggagttggagaccagcctggccaacatgatgaaaacatgtctctgctaaaaatacaaaagttatccaggcatggtgctgtgagcctgtagtctcagctactcaggtgaggcgaagggcggaggttgcagtgagctgtgaccacgccactgcattccagcctgggtgacagagcgagactcttgtctccaaaaaagaaaaaaacaaaacaaaacaaaaacaaaaacaaaaatccccccaaaactaacaaaaaaaattatgattttgttttgaagaagacttaaaatatcttttcatttaatttaaacaaaattttatcttttatcctttactattttttctttattaaaatcacttatgaatttttgctatgtctacattttatgtttacctgttgcctcattcttttgcttatagaatatttttgaatattttaatattatcttttatttcctgatcactcttagcttaacctttttttttttttttgagatggagccttgctctgtctcccaggctggactgcagtggcgtgatcttggttcactgcaagctccacctcccaggttcacgcagttctcctgcctcagcctcccgagtagttgggactacaggcacacaccaccattcctggctaatttttttgtatttttagtagagacggggtttcactgcattagccaggatggtctcaatctcctgacctcgtgatccgcccacctcggcctcccaaagtgctgagataacaggcgtgagccaccgcgcccggccagtttaatcttttttttaattattgacattacagtggtccacaaagcaggatgccaaggggatgataaggggaaaaatcacaccatagacaaggggagatggagtctttgcagcaagtcacctcccggaattctaaacatttcccacccccttcagctctgatttctggtagaatttatctagataactccagaggtccacaggcaaaatcttccaagacaatagtaattctgttgtgcagacatttaagtcactagattgggattcttttcctctaacacttagcacacagtaccttgggcattacagattctaaaatatatgactcatttatttatcccactaatatttactgagcacctactacgtgtcagacacaatgctgactgctagaagtgcaacaaaaagagtaagagagagtgtggatccagtcctcagggagtgtacaatgtggaagaaagccaagtcctgatgtggaggatcaggaagagctttccagaggacaagagacatcttgggagctgaagatgtacaggaagtagctcagagattgagcagacgtccacgagatgaggggatgctgggacctcctaggagcttaaagaggctcagacttggaggaacccgatgtgagggctggagaggaaaggagtagaaccttcgaatccacatcagggaggctgggctttatcccgggggcactgggtagcctttggagaacttaagagcagggagtggcacactgggttccagaaggcagcccatggtaaccacggctagggaggaggttccacaccaacccagaagagaaacggtgctgcctgtaattagagcagaggtggtgggagtgtgacaggctggagggaacacagaggaattggggtgagtgaataaaattggtttggggcaagctatggagataggggagacagaatcaaggaaagacacacagatttcaggtcgtgcagcaggtgatgtctatgccagttgcagaaaagagcaggaggagaaaacgtgttgaaagagaaaggggaaggtggtgcatccagtttggggcatgaggcattagacgtgcccaggaactttctggggaagaatggcaaggatctggggcagtcatgactgggtcacagtcagcgaggagataggtatggaggctgatgagggaagaggatgctcacagggcgggaaaattgaggaacatcagtcatccaggttgataaaagaagaggagcttgcaaaggagaagagaggaaggaaggaaggaaacatgggcaggggggtcatgggagacacagagggacaatgtcccaggatgcatgtgtgctcacggcacatctggttgcaggaagtcaggtaagaggcgggtagaactccacgggaatcggccatgaggagagtgcgggtgatcatttctgaggggtgcaagaggcaaggccaggcatctgtcgttcaagacatgtggggtgaggaagcaaaggcagcaagtgtagacaacaatttgaggagtttgattgtgaagagaagcaagacaaggaagtagctggaggaaggtataaaaggatatatattctttttttcacagaaggaagggatttaagcgcacttaatacagagagaatggggccagaaatgagggagagaaggaaaatgcaggtgacagggaagataagagattgagattcccaagaacaagaaagaaatggattccagggccccaggggaggtgagcctcagacaggaactaaggggcttctttttttttttttttttctaagacagactcttgctctgtcacccaggctggagtgcaatggggcaatctcggctcactgcaacctctgtctcctgggttcaagcgattctcctgcctcagcctcccgagtagctgggattacaggtatgcgccagcacgcctggctaatttttgtatttttagtagagacggggtttcaccgtgttggccaggatggtctaaaactcctggcctcaagtgattcacccaccttggcctcccaaagtgcttggattacagatgtgagccactgtgcctggctggaactgaggggtttctttcgttgtgaaagaaaagaaggatgagaggatggattcagataaagtgaggcgtgcagccctgtgatccccaggtgggggcagttctgaatcgggaaacttgtactttctcagggaagcaggaggcaagacagctgctgagtgcgaggggacggcggaggcaggagcagctgtggagaagctgccgtgggaaggaagatcattggccagggaaacgtctgggagctggggaagacagagatcctagatggagtgggaagtcacagagctacggcatcctgaatttgcagagcggcgtgttttccgggagaactcatcagcctatgtgtagacactggaaaaagcagacagttggatttagctgtgatcccagtgaccacagagggggcaaagaaagtgcatcatctcacacaacatcaccaggcggtccttccccagcagcaagggaaacgctttagtggagggacagtggccaagtttatatttgtcaatgtcaagctgaaagctctctagtctgtataatgaacactatttcttcctaacctgtcttgctctttatgaaactgatgggtatatttcaaagtttataaccttcctaacaaaccagggacatggttgttattacatactccccttaagaaaatatcttcccttgataggtggggtggctcacacctgtaatcccagcactttgggaggccaaggcaggaggatcacttgaggccaggatttcaagtctagcctggccaacatggtgaaaccctgtctctactaaaaacataaaaattaaccaggtgtggtggtgcatgcctgtagtcctagctactctcgaggctgacacaataattgcttgagcctgggaggcagatgttgcagtgagccgagattgagtcacagcactccaacctgagcaacagaacaagaccctgcctcaaaaacaaacaaacaaacaaaccaacaaacaaaccaagaaacaaacaaacaggaaccaggtgtggtccttccctaaacagccacctaactaacaaactttgggaacacagtccctggaggtatggaaagaataccaccacatcagaagccaagagatcaggggtcagcgctagtaatttaatctgtgaccctagatcaagtttcttaacctgcacacctcagctggcttctctgtaagctgtgagacccacccaacatatggggctttctgaatgactgattcccgcgatccaggcccagggcatgaccaacgactgccttcccatcgctccctcttccttctagcccctgagctcatctgattctatgacttaaaggaatggtatagaaaactaaatgccataggtatgtaattttctttaatttttatttttattttaagttctgggatacaggtgcaggacgtgcaggtttgttacatgggtaaacgtgccatggtggtttgctgcacctatcatcccatcacctaggtattaagccccacatgcattagctacttttcctaatgctctccctccctccaatcccacctcccgacaggccccagtgtgtgttgttcccctccctgtgtccacatgttctcattattcagctcccacttataagtgagaacataaggtgtccagttttctgctcctgtgttagtttgctgaggatgatggcttccagctctatccatgtccctgcaaaggacagggatctcattcctttttatggctacatagtattctatggtgtgtatgtacattttcttaatccagactaccattggtgggcatttgggttgatgccatgtctttgctattgtgaatagtgctgtaatgaacatacgtgtgcatgtatctttataacagaatggtttatattcctttggatatatgcccagtaacaggagtgctgagtcaaacggtatttctggttctagatctttgaggaattgccacaccatcttccacaatggttggactaatttacattcccaccaccaagagtgtaaaagcgttcctatttctctgcaactttgccagcacctgttgtttcttgattttttaataatcaccattctgacttgcaggagatggtaactgattgtggttttgatttgcatttctctaatgatcagtgatattgagggttttttttccatgtttgttggctgcatgaatgtcttcttttaggtacgaacagatttaatgtgtcccaaaccaaatgatacagtttcatgaaataattacccttcctacatgaaatgcatcttaatattttctgttttattctatttcatgcttgttatcacccccaaaattaatgtcattgcccactagtagactgtgtcttggagtttgaaaaactgtgtagaaggcctgcttttgtatagctaaaacatatcagtgaaaacagaacggaaaatgttgaagcttatgccctaaaaatgctgaacacagctgagatgaacttctctcaaaacgacaagaacaacaacatttctgcttactttcaggacagacttggctcacctctgaacccctgtccttttggctaattcccatacatcttccatccccacccgcgataccttgtcctctgaaagcctttcctgaacctccgaatcaggacttggttcccttctacatgttctcaaagcacccaagcaatcatctacatatagtgcttagcacagcaaacggccgatagtgacaagtcaatacatgttagaatatattgccatagtttgtttactttttgatttttccaatagattgtacgcttattaggaattcttgcccacagggaaaaaatttcaggatgacaaggattctgcttctgcagatatttaaaccaccagatagaaatttttttcttttaacacttagccgcagtcctttaggtgttacaaggttaaaaaaagaaaaacccaaaagatgtgttcttgatatcagctaacactccagttaaaggcgaaaagagctaggccaggtgtggtggctcatgtctttaatctcagcactctgggaggccaaggcgggcagatcacttgagcccaggagttagagactagcctgggcaacatgacaaaacaccatctctacaaagtgcacaaactagccaggccatggtggcatgcaactgtagtcccagctactcaggaggctgaggccggaggatcccttgagcctcagaggcggaggctgctgtgagctgagatcgtgccactgcactccagcctgggcgacagagcaagaccccgtaaaaaaaaatgcaaagagccaaagagcagacccctggctgtcttgttgtctttccctcctagttgttcatgaattaagtgcccagtgaggagacagctgccaacgtataggtgagtttgcagtgcaagccgagtgctgtgagttcatgggcaggtaaaactctctgaaacgctggagagaacctgaatggcacttgtatacattggtagataaagcatttaaagggttcctcctgttcttagaaaaggatcaaactccttcgtatgacttaacgcaggacaactctacgggacagtctgcccaggacaatctgggtttgtacctgttacccaagcttagtgattaataacgtgctctttcactctataaacagtccccatctggaggataacgtatatggttcacctgcttacaggtcctatgtgatctggcacagctgactcctccagctccacccagcaatagcccacacactggcacatgctcctttctcgcagcatcactgctatcagagatcacaattttcttcactttgcaaatggagagaatgacactccaagaagttcactggttaaggtcatatggcaaattaggatggggagcagaggtttaaatggaagctgtgatgcttactctgctcatttccactcatctgcaaggcttagactggactgcactgggattccagactcacatgctgcagggacattctacaaacactgttcctacctcccagaacccccatctggctcactgccacttccccttcaggtctcagttgagccgtcactgacagctctgcgacaccccaaatctagctgtgcacataataccaagtgtgtcccctactgaaacacacaatcattctgcacatatttgttcacaacttggtatgtgtcaggccctgttagagtggctggggacacatgtagggacaaaatgccagccctcatggagtttcatgctagaggaaaaaagagacagaaaggaaactagcaaatataaaacagagttgcatgacattataaactgatacaaaatagtacaaatatctcatgaattcatcacaattcattataatttcctatttgcctgaccacatctccctgtgggttttgcagcacggtgtgtgatctgaggcttgcaacaaaggcctggtgaattcaatagcagtttccctttccattctctccattgtcctgggaacttgtcctgctctgataacatacaaaagataattatatctgtaactaatcttctaaaaagcatctgtcccacacattcagggttattaacactgatgccatgttcactttattctcaacaactactcatttctgaatcataaggttcctcatggaggtggagataaccctacctaccgggacattctgtttatgttttagggactgtcctttccatggcttccctagtccctcaggtgctgtgtgagttgtatttcctccattaattctacactagaaaaaggtgtatatgctcaagctgggataggaaataaacaatgaactcaggagtagcatcagcccagagatccctgccattgggcattcaatgattgggtaaaaagttaactatcagcaccttacaccaattagaaaggctactataaagaagatttttaaaaaagcccaggtgcggtggctcacgcctgtaatctcagcactttgggaggccaaggtgggtggatcatgaggtcaagagatcgagaccatcttggccaacatggtgaaaccccatctctactaaaaatacaaaagttagctgggtgtggcagcgcgtgcctatagtcccagctactcaggaggctgaggcaggagaattgcttgaacctgggaggtagaggttgcagtgagctgagatcatgccactgcactccagcctggcgacacagcgagactccatctcaaaaaacacaaaacaaaagacagcgttgctgagaatgtggaataattgggaccctttctaccactggtgggaatgtaaaacggtccagccactgtggaaaacaatatggcagttcctcaaaaaattaaacatagaattaccctacgaccccacaattctactgctgggtacataccccaaagaattgaaagcaggacctcaaacagatatctgcgtgttcctcttcacggcagcattattcacaataatcaaaagatagaagcaaccatcaacagatacaaggataagcaaaatgtggtatatccataaatggaatagtattcagacttaaaaaggaaggaagtcctgtccaatgctgtcacatggatacagcttgagaacactatgctaagtgaaataagacagttacaaaaggatggatactgtattctgcttctgtgaggtccctagagcagtcagaatcttagagacaggaagtagaagggtggctgccaggggctgagaggaaagacggatgaggaacgaatgttccacgaggacagagtttcagttttaggagatgagaagaatcctgtggatggatgatggcaatggttgcaaaacaatgtgaatatacttaatgtcactgaactgtacgctagaaaatagttaagaagttaaattttaagttatgtgtattttaaccacaataaaaaagttaactggtaggtcacctgggactgcggtttaaagcaaatgcttgatggttagactaatctggatggtccaactaacctgactctaccactgactggttataagacctggacaaggggctctaccccttgagcctcagtttcctcatctgaaaaactggaataataataatatctaatttataaaggcttttggaggttaaatgaagcagtaatgcctcttacatataaataaaattctgagtatgatatacagcacataaattctaaataataaagactcaaaaccatatttcattggttttgttgatgctgattattattattataattaatactattagcttaattcaaaagctaacatcaacctacagcaacctgcagaaagatgtcctgccaaatacttgctaatttaatccaggagcaaaaatctatgattctgggcttgagtgagctttcctaattttaaaactctgatgctcattttgtccccaagaatgtgtttagatgacagagcaatcagaatttgacatgtataaatgcttggcatgttaaaataatgaaagatattttcaccattgtaaggaaacagcttttaatccatctctctggttcaacatcacatttttctatagtttctcatgacttcttccttaacaattggaataggtatgaaaaagctgagctgaacacatagctgcttagaaatgagctgcttaaagtgttaaaacaacagaaacagcaagcatgagtttaatgctatgtatgccgtcacaatactaatttctctattttaaattacagattacacacacacatacacacacacacggaatcacgtctatattgctgggattttcattatataacaatatatcattttaaatgatttgaggcaaattattgaaaaaaattaaagactgaactccataaaaaggaaatcacctgaaatcaaatataaccttgttaacaaaccagcacattagcaacatttttaggggcaacaacataatcagcaactctaagacatcaatcaaatgcattaaaaacaggaagtactaactctaattcctaatttccagaaaggcaaatataccataattaaataacacgttataaggagatttgtctgtgtaggtctacttctgaatccccgaagttacatacttgtaccacaagcccatactcttgaaagaaaattctggacccagtccacatggaattttggttaaaacatctaattcattgcagagaagaatttagtcttttccacggaagagacagcatgtgttagaatgagaatactttatagaaatgaccagtgacaagccggctatgtaagggggcttctgatgcctggcgttaacaagagacagagagtattattgttgaaagggatctttgagattacagaaggagctgaggtgtgaataatcgaacaccatccccttgttgcctgaaggagaagtgagacagcaaaacaaatcaaatttccaggagctgcaccgtgtatggtgagcgaagacgcaatgaggacatgtctgtaggagaacagaggtagaagttagctcctcaagtaacagttgccatcccgaggcaccacagcacaagacagtagcggaaatgaacatgacaacgcggatggtgggtgacaagagtcttgcctggatattgacatttttaaagtgtagaagaaaatcgcaggtcactgaaacaaaggctgatggtgcccagcaggttactcttgaaatcagaaacagaagttcatgagaggcaagaagacagaaacaacaactgaaaaacttagagtggatcgctaacttgcaggagctgtgcagctttggctttgcaggttttagaagctctccctacgccacgtctttaaatatatgtatgttcaatcagcaggaggaagggactaacaagagccttctgcggtaagcacctgcatcaaacaatggcactgatctcagagggattttaaacagctgtgcataaacttcaaaagtaatttgcaaccatattagtaaatgtcactcttcttcccgctagacacagcacttttaaaagagattaagcatccgcagtaagcctgccattttacaagggttaccaaagataagttagggaaaatatgaagatgatgattcacaaggtcggggtgtggggtggggtgggggacccaggaccttaggaatagggcttgtctatcacacagcctcgggcaagaagggcccagtggggaccatggcttctagggagcaaaccaagggaaaagagcaacggagtggaccctccaggcttcttgcctctctcacggagcctcacgaatcccagtggtttagaattttctttggcaaaagaaaaggtcaaagaggccggagttgacagaaagcatgggcggacttctcagatcttgtaggtggttcttaaaagaattcagcaggcttgaggtgtgctctcaaagggcaactggaacgtcaaggacttggacaccaggcacagatggttcatttcccatggacaggaagagggcacggagtgctccctcttccctccaccttctccagcctagtccccctcagcctgtgccactcctgaatcatcttttatagcaccacgtccagcccgcacaggggcaggacagcccagggaacaaggcagtcctgtggcgctctccttgcagaaatgaccggagtctcccaatccagccagcccgtggacctctcttcatgcccacgggggagtgcacacgcctgtagcattcaacagtcactctcccattgataacggtggctctcgaaaatccaataccacaaagatactttattgcacaaactttgcttggttaacctggccctcaaagctggggaataacctcacttgaggctacaggaatgagcacgcagatttttcttttttttttttttttggtatctttcaaagacctgcctccccctcccccaggcccttgaccagaaacttggcttgtttagaagcctgagcaatggcacccccgtccgtgctccaatacattcccagaaaaggggttatgctcccctgtggacaggataccatctccagaaaacatgtttcctcacgcattttttttttttttttttaccaagaatacaaaaactttccaccttcttccctccccgcaggccccctttcgttcaggtgagaaggaaaagggagaagaaaggaggaagcgcccccaggccggcggcccccacccggctaaggtcgccagcatcccgcatcccgtgcgacctgcgtcccagaaacccagcggggaaattcttcccggtgcgctcttgcgcccgcttggttccatttcctactccgcctgctcacccggcagccctcaccccttcccggaggctctccgaggggcccgggtagcccttctcgccacgggtctcggcccctccagcccgctccctcccggcggcggcgcggggcgcggggccctacctggagcgagcacggcgccgctgctgcccggtggcgctgggactgcgcggggactgcgcggggactgcgcggggactggcggggctggcggggctggcggggctggcggggctggcgggcccggcgcactgcgggtgcgcctagaaggcggtgcccgccagggggcgctcgccagcctccccgccagcccggcctcccgggacccggcacctctagccagggacgcgcgctcggtcccccgccgtgcgcccccggtcccgcgcccaggctcccgcccctggcctccttaccagccacttgtcgcccagctgcgaactggagcgggaggcggcggccggagggcccaggacagccccgggagggcggcgaggcggagcaggagcgccccggctccggccacattctcagagtcaggaaaaggggcgagaggccacatgtctccctctcgcccaactgaaaacgaaacggcgctccagcagattgggtggaaagagctgggtctcttttctctgtttttcacgctagaaagggcttgtaaacattgttccttttaaaatgacctaccccaggcatttgtttgggcacacttctgtcctggggtcatcgttcctaggtggcttcggacctgggacttttcctgtatctgcacattgtcgttttatacacaattgccaaggtgggactgctttcaactttactgtgcttgaagctgcaaaggtaatgttgccgccgtgcgtgtcattttaggactttttatgccttgcgggtaatactaatgatggtcacagggaggataaacggggtggtttctttttctatactccatgtaactaatttctcattcaggttagaaaattatatgtctggttactaatattcttactgaatggtttccttgcaatgatgacaccaaataattaaaacgtacttgattaagacttttgttgctgtagtgtactaagatcagattaatctgagaagtaaaatagtaattttttgtccttttttcttttcttgttttgagagagacattaaaaacgattaaaacaaaacaaaacaggccaggtgcggtggctcatgcctgtaatgccagcactttgggaggctgaggcgggtggatcgcttgaggctgggagtttgagaccagcctggccaacatggcaaaatcgtgtctctcctaaaaatacaaaaattagctgggtgttgtggcacgtgccagtaatcccagctactcagaaggctgaggcaggagaatcgtttgaacctgggaggaggaggttgcagtgagctgagatctcaccactgcactgcagtctgggtgacagcaaaactctgcctcaaaaaaaaaaaaggtttaacaaaagccaaaagttgaattagcagccttctgatcatgggaatgtaggatgtcaactaaaaagaacctcagaggttgggaaggcagatgaaaaactgaggccccgaagtgtttcaagacttgattaaatcactcaggtctgcactaggaagcgagttatgatgatgcccctaatctatatgaacccaaataaagccaaaacacacacaccttttaaggataaaactatattccattaaaattagccccgcatttgtcaatatctaacagcattggactgaccctcaggccagaggctgtagctcttggaagatcctagccaggaggtttgagagtggccagtacctcggaagtgctggctcactctgacatcatcagaacctggcatacagtaggcgctcattgggtatttgctatggaaattaggcaggaaagtgcgtctgtgtctggaaacaaagaggcaaagcttaagcagtgatccccatgcagattctttctgcaaactacaaaacagaagcttccctagttcagactgccatccatctggctctttctccaattgtttttcagcggatcctgttacagtgcaaagaagaaatggcaaacggataacagctactgtgcctagaagatggtagattcctcacgctccatatctgggtttctcattgacaattaggcactgaaaggaagctcatatgtcctgttaatttaatcagtagttagtggctttagaaaaagtttcatatatacaccaggtatgataaggacttttttttttctttttgagacagagtcttgctgtgttgcccaggatggagtgcagcggcgtgatcatagctcactgcagttttgatcccccaggactcaagttatcctctcacctcagcctcccaaatagctgggactacaggcacacatcaccatgaccaagctaatatttaaaaagatttttttgtagagacggggtctcactatgttgcccaggctggtttaaaactcctgggctcaagtgatgctcctacctcagcttcccaaaatgctgggattatcggggtgagccaccatgcccagcctgtgatgactttagacgcactactcatataatattcataatctgatgtgatatgtatcatcatcattatcatctctctttaacagaagagactaacaaggcttagaaaggttatgtacctcgctcaagatcccacaattactaaagtaccagaaccaagattcaaacccaggtcaggctggagccaccatctcaagagctgctgaataattaattctccttttttttttttttttttgagatggagtcttgttctgtcacccaggctggagtgcagtggcacaatcttggctcactgcaacctctgccttctggattcaagtgattcttcctgcctcagcctcctgagtagctgggattacaggcatgtgcctgccaccatgctcagttaatttttgtattgttagtagagacgggtttcaccatgttggccagggtggtctcgaactcctgacatcaggtgatccgcccacctcagcctccgaaagtgctgggattacaggcataagccactgcgcccagccaattctccattcttacatcgtacactcagttttctctttctttctcttttggacaactgatctttgaggactcttggctactcaattgtcctataatcgtatagtcctacaacaggaaacccgttaacctgaagatcagatcttttaaaacaacatccatcatatatctacaaaattgggatttttttatcgtaaaatttcatctaaaacaaaaaattcacatctgttcttggtatccattaggtgtagtggacacctctagatattcttgatgccagcatcctgtagacccgccatctcctttcccaggccatggggtgtttctgttttctattagacactgtctcttagttatataaacgtggctgctctcagaagttctccacacctttgtttcctggaagaggaaatggcatttcctggaggggatgacacgtgggcggtgaggttccactcactacgttaaacacaccctaactttcagctgtgtacttcttttcctctttcaggttctgccctgatgtttcctggaataatgctgaggactgcctttcgggtagccgccctattcagttcacttcatctcggaaatacctgacccctgccttggatccagcggccctcctgagagctgaggaaggaggaaatcctatgtgtctgctcccggagctgccacaacccatcttcccacaactcggaacttggaaaaaggaacccaggacacgactttgcttttcttttggacctagttggtgattatactctgtctcccatggagaccacgtcttgcatccttccttctatatgggatttaggatagaaattaaaaagaaaacatattattttgagtcttgatttggagaaaggtagtattcaggaggaagtaggctatgatacacatagaaaatttgaggacagtgttacttaacaaggacatttctgtctctgcagaagtcacagcttggaggaaaccagtttgcactatttgatgaggaatttggccaccaaaccactgatactttcccaaaggtttggcagaaattgttttttgagtggctcaccagagtacccagaagaatcagtatggaattagaggacagtggcctaccctaaataaagacatgagtgatgtataaagtctagtgtcaatttattcagaaaatatcaaaattattctgggagctatgggtcaaagttgataggcacaaacaaacaaaaacgaaaggtattttaaattcacagcttggataagtaaaagggagatgttgtcatttctcttcttcaatccaactttagattttcaagccggaaaaagggtaattagaagttagaaattgttattgccagaaaatagctctaaaccctgaaaaaaaaaaaaaaaaaaaaaaaaactgaccctcctcttggggagtgataaacctcaattactgttgatagtaaaactgatatcaactcttcgaaaccagtgaaaggtgaatggaaaccttaccctaggttaaggtttaaaaaatgttcataatatatatttgaaagttccattatttaaaatattcattagacatgctttgtaatgttaagttacttcaaaaaatcttacacaagggaagggaagtatgtattattccttcatttaagagaaagataatgtgtgaatattagttaatatttatcgtacatttactacctgtgtcgaagcgtagtgttacacacttaatttcaattatttaatttgattctaacaatgaatcccctgagatggataatatcctcttcattttacagatgagacaattgagacttaaaggttaaacaaatgatttcctaagctcattcagctaataaacggtaggggactgcttgacaccagtccagttgaccctcaaatccatgatttctgccaccatattcacagaaacaagacaagagctgaaaatatagcctgactcttgaaacagtcaaagaattgtgtatgtttatgaaagttctgattaataagatattctgaggacaaaagacaaggcatgggtagaggggcaatgtgtagattagaatgtatcacaatgcccactaaatagtaaaaccatagaaaatgaaatttaatccttactgtgtagaatatttagagtagattgttttttcctcggtgtcaattactattacaactatcaaagaatgaaattaaacaagaaacggttcctttggtttttttttttaaaggtgggagttataaaaacagtatttgccatctggttttagttatggctgtggaaattctatgggtacaatttgttgtcattgttgttaccactaccaatacagagatgctaattgtaacatcagtttctaaatcagatagtgaataattacattttcaatgttttcttaacatagatacaagttaacaggatatgcttctggcctgtttctggattctaagggtagaaccagcataaaactagtcagtccaagtatttctaaagatccacagacacagttctcctggatttgggaagcctagagatattagcacaataattaaggcccaagtgagtataaaattttatctgaaattgaagagatattgattagataatccacagagactactttttagtgattatcttccaccagggtaaaagcaacagcagcctgaaaatgcaaaagaccatacattttaatggtaagtcctccccaggaaggattaataaatctcaggaggaagatttattatctgtaaatccaggaggaagaaatcaagatgaaaactatcatatttataaatttgattgttgcaattttatagtttgacatagtgcaattgctttagatttgaaggggaacttactttagagtaagtcactcaatctcttttttggaaaggcaaatgccacacctgatcctcatcactcccttctcctttgtccatagcctggctttattctgccattaacacacacacacacacacacacacacacacacacaaattgggaagaggatttctcattttacagaaagtatgctgggctacacaggatattctatcaggtttcttccagctataaaattctgagactaaatatcaaattaaagaaagtactaattgtcagcgatgggggatgtactgctatttgcttctagtggtactcactgctcatttcctatattcactggtataaaaaaatttcaaacaccctcaaaaaagcctatactggtggtaccaggaaaacgctgaaaatcattactttctgtgtggtgtccagctcttttggttacatcatcacttcgaccattcacttttaaagaaaaacttttgtggaacaaaaatataaagatttattttttttcttggtggcttagcacagtggcctaatgtggctgaccatgtgcacctgttgtgtgagtcacttagacgtgctttgtttcttggtcacagttgatccctcaactcaagcatctcaccctcaaaatgtttgtttgggacccaagaggcaaaccttgagatgggttatttctttcaccttggattggctcatctgctgggagtggagccaagctgacatttcctttcctttttgtctgcctatcactacgtagaggcagcacataagagagggaaagccatgcgcgtggagtccagcacatcacccagaaggcagatgttctatctccattttactcattaaaacaaacaaaaccacacctggattgcctggtacttaaataaaatgcactatgatgattgaagaaaaatatcttatatttaaggaatagttttaatagcttacatctgtatttctattagcttccgtttctatttttaatatttgtataatattaaaagtaattttaaaaatgaactaatctttttacatctcttatgagaatttaatggagatatgatgtttgaagatcaaagatacgtggtatttgaaatcagaaaatgtgtttgcttttctacacagattacaaatatcatgcattatttcacaaactcttctcaaagtgttgattttaaaattagtaaaaggagggtatattcatatcacatcctggcatttttataggcaagattgagcagctataacctctaaagtgctttgatccctataagcctcaagaagagaatggtgcaatttgaattaataactacccattatagagcatttgtatcacagtattttccaaatactatcttatttaaccctacagcaatcctatgatatggggattatgtacacattacagatgagaacttgaggctcggagaaagtaaataacttacacaagatcacaaagcaagtgactgccagagccaggatcagaacccagtcaggcttcattaggagctctgctgaactctgtctagagaattctcaccacctgctgcaaaggctaaaagaaagggtcatattccacatgtagattttgagaaatatttgttatttttcttatgataaaggttatgcatacacactcacacacacacacacacacacacaactagaaattacagaaaagaaaaaagattagccagaatgtcaccacctaaagacagataatattttggtgttttcaaatattcttttatctatacttttttgaattattttattttaaaaataacttttactggttgcctgattatgaagtaataaatattcaccataaatattttgaaaaatataaaactgtctataaaagaaatttgaaatgattgctaatctcaaaatatagatacctgtcagtactttggcattttatcctccttgtggctgaggtcacatatcttgagactgaagcacaaaatttctataccatacagtttatagtttaggccacaacatcatttttaaaattgtttctttggtttttacttgatttgctgatgttttattttttagaaaattgcagatgtgatttttaggcagctgattggaatgttctggttgctctgaataggactagctactttgttttttactgaaggacaaatattattcctacacacataaaaaacctcaaagaatgagtaatgatactgtttaaatctgcccttataactccaaagaatgacttcaaattttctttcttccaaagcaacttttaaaagcctttccactgcacagtgaaagaaaaccacaaactccttgtttaataagtgggatcacgtgcttttaacacgaggaaaaggtcaatctgaagcaactgatatggaactgccagagtaggtacgtaaatttaggagttacatcaatttgggagggctgcagaaatgtggatcagattttaatcacactgaggaagtttctttgagcaaaagacgtgatggttgttctctagaacctttctgtcctgtccgttgctttgccaagggagctagaaaagaaataaacatttaagaacttaaaaggcttctggataaaactcagcttggtgcaacacattttagctatcacagctttactcccaagcttccacctttcctaggagcgcagtaaaaacctgagccaaagaaaccaaacaatagaactgaaattctttaaacttgagttcttgaggttatagtctttgtgcactccataaagtcaaagccctaaaaagatttttagaaaacaaaacacttgtatctgtatctatttccccaaacctctctacatttacttaccttttgcagactcatgctttctcttttccttgtgattgcatttggatagaatgaagacctctcctacagttctcaacttaaattctttcttttatttcttagctacgaaagaaaattcaaaaaattcaatgctctactttgtaactccctggacatagtgagtccattatgtacatcatgaggagggagtggagaaagtggaattcttatgtaaattcatacagctttggaaaatggtttagcagtacctactaaagctgagcatatgcaaaaccagtgacccaggaatgtcatgggtacataacctacaaaaatgtagacagatgcgctaaaagacatgtacaacatgttcactgcagcccagttcatcatcaccccaaagtggaaacatctcaagcgtccaccagctggaggctgcacaataaaactgtggtactttcgtcggtagaaacatgccacagcttgaacacacgctgaaaacataacgtcaagtgaaagaagccaggtcccaaaaaaagacatactgtatgattgtatttacattaagtcccaaaacaggtaaactgaattcatgcaatggaaagtcatgagagtagctactgcatctggggaggcaggtggtggagtgccagggaaggagcaccaggatggctcatggtgctatttttatgacttgatgtaggggataggtaataggtaggtccactttggaaaagttcatctagctgtgtatttgtgacttgcagtcttttctgcatgtgtcaattccagtaaaaagattacttgaaaatcaagtataatattattgtatttacaaagccctttctacgtagccagaaacagggttggtttcccaggtgactgagaggtcgtcaggagcttagtgagtggagggcaggggacaagtgtgttcattctctctccctctctctctgctgttctgtaaggtgacaagttaggcttactgccagtgtgaccttaaataagccatgcatgctttctgaatccttttttcttatttggtgagtgacgtgctagttaaaatggtgtctccagccctttcccgtcctcgctgctgtgattcaagccccctccttctctgtggggcttcctccgacctctcgatttcactgtcacctttctctcttcctctctctcctgcttcctccctgtccacccccatctctgtccccccagggccgagtttgttttatatctcttttggtatctcctctggttttctggcaccatgtcttacgtagagcaaataataatgctttaaaaaattctcgataaaggaaaaagttcagtaaagtgtgaatttcacattgtagtcagtggttaaatgcctcaaacacttaaaaagtagaatttatctcaacctgggcagaaggcagtccatgccaatttctaaatggaatccaatagcaagaatgcacaaag

SEQ ID NO: 1165 - DNA, 129408 bp, Homo sapiens
ataagaacgtcacggagagtggggtatccatcctctcaagcatttatcctttgagttacaaacgatcagattacattctctaagttattttaaatgtacaattaagttactattgactgtagtcaccctgttgtgctgtcaaatggtcttattcattctttctatgtttttgtacccattaactaccccacttaacctgcagccctctactacccttcccagcctctgttaaccatccttctactctctatgcccatgagttcaattgttttgatttttagatcccacaaatacgtgggagaatgcaatgtttgtctttctgtgccaggctcatttcacttaatataatgatctccagttccgtccatattgttgcagatgacaggatctcacttttttaatggctgaatagtactccatggtgtatatgtactacgtttttttatccattcatttgttaatggacacttagttgcttccaaatcttagctgtcataaacagtgctacgacaaacataagagtgcaggtatctcttcgatatcctgacttacttccttttgggattgctggaacatatggtagctcaatttctagttttttgagggacctccaaactgttctccatagtggttgaactaatagtttacattcttaccaacagtgtgcaaggattcccttttctccacatcctcaccagcatttattattgcttgtttttgcatataagccattttaactggagtgagatgatacctcattgtagttttgatttgcattcctctgatgatcagtgatgtgtggaataccttttcatattcctgtctacaattcgtatgtcttttgagaattgtctattcaaatcttttgcccattttttgattgggttattagatttttccctataaatctaatagtaaatagttgtttgagctccttatatattctggttattaattccttgtcagaggggtagtttgcaaatattttctcccattctgtggattgtctcttcactttgttggttatatcctttgctgtgtggaagctttttaatttgtgatcccatttgtccatgtttgctttggttgcctgtgcttgtgggatattactcaagaagtctttgccagaccagtgtcctagagattttccctcaatgttttcatttagtagttccatagtttcagaacttatatttaagcctttcatctattttgatttgatttttgtatgtggtgagagataggggtctagtttcattcttttgcatatgggtatccagttttcccattaccatttattgaagagactgccttttccccagtgtatgtatgttcttggcaactttgtcaaaaatgagttcactataggtgtgtggatttgtttctgagttctctattctgttccattggtctgtgtctgtttttatgcctgaccatgctgttttggttactgtagctctgtactgtaatttgaagtcaggtaacatgattccaccagttttgttctttttacttaggatagctttggctattctgggtcttttgtagtttcatgtacattttaggatttttttttctatttctgtgaataatgtcactggtattttgatagggattgcattgactctgtagattgctttgggtggtgtggacattttaacaatattgattcttccaatccatgaatttggaatatttttccttttttttttttggtgtccttttccattttgttcattggtgttttatactttaatataggaatttttaaaagtataatttaggaaggattataaaatatctctgtaagaggtttttctttagggtttggttgtgtgtgtgtgtgtgtgtgtaaatatcggggtagagaggctttgggtgtttgcatatgtctgtgagagaaaaacagctttttggtggtggggtgagaaaaaggagaattttattcaaagaaataaaagtagcatacagtctttcagaaatatgtaatgtgaagcaaatgcataatggaagaacttagaacaggaaaggattagtcttcagctttacagagaaaaagaaaaatctgaaaaacatttttcaacctttgtagtttcagtgttacgtagctagtttatatttagatgattttctgattttgagacattaacatttttgtttatcatttgtaggtttttagaacgactgttcgagcgacatataaaacaaaataaacatttggaggaggtttgtctttccttataacttcattagaaaaattataatgtaaaaataattgtatggtttttttcataccttcaaacaatacattaaaagcaagtgctttttttttcccttgaacttttttgagggtggtggtgggagaagtgaaaggaaaagtattaatcctgtgagattttcagcactgcagtcaaaatttaatttgactcaattaatgtaattagtctcatcttttcttaatcctaggaaaaaatgcgccacctgctgcatgtcctgaaagtagacttaggctgcacatcggaggaaaactcggtaaagcaaaatgatgttgatatgttgaatgtatttgattttgaaaaggctgggaattcagaaccaaatgaattaaaaaatgaaagtgaagtaacaattcagcaggaacgtcaacaataccaaaaggctttggatatgttattgtcggcaccaaaggatgagaacgagatattcccttcaccaactgaatttttcatgcctatttataaatcaaagcattcagaaggggttataattcaacaggtgaatgatgaaacaaatcttgaaacttcaactttggatgaaaatcatccaagtatttcagacagtttaacagatcgggaaacttctgtgaatgtcattgaaggtgatagtgaccctgaaaaggttgagatttcaaatggattatgtggtcttaacacatcaccctcccaatctgttcagttctccagtgtcaaaggcgacaataatcatgacatggagttatcaactcttaaaatcatggaaatgagcattgaggactgccctttggatgtttaatcttcattaataaatacctcaaatggccagtaactcaatattacttttcttccttttttaaaatgtatgtataagatttctctattggttttctgtgctgcaataataagttaccagaaacctagcggcctaatgtgccacacatttattatttatcccacagttttgtggatcaggagtgtaggcacagcttagttgggtcctctgtcctgggtctcacaaggctaccccacaatcaaggcagtggctggggccatgttttcattaagaggcttgttggcagaattatcctccttgcagttatagatttgagggcttcgttgtcttgctgaccagtggctagaggctgcctatagttctctgccacttggccctttccttagggaaattataacgtggctgcttgcttttttaaggatatcaggaaaaccagagagattctgctaacaagatggagtcttatataatgtaacataatcacaggagtgactttctatcacctttaccgtgttcttttgggtagaagcaagtcacaggtcttgcccacacttaagggttgggaatatatacaagggtgtgaatgccagaacacaggaatcactggggtcatctgaggacctgctggccacaatttctaaaatcacttttcagaggaaaacatattttacctatattttcagaggaacatattttacccagacataagcggttttgtaggctatgggaaatggtttatgatctggtgtgagtcttgaagcgttggaccttgtctgcaatatctttaattttgtttttctcacttttcctgcaatatctaaagcctcaaggacctttcagttgtcagtgacccagggaattctgtcagctggctgagatgttgtctcttgttgtgagtgcaaacatttagtcagacctgtctgaagccctctcctacccttgtagctcatgaatgagacccttactattagaacatggcccagcagattcatctctaattatacctttttaactatttacaataatataattgaatatttgtgtgcccattatgtacaaagtttcatgcctagatactgtggaggataaaaacaataacccattttgtttttataagctatattttaattttatatttaaaaaaatacaacccaggtattcttctaaaaacttaacagtgacttccaagtatcctgttctttaactcgggtttttatcatcctttggccatagcagtgtttcccaaagggtggtacttaccactggagacctgagagttgattttagtggtatgtggatgacaggtccatctcattcatgggatgctgaccatcaccactgtcttcaggataagacacaggtacaacctgcaaagcacaatatggtgggactgagcacccaacccacttttcacctccactgtcggaatccccaactcaccctgctacaacccttttttggcacaccttcccctcagccctcacctctggacttcttccctttaaccctgtaagcaacaccgtctatcccctcttgcagtcctcttaaacctcctgaaataaccttggctctattcttggtccccagcctgggtctccccatctgttagatctttacccctctagttgcttcttgggttctgttgttcctcagccccagggttcctttcttcagtcccagcctcactctttcacaaaccccctcttcccattccccatgtaactaccccagacctactggcctggcccaaattttccttccttggctggagctaccatctgtctttccggaggcattctcagaaactatctcctggctgctgttctccaacactttggtccaagccccagacctgccctatttgacattcagtcttcatgctctaactctgggtacagcttcttgtctctggggccatgacccatcctaatttggatacctattaggacaatttgttgttatcctttagtttccctttaagttttaaaaggtgagttgatttaaagaaatattaaaaatggttcttgaatgtggcaaaagtattatagtatgaaggtaggatgtgggtggtaagtttgggaaacagcacttaaactcttctagcagcatctttttttatccctaagacatcttgttacagcatcaagcaacatctttatatcttcccctcttccttctcacacagcccatcaactgaggctgagaggcatgatgaatgcgagtgtgtcttctgagccaggttgcctggatttgattccttttgagctgtgactttgagctgggttactgagcctgtgtgtgttttctcatatcttggagaggggtaattatagagcctttatcatagaatacaagaattaaatgagcttgcatgataaatacaggctgctgctacttttttttttgctatttattttttatttcagtaggattttgggaacaggtgatgtttggttacatgaataagttcttcattggtgacttctgagattttggtgcacccagcacctaagcagtgtacattgtacccaatgtgtagtcttttatccctcactccccgcctaccctttcccctcagcccccaaagtccattgtattattcttatgcctttgcatcctcatagcttagctcccacttatgagtgagaacatacaatgtttggttttccattcctgagttacttcacttagaataatggtctccaattccatctaggttgctgcaaatgccattatttcattcctttttatggctgagtagtattcaattgtgtgtgtgtgtgtgtatatatatacacacatcacattttcattatccacttgttgatcgatgggcatatgggctggttccatatttttgcaattgtgaattgtactcctataaacatgcgtgtgcaagttatcttttttgtataatgacttcttttcctctgggtagatacccaggagtgggattgctggatcaaatggtagatctacctttagttctttaaggaatctccacactgttttccatagtggttgcactagtatacattcccactaacagtgtaaaagtgttccctgttcaccacatccacaccaatatctactatttttttattttttgattatggccattcttggaacagtaaggtggtatcgcgttgtggttttgatttgcagttccttgataattagtgatgttgaacattttttcatatgtttattggctatttgtatatcttcttttgagaattgtctattcatgtccttagcccattgttgatgggattgtttttgtttcttgctgatttgtttgagttacttgtagattctggatattagtcctttgtcagatgtatagattgcaaagattttcttcactctgtgggttgtctgtttactgattatttcttttgctatgcagaatcattttagtttacctaagtatcatctgtttatctctgtttttgatgcatttgcgtttgggttcttggtcatgaacactttgcctaagccagtgtctagaaaggcttttctgatgttatattctagaatttttatagtttcaggtcttagatttaagtctttgatccatcttgagttgatttttccataaggtgagagatgaggatcgagtttcattcttctacacgtggcttaccaattgtcccagcaccatttgttgaatagctttgttgacagtcagctgactgcaaatatgtggctacatttctgggttgtttattccattcctttggtctatatgcctgtttgtttgtttgtttgtttgtttgtttgtttttgaggcagagtctcactctgtcacccaggctggagtgcagtggtgtgatctgggctcactgcaacttctgcctcctgggttcaagcgattctccgacctcagcctcccaagtagctgagattacaggcacctgccaccatgcccagctaatttttgtagttttagtttgtagtttgtaattttagtagagacggggtttcaccatgtgggccatgttggccaggctgtctcaaactccagcatagaaggtatgttccttctatgctgattttgctgagggttttaatcataaagggatgctggattttgtcaaatgctttatctggtctattcagatgatcatgtgatttttgtttttaattctgtttatgtggtatatcacatttattgattttcagatgttaaaccatccctgcagccctggtatgaaacccacttgatcgtgatggattatctttttgatatgctgttggattcggttagctaggatttcgttgaggatttttgcatctgtgttcatcagggatgttggtccatagttttgtttttttgatatgtcctttcctggttttggtattagggtgatcatggcttcatagaatgatttagggaggattccctctttatcttttggaatagtgtccataggattggtaccaattcttctttgaatgtctgatagaattcagctgtgaattcatctggtcctggaatttttggttttttgttagtaatttttttttttttttttttgagatagagtctcgctctgtcacctaggctggagtgcagtggtgcgatctcagctcactgctgcaacctctgcctcttggtttcaagcaactctcctgcctcagcctcccaagtagctggaattacaggtgcctgccactgcgcccagctaatttttgtatttttagtagagacatggtttcaccatgttggccagactggtcttgaactcctgacctcgtggtccacccgccttggcctcccaaagtgttgggattacaggcgtgagccactgtgcccagcctatttttgttggtaatttttaaattaccatttcaatctcactgctcgttattggtctgtttagagttttctgtttcttcctgtttaatctaggagggttgtatatttccaggaatgtatccatctcctctaggttttctagtttatgcatgtaaagctgttcatagtagccttgaatcatcttttttgtttctgtggtatcggttgtaatatgtcctgcttatttcttgtatttatttatttatttattattattatactttaagttttagggtacatgtgcacaatgtgcaggttagttacatatgtatacatgtgccatgctggtgcgctgcacccactaactggtcatctagcattaggtatatctcccaatgccatccctcccccgaccccacgaccccacaacagttcccagagtgtgatgttccctttcctgtgtccatgtgttctcattgttcaattcccacctatgagtgagaacatgtggtgtttggttttctgtccttgagatagtttgctcagaatgatggtttccagcttcatccatgttcccacaaaggacataaactcatccttttttatggctgcatagtattgcatggtgtgtatgtgccacattttcttaatccagtctatcattgatggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgactttcacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatatctctgatggccagtgatggtgagcagtttttcatgtgttttttggctgcataaatgtcttcttttgagaagtgtctgttcatgtcctttgcccactttttaatggggttgtttgtttttttcttgtaaatttgtttgagttcgttgtagattctggatattagccctttgtcagatgagtaggttgtgaaaattttctcccattttttaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcctgaactgattttcgtataaggtgtaaggaagggatccagtttcagctttctacatatggctagccagttttcccagcaccatttattaaatagggaatcctttccccattgcttgttttcctcaggtttgtcaaagatcagatagttgtagatatgcggcgttatttctgaggcctctgttctgttccattgatctatatctctgttttggtaccagtaccatgctgtttttgttactgtagccttgtagtatagtatgaagtcaggtagtgtgatgcctccagctttgttcttttggcttaggattgacttggcgatgcaggctcttttttggttccatatgaactttaaagtagttttttccagttctgtgaagaaagtcattggtagcttgatggggatggcattgaatctgtaaattaccttgggcagtatggccattttcacaatattgattcttcctacccatgagcatggaatgttcttccacttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatccagagactttgctgaagttgcttatcagcttaaggagattttgggctgagacaatggggttttctagatatacaatcatgtcatctgcaaacagggacagtttgacttcctcttttcctaactgaataccctttatttccttctcctgcccaattgccctggccagaacttccaacactgtgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagtatgaaaggttgttgaattttgtcaaaggccttttctgcatctattgagataatcatgtgttttttgtctttggttctgtttatatgctggattacctttattgatttgcgtatattgaaccagccttgcatcccagggatgaagcccacttgatcatggtggataagctttttgatgtgctgctggattcggtttgccagtattttattgaggatttttgtatcaatgttcatcaaggatattggtctaaaattctcttttttggttgtatctctgtccggctttggtatcaggatgatgctggcctcataaaatgagttagggaggattccctctttttctatggattggaatagtttcagaaggaatggtaccagttcctccttgtacctctggtagaattcggctgtgaatccatctggtcctggactctttggttggtaagctattgattattgccacaatttcagatcctgttattggtctattcagagattcaacttttcctggtttagtcttgggagggtgtatgtgtccaggaatttatccatttcttctagattttctagtttatttgcatagaggtgtttgtagtattctctgatggtagtttgtatttctgtgggatcggtggtgatatcccctttatcattttttattgcatctatttgattcttctctctttttttgtttattagtcttgctagcagtctatcaattttgttgatcctttcaaaaaaccagctcctggattaattaattttttgaagggttttttgtgtctctatttccttcagttctgctctgattttagttatttcttgccttctgctagcttttgaatgtgtttgctcttgcttttctagttcttttaattgtgatgttagggtgtcagttttggatctttcctgctttctcttgtgggcatttagtgctataaatttccctctacacactgctttggatgcgtcccagagattctggtatgtggtgtctttgttctcgttggtttcaaagaacatctttatttctgccttcgttttgttatgtacccagtagtcattcaggagcaggttgttcagtttccatgtagttgagcggttttgagtgagattcttaatcctgagttctagtttgattgcactgtggtctgagagatagtttgttataatttctgttcttttacatttgttgaggagagctttacttccaagtatgtggtcaattttggaataggtgtggtgtggtgctgaaaaaaatgtacattctgttgatttggggtgaagagttctgtagatgtctattatgtctgcttggtgcagagctgagttcaattcctgggtatccttgttgactttctgtctcgttgatgtgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatgtttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttgccagtctgtatattttaattggagcatttagtccatttacatttaaagttaatattgtaatgtgtgaatttgatcctgtcattatgatgttagctggttattttgctcattagttgatgtagtttcttcgtagtctcgatggtctttacattttggcatgattttgcagcggctggtaccggttgttcctttccatgtttagcgcttccttcaggagctcttttagggcaggcctggtggtgacaaaatctctcagcatttgcttgtctgtaaaggattttatttctccttcacttctgaagcttagtttggctggatatgaaattctgggttgaaaattcttttctttaagaatgtcgaatattggcccccactctcttctggcttgtagagtttctgccgagagatccgctgttagtctgatgggtttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgctttgctagattggggaagttctcctggataatatcttgcagagtgttttccaacttggttccattctccccgtcactttcaggtacaccaatcagacgtagatttggtcttttcacatagtcccatatttcttggaggctttgctcgtttctttttattcttttttctctaaacttcccttcccgcttcatttcattcatttcatcttccatcgctgataccctttcttccagttgatcgcattggctcctgaggcttctgcattcttcacatagttctcgagccttggttttcagctccatcagctcctttaagtacttctctgtattggttattctagttatacattcttctaaacttttttcaaagttttcaacttctttgcctttggtttgaatgtcctcccgtagctcggagtaatttgatcgtctgaagccttcttctctcagctcgtcaaagtcattctccgtccagctttgttccgttgctggtgaggaactgcgttcctttggaggaggagaggcgctctgctttttagagtttccagtttttctgctctgttttttccccatctttgtggttttatctacttttggtctttgatgatggtgatgtacagatgtgtttttggtgtggatgtcttttctgtttgttagttttccttctaacagtcaggaccctcagctgcaggtctgttggagtacccagccgtgtgaggtgtcagtctgcccctgcttgggggtgcctcccagttaggctgctcgggggtcaggggtcagggacctacttgaggaggcagtctgcccgttctcagatctccagctgcgtgctgggagaaccactgctctcttcaaagctgtcagactgggacatttttttgtcctgcttatttctaattgagtttctttggatcttctctccttttcttcgttaatctcactaatggtctatcaatttcatttctcttttcaaagaaccagctctttgtttatcttttatattgtgttttttttgtttgtttcaatttcatttaattctgccctgatcttagttatttctttacttctgctgggtttgggtttggttgattcttgtttctctaactccttgaggtgtgaccttagattgtctatttgtactctttcagacttcatgatgtaggcatttaatactatgaactttcctcttagctctgtctttgctgtattccagaggttcagatattttgatagtttgtgtcactactatcattcagttcaaagaattttttaatttccatcttgatttcattgttgacccagtgatcattcaggagcaggttattgtacttccatttatttggcatggttttgagggttccttttgcagttggtttctaattttattctactgtggtctgtgagagtacttgataagatttttattttttaaaatgtgttgagacttgttttgtggcctatcatatatggtctatcttggagaatgtttcatgtgctgattaatgaatatatactctgcagtttttggctagaatgttctgtgaatatctgtttagtttatttgttctagggtacagtttaagtccatagtttctttgttgactttctgtcttgatgacctgtctactgctgtcagtggagtattgaagtcccccactattactgtattaacatctatctcatttttttggtctagtagtaattgttttgtaaatttgggagctccagtgttaggtgcatagatacatttaggattgtgatattttcctgctggactagtccttttatcatcatataatacccctctttgtcatttttaactgctgttgctttgaagtttgtgtgatacaagaatagctactcctgcttgcttttgttgtccatttgcatggaaagatattccattggtaacaaatatcccactggtattttgttggtaactttttaattaccatttcaatcttgctgcttgttattggcctgttcagagtttctgtttcttcctgggttaatgtaggagggttgtatatttccaggaatttatccatctcctctaggttttctagttattccattcaagatattccatccaaatggacatcaaaagcaagcaggagtagctattccacccctttacctaagtttatgtgagtctttatgtgtcaggtgggtctcttgaagatagaatatacttggttgatgaattcttatccattctgccatttcatatcttttaggtggagcatttaggccatttacattaaacattagtattgagatgtgaggtactattctattcatcgtactatttgttgcctgaataccttaggtttttttttcattgtgttaaaatgaaaaattataggtcctgtgagatttatgctttaaggatattctattttgatgattttgaggatttaagatttagagctccttttagcagttcttttagtgctggcttggtagtggcaaattcagcatttgtttgtctgaagaagactgtatctttccttcatttatgaagcttaattttgttggatacaaaattcttggctgataattgctttgtttaaggaagctaaagataggaccccaatcccttttagcttgtagggtttcggctgagaaatctgctattaatctgataggttatcttttataggttacctgatgcttttgccgcatagctcttaagagtctttcctttttcttgactttagataacctgatgactatgtgcctaggcaatgatctttttgtgatgaatttcccaggtgttctttgaacttcttgtatgtggatgtctagatctctagcagagctgaggaagttttcttcaattattccctcaaatatgttttccaaacttttagatttatcttcttcctcaggaacaccaattattcttaggtttggtcatttaacataatcccaaacttcttggaggctttgatcattttaaaaaattctttcttctttgtctttgtcagattgggctaatttgaaagccttgtctttgagctgggaagtttctttcttccatttgttcaattctattgctgagaccttccaatgcattttgcattttgcatttctctaagtgtgttcttcatttctagaagttgtgctttttgttttgtttttgtttcgttttgagatggagattcactcttgtcgcccaggctggactggaatggcgcaatcttggctacctgcaacctctgcctcctgggttcaagcgaatctcctatctcagcctcccgagtagctgggattacaggcgtctgccaccacagctggttaatttttctatttttagtagagacagggttcaccacgttgggcaggctggttttgaactcctgacctcaggtgatccacctgcctgagcctcccaaactgctgggattgcaggcgtgagccactgctcccggccgtgattgttttttacttatgctatttcactggagatttttccattcatatcctatatcttttttttttttttctttgaaaaggagtcttgctctgtcacccaggctggagtgcagtgccacaatctcggctcactgcaacctctgcctccctaggttcaagcaattctgcttcagcctccccagtagctgggattataggcgcccaccaccatgcctagctaatttttgtatttttagtagagacagggttttgccacgttggccaggctggtctcgaactcctgacctcaagtgatccacctgcttcggcctcccaaagtgttggggttataggtgtgagccgctacacctggccctatatcattttttttatttctttaagttagactttacctttctctggtgcctccttgattgacttaatagttgaccttctgaattcttttttcctgcagtttagagattttgtcttggtttggatccactgttggtgagctagtgtgatcttttggggtgttaaagaaccttgttttgtcatattaccagaattgcttttctggttccttctcatttgggtagagaatgtgagggaagatctgggactcaagggctgctgttcagattcttttgtcccacaggatgctcctttgatgtggtgctctccccttttccctagggatggcatgtcttgagagccaaactgcagtgattgttatttctcttctggatctagtcacccagcagggctaccaagctctgggctggtactggggagtgtctgcaaagagtcctgagatgtgattcatcttcaggtctttcagccatggataccagcacctgctcaagtggaggtagcaggagagtgaagtggaccctgtgagggtccttggttgtatttttgttaagtgtactactggttttgtgttcgttggcctccagccaggaggtggcgctttcaagagtgcatcagctgtggtattatagggaaaatcacactgtgggcggggccatagagctcccaagagattatgtccttttttttggagttcttctgctgtcccgcagagcctacagcagcaatccatctccttctgtctgctcaattctcttggctttcctggtatattcctgcagtagttcttggagcaaaagttcacaatgtgggtttccacacgctgctctgtccatctgagtgggaactgcaaattagtcctgcctcctatctaccatcttccctccagtataccccctgctgctagtatttttaaacaaaccatgccactctcttctttaaaacacctgtgagagtttgcacttgctaacacaataaagtccaggacctttggcattttctatgttatattttccttcccagttcatgtcctgccatcctctccgaagcaccctgtgtcaatcacacctactcgcttgttcttcacacatagaggtcctctctctctccatgtatctgctcagggtatcatttcctctctttggcaccctggagtcttcatttaaatcccagactgaatataacacctcctgtgaaaccttgagggattgccctaacatttgtccctcctaccccaactctgtgatctgaaatctgtcttactacatgagttttataatactgtttacccaatttgtctctagactgtaagattctcaagaggaaggacctgtttctctttggatacccagcttgacaatgaatgcatttgttcacggaggaagatagtttgagcttaatgggaggtttagcttcagataaggttatagggaaaacaggatatttcctcttctctttatactcagaaagttcaggttccccgtgtagaaagaagaatgtagcagattgctaagctacatgaaaatgtgtttgctcacattttaaatggtgtaaaatataaattaacatcatcattagaaggctggccttaaaaagtcacatggtctctaggaagtcaataagtaaagaacagagcagcttttgtgggcaagactatactttgccaagtgaactaattagctgtatggtcaccagtgaattactttatcccagaccttgtgtgtttttgatttctcagacctcacggggatgaagggccttggttttaaagagctcggactaaatgatccaaagatttctttttgttactaaaattagttctactttaattcttaaggtctgtagaaattaaaatggaaataatttatatttgaagtagaaatacctattcactcttcatgtgctggtgtagtattggaaatcagtctgctaaaccgattcatacttcagtgatagaagatgccaccctgagttactttccccagtagccagatggaaccagtaaggaatatcatatcctaaaagaacaaatccatgtttaaagactgggaggaagatctttttgggttggagtaaggaaagttttgcaccaaggctaagcttgttgccttgtgcattctgctttgtgctcatattcgagttttgaggcaaaaacacacacctagcagtttgggacatgaggcctccatatcacctagtttttccaacccaacaaaccctcaagtttctcccgagagaaagaatataccattgtataagtttcctattgctgctgtaacaagttaccacaaacattaaaaaacatatcttacagttctggaactcaagtcctaaaatcaagctattgctggagccacattcctcttggaggctgtaggggagaatctgtttccttgcatttaccagcttgcagaggctgcctgcgttccgtcacttgtggcatcttcctccattttctagccaattgtggaggatctttaaatctctttactaaagaccctggtgattactttgtgtccacctggataatccaggataatcccccaactcaaaaatgcttcatttagtcacatctgcacagtcccttttgccatgtaaaatttataacttcaggggattaggatatggacatatctggggagctgctattcagcctaccatgactataaatatcattaacctaattaaaatggcctaaattagctggctgtggtggctcacctataatcccaggactttgggaggccaagatgggaggatcgcttgagctcaagagttcaagaccgaccagcctggtcaacagagtgagaccccatctacacacacacacacaaaaattagctgggtgtggtggcccacagctgtagtcctagctaattgggaggctaaggcaagagaatcacctgagttcaggagatggaagctgcagtgagttgtgatcaggccacttcactccaccctgggtgacagagcaagaccctatctcaaaaagaaaaaaaaagaaagcctagatagactttagtttgtattaattatagcttggctatacaatgagtcccaaattaggacatatattaaacgtccattgatttttaattactaaagcagtggttctcaaactttaatgtgtatcaaaatcacctggaaaactaaagtgatttctgggccccatccccatagcttctgactcaaaatatttagatctgggtcaaggctcaagaatttgcatttctaacagattccagatgctgctactactggtccgaaaacaaccccactggaagatgaataaagtggacacaacaaatagcatatgttctactatagaggtggccacatgaagagctctgcaagcccactgtgaaattgatagcaaatctttattcaagtgtattaattgacccacaaatatcctgattaatgaagctggctagtttggcaagatgcattctaactcttaaagtgattgattactgtggagatgtgtgatgacagattggcacctactaaggaaacctctcttgcctggtacattattaaaaataatccagtggggaaataggactaatttaattacatgcctttatgcagtaagatccacagttgaaaaatagaggcagtagctttaattgcactgtaatgttcacacacaaatcatatcttgcttgaaacagttttatggcaaaaatagaccatatattgatttcacatatataacatttaacccttcaagcctttttgcccattaaatatacacacctttacaaaccaataacagtttagaagaattaagctcttctgattataaacttttacattattgatcagacagtagcacataaaattgcttttttttttagtattttacatgaataattttatttgtgcttcatgaaaactccatttatcccattttttattatactttaagttttagggtacatgtgcacaatgtgcaggtttgttacatatgtatacacgtgccgtgttggtgtgctgcacccattaactcatcatttacattaggtatatctcctaatgctatccctccccctccccccaccccacaacaggccctggtgtgtgatgttccccttcctgtgtccatgtgttctcattgttcagttcccacctatgagtgagaacatgcagtgtttggttttttgtccttgcgatagtttgctgagaatgatggtttccagcttcatccatgtccctacaaaggacatgaactcatcattttttatggctgcatagtattccatggtgtatatgtgccacatttccttaatctagtctatcattgatggacatttgggttggttccaagtctttgctattatgaatagtgctgcaataaacatgtgtgcatgtgtctttatagcagcatgttttataatcctttgggtatatacccagtaatggggtggctgggtcaaatgatatttctagttctagatccctgaggaatcgccacactgacttccacaatggttgaactagtttacagtcccaccaacagtgtaaaagtgttcctatttctccacatcctctccagcacctgttgtttcctgactttttaatgactgccattctaactggtgtgagatggtatctcattgtggttttgatttgcatttctctgatggccagtgatgatgagcattttttcatgtgtcttttggctgcataaatgtcttcttttgagaagtgtctgttcatatccttcgcccacttgttgatggggttgtttgtttttttcttgtaaatttgttagagttctttgtagattctggatattagccctttgtcagatgagtagattgcaaaaattttctcccattctgtaggttgtctgttcactctgatggtagtttcttttgctgtgcagaagctctttagtttaattagatcccatttgtcaattttggcttttgttgccattgcttttggtgttttagacatgaagtccttgcccatacctatgtcctgaaaggtattgcctaggttttcttctagggtttttacggttttaggtctaacatttaagtctttagtccatcttgaattaatttttatataaggtgtaaggaagggatccagtttcagctttctacatatggctagcaaggtttcccagcaccatttattaaatagggaatgctttccccatttgttgtttttgtcaggtttgtcaaagatcagatggttgtagatgtgtggtattatttctgagggctctgttctgttccattggtctatatctctgttttggtaccagtaccatgctgttttggttactatagccttgtagtataatttgaagtcaggtaacatgatgcctccagctttgttcttttggcttaggattgtcttggcaatgcgggcccttttttggttccatatgaactttaaagtagttttttccagttctgtgaagaaagtcattggtagcttgatgagggtggcattgaatctataaattaccttgggcactatggccattttcatgatattgattcttcctatccatgggcatggaatgttcttgcatttgtttgtgtcttcttttatttcattgagcagtggtttgtagttctccttgaagaggttcttcacatcccttgtaagttggattcctaggtattttattctctttgaagcaactgtgaatgggagttcactcatgatgtggctctctgttcgtctgtgatttgtgtataagaatgcttgtgattttttgcacattgattttgtatccagagactttgctgaagttgcttatcagcttaaggagattttgggctgagacgatggggttttttaaatatacaatcatgtcatctgcacacagggacaatttgacttcctcttttcctaattgaataccctttatttctttctcctgcctaattgccctggccagaacttccaacactgtgttgaataggagtggtgagagagggcatctttgtcttgtgccagttttcaaagggaatgcttccaggttttgcccattcagtatgatattggctgtgggtttgtcataaatagctcttattattttgagatacatcccatcaatacctaatttattgagagtttttagcatgaagggctgttgaattttctcaaaggccttttctgcatctattgagataatcatgtggtttttgtctttggttctctttatatgctggattacatttattgatttgcatatgttgaaccagccttgcatcccagggatgaagcccacttgatcatggtggataagctttttgatgtgctgctggattcggtttgccagtattttattgaggatttttgcatcaatgttcatcagggatattggtctaaaattctctttttttgttgtgtctttgtcaggctttggtatcaggatgatgctggcctcataaaatgagttagggaggattccctctttttctatggattggaatagtttcagaaggaatggtaccagcttcttgtacctctagtagaattcggctgtgaatccatctggtcctggactttttttggttggtaggctattaattattgcctcaatttcagatcctgttattggtctattcagagattcaacttcttcctggtttagtcttgggagagtgtatgtgtcgaggaatttatccatttcttctagattttctagtttatttgcttagagatgtttatagtattctctgatggtagcttgtatttctgtgagatcagtggtgatatccccttcatcatttttttattgcctctatttgattctcccctcttttcttctttattagtcttgctagcagtctatcaattttgttgatcttttcaaaaaacgagcccctggattcattgattttttgaagggttttttgtgtatctccttcagttgtgctctgatcttagttatttcttgccttctgctagcttttgaatgtgtttgctcttgcttctctagttcttttaattgtgatgttagggtgtcaattttacatctttcctgctttctcttatgggcatttagtgctataaatttccctctacacactgctttaaatgtgtcccagagattctggtatgttgtgtctttgttctcactggtttcaaagaacatctttatttctgccttaattttgttatatacccattagtcattcaggagaaggttgttcagtttccatgtagttgagcggttttgagtgagtttcttaatcctgagttctactttgattgcactgtggtctgagagacagtttgttataatttctgttcttttacatttgctgaggagtgctttacttccagctatgtggtcaattttggaataagggcaatgtggtgctgagaagaatgtatattctgttgatttgtggtggagagttctgtagatgtctattaggtctgcttggtgcagagctgagttcaattcctggatatccttgttaactttctgtctcgtttatctgtctaaggttgacagtggggtgttaaagtctcccattattattgtgtgggagtctaagtctctttgtaagtctctaaggacttgctttatgaatctaggtgctcctgtattgggtgcatatatgtttaggataattagctcttcttgttgaattgatccctttaccattatgtaatggccttgtctcttttgatctttgttggtttaaagtctgttttatcagagactaggattgcaacccctgccttttttttccatttgcttggtagatcttcctccatccctttgttttgagcctatgtgagtctctgcatgtgagatgggtctcctgaatacagcacactgatgggtcttgactctttatccgttttgccagtctgtgtattttaattgaagcatttagcccatttacatttaaggttaatattgttatgtgtgaacttgatcctgtcattatgatgttagctggttattttgctcattagttgatgcagtttcttcctagcattgatggtctttacattttggcatgtttttgcagtggctggtaccagtcgttcctttccatgtttactgcttctttcaggagctcttgtagagcaggcctggtggtgacaaaatctctcagcatttgcttgtctgtaaaggattttatttctccttcacttatgaagcttaatttggctggatatgaaattctgggttgaaaattcgtttaagaatgttgaatattggcccccactctcttctggcttgtagagtttctgctgagattcgccgttagtctgatggtcttccctttgtgggtaacccgacctttctctctggctgcccttaacattttttccttcatttcaactttggtgaatctgacaattatgtgtcttggagttgctcttctcgaggattatctttatggcattctctgtatttcctgaatctgaatgttggcctgccttgctaggttggggaagttctcctggataatatcctgcagagtgttttccaacttggttccattctccccatcactttcaggtacaccaatcagacataaatttggtcttttcacatagtcccatatttcttggaggctttgttcatttccttttactcttttttctctaaacttctcttcttgcttcatttcattcatttgatcttcaatcactgataccctttcttccagttgatcgaatcggctactgaagcttgtgcattcatcacgtagttctcttgccatgtttttcagctccatcaggtcatttaaggacttctctacactgtttattctagttcgccattcatctaatcttttttcaaggtttttagcttctttgcagtgggttcaaacttcctcctttagctcagagaagtttgatcgtctgaagccttcttctctcaacttgtcaaagtcattctccatccagctttgttccgttgctggtaaggagctgcgttcctttggagggggagaggcgctctgatttttagaattttcagcttttctgctctcttttttccccatctttgtggttttatctatctctgctctttgatgatggtgacgtacagatggggttttgatgtggatgtcctttctgtttgttagttttccttctaacagtcaggaccctcagctgcaggtctgttggagcttgctggaggtccactccagaccctgtttgcctgggtatcagcagcagaggctgcagaacagcacatattgctgaacagcaaatgttgctgcctgatcgttcctctggaagcttcatctcagaggggcacctggccatgtgaggtgtcagtctgcccctactgggaggtgcctcccagttaggctactcgggggtcagggacccacttgagggggcagtctgtccgttctcagatctcaaactcctttctgggagaaccactattcacttcaaagctgtcagacagggacatttaagtctgcagaggtttctgctgccttttgttcggctatgacctgcccccagaggtggagtctacagaggcaggcaggcctccttgagctgtggtgggctccacccagttcgagcttcctggctgctttgtttacctactcaagcctcagcaatggtggatgcccctcccccagcctcgctgccatcttgcagatagatctcagaccgctgtgctagcagtgagtgagtatctgtgggcgtgggaccctccgagccaggtgtgggatataatctcctggtgtgccgtttgctaagaccattggaaaagctcagtatttgggtgggaattacctgattttccaggtgccatctgttaccacttcccttggctaggaaagggaattccctgaccccttgcacttcccggctgaggcgatgcctcaccctgctttggcttacgctcggtgggctgcacccactgtcctgcccccactgtccgacaagccccgtgagatgaacccggtacctcagttggaaatgcagaaatcacctgtcttctgcgtcactcgcgctgggagctgtagactggagctgttcctatttggctatcttggaaccgcaaacagtatgtttttcttacattttttcctttacctttttgtttgacttacaggggtttaagtattctgtattatcttgtttttattaaacctgttctagaaataaacttgttgtctctggagaatattcagttttttcaacctgtttgttggtctgaaccagtgttgcactggtattatttcagtaaaactacaaaaccttaccaaaatcctttcaggacacttaactctaagattaaattacatttcaataaatattaatcactgtaagtaacaaaatatttgtctcattcaatggtccattaatttcaagtgatttctaataaacttccaggataaaaaaatttggaccgtctcagcatatggtcacagtctgacctgtaatatctgtatcttatgaaaaatgaatacgtttatattccctgttcatttgttcagtttttctcagctgatgagcagacagaaatgaaaactagttattgaatctgtactagtctcatcaacctactaaaaaaattgaggcctgacagactcatatcctgtctaacccaggtaatcatccaaccttctgaatttctttggcaatggacatctgtttttaagagtgaatactgaagatgtttgttttaccaagtttttagagtgtgaatttaagttacacacgcacacttaaatgtcagtggtttcacatttgacaactgaaattaagtagtagtctttgtacacactttaaaaaccacctaccagttcagttaaaattgtaggtctattaacactgaaattatgtcgcttgtgtactgctatatccagtgcagctacaccacattgtcgattcagagccaagggattttacagattttaaagtgcgtttatttgacacaccacaaagtcatttaatgaaagttaaggaataatgatcaaaacatttatctagttaataagtaattttcagaaatttggaacagtacgcaagccatactatttctgaagttctacagaagttcaaacacaatgattcctttcttgtcatccgtttgtccctatttataatattaaagcataactcaaaagtatatggttactatccctttagtaacccataaaatgttggaaggtgtttagatgttctttagatttttgaaaattaagtattttttagaatacacatgggtaatgtcaacatttttggaaatatgatgtgcagacagaccttaattttacttgtatgtgacctagggataccctctatataatagcatttgccttggaactgctgctccttcagctgggtgctgaagaccttcaccttccttcttgggccatcccttacttcccatttcaagccagtaatattaaggaggacatataagtggcaacaggaaaggtaggggacagttttgccaatttgccctccttcaccccctgccccacttcagacagtttcattagcaagatccctgctcacattataaggcccattctgttccttacccatgcacagctcaagtttctgcaacaaacgctggcatacgttctgaaaagtttcccataaaacagacacttaacttcagttgctttctgagtcttggttgccactgcccgacaggagtatttattctctgatctcaccagcagggtgcagtagggagaaaagttgccctataatttcttggagtacagaacacatacagatacggtttggttctgtaccactgcttacctttcagggcccctatggtttcagtaagctttgagggcacaaactaagaaggctaacaccaagagtattgtttgcatgggtaaatattactaaaagtcaacatacaagtgaacttttagagcatattttttatttgggaactacctgaaatacccagaaaactatgccaccactttaacaatccaaggacttcaaatgttttctaaaactctctctacccaagtagacatgcaaactttgatctgaatttcctgacatttccttatttttctgtttttgttttgtttttttttgagacagagtcttgctctgtcacccaagctggagtgcagaggcgagatctcggctcactgcaacctctgcctcctgggttcaagcaattctcctgcctcagcctccctgagtagctggacacgtgccaccatgcccagctaagttttgtatttttagtagagacggggtttcaccatgttggccaggctggtctcatactcctgacatcgtgatccacccgcctcggcctcccaaagtgctgggatttacaggggtgagccaccacgaccggccttcctcatttttctataaataattttagatagtagggtaaatggagttcttatttccaggaatttgaaaagctcatattcttttgagaaatgttttcccaggcaaatttctaatgcagctattcctctacttttgaaatgtccatccctcagctcaaaagaaagcaccctgcaatttagattctttttttaaaaaattaagtttaaactggaaagggatagttttagcttgttccacatgaaatcttgctgataagcaaattcaactacatttctatccaaaagagttcctttaaaaagtctgacttacagtcaggcatggtagctcatgcctgtaatcccagcactttgggaggccgatgctggcagatcccctgaggtcaggagttcgagaccagcctggccaacatggtgaaaccccatctctactaaaaattaaaaattagccgggcgtaatggcgcacatctgtaatcccagctacttgggaggccaaggcaggagaattgcttgaacccagaaggtggaggtttcagtaagccgagatcgtgccactgcactccagcctgggtgacagaacgaaactccgtctcaaaaaagaaaaaaaaagtcttatttacaataatttcctgtttccatttctttatgcaaatctcaaataataaacctgctcttggcaagctgcagctaatctccagtttatattactgtacatagttgtatatttaaattttcttaatattgtgaacatttaacatctcaacccttctgaaatgactgatggtgaaagcttcacagaaaagctggccacgtcatgctgtcgccactcagtcccacaacaccacactctcctccctcctcctcctgtttctggctagacattgctttctggacgtttctaaggaagcacaggcccagcttctaattcgaccaaagggttttaaagtctaagttctagcattttctgaatgcttcacagtagatgttccagaagaaattaatgactacaataagcattccaaatgatattctaaaatgaggactttctggctggacacagtggctcacgcctgtaatcccagcactttgggaggccgaggcagacagatcacttgaggtcaggagttggagaccagcctggccaacatggtgaaaccccgtctccactaaaaatacaaaaattagccgggcatagtggtgcatgcctgtaatcccagctactcaggaggctgaggcaggagaatcactcgaacccaggaggcagaggttgcagtgagccgagatcatgccactgcactgtagcctgggcaatagagcaagactccgtctcaaaaataaaaaataaaatgagtactttctgtgctcaaaactaccaactaagctaaactatttcatcaaaagaccccactaatcaggaaaactgataccagagataccaaaattgatcagtggaaaacagtggtttataactctacgttttgtggaagtgcacattttgataattcttattaaaagacactaagatacatgaagcattgtgtaagtttggcagacattaatatactcatttcagaggcagtaaacctatgaacccttaatgttctagtttgctcttgaaaatgatactatttcaaagctcagtaatgtggatagatttttattcagaaatcctttcatattcactaactgcaattaaaagtttaaaattacatggctcttaggaatgacgccaaacatgcaacattttaagagtaatattaaacagtaattttgccctcagaagtttacttatcaaattattacaacaggaacacaaatagaccacatattactctttaattagatttgttttacaatatgttcttgtcaacgagctatgtcaaactgtttgtttaaacctgacagaaaagcattttcacaaaaacgtaccatggagagggagggggaggggaagaagcactttttctagagatggaaaatagttccagtaaaaagttcttattcctttcttctaaggagctcgttctgaatattttcacttagttctactgttctttaaacaggactttaaaaagaattttgtatttacaaaatttacattttgttcctacaaaatgtaattttttaattttgtaaaataaaaatgtaaaattttaattttgttcctacatgagaagtgtgcgtactttcaattagttttcattaatatcttctgagttttcctcttaggtggttggtttctgggtaaggcagagttaggctggtgcacacactatttaggaagtcctgtctcgtggctgacaacatacatgtagtgctcaaggaagtgagttaaggagtgacatgggaatcaaaatgatgcctagaatagtgtaatttgggaaacagccctagatttgacattttggaagttcactgtaagaagagaccccaaaaagaaggaaaagggaaagggttcctcagctaaatatcccactcatccatgcctactcagcggtcactgtgacaaggccatcttaatcggggccagagatgacactctccccctgtaactcagcctggctctgtctattgggatgtgcctaaatgggatgggtgagggggcactaaacagctaacactggccagggaattattaaggagctaaaatgcaagtacctcttgaataccacagcaatctctgtgcacaaatttggactgtactttttgggagaagaggtgaaaactattattaactattcccttccttcaaccaaaaggaaaaatacgcctctttaaggcttcttttaatgatactataatgctgaatttatttatgaaaaagaaacaatacaggttgaggtgggaaaagccccaaggaaacggagtaagtcactggcggtcacaggacttgaattccctggggacagtgctgtggggtcccctgctcgccatcccagcacctcagtctgagtatagataatactgcatttttgtaaagacgaaggcatcctgcatttaccatcacactccacctactcttgtcctagtcatcttacatactcttagtccttaatctctcccaaaacgcttctcagcgcccattgttattgtgtcatctacaaagcaacacatatattaaaactcagatttgtttttaacaaaaaagtgcttaaaaccaccctaggcaattgtttttcacttcattttcaaccaataaaatcaaattcatttagatctatgaataatactgaaaaaataatgcttattctcttacattttaaataatgtgccttcatcctcaactttacattaactgactcatttcagtatctaaatgaattgagctctcatttgaaaaacagaaggtacaactatatagaatttttaggataaaaaatgttctggatagaaaaatccttttgatgtttcaaaataacacagattctcagtatagttttcagtttggcaactaaaccattattaagtacccaaggtttttaaaaaataacaaaagataataacatgatttttaaatacaaagttatataggagcaactcatatctgtggatcatccttacacaaagttgtttctcactagaaaaatccctaaatatttgtcataaaataaaaactccattatcaaaaattagtttaagatagaaatctatgcactttaatgattgccagaattgcccagcatagcttcagtaaaatagagaattgtctagaaaatacaatctccaaaatgtgtgcaagtactgcaaaccggacagaccggggcagggcaaggcccttgaaaccaagtcctccttgagcacctttcccaggttagaaacccctcttcagcctgtgcttcgcacgtttccttcagcgtgccgccattcagactgcgccacttacgtcccagtgccacgctgcgtggatcaagtgtcaacgggaaagtatgagttaggcaagcgctttttttttaagctgtaaacgcttcacatgactggccccgtaagaaattgtgggagcttagatgagcctggagcttttcaggaactggatgaggactctgtacacaaatgtgtactggcagagagtctgcaccagcatcattctctgttgcctcagcatgtccagcactctcgggatgtccagcacctaggttgagagaaacggtaatgaagataatgtgttcccctggggagacagaaaggatgggaggacacgagtgtcctggcagaaacctggttgggagatggacagtctcttttccaccttagcgtcttctagaaataagccatgattgcctacttctgattttctgattagttttagctataaatagaatgtccatgcagactatttcttcaacattccccaggtgtagctcactgactttgtatggttggacataattaccatgtctcactaaataccaaaattatacaaaaacatagtgtgctaagtgctatcagtatctagctatttccctcaagggctctgggcagcatgaatcatccttgaaatgtaaacagaaaaagaattctgagctcaaatttgaaaaaccctgggcaagtaaaacaaaattaaacagctttatttatcgtatgacttcttagtctttaatatgctaattggtactgagactctccaagaagacacagccttttgcagggaacattagtaacatcttgaggccaccacagtccaaggaaatgtgcgcaaaaagagctattaagtcactatgtccctctcttccccagcctcatttccacccaaaaaggccaggtgatcataagcgccatcacctcattgtgttccaggcaggcgatcatgatctccgacaaaatcaccacgccagtccttcctaccccagcactgcagtggaccaacaacggagggttggggctttggggatcacttgtgctatttgtatggcgtcgaacagactggatctcttcaagatatgctgtggaaaatcaatgaaatagaaaagtactcaaggatcaaggcgtatcacattgttgactcaatcttcatattctctccactgattaagaggactgcagataaagagcactgggtgccagtgaaccaaacccaaccacaaagggacagtgtgaccctgagcaagtcactacctctgtccactttctgatctacaaaatgaaatgacggagatactgagtcagctgtggcattctactcactaccaaatcataatttataaacctcgttaaccctccccaaaacacttgtattctttatgttaaaacaagtccgaagcttatatgagataacataaaggaaatatttcggaaacataaatgttcctctctgtttaacacctccagaggcagctgtcctcggaacaaagttaaagtcactcacataaaaatcccttgaggtcttctggacagccatgttcaggccagtctgtgtattggaggtgccagacggtcctctcttgcccagtaaggaggtgcttcatcttcaggcctgtggtggcatagcagccagagtctgtgcggaaccgggtcgtgatcttaaaccttccataggtgacagtgttgtgcctggaaccaagtcgtggccagtacctaaagctcttctcccttccaccctcctgttaaagatgagcatggttaaatgactcgagatccggcaatggatgcctttctcacatagacggcacatctgaaacagaaccacaaccctaccctgcctttttctccacaggtcaggattccagatgattaacattaactgttcttcagaggctgagaaaatcacttaagagaaataagtacctacctcttctgctgtcaccattgctataattgcaattccctgttcccataccatctgccaaaaatcttgacaggtattctgtaatggtccctgtgtggcaatataatcccattcgattccactgacagagacctgggattagaaaaggttaaaaaaattgatgtgtgggtataatatacataggtatgtatgcatgcattcatggtagtactaaaaaagtttttttaaaaaagtaaaaagtaaaaaagtagtaaactggattattcagcagaataaggaaagacttttcatcttttcccttgtgaatacaatttgcattactgacatttttataaacttaggtactgtgaatatacataatatctatgcaacctgtttaaccttgctgaatgtcagttctcatttatacaataaagatactgcctaccgtcatagggtcattgtgaggactgagtcagtatctatggtacctggcacataactcaataagtagctgttattgcagacatggtgcctcttctttaaaaaaaaccttcctacttaagatagtctcacctctgaacttctgagtcaaggtcactctccacaataatattaagtttccacttcagatttaacttccttgagagcagtctaatacaacagtaattactagatttgtggttaagagacctgggttaaatcttggcttcaccaatattgagtgacgacaataactgtctccaaacactcactaaacgtaaaacccagtgccaagccttgtgccacacgcactctcactcagggctgccagccccctagtcaccgctccacatcgtctcactgagcacccagtggctgccactgtggatgagtaccaggttataacagtgaataaacactagggaggaggaggggactagtgagaagctggcagggtaggtgtcatcatttatttatttccatgtaagtgagatgaggtcccacaacacagcttataaagtgaggtcccacctcattttagatctaggcgtcagacccaggtctatcaaattctttcctctattctgcaagtggctgctgaagattttgaaatatcactacagaactacagtatcattcattcttatccatctagtcatgagagactggatgagttatttcaaggaaatgctcggtttttaagtaaattatgctgatattatatttaaaaacaaaatagtatgtgcatagattcccaaaagccatcaaggggtactggcattcacaggcagactgccagtctccagaaagccttggtgtcagcttgttcccttctcaaataatacttgcaaactaaagaaaaaaaccaccacctgtccacagttactcattcactcaccatgagatttctccttcccaaaataaagaattgaatgtggccagcatgaacaaagggtacaatgaggaagagggaacatctggctttattccatcatgtgttgtgaatcatcattttgtccattttcataggagtgatattaccccagataaggtgccaagaacatacactagggaaggacagcctcttaaatacatgggactgggaagactggatatccataagcagaaaagtaaaactggaccccctatctctcaccataaacattaccccagtttaatggcattatactggttccaggaaaaaagcacttcttcaaagaaaaaaaatgatacttaaaaattattataaagagtatgtaaagagaacagatggcaccttggtaagttgaaagcttttgtgaacaccatcaaaaagcccagacacttttgttacataaaaatgcatgtcagtatgtgatgaggaaaaactagcaattcagtggctcccagaatttatgagctaaaaagaggtcttcagatttagaaggacaaagttctaaagccaggcaacacaaggtcaaggctgtagggagccatgatcataccactgcactccacctgtctgggcgacagagcaagactctatctcaaaaaaggcaaaagaaaaaaaaaaaagccgggcaaataagtgcgccctgagtcctggtaacagtgttgggggcagagtggtttcgcacatggagagtagacatgactttggctctgtctgatagacgctttttatctagcactggtatgtggatttcccagcttgcagtacagtttgtcacaaatgtttaaaactagggtgtttatctaaaacaatacaataaaaataaattttaaaatatctgaattctaaacagacatgaatacaattcttaccattcttgtaacttaactgaaactgcatgtgctgttgattacttgaggcgttcctctcaccttaatatgtgatgcgttgatgtaaccagtgttgttttctttagttgggaccaactccactctcacatcatcataaggaagaacatcttggaatcgatttctttctgcattttcagggagtcgtgctgttgagcactccccatcaactagccgtttcttaagaattctttcatattctgtgaataccattccttgttctaatcgttgttccagaattttacactataaaacagaatatgtgtaataacatgaatacagccacacgtcgtggctaccttttgactgtatatttgaaatcttgttttctgcttcaaatctagcactgtataatattgaaaattctaggttgggcacggtgtctcatgcctgtaatccctgcactttgggaggccaaggagggaggatcacttgagcctaggagttcaggaccagcctgagaaacacagtgagaccccgtctctgcaaaaaattaaaaaacgagccaggtgtggtggtgcatgcctgtggtcccatctacttgggaggatgaggcaggaggattgcttgagcccaggaggttgaggctgcagtgaaccatgagaacctatctcaaaaaaaccaaaccaaaaccaaaacagaaacaaaattctaggtgaaaatgaagttaaaattttaaaaagccacaacaacaagagttaaaagaacaaaagacaatcattttggtgagaaatataatgcaaacttttgtttaaagttgaaaattggcctaaagaaatttgttgaattcattttctctagatctgtggtcaattttgtgacccctaatagatggaattctcctggggaacagtaagtaaatctaggggacggataatgagttccaacagctatgaacaaatgtttccattttatgtcatacgatatataaaagactaaagcagtaggaaatattcgaaactacctccaggatcccgttgtaaagcaaatgtatgcctatctgattttgatgtaataaaacctcatagaaaatacacctcaggcacaaaggaagttttgaaaaattgagaaactactctcgagataaactttcagtataataaaagtcaatgtctgctgcttttcccctgtatgctcctgtatttttgtagatttcttctcactttaaggccatcaaaatcaagactgctccaaaaggccaggagaaggtaaaaaagaacactgagaaacaaacaaacaaaaaatcagcattcgaacctgaaattatctattaagacattagctatacatttgccccaattttgaggcccatattacaaaattccttaacactcatttattattaaattgtgttagaaaattcaccaaaatctcatgaaggcatttgcgtagtatttaccggttgttccagagaaggcacaaagccctgtgtgtcccatacataccctttcatcattcgttgctctggtagccacttcctttccttcatcaggcagaggcactcgagatagggagagtccatttagggcagccagtttaagaggaccaattttttttgcatctactcgagtctttttcattccctgtaaaaggatttatatgtatatatgaaatatacacaaatacaacccctgtgaaaagaagtttcaatgcactgaagaccaggaacacacagagggagtgttctcctttgccaataaacccagaaagattacactccttcacacaccacttgtttaacaaacattagtaggaagacattcctttcaaggccaaagccctgataaagtcttccagatagaaggttttgaaacactattggttacaaagttctgttgtaatgaaaggtgaggctccaggcagactgcattccttttaaaacaagacagacgtaacaaatcagctgaagtccaaaaaaaaaaaaaaaaaaaaaaaacaaaagctttaaatgcaatcaattgactatagtaagcttttataaattttttttttgagggtctcactctgtcacccaggctggatggaatgcaggggcaccatcatagctcactgcagcctcaacctccagtctcaagcaatcccacctgaacctcccgagtacctgggactaccagcacatgccaccatgcccaactaatctttgtgtgttttgtagagatggggtctcactatgttgcccaggctggtctcaaacaactgaacttaagcagtgttggcctcccaaagtgcttgagattacaggcgtgtgccaccatgcccggacagctttttataatttttaaaatatataaattctttaagtcattctgaaaaattaaatggtttctgcagcagccccctttgtgtgttaagccccctcctcatatgctactctgcattctagtgcagacttagatgacccgggttagatcacgctacctctcagaacggctacgtttttaaacaaggaaaataaaacagggctaaaatctccatcatgacaccaggaggataggacagaagagaaagcatcaacaaaatcttgtctcctgaaatcaagtgtttcctaaaattattattagagcatgattttcctctctgagaatagtaagcataagaacactaagttgaccaggtgcgggggatcacgcctgtaatcctagcactttgggaggccgaggtcaggagattgagaccatcctggccaatatggtgaaaccccgtctctactaaaaatacaaaaattagctgggcgtggtggcacatgcctgtaatcccagctactcgggaggctgaggcaggagaaaggcttgaacctgggaggtggagattacagtgagctgagatcgtgccactgcactccagcctggaggcagagtgagactccgtctccaaaaaaaaaaagaacactaagtttcgttggatatactacacttccttggatgatatcaatataatgagtagccccaactggaaaataatggttctgccctgtaaacaaaatccgtgttattccagctctctcagcctgtaacaggccatgaagccccatgataatggtgcaagaacagagggaaaaggcaacttggtgagagaggaaaaaaatcctaaaagattgctgctgtaattggagactgtgattggtacctaactcaataagctaagtggattaatttttaattttataattaatatttgatcatgagctccccacataatgcagtctagactataaacagcagaggcctgggttcacatctggcctctaactgaccaacttctttcaggcaagtcacctttcctctgtaagcctcacctagacagaaagagacagatatatccagacacaggcatacagactaaacacttcctgcttaggctgaaatttaatgattctaacgtgcagaaaacagtgatgtgctggtaatatttaacaacaggctcttggaaggaagttttgatcggtgtttgcccatatccatggtgtaaatactcccatcacagccaatttcaaactgttaatgtcacatcaattggctcacaaggttcctgaacatttaagtcggctcttgctagtcaatatgaactagctctggcacttctctgcctgaaaatgactcaaaatatcccacactgggacacgctggataaagctgattggctgtgaggtcagttcaaaagccagtattggaagaatgttgtatgtagtcaaaactagccttgaatatgccttaattagcccttagaatataagcacaggattttaatgcataccctgcacagtgatttcttatgtgagaaccactgcactaaagggtacaacaaaaagaaaatctttatgtagatatatgagcacccaaaccagtctgcctttaagataacaatcaggttgctggaggtggagatgggtggagaattctaaaatcattcctacttgtctacagtttatttcactgtttttaatactaaacctccataaccttaattcacattaggaaatttgttgtaacgattaagataatggcaaccccatgttactatgaaaggtcagagggtacaatagggaattggcctcttccactcttgaaagccattaagttaaatatatgatgccacctcacagtaatgttaatattgactaatctctttcaatgtgccagaacctcatttttatccccccaacaactctctggggtcctctcatttacaaatgtaaaaactgagtcacagattaaatagcttgtctgaggtcacatggctgcctcttttacaaggtaatcagtgtcaaaacaaataaaagcaaatctttggttaaaatcagttacactgaatcatgtaattcaggaggcattttttcatgcctaactgcatgtgggacataatgccacgaagcaggcagcgaagggatgaccgtcctcatgatctgaggttatctgatgtggaagctgaggttctgacgcatgaagggtcctgaccgtggtcacagagaactaacaaatggcaggctctagactcagccccaacgttcttaacttgtaggacctttgctctttcctcgtgaccacagctgccatacccattccttaagtagaatcctttaagcaaaaaggaccaaaaacataatccaatcacataattttactagtattgtggtcttaaaagtcaatgggagagaaaagttcttttaagagaaccaaattgatcaaagtcctcagatttaactgaacctaccagaccccattcaaaacatacagggataaaataggcctgagtactgagctgtactcagatagcatttggggaaagtacgtgagtcacacataaaaacagaccgttcttaatgcaatgggaagggtgttaactataaaaggaccctgtccagctggctcagggattcaggtagagttactttggaaaatctacccacaccttatcctgaatcactgctccctacactcttaaatctgtgtccactgaaggcattggcctttactgttcagggatgtgagttatgttgcatacttgtgaaaaatttaaaaatcaacttaaaattcaaacccaaaacttattaaaagaaagcaaatttaggccaggtgtggtggctcacacctgtaatcccagcactttgggaggctgaggcagccagatcacaaggcaggggaatcgcttgaacccaggaggcagaggttgcagtgaactgagatcacaccactgcactccagcctgggcaacagggcaagactgttctaaaaaaaaaaaaaaaaaaaaaaaagcaaatttaaatctgtggtactttttttgttaagtagtttttgtctatgtacattaatctctttcataagtactataatagtgtgcgttttttcctgtttagcaagatgtttgcagcatcttaaaggatgtcatacactaggccagaaccacacttgagatgagccgtcctgtcggagtttgcagtttagcagcgatggggggaggagaaccctagttgccaggacactggaagccaacaggagaaaggatggaggccctaatcaagttagcctggctcaagtgcagggcatgaggagtggagatgtgggccaggaagagctggaagcctgagcactgcaacaaaatcacttcggtggacacacttcatgacaaggccgcagatgcttagtcccaggttaaggactgagtttaaaagtttcagtgaaagactagcaaggcttcaacaagcaattatgacttaatagaacatatacagtatacttcaatgcagaacatacatctacagtgtagatgataacagaatgggcttctaagtatgggtttaaaattccagttcagtcactcactagtcatgtgaccttggaaaagttagttaatatctaagtctgtttcttcatctgtaaaacaggcataacaataggcttactgtaaataggccacaaaagtagaggaaatgcttggcccatggcaaatgctccaaggatggtagctagagatgatgctactatgcttttttatattttgcttcaaagtaggtaaaaagtgcttaattcatatttatttattaggctgaatattaaagaactgcatcttctaccggggactttccttagattctcagctgaattcatctttcttttaaatttaagaaacctggacgtctcaggatttgccttaacaaagtgccaccttcccaactccagaatcactctggagaatcacggccaagatatgtaagctgtatccacacacactccaacctggagaattatattaggattgggtacactttcctggatgcttttttcagatatctcttgagcaaactaaacaaatgcacccctggggtgccacatcacccacagtatttttaatgggtggctaaagcaatcgtggctaaagtaatgaaatcttaactgtctttcccttaacagtgcattactaaaacatttcattcatcttttccatttcgacaaaaccctgtgaatttaccttttcacttcatctataataattatctccagtaaaaccactaaaattcaagtggatccccatgatttccataaatttaaatgtgttcagaattagacaaaaagagagtgacgtgggggaatgaagaacgttaaaagaacaagaggagctgaaaaacacgggacgtgatgagtgaaagaagcgccagggcgaacgcgcggtcccctggcccggcactgctcgccgcgtggcttacccctagaggcgggagcccttccacgatgttcttcttcccagagagaaggtccgacaccggccttttcttcagagagtccctccgggctcggtagcggcctgacgtggtgaggtcggactccgacatggagggcatcagcagcccgtctctccagggccgctgggcctctgcggtcgtgcggacggggctgctgtccatcatcctcttctccgcgtctgggacgtgggccttgggctccaggatgtgcaggggcccggcgagcaggacgcgagggcagccaggtgggtcctgggccaggccgggccgaggctcgcgcgcacgtgcaggaggcgcccgggccccgctctcctcctcgaagtcctcgtcctcctcctcctcgctgctgtggattagcatggtggcgtccgacagggacttcttatggccgtacctcaagccctccgcctcctccggcccttctcgctgtgtcctctcggtgaaaacgctgggctgggagcccaccgagacggctcgcggcgccacctctgccgccgacgcggatagggtgcgctccttgagccgcaggccctccaggccgtggctgagcccggccacctcgatgctgttccgtttgtgcagctgcgcgtggcgcgcggcggtgaggggctcgctgacctcctgcagcgagtgcgccacgggcaggctgtcctcctggaacgtttgcaccgagtggtgcacgcgccgcgtgatgaggtcggggttgctgctgctgatgtaaaggtggcgggacaggtctggcgtgctgttggcgggcctggggggcgggtagggtgggggtggccggtacacctgcgtccgcatgatgttgggagacgggtagtcctgcgcctgcagctgcgcattggtcagctccggcacgctgaccgcgcccaccacgggccgccgctcggcagggtaggggtagggagacgggctgtggaagctgtagctcaggctgaacgggcagtgtgcggccgctggcgaggggagctgtgcgtgctcgcggatctcgggctggctgtagaccagcgccgcgggcctgctgtaggcgtacgagctgccgatgttgaggtttcgcagcgagtggctctgccgttccgcatgcaccaggcccctgttgagctgcttcatcacagtctcatagtctggggtggggcggtaggacgggggtatcacggcgctgtgccgatgggacgggaggtagtcaggcctcatgacgtcactcccggtgatgctagggttggacgacatcggcgagggctgcaagtagggctgaggattatttaaggagttggtgctgtgtgcactgtagacactgccattacggatccgaccgttgaggtcaatctgggctctatccaagcttgtctgagagtgacagtagtatccgttctggttgggcacaaagaggttatctagaaaaaatgagttcaaaatgagatttttttaaatggactaattactccaaccaaatactgagatcggcccttacctctgatgacatttttaacacagcttgtaaaaatccccgctagaatgacctagctttagccacactatctgagtgaccctgggagcttcggcttcctcatctataggatgggcatggctctgcctacttaaggggtggcattcattgggtgacaaagtgagaccctgtcttaaacgaaccacacccacagcagactagcagactttttggaactctggggaagttgaggcagagataccattcaaggcactgggctggggactctgcctttcttccctgggtagggatgtggccttgctgctgctgagctagttcaagcaccaactgtctgtaagcatttccttaactggaaatttttattgttcttcccaaatgaatatgagagcttcgactgtaaaagggtaatggtatagcaggatctgaacttctctggtccaacagtgtcaccagcagccacacagcccataaagtgtccagaagccaagaggagccacattaaacagctgcagctgccccctgccctggcccccatgtttcaggaagatccagacctgcagctaacagaatcagtttaacctaatcttaaaatagctatgcatgtgtccctgcccagggatgacaggggccatgtttcttctagtcaatttgtagctcacctgccctctgttactgaggatgatttctaaccctagatgatttctaacactcagcagccaactccttcaaataacaatttcctctgaaaggcattctttttgtgcttcgaaagctccatggtgatttatgtgatcatggtgatacttaagtaatacaccacaatccagtgggtacactttattctggtggcacatgcagctgtgaggaaatagcactcaaatctccatggtattcttctgctgacacacagcacttccatgtcactgtgctttcctcatttatgcaaagcttggtcatggctccatctctgcaatccccctttcctcactgctgccacagctcgggcccctaccccagcttgtctgaactagctctatatacacctagtctccctgcttctgcaccccacaaaccatctagccatttatgagactgttatgtggaaaaggcaatactaagaatagaaggaggaaaagatggttggaatacaggcaagaaaaggggaaaggtatgcatgaaatcaccataattcaaggaagggagaagagatgaagggttacaggagtccagaggaagaaatgctcatttccagcctgagttgggttgatggggacaaggaagagagaaccaagaaccacctcacaagatatggcagttaaggggacttgaggggtaagtgggtggggtgggcgtgtccagcttccatcagaagtgaggtctctccacctctcagagcacgcagggttacccctcctcaccccttgatatcaggcacaacaatgcgactagtaatggtcaagggaaagtgcacagagggttaaaagccagcttccaggctctcttccaactgcaacactgaccaacaacattccagagagaagagcctctccagctcaagcccctacggcagactcagacagggcagagccctcctgctagtacagtgtgcaacggacaggtgacctttattattacttccctgagagtttggaatggagtattttgtcagcacagcatagccctgcctatccggtctgcatggcagcatgtgaacggaagggtgcatggggtaagggcacctgagggtgcagagcggcactggcaaagccagggtgcacccctgggcaagctggggtggctagagtgtcagatagctacagaggagtaaaataacttgggaagtaaggttggaagggcaggctcagggaatattgtgtggagtctcgaacaccaggcaaaagaatgatcctgcacacagccgtgtgcagtggctcacacctgtaacactagcactttgggaggccaaggtgggcagatcacccaaggtcgggagtttgagaccagcctgaccaacacggagagaccccatctctactaaaaatacaaaattagctgggcgtggtggcgcatgcctgtaatcccagctacttgggaggctgaggcttgaacccaggaggcagaggtggcagtgagctaaaatcatgccattgcactctagcctggacaacaaaagcgaaactccatctcaaaagaaaagaaaagaaaagaaaagaaatgttaaatgtagatgagatccctgggaagctcacagagggagggaaaaagccacaggacagacctgcagagctcaccaaacaatactgatgggaaggaggagggaaaaacctagcatgccaggagagtttccagaaggtacaaaggcttgaatgtgatggtgaggggatgtgggggtgctgggaggctcccagagggccgctttaacagagtggcaaagacagaggagtgggcgggtaaccagcaagcagaagcagcacacagagagtactcttataagtcagtgagaaagggctgggcacagtggctcacacctgtaatccccactttggaaggccaaggcaggcggattacgaggtcaggagatcaagaccatcctggctaacacggtgaaaccccgtctctactaaaaatacaaaaaattagccgggcgtggtggcgggtgcctgtagtcccagctactcaggaggctgaggcaggagaatggcgtgaacccaggaggcagggcttgcagtgagccgagatcgcgccacttcactccagcctgggcaacagagtgagactccgtctccaaaaaaaaaaaaaaaaaagtcagtgagaaaagaaagcagatcactcaaaccattacttaaagggaggagaatgaacaatattaagatgtttatagacagagggaagagaatgagtggcaaagtgagactaacaatgcagaggacagccaggtcctggaagtgggaggggccgggattgcaaataccagacaagggcagggtgcaagagggaggaaatacaagaacatggtgagggggatgctctcaggctctacacccaaagccctgctctctactacccacctcactgcatgaaaaccctcatcttttacaccagggccgacacaaacaatacagtcacatcccaccttctggtcccttcatgcatcactccctaccagttccttacccgagaggaaacctggaccactctactctccaaacacaccctgcttcattctgtgcctggcgttcactatccccaaaactaggaacagcaaccccagtcaagttcctgcctttctacctgctgaaatccacccatcttttcagatacagaaagttcttctcaatctccccaatgtgatgagtctctcttccactgaggagcatggtaattgcacatgctgtctcagaaaaactatcatattcaagttatttgtgccaggagtggtggctcaggcctataatcccagcacttagaaaggcagaggcaggaggatagcttgggcccaggagattgagaccaccctgagcaatatagcaagaccccattctccacgaaaaaggggttcaggggagaaagacaaagttatttgtgcacttgtcttatcttaaactattagattctaaggtgttttttttttttttgagatagtctccctctgtcatccaggctggagtgcagtagcacaaaatcttggctcactgcaacctccacccccaccttgggcttaagcaatcctcctacctcagcctcctgagtagctgggactggaggtgcataccactacgcccagctattttttttttttttttttggtagagacagggtctggccctgtggtccaggctgaagataaacttcttaagatgtggaaatactcatctgcataaacctccttagcatttggtatagccccatacagagagagtatagagtaaatgttaattgactgcttaaacttcagcttgggggtttgttataaatacaattccttatacttctcatgtgaaaactgcagtagtcatgtgtttaacttttacaataggaaagcctctggcagggaaagaaaagtaaccctgggaattctttgtcagatagcaaagaagcacttaaaggctaatagggtggtggtaaaaggacacaggaaccagcttgatagtttcccattggccaaatttgagaccagtggagcatcaaaatttgatactgcatgtttttacatacattcaagaacccaaatatacctggatcatctgaggtcaggagtttgagaccagtctggccaacatggtgaaaccccatgtctactaaaaaatacaaaaattagccaggcgtggtggcgtgcctgtagtcccagctacttgggaagctgaggcacaagaattgcttgaatctaggaggtggatgttgcagtgagctgagacacgccactgcactctagcctgggtgacacattgagactctgtctccaaaaaaacaaacaaacaaacaaaaaacaatatattggcttcttttatgaatccaggatagctattatcatgatgcaatttggggtgcaacttcagccaaaaactgtccaggcttcatgatctccaagcattcacagatttatccatagtcataactatgtaaggcatggcagaaacagtgtactttaccttgggaagaagcatatggttctgtataatgtccattatagtgcaactgcggtgggggaggcatcacgtagggctggggtttaggctaagaaatggagagtttgacacagggttgaaacacattgcttatgtaatacaggtaaagttattatccactggattctttctgttaaaaaaacttctaaaggaattaaatatattatatatggaaaataaacatgaagacacagtagttcttaacatatctagcatttctgtttccccaaatggcaatgtcaagccctatgactgataccaaggacattaggctccaccagaaaatctgcatctaaaaagctaagagcaagaagcaatagatacacatttccttgtagaaacatttcaacataagaagcttataggtattatagtcaatcttattaaaggcatctagtattttaaatatataccaacttaggattactcttggccaatagtctaagttcttaatattaaggtcagacctaatattcaaatatgtataatataataatataaatattaggttggacctatgggaaaaaattaccatttctttggttaaaaatgatgaaatatcaatacacttttatggttcaaactcaaaattaacagcattgaaagcatattttattcaggaaaaacatcactaaaataaaaaagcaatcatattttccttgtttcttaccagagacatccttgaagaagacctcctcctgattgggttcactgtgacagtctgagtttgcctataaaataggatgactctgagaagagcacatacacactctctcttaaattctaccaaaacaagatataggaatgtaaaataataaatcttctcaggcaaaaaaaaagacaagctatctaagtcatgaagtcaaagaaaagaagggaggttctctgtcggcccgtggggcctcagccctttcctgctgccccaacccgtcaacctgccctgtggtttcaggctccccacacagcatcatcgcctggacccacaaggggatcagagcatacttcccaggcccatccaataaacctctggattagccataagcagtggggaaagagacaaggctacatcacccacacacttgtcgcaggagaagctggattcagtgcaaatgcaaatgtgtttctcctatgcgctgggggagccctgggtccctccactaaccttcctcccgggggaccatccactgtcaacccagaagcctcaagcagtaagaactgcctttaattaaaagtctgttaaccacagactacaaacataatgaagaaatgaatttatgattttagtgacaagaatctacatttccaagtgcagtaagcatgctcctgtagacccgcctcttgggagcatcttgggcccaggagttcaagaccagcctagacaacatagtgagaccccatcttttaaaaaactcaaatataaaaaaatttcaaacctacgtattttttaaatctacatttcctctaaggaaccaagggaaagcaaagcacaagacttggttcagtgagccgatggtaaacccatttacctttctttgcaagaaatttctgatttgttttgaatatactttttaaaaaaacacctaaggccaggcgcagtggctcacacctgtaatcccaaactttcagaggccaaggcgggtggatcacctgaagtcaggagttcgagaccacctggccaacatggtgaaacctcatctctactgaaaatacaaaaactagctgggcatggtggtgggtgcctataatcccagctactcgggagtctgaggcaggggagtcacttgaacccaggaggcagaggttgcagtgagccgagattgcgccattgcactccagcctgggcaacaagagcgagattctagcctcaaaaaaaaaaaaaaaaaaaagtacctaaacgtattagggagtgctgacaaacactaatgtgataatgtgagattttcaactactcacacagcaagttctatctttaaaaaaacaataaggtaaaaaaaggaaacagacacagaaaagcccatttgtaactattgttttcaaataaaggcaagatttttttttcttctgtgtggtcagttttactgcaagatctaggaacctaaacacactggattcttggctttgttgatgacatgtagttttgtcaaagcactttttcttataccttttaccacctattcctggttcatgtacttatgtaacacataatcactgattacaaaaatattttgtgacctttggttacagtgttctaaggactaattactagaaaatccatcatgacaaagtgaatattcaatccatttaagcaaatttaccataatatcaagcctcatgtctcataaattaatattactcttagcactctgaaaactagtatcttatattcaaaaaccctgaatattagcttatttttataagactcttgagataaaaagaaaactagtacatactagttttaacatcaggtgattacaactgcttttactagcttttataaataatttcatttctttgttactggaaagtattcaggctgttaatgaaaaataaatgtctcttttccaaaagatattccattcttccagtatttattttggtgacacaagtctgcatggcgtgtctgggttttaaaaaataaaaaataaaaaataaaaaatactccttaactgcacattaatatattccttaaaattagtgcccacaaattagccaggcgcggtggcaggcgcctgtaatcccagctactcaggacgctgaggcaggagaatcgcttgagccaagggggcggaggttgcagtgagccgagatcacgccactgcactccagcctgggcgacagagtgagactccatctcaaaaaaaaaaaaaaaaaaaatagtgcccagaatttgaagacgctgcatttttgcagccttgaaatttactttgtctctggttattcttcattgtcaggactaggtttaggcaaactgggtcctctgaaccctgtgttcagtctagcagagactcactgtctagatggactgaacttaagaaacttttaaagtactacaaattcacaaggattgccaacagaattctctgtcaacaaactccaacaacatgtctacagttgcccagcctggggcaaaaataaaacacaaaacccaaggatgcagagcttcagcacatgggcggccctcccacactgagagcttatcttggcgctcttgccgcagcacccagtgtggaggcgaacactgcccactgtagtagccggctctactaagaaaacaaactacaaaagcgtgtacctgccaaagtgcttgacccaggcagccacgccatcagttctaatagtctaaccttctctttcttcttggcattgttcttataaatgcagtttactctgagaccagctatcctcagcttggcatacaagagaaaaccatgtaactgttggctgtggtttccaaactttttgggcagttactatgttgatgggtgctgctaaataactgagaagaaatcactagaatctgtgtgccaaagaagacaaaataaaaattaaaaaggctgagccaggcgtggtggcacatgcccgtgtagtgccagcgacttggaaggctgaggcaggaggatcccttgaatccaggagttcatggctgtagtgcactacgatcccatctgcgaattcccaccatattctacctgggaaactgggatactaggacctggtgtctttaaaaaaaagaaaaaagtctaccagcccaagtaaaatcaatattatttattgaaactgtgctaaggactgtacatgattatctcgtggaatgtgaacaccaaacccataagggaggtccagttattatcctgattttacagataaggaaagtgatacgtaagttcagtaagttgctcctggtcacatggcaaacaagtagtagaaccggcatttgaaccagcaggtctgtcagattcctgagtgtatgtgtctaacaatcatgtgtccaacctgctccccaaccccaactaatctgtaagctccgtggaggcaagatgtggtatccctggtgcctttgctgagcaaatgagtgactaacaagtgaggactaaagtgatgcttattactaagcatttacagctgagcttgtatttctaagcctcgtctgaattttgctttgtaagtttcctttcttatacgatgtaagggagttaagattttgataaacaaaaagatgccattgaaagctcatgcactaatagatagttcaaggaatagattccttcctgtaatcccaggtacttaggaggctgagatgtgaggatcacttgaggccaggggtttaagaccagcctgggcaacacagcaagaccccatctctaaaaaactaaaaaaaaaaattagccaggcatggtggcacacgcttataatcctggctacttcagaagctgagggctgaggccagtggatcccttaagcccgggagtctgaggttacagtgagctatgatcacaccaccacactccagcctggaagacagagcaagaccccgtctctttaaaaaaataaataaataaaagtgttagatggtggaaatacctagcaaatgtttgtctcaatgacttacaccttttgagctcactatagtaagggtaaggaagaataaatgctctcctcccagcctacacttgggtagaccagggctgcatccaagctgcttacaggtcactgacttggctctgggatgcctgcttccactgttcacccccctaccaaaccccgccttaggtgtagcttcctggcattgtgggatgggagaggaacaaagccagcagagaccatctcaggtaactgggaaggaatactgatggagggagaggccctagtgtcactccagccccatgaaatgtgtggttttctttttttttttttggagatggagtcttgctctgtcgcccaggctgaaatgcagtggtgcgatcctggctcactgcaacctccacctcccaggctcaagggattctcctgcctcagccttccgagcagctgggattataggcgcccgccaccacgccaggctaagttttgcatttttagtagagacggggtttcaccttgttggccaggctagtcttgaactcctggcctcagataatccacctgcttcagcctctcaaagtgctgggattacaggcatgagccaccgtgaccggccgacatgtgtggttttccagggtgacactgacctttatccatataagaacctactcagaaaaagccgctgcctctcctcggctccaccaggggtccatgtccccatacccagaggtcccactgtttggccttgtggctgctcctcctctcccctcccacctcttcctgccctgctccttcacatggatccatgggaactactgggtcctctctacacttctggggctcaggggactggaatgggataggggctgctccatcttcttccagacttcctatagtctcttcaagccctgcagtaggccaagaagatgggtaaactctttccctttccaggcagggcctactctagtcagtctcctgattacaaaagtctccggaaccaaggtggacaccggctgctatgttcaccaacacccctgagctgcagggagcactcaccagccatctcactgcgctcagcgagtggcctgctgcagtctgaaatacaagtttcccttctggagaaagtctcttgaaccctctatcacttggctttgcaggttgaaggataccatcctcccttttcctcacagaaaagagcaggggagccacctacaccaaggggcctctcatgactccccaactctctcggcattttccttatataaatcagggagggtgcttacagcatgaccagttctggggcttagagtgagagacagtgggtttgaagcagatttctgatctaacaggttgacattattatgtcatttaattcccaattcaaccataaaggaatattaagtataaaagtctcaatatcctcactttataattttaaaagacagattgttatccatctaacatttttaaggtttggataacgatcattctgttatctaatgcactttgttagggggtggagggagaaggctgttggattatgccattgtataaatactaaaatatagttatctgggtcaagattagatgagtcacataaggccatcccaagcagcaataaactacaatagatcaggactgggggtaaaggggacaccctgggattacagttcccctttctgtgcaagtcgagtctatctcctgggccaccagtcaccccagcccaaagcagatgtccagaagccaccgtccagttccaggccaggggcagttttgttaaatgcctatcacgctttagtttacccatctggcccatgacaacaagtctaccaatacttcagaatcataatattggaacatgactaaacagtctatattgagagcctttaaaacatggccataacaattaaagttcttttcattttattatcaagcaaaattttaaaagctaatattaaaagcttcatttactttatgtgggaaacaaacgctcacaatgaaatatattagttccctacagaatgaatcataagtaattacataggaatagctcatggaaatcgactgccacaatctattggatatatagagattgaaagcaaactttggaaaacagccctttaaacataactattccattttaaaaagattcaggtgttccttatttaggtatagcatatgcaactgatgacattaatgtagttttgttcacacttgccaataaatagcaatattccaaaaactagagctgaatttctaagactcattcaccataatcaatcatttgttgcttttccctcttccctcttttacttattacaagttgttaatttgcaaaaaaaaaaacacaaaacaaaacaaacaaacaaacaaaaaacaggcactaaccaccaaccaatatggatgcctcatggaaagggattatgttttatggtttattcaaaatgtagactctccactattttccagagaagaaacaaactgaggtaataatggctcaatattatgaacactcttaacttattaaagtctttaaaatgaaaatgctgtggtccaacagactgcattatctactgcttgaatcttagaacttacttctgcatagaaatcatgccacatatggctggataaccaggccagccccagggaaccccaaaggcaagtagcactactgaatatcaccaccagggggaacactttcatatgcaaatacacccaggcccctagcagaaaccgcttcccatatttacaaagaaagcaggttcctcctccctgtcagtgcttacgaaaatcccatcaccagaccagcgatggggactcggatgcaaacatggtgcaggggaaggcagagaagagacagggactgggccatacatgcaaaccactggccagctccccgtccgggtgggcatccccgcatgttatctttacactgctgctcctgcccagagtttctctcacaccctgcaagacagaaggcacttccacagcctttctccttccttcctggtgctaagggacaaaatgcccttgttagactttgcctccaccccatgcctcatttacaatctgtaataaaaggaagagacaaaggagcaaaagtgctcttctcccctgtgactcccatcactgccacactccggctcccattgttcactaagcccttatgcaccgggcaccttgccagacaggggacacgaagatgaggaagaggagaccctgccctcatggagcttcatcaaacaagagagacagatcaaatgaaaatgatctgtcagttgatatctgtcaatatgaaaaaagcaggcaggaactactctaacaggctagcacagcggctaagagcacaggctcgagtcttgctgctccacttactagttgtgtggcagggcaagacatttcacttctgtaagtctccataccttcatcaataatgggatagtaataattgtgcccaacagggttactgtaaggattaaagaaaataaaagctctcagtataatgcttgacacagagcaagcatttactaaattattgttatgaattattcaggtcattgttataaaagaggtagaaaaaacaactttcagagtggtgtcaaggactaagcaaactgaatgtttggtggtgtctatgggggctgtattttaaactcaatcttgaagaatgactaagagtctgtcagagaagggaaggaagggcattttagcaaaggcctgggctgggggcattcacatgataaggaaagatgccttcctggagtcagactccaaggccaactgggctggggcagctaagtccagagaaggacctcaggagtctgcccttaatcctgtacccaggacggggcgggtgagaggcacatgctcagatttgttcctgacatgtaacttcaagagcagtgctacatattttgcttatctatccagaagactgactgcatacagatgagatagggcgtggggggccaagtgggagggagctccaggaggtgcctccagacatggaccagggacaagaggacagcttaaagaaaggttgtgggaattgagtgcaacatttcgggtctcagcttagatgtcacttggctgggtagcctttcctatcttggcagttctgggtgacgtaccattttcctaagggatcttacagcaccaagacatcttgaatcagagctcttaacacctgtatctatagattagctgaacaaattcattaaggccgacagtgagccaggcccttgcttggcatggggaatatagcactgaaggcagggaagagtgtctgtcctcaagcactgctctagagctaacctgctggcaggggatacaggcaaacaaacaaacaaacaaatatagaaattcacatggtgctaagtgctataaagaacaaaacaaagttagagggtaaagagacagatcatagtggaaggggggtaccataggacaatcagggacagcctctgaagagggtcatatctgaccagacagcaggctgcaatgagggagcaaggcaggtggagacctgggaaaagagcaaggacagcatcccctagggtgaggcacatctgcagcctagccaggataccactgtggctggaacagagcaagcagggaggaggataaaagacataaggttgaaaccaggcaaggaccacactgtgtatggcctcgtacttttattagaagtaaaatggggccaggcctggtggctcacacctgtccagccctttgagaggccggggcaggaggattcctaaagtccagaagtttgagaccggtgtgggtaacataaggagatcctgcctctataaaaaacaccaaaaaattaaccaggtacacacctgtggtaccagctactcaggaggctgaggtgggaggatcacctgagcccagggaggttgagaggctgctgtgagccatgatcatgccactgtactcagcctgggtgacagagctgtctcaaaaacaaactaaaaaaattacttaaaaaaagaagtggaatgccaaaggagggttaagaagagtgaaaggatctgggcagggtgcggtggctcacacctgtaatcccagcactttgggaggctgaggcaggtggatcacgaggtcaggagatcaagaccatcctggccaacatggtgaaaccccatctctactaaaaatacaaaaaattagctgggcgtggtggcatgtgcctgtagtcccagctactcaagaggctgaggcaggagaatcacttgaacccgggaggcggaggttgcagtgagccaagatcgtgccactgcactccagcctgggtgacagagcgagactctgtctccaaaaaaaaaaaaaaaaaaaaaaaaaagaagagtgtcagtgtcaggatctgattcaggttaaactaagatcattctggctgacatatggaaaataagctacaggcagcgaaggcacagaaacaggaaagtcagaaggctacctcagtattctgatgagaagtagtggcagccagcactaagctgttaacacgagtggtaaaaatggtcaggtttcataccacatccaattcatcagcaagttctgccagctctaccttcagaatatacaggcagtagtatatattcaccacaactttcagagtggtattgaggactaagcacactaaatgcttgcggtaggatgcaggagtcaagagctcaaggagggccgggcacggtggctcacgcctgtaatcccagcactttgggaggccaaggcaggcagatcacctgaggttggaagttcaagaccagcctgaacaacatggagaaaccctgtctctactaaaaatacaaaattagtggggtgtggtggcgcatgcctgtaatcccagctactcgggaggctgaggcaggagaatcacttgaaccgggggctcagggggaggacaggtcaggagaagccccctagacgaaaggatttggagaaaaggcctcaggaccaaaccagcaaaggtgactgagaagaaacagcctagaaagaggaagccgagcagggggtggtgtcctggcagccgaagaagagcaggattccagaaggatggaaggagctgtcggaggatcagtactgcggagcggtcaagtgagagaactcatgaaatgatcactggacgaaagtcacctgaccacaacaagcagcatcagtaacgtggaggcttagggaaaatgggatggaaggaaggaaacatacaagcatacacaactctcttgaggaaacctgctattcaggaaagcagagatatggtgcagaggctggaggggagtatagatgaaggacaatattttatatgtgcaatatcaccgtgtgctttattgatctggcaaacagtaagaaacccatgtgggctaagaaaaatgcacaccaggaaggaggggcaaaaattcttcagatagctggaaaagctgaataatctttaatgactcaaaatgcttaccagaggattgatttaaacaaataaaggatattattccctttttacctttcaagaattacaatggttcttgtaactagttgaaataaatcttagaggcatacaatgtagttattacaagttggtccaaagctaaaataggaaaacagctataggatcaagaaaagatgtcaactgataaaatgtctttcttgatgatacagtatactcaagattacaatttctaaattcattatttttgataatttccatgagcaggacatacttacaggttacactggtttagtctgtaaaacttgtgtcgcgcaacacagagtctccaaatgtattttgctgtttccatgtcttcctagcaaacaaaataggcataaagcaatatgaaagcacacatacaacttgatacgtttaatgcagagtttgtctaaagacataatgggtgacatcatatgacaaagtcactttcagaacactataagcctttcattttccaacactgtgcccatggtatgaataccacaagtaggatttaatttatgaagacaaaacaatctgttctaacagtgtgattctcatattaaacagtttcaaaatgacttgggaatctaaaaactataaaaataccaacttttattcttgccaaatatactcaaagacatttttaaacaaaaatatgactcagtaactcaatattgcctttgtcaagagagcaaaagcaagtaactgttaaataacatttcttcagagctattcatttatcaatgaaatttaagatatcagtgcttactttctcccccacataatccctgaagtttaatttaaaggttatcatgatcagacagtagttatccaaagactcattcactcagcatttactgagcagccattttttgctaactgccattttgcaaaatgctatatgataaaactgcatgttttatacaattacaaaatattatcattttaatgctgccctgcctccaaacacatacaggcacgcagaagtagaacttgttaacttttaggaaaaacattccatgcagacccctaatgtttactcacagtttgaaattgaatggtctcctctttatttgccagctctaatgcaaaaaaggacttgttgtgggacatgttggcaatgtcatgccacctaaagaacagcaaatagagaactggcaatgtgagtgcccatgggggaaacaaggagatagaatacacaagttttccctaagcctgacgtgtaagttagcatttggtaacatttttgagaaaaacaaaaaacaaaaaacacgagaccagcctggccaacatggtgaaaccctgtctctattaaaaatacaaaaactagcccaggcgcagtggctcacgcctgtaatctcagcactttgggaggccaaggtgggtggatcacgaggtcaggagatggagaccatcctggctaacatggtgaaaccccgtctctactaaaaatacaaaaaaaaagaaaaaactcgccaggcgtggtagcaggtacctgtaggcccagctactcgggaggctgaggcgggagaatggtgtgaacccgggaggcagagcttgcagtgagccgagatcgcaccactgcactccaacctgggcgacagagtgagacactgcctcaaacaaacaaacaaagaaacaaataaaaaacaaaaactaggtcaggcatggtggctcacgcctgcaatccgagcactttgggaggccgaggcaggtggatcacctgaggtcacgagtttcagactcctggccaacatggtgaaaccctgtctctactaagaatacaaaaaaaattagctgggcatggtggtgggcacctgcaatcccagctacttgggaggctgaggcaggagaatcgcttgaacccaggaggcggaggttgcagtgagctgagacagcaccattgcactccagcgtgggcaacaaaaatgaaactctgtctaaaaaaaaaaaaaaaattacaaaaactaggccaggcgaggtggcaggcacctgtaatcccagctacttgggaggctgaggcagaagaattgtctgaacctgggaggcagaagttgcagtgaaccaagattgtgccactgcatgccagtctgggcaacagaacgagactctgtctcaaaaaaaaccaaaacagaaaaaagaaaaaaaaaaacagtggttttaatcagctagcatgaatgttctaattgaagtaacagcagctagttcaaaaagtaaactcatgtataataaatgagggaaaagagaatttaaaagatgtaaaatgtatcattctcatgtgtcagatttgcttgatggaagatccctctcttagctgattgccaatgccccatttattcattcaacaaaataaaagacacctattataacaatgccagaaattgcagtaggtcctagggacactaagattagtgagttacagtgcttccctcaaattcgcacagttggaggggaaaggtgggagaaagaacacagaagcaaacaagaacttttaagtgctgcaggtattaaaataaggcacaaaagtgggggaggtgtgctctgaaaagcttcagggtgaagataaatttgaaatgccaggaactcaaagagtgaactattctggaagtgatcactaggattcaaaatcttatactttctaattttatcgtattagcttttatatgttaatatttgattttattaatcacagaattttataaaaagaaaaaattatggaagaaaaaattttatccttctccattagatttatttattttaaatgtattaaaataaaatcaacttagtacggattccgttgtttgttaaatctaaagattattagcatcacattaaggcaactgtgaaaattcctatccagtgataaaggaagccaggtagaagcctcaagtttccatgtgacactttgggcaccatcagagccctgctcttcaggtgaagccacggatccattttcctctcctctccctgacccccaactcagcatgttgggaagggttaatataagtggcttggggacgagagagcaactgccaaaggggagccacccagcccagggcagtgcattctaggaatggggttctgctccccaagtgatgcgtactctctgaggtcataatcaccatggagaattcatggctcaagaggcagtaaagcaaaggaagtgagggaggagatgtcagtttagagaaaaagctcttcaaaggccaaactagttctcaagaagaaatggtaggagtggtttagaaagcttgagtagtgtgtgtgttgtggggcgggcagtgagtaggcggtggagagaataaaagctgtttaatacagcgattaagagcccacgcataaagtggaggatccaagttctagtcctagttatgccagttaataactgggtcaccatggacaaatcacaacttttctaagcctcaattatcacacgtgcaaagtggtggtaatacctactgctgacagtgttatgaagattacactaaaaaaaattcacaaaaaatgctcagcatagtttatctgactcatgataagcactcaacaaatggtagacacaaaggaaccaaaaaacagaagtgatagaatatgttttcctgccttataaaaacaatataagcttttggttggacatgaactttgggttttccagataacagattttaaggaattaaaggtaggggattgtacaatatggtccaacttactatctttaagatacaaattagaacacagaatactataaaggaaattaaaatcacctgtactttcattgttcagagtcagttactattagcacatcgctatatattctttccaacttgcttcacattccaagatttccacaaatgaatagtatctttttttatatcagcaaaaaaaaccaacattataaaaaataattgaaatttgcttagatactggtattttaggaattttggtacaaaactagagtcaaaacaaagctctatatttttcataggaaagagcccttcaggctgggcacagtgggctcacacctggaatcccagcactgtgggaggcaggcagatagcttgagcccaagagtttgagactagcctgggcaacatggtgaaactgtctccacaaaaaatacaaaaattagccaggcatggtggcattagcctgtagtcctagccactcaggaagctgggatgggaggatcacttcagcctgggaggtcaaggctgcagtgagtggtgactgtaccactgcactctagcctgggcaacagagtgagaccttgcctcacaataaataaattaaccaataaatagccttggaaaccagagctcaaattaaacattcatatcaaagcaaagaatggcctccatatggcacaaaaagggtcacacatttttaagcattttataataggccgtcattataggcattatactctggacatagagttttgaagaaagcggcttattgaaaaggactgttgcattcagatggtatttttttcctaggaagggaattatttccattttttaatgagaccttggtatagacttgtgaacaatttaactgctgtaagtactaaaaaatgtatcaccaacaggagccatagaaaacatacaaaaagaggtaagaaaaatacctaaataccacaggatgccttccattcttgtgtttcacaaagataccttcaagacacgctccaatggatatgtcacttccttggctatcctacaaggagaaagcagaagaagaaacacccaggaagcagatgcagaggaactgctgctagagttccctggactggtttcccagatgtagaaagttccgaagacctacagagtaactattcaggaagacaaaagtctgaatgagatctatgatcttataggtaagtataaaaattgaaaaagtttggccctccttaggaactctatttcaagaccatttcaaagtatgaaccacaaaatgggaatgtgttttaccacaaaactttggtcaccaggacctcagcttttaagtttccagagttttgcacgtcctcagcctttgcacataaggacatccttggatttccccatgattttctcaaatttgtaagcctaactttaaagagccccagccgccaagccacacttaccttagcagggtagctctcttctccatagccatccattctctctacctcctgcatgtacagcatttcagcatcaggagctgtgagccctctgcaacccaaaagaagcaagattgttcacaaagcaagcttaaaatggtttaaaataaagcttttcttaaaacctatatgtcaatttagcataagacattataaacatttcacgtttctaagcatctataattggctatatcaatcttgctatttactgaaaaccagtatgtgctgaatgctgagggtatcacatgagatcctgctctccatacttaaggcagatgagtgggaaggtgggggataaaacaactccctaaaaaatcttagggtgaaatcttgaacttttcttaaaccaccaagtaattgcttattatcccaaatatcagggctgggcatggtgactcatgcctgtaaccgcagcaccttgggaagccaaggacaaaggaccacctgaggccagcagtttgagaccagcctgggcaacatagtgagaccctgtcactacaaaaaaaaaaatgttttaaattagccaggcatggtggtgcacatctatagtcccagcagcttggaaggctgaggtgggaagactgcttgagcccaggagttcaaggatgcagtgagctatgatcgctccactgcatgccagtctgggcaacaaaaaaacaaaaaaaaacaaaaataaaaacaacaaaatatgaggcattactgagaattatgtgctaaatgtcgaacgcagggaataagggtacgaggaggctacatgaaaacccctttttgctcaggtgagtgcaacactactaggatgggtaggaaggcagtgtgggtaaaggaggagtgcccaagtgcatgcagacttgcatctccagcctcatcttccgatgctccccgctgtcctcaaggcacccacactgcagccatcccaaactctgcatctcttcagatagaatatgttccctagcccctctgggcttttgcacatgagaatccctcttcttggtgtgcctgtgactcacctgtggacctggccaatccctaatatccttcaagactctgtctatgcatcatttcctctggatcaccttctgggattctccaatgccgcagctccatgcagtcccaacacattccgcccatacccctctaactgcactcattatcttcttatatgtattataattactatagtgggttgtcctgccagccctcatattgcagggctgggaatgcactcttagaagacaagaaattattctatttatctttgtgtcatagcatccagcactcttcctctgcttaatgcagaataagaacactaagctatcttttaaggaaatgcacaaatgaataaatggaagtgacaaaaggcaggacaatgtgtgcctgagggaccaattaagctagaaaagaaatggttcatgtggttctgctgtccagcagaaggtaaagctgggaaggcaggatttaaccaacttgtaggaggcctttaatcccagggtaatgaacttgggctagtagaaagcatgaaaatacccatgagcacgtggaaggagaaggagagaggtaagaggaaactgatattctagggagattaatcttttgtgagtcactgtgtggatttgagtggagagagactagaggcaaaagtttattttatttggaaggggataagcaataggttctaatgaaactgatctgctttcaatttccacctctaccacacgtagaggtaactaaatctttttcttttttttttttttgctctgtcaccaggctggagtgcagtggcacgatctcagctcactgcaacctccacctcccaggttcaagcgaatcccctgcctcagccttctgagtagctgagactaccggtgcatgccaccacacctggctaattttttgtattttagtggagacagggtttcaacatgtttgccaggatggtctcgatctcctgacctcgtgatctgcccacctcagcctcccaagtgctgggattacaggtgtgagccactgctcccagccagagataacaaaatctttttgagcttggtttccccatctggtaagatggagataataatgtttatcttaatgagtagttataagaatttaatgatagagtacagacagtcctcaacttacgatgatggttcaactgaatgactttcaactttacagtggtacaaaggtgatacaaattcagtaggaactgtacttcgaggacccacgcaactattctgtttttcactttcagtacagtattcaacaaattatatgagatattcaacattataaaatatattacaggctttgtgttagatgattttgcccaaccgtatgctaacataagtgttctgagaacacgtagggtaggttagggtaagctatgatgttcagcaggactggtgtattaaatacatctcgacttaaagagtattttcaacttactatgggtttatcaggacttaaccccatcacaagtcaaggagcatctatatgtggaactgtgtggtagttggtttagaataagacttagcattatccagaagagtattttttcttacaggcaacacagagattcatcatgaaagaacgtcaatatgtacaagtatacaaaggtatgcagaagcatagttcagagtaataagcaccatagctcttagcatagctccccaggtgacagacacagcttccataggtatagagagggaagtaaccctgtacttgctaagctgtatcataaaagaaaacaaatcatcctaattttacgttaacctatacaggtttgtttgaggttatcaaacaaacctttactacatgcagtaaaaaatgggcacccttcaatgactggctgctttcaacttcctcagtgtcctcactggtaaaacatggacaataaataagtaatatgggtaagtgcttacttagaacagcacatgacacacagtgagtgctatataaatgttggctacttgtaatagtagtggcagtaatgttccaaatttagttgggcaaataaatattaatcatgtaaattaaatatttaattgaatatttcaaattcaagcagacattggttctatgctatttccatgtcttatttcttagagttacctgtatttctgatgtagtaaggccactttttgggttgcttcttccaatactttttcatcttgtaaccatccctgaagaaaacacacagtggtaagtatgtgacaattcaccccaatttcttagaaggaatcatggccattgactgttaatgactctcgtcactatcaggcaaaattatgactattgttactatatgggagctttgtttacataggtaatcatctttctaaggaattaactggcttctcacaagagccaaaaaaaaaaaacttgccccaccttctcaattccagggaaagtttcagctgagttatgtcaagttggtgacagtagttagccagtcctgagcccagcaagataaaaacatcttgtgcgttctctggcactgtgtagacactcagaacagcataccacaccttccttagttgttgcaatgcagtttccatgtcccttccatcagtaatgactttataaaagtagaaggcagtgtctttgtcatctactttttaaattgctgatgagaagcgacattcctcaatataattttgtaaggtttcaaaccttcagttaaaagcaaaacctgtgcatgcttcctgagaagctgaaaatgaatccttctttttaaactcacaaatagaaaacaaatgtctccaggcacagtgcagtgactacagacccttcagtttctgtgggttcacaaggaccaagatgactacaacagggaaagcagtcacacttgagatgtttataagagggaatttttttttataatcctattcctgacagtaagtctatcatacggatttcatttcagggattattaagggtataggaataaactgtttcttttaaaaggcccagtgtcaaaagaagtcttaccacaggaaacaaggcaaatttctgaagaaagtcctgggattcatactgatcaaagtcaccaaaatccgctatatagaatgacaaacattcacgttaattatatttaaatttcattgcaaaatatgcacaacaaaattcaatacgcagtatatctagatggtatgctaatatttcagaagtcaaatttgttatagctatataaagtatatttttaaagtatctttttaaaagtgttaattaggcagatatgagtcttggcttggaaaaatgcctatgaattaaataaaaaaacaagttgcaagctctatgtaatatgatctcattttacagttaaaatgcaaacaaaacctaccctgtaatcatatatgcttgcttatgtacaggaaaatgtcaaggagaaaccaaattgtcaacagtactgatgacctctggggaatagacttagaccacttgaatatattacagcaagatatatttgtgttgaaatttttaatattttttaaaaaattgacaattcagcaaaatgcttatgaaaaagtaattcttaaagccaaaagtgatacttaagaaaatctaaagtaccttgaaaaggaatgtggctccatgtgcatcaggcatttgtttaaaaatgatacatgtctccatgccttcttatagctgaaggagttttattaataattattctgattaaatttcactcccaaggctaaatgccagttattgtttgaaataatgccccatcagaaatcttcccagccaggcacagtggctcacacctataatcccagcacttcagtaagccaaggagggaggatagcttgagccaaagagtctgagaccagcctagcaacatagcaagaccctatctctataaaaaattttaaaaatcagccaggcatggtagcgcacacctgtagtcacagctacttgggaggctcaggtgggaggatcacttgagcacagtaggttgtggctgcagtgcgccacgatcacatcactgcactcaagcctgggcaacagagtaagactgtctccaaaaaaaggaaaatacacacatacatgtaaatacatgtatatcagacatgtaaaaatgaaaaaaataaacaattcaaaaatgctggtgaaatgcagaatctttatttatatatgtacattttaaagatgaggtcttgctatgttgcccaggctggtctcgaactcctggactcaagcaatcctcccacattggcctcccaaagtgctgggattagaggcgtgagacaccgcacccagccatctttatctattatgattgatgttattactgcataattcaggacaaccatttaagaaaccaaacaagtgggagtggggtgagggataaaagtctatacatggggtacagggtacactgctcaggtgatgggtacagccaaatctcagaaatcaccactaaagaacttattcatgtaaccatagccagccacggtggctcacatctataatcccggcactttggaaggctgaggcaggtggatcacctgaggtcaggagtttgagaccagcctggccaacatggtgaaaccccatctttactaaaaatacaaaaattagttgggtctgtgtggtggcaggtatctgtaatcccaggtactcgggaggctgaggcaggagaatcgcttgaacccaggaggcggaggaggttgcagtgagccgagatcgtgccactgcactccagcctggtccatagagcgagactccatctcaaaaaaaaaagtaactaaataaataagaagaacttattcatgtaagcaaacaccacctgttccccaaaaacctattgaaataaataaaaagaaaccaaacatatgaagtgtacttaaactgtaagcgaatataacctcatcaaactcactgactggcatatctttcttcttaaaatatgacctattagcagacaaagtctttgaactagatgaatacatagcatagtattaataaatgtatatgtatatagtcatgtgtcaaggatgggaatgtgttgagaaaggcatcatcagattttgtcactgtgcaaacatcagagtatacttacacaaacctaggtggtgcagcctactccacacctaggctatattgtatagcctactacacacctaggctatattgtataacctattgctcatagaagcctatacagcatgttactgtactgaatactgtaggcaactgtaacacaatggtatttgtgtatctaaacacagaaaaggtacgctaaaaatagtgttataattttatgggaccactgtcctatatgaggtcttttgttgaacaaaatgtcattcggcatatgattgtacatatgtgtgtgtatacacacatatatacatacttctatttattgtactgtttgctctgttgacctataacatgattaacttccagaagtctcatatttcattgaggtattccaagttcattttttcccaaaaggaagccccttagataacagaatatttcactaatatataaacactactaaagatgtatatagatagataacttaaaaatcccttgctattttgttgtaacacattttaatctgatagaaccatttcattatgaattgatcttatttaccttgaacagctaagcctgctagctgaattgcttgttctaaggtacaaggaatacttccttccaagatatctttcttcagttgcagataatactgatacctataaaaaatgtcagttgtataaggtcaatgtcaatattatctcattgagatacaatgcatttaaccataatttggtagagaagcataaaccagtgaaataaaaccttaatcccacatggttgtgtgtgtttttttttttttttttagatagggtctccctttgttgcccaggctcgagtgcagtggcatgattactgctcactgtagcgtcaaccttcctaagcttaggtgatcctcccacctcagcctcctgagtagctgggactacaggtgcataccactatgcctgacaaatttttctattttttacagagatgggagtttcaccatgttgcccaggctgttctctaactcctgggctcaggcaatcctagtgcttggattcaaaatgttgggactacggacatgaaccaccacacagagcccctagacagtttcaaacaaggatgagaaagtcctcaaccacatgacacttacacatattaaagtatatgtgatgaattacttatcccagattatagttatttcaaaattaaaacgatcctataagacaattagtcatctgcttcatgccctgtaaaacagtccccacaatttctttttagttggagaaatggaaagccagtggctaatctttactttaaaaactctgactagtaacttagtaatataagagtttgcttaccttgtttggtagaagttccctagcactggaaagtaaagccagagaaaaatggtttctgatatttcagaccaggctgatattaaaatgtttctgatgaaatccctcaaaacagctgttaagatgctttcttaatatctggtaatgtgggtttacttctgtttaccaccctgtttgtactttcaatatatagggcatcagttaccagaacaaggtttagagtcaagtagacctgaactctccaaattagtattctgcacgaacttgggcaagtcataatctggtgaatttaaattctatcaccagtaaaatgagggtaccatcaccccttcacaggactgaacatactcaaataataatatatgtgaaggaccaagagcatagccggctaacagcagctcttatcaatcacgtacttgaagccactcacttctccattttgataaagctctagagtgaagatttactacttccttttatttattttctcaacaggtaattactggggtctattatatgttaagcattattctagatgctggggataccgtactaaatggaaatcacagacactctgccagtgcagtctatggagccatctggaatccaaactgtcctccgtatctggtgcctgtgaagtgcaacccagttacagttcatgtttgaattcctctgacagcccacccctttaatcatttcatatgagtctttatcatcttatttcagccacagacatgtaaacctctgttctttattaccaaagaacctgaccaaaacaccatccattcaagtaagaagaatttggatccagcttttctccttccacctgctaacagccaaacccatggatttccctctatagctaatgggatgctggcagttctgggatccaccaaagagaaaaacttgagattttctatatggcagctcctttcagaagcttatctgagggagagcgtgtttagggaagtctgtctattgaacatgctattcacatattccattctaaatattctaggacttttccttaaatcaaaaacactagaaagggctgggtgcagcggctcatgcctgtaatcccagcattttgggaagccaaggcgggcggatcacttgaggtcaggagttggagaccggactggccaacatggtgaaaccccatctctactaaaaatacaaaaattagccaggcgtggtggcacatgcctgtagtcccagctacttgggaggctgaggcaggagaatcgcttgaacccaggaagcagaggttgcagtgagctaagatggtgccattgcactccagcctgggcatcacagagagagtctgtctcaaaacaaaaaacaaaaaacatgaaaaagcaacatacttggacccaattaatgtagccttccacaaaaatatttttgccttacattatactgttatgagaattgactcttccatatttgctctaacttattcatttctggttcaatgtcttatataaaaaatcacacctcaaagtttctgtttaaatgctataccaggaaaatgtatcatgcttgcaaacaggtatgcttctttgtgttacataatgaatgatggaactcgtatttcttcttttgctttggctgccattaagctcacagctaaaatccaggcataatcgcactcattactatccctcttaattgctttctccactatttaataatagttacctttaagtgatgaagagctggagctcagagattaagcaacatgctcaaatgcacagagccagactgagctggagtttgaatccccaggtctcaatgacccaaaggtcttgttcttaaccacgacaaatctacagttatagatatttctagtatttttattcatttagtatgttacatgacagtccacaaaacacaatggtcgagagcaaggacccaggagccagcctgcttgagtcccagttccagtatatactagcagtgtgaccttgggcaaggtgttcaacccttctgtgtcttggtttcctcatctacaaaatagagataatagcacctacatcacaggatttgttatgagaattaaattaataaagtacttgggacagtgtctaacatacagtaaaaaacataagtggttgttattatatgttattgtattatccctcaaatactttaatggaagcaactaaggatggatgaatggatggatggatggatacacagacagatagatttttttttttttttgagacagggtcttgctctatagcccaggctggagtgcaatggcgtaatcagggctcactacagcctcaacctcctggactcaagtgatccttgagcctcagcctcctgagtagttgggaccacaggtgtacaccaccacagctggctaaattttttttaattttttgtagaaacagggtctctctatgttgcctgggctggtctcaaactcctgagctcaagcgatcctcccacttcggccatccaaagtgctgggattacaagcatgagctaccacacccagccataaatacgtttttcttaaagaagtatttactgtaggagcagatggccaagaaattacacttcaatgacattatcactttctactaaagtgattaaaaaaacctttttgctaaaatttctatatattggtggggctgaagatggcttataaatatgttatttcaatatttttgcaggcctgctgcggtggctcatgcctgtaatcccagcactttgggaggctgaggcaggtggatcacgaggtcagaaggtcgagaccatcctagccaacatggggaaaccccatctccactaaaaaatacaaaaattagccgggcatggtcgtgggcacctgtaatcccagctactttggaggctgaggcagaattgcttgaacccaggagtcggatgttgcagtgagccaagatagcgccactgcactccagcctggcaaccaagcaacaagaagaatgaaataacaggaaaaaaacaaagcagtaataaaatgtaacatgcagacctgaattcaaaactgtcagccaaggaataaaagaaattgcacgttttgattcaaaagcaagtattccataaacttgcccgaaagtcaaaatatgctgattaaatattttatctaaatctttatgaagttactgatcaactttccaatataaaatatttcatacaatatatgacaataattatataataaattaggtgaccccattttgcacaacagaaattccaaataatgtatgaagaggcagccttttttcttcatctgtttttcttagactagtaatagaaggcaatgtgtaggcatcggcatttttattttttaagttttattttggaaattctgaaacatatgtagagacattaagtatagtcaccccatctccttatcatggtgcctcacccatcaaccttatgcctaccacgttttctgcatccatcctgtcctttgccccctccaccgccagtgttttacagcaaatcccagacatcgtgccacctgtaagtacttcagtacatatccctaaaaggtaagctttattttttaaaaatgtaactacatttttatcacacccaacaaaatgaacatcttcataatacccaatacctgattcatatgcaattttcatgattgcctcaaaaatgcatttttacaattttcttaaattagaatccaaacaaggtctacagattacatttaatggatgtttctaaatatctcttgctataaaaaagaaagtttttattaccttttattttcatgttattaacagaaatggagccatttgtcatgtagaatttcctgccttctggacttttctgattgtagtctcatggggtcatttggcaagtttacatgttctcacatctttcctgaaaactaatcattagatttagagcagcactgtctaacagaacattccgcagtgatagaaattatctatatctgcactgcccaatatagtagccattagccacatgtggctattcagtacctgaactgtagctagtgcaagaaaatttttaattgtattaattttaattaactttagccacatgtagctaacaactaccttactgaacagtgcagactggaagcttgctttgatacaagttcattttagtcattttcatcagtggtgcctggtacttcctgatgcatcacatcagaagaaatggtatttggttgtcccacttacagtgacgctgacattgcccactgagttcagatgatgccagcctgttccctttacccaaaggttttagccaatactgatgattgttacctctttatatagtctataaagaaaagataggataaacttactgccattcagagtaatgaattgtactctagtaagtttcaaaggtgagcaatgaggttttttttaaagtattatgaattcatgaattttaagatatatttggtatgttttaatccatgcagttgtattcttttttttgttttgttttgtttgagatgggctctcaccgtcgcccaggctggagtgcagtagcgtgacctcagctcactgcaacctccgcctcccaggttcaagggattctcctgcctcagtctcctgagcagctgggattacaggcgtgcgccaccacactcggctcatttttgtatttttagtagagacggggtttcaccatgttggctaggctggtttcaaactcctgacctcaagtgatccacccaccttggcctcccaaagtgctgggattataggcgtgagccactgtgcccagcccagttgtattctttatgatggtcaaaatttccaagctttgtgcagtggtagtatcatagccagtgaggtttatctgaggcatgattatcgacaattgaaacaaaatgtcctcttttgcaagtaaaaactccaggcaccaaagtgtttgctcgctctgccatgtgaggacccagccagaagttctgcaagccaggaagggaaccctcatgagacctcaaccatgctcagatctccaaactgagaaaatacatcagctacccagtctataatattttgttacggcagcccatgctaagatatatttgcaggtcgtttttgctagatatataatcattgcctcatatttcctttccttgaggatgttaaatgttacttttttgtctgttggcatgaagtgtttttccagaagtctgataccaatcttattttcttaattttataacagttttagtctggatgcccaatttctggtgactttgcagaatgtgttggcgctgattgctctggactgaccataccaggtacacagtatgccttttcaatagagagcttcaagtcattttcctttcaaggaagtttttagaatgtgttatagctagaatatacaatttgttatatagtttttggaatttgttctttgccaatgttttgccttagatcatactgttagaagaatgttttggctttttcctttagggaatcctattacatctattttttatcttgtcttctatacttttatagtttctatcatttcaaaatttctaattgtttttgcagctattttcatattcacctgttacacagacgaattattcccaagcttttctaattcagatttaaatggttctttcatatcatgttattttcttaattttttaagttcattttgtagtatcaggtggcagttttctgctgctttatggtcatatttttctgttaagtctgcactttctgaagatgtattattcagattgttgttctccccctttgttttcttttttcttttttttttttgagacagagtttcactcttgttgcccaggctggagtgcagcggtgccatctcggctcgctgcaacctccgcctcccgagttcaagcaattgtcctgcctcagcctcccgagtagttgggattacaggcatgtgccaccacacctgacatattttgtatttttagtagagacggcgtttctccatgttgatcaggctgatctcgaactcccgaccttaggtgatctggccccctcagcctcccaaagtgctgggattacaggtgtgagccaccacgcctggccctccccctttgttttcttccaatatctttgagtgggtttttttagaacacaatttttgaggtataattggcatacgaataagctgttcaaatttcaagtgtacaatttagacacatatatatatccatgaaaccatcactataaaatgaggaacatactgaccaactgcaaaagtttccttgcacccctcataatctttctctccaattcctaccccattcctaggaaaccactcatctgctttctgactatggatgtaatagacagaactctggatatcttggaccaagaggtaacctagtgcatgggaaggatgcgctgaggatgctggagcactaagagaaagtgcgagcatccttgaagactctgtggagctgtcagacaagctctgcaaggctgacttctgaactctcacagaagtcaatgatatttagggtttttgttatatatagctatacttaatccttaccgatacaacttctctatcaggtgctcctatacctaatcgatgagcaatcctattgattgactctaataggcccattctctctcaatccagctaatgcctttctgttcagttctatattgtaaacctatgcctagattatggcacaggtattcctaaactggtgtcctgcctatagtcttgccatctctgatctaccttctatgatgggtgatctttgtgaaatgtaaatttaatgattccattaaatttgaaaatctcttcctcattgtaccatgactttattgctaatgtctatttttaaaacctccttaggtaatacctgaaacttcctgaagacatgtaatcattttgattattccccctgctttgcaaaaactattccctctagaacatttctaaagtcaatttaaaagtcagtctctctacctttcctgttcaagttccccttgccccacccctaggaatccacagctttaattaaagcatttattatcataggatactgtaactatttatatgaactgccaattccaccagactgtgagcagctcctccagggtgggattaaagcatattcacctcccactctattcaacacaattcttagagcatatcttcagtaaatgtttaaatgagttaaagtgatcagttcaggctttttccttctggcttccacttttctcttcaatatttctatctcagacttttacagtcagtttgtgtttatcctaccactggatcctactgctttgactttccattctctcctaatcattaactggcagactcaaacagcactccacaaacatgggacagtaccaggttcttactatctgcaaggcactgtgtaagatatcattaagtaaagctaaagaaaacatgggctaaaacctaggaaaaagatacacggacaatcctaataacagggtatgacaattaccatcttaacacaagtagaatcaaattctaggtggtaagccaaaactcattctatcctggggtcatagatgcttcatggaggaggtaccttctgaaccacaactcaggaggcaaacaggattccagtaaatacatgtgagagaaagatctaggacacaaagatgaaagggcgtgcagcatgtttcgggcccttgaagtagcacagctacttcatttttgaacatatttaacgttcaaaagtaacattaaatagggttaaaaaggtcaggtagtgatgggattcacagaactttgaaaggcaggctcaagaactcaaattttattccttttttcattgtcttcagggggaaaaagaataagaacacttagttcctctattctgctccttaatatcatcttccctttctgcttttgtccctattaagtgcacttattggccaaaatttcctgatcttaaacacttccctccctctcctctgtactccctccccaaccggtctacagaatatagctagaggcagagaattctaggagcctttcagcacatttccttgaggaatgaagacagattttgtaactaattttctaaaatctcttctctcctttccttgttacaaaagatcagaaacaaaacaacaaaaacattaaaggtaacatcactacaagaagagttcacagagagggtaaatccatcatttttccctttaattattcctttgtgcctagtgaacccataagttacccaacatgcagtaaaacactctgacatgccacatatgagaatctctttgtaacaccgtggctaaaaatgtggggcgagagggcaaagtttcaaacttatcttctgacttcaaccttagtttcactttttacatctcactagactatttcctaaaaacaaacggcatgtaatttctcacctggtaatctcctgctgcagctgagaaactgaaggcacataaaacaccactccaaaatagacggtaggttccaatgcatatttatccagctgcttcttcaaaggtttttccaaatctacccaccggcgctgattttgcttgttgtagtaccagaggctgaagtaagtgacctggaaagacagaaggtcattgaaggaggcaataacatacaaaaggatttcaatgacttcagtcgcactaatccctgacctgtgaccaaatgacagcagtctcttattgcctttcttctcagagaagaacaacagcaaaaactgaaggaaaaaaaggaggtaagacctatctgtaactagctactcatattcaggaaacagaggcaaaaactcaattgctcttgcatatcatttactgaactctgaaccaaaaaaatacattcacgacctagacactggaatgtagtggcggctactcaattttatatgcagattttaacaacaacaaaaatacagaagaatttatccttggtttttcaattactaaaacactaaatttatcatatatatgtatatatacacatacacacacatatgtatatatacatatgtgtgcgtatgtgtatatatgtgtgtatgtgtatatatactatatatacacgtgtgtatatactagtgtatatacactatatataatggtatatatatatgtgtacatgtgtatttatgtgtgtatgtgtatatatagtgtatatacactatatatatggtatatatatgtgtatatgtgtatatatactatatatacgtgtatgtgtatatatacacctgtatatatatatgataaatttagtgttttagtaattgaaaaaccaaggataaattcttctgtatttttgttgttgttaaaatctgcatataaaattgagtagcccccactacattccagtgtctaggtcgtgaatgtatttttttggttcagagttcagtaaatgatatgcaagagcaattgagtttttgcctctgtttcctgaatatgagtagctagttacagataggtcttacctcctttttttccttcagtttttgctgttgttcttctgggcaacagagtgagcctgggcaacagagtgagaatctacctcaaaaaaaaaaaaaaaaaaaaaaaaaaaaaatatatatatatatatatacacacacacatacgcacacacacacacatatatgtgtatatatacgtatatatacacatatatgtgtataagtgtatatatacatacacgtgtgtgtgtatgtgtgtgtgtgtatatatatatatatatatatatatatattttttttttttttttttttttttttttttttttgagatagattctcactctgttgcccaggctacagtgcagtggcgcaatctcagctcactgcaacctccgcttcccaggttcaagtcattctcctgcctcagcctccagagtagccaagattatagcatgcaccaccacacccagctaattttttgtatttttagtagggacagggttttaccatgttggtcaggctggtctcgaactcctgacctcagttgatccgcccacctcggcctcccaaagtgctaggattataggcatgagccaccgcacccagcctcataattaatatttttaaataatcataactggggttctacccagtagaatgctgagtaagcagtgttaaaccaacttttcactactcttagttttggtttctataaaagaaattatttcatgtaagtaccatttctagtattcagatgcaattccaactcttctttattcctttgtccccaaaatttcattacatgcacatttaaaacaattataatgctgtgaaggtgaattctctctctccctacacacacacacatacacacacacacacacacacagagtgcatgagaaaagctatgactaatgcagtaaaataacgttagtgtattactcagaagtttaaagaaaatgcccagatgtcttagcatttagatctcacttgctgtgaaatgaaactgttaagataaatcaatactagccctgggcctggtcaacctgaaaggatattaatgcacttatgagctgaaatgacagcctcaagccactgctaatacttgcctcaaaatcaatctacagattaagacaattggaaaatcactgctttgtagttgcacactccagaataacactgtcccaacagaacttagtgtgatgatggaaattatctacatctgcactgtccaataaagcagccactagccacatgtggctactgagtacttgaaatgtggtagtgccaccaaggagctgtatttttaatattatacaattttaattgacttaaatagctgcaagtatctagtggctactgtattggatagtatagatttaaagcaacaagaaaactgagaaataatagaacatttctttgacctgcaatcctcattcaagtaaaaaataaaactttaatttgcaagggaaaagattatgcaaacatgtgctcaatagtcattttattattttttaacaaggtaagaactatacctttaaaatgagttcatcaaataaattcaacaagagtgaagaatgtgcccattttcccctatatccacaaatccctagaatactgctggaattcaataaattttgttgaatgtaaagaaggaatattctcttgcttcttagttgccacccaagtcatcacacaagaatggaatattttgaacatttcctatgtgccaggttgtattccaagagctgtagagataccatagattaaatcaccatcactaatttatgaagtaggtatttttatctgtgtaaaacctcaaagccagtgtttcccccaggtattgtccctggactacctctaccagaagtacctagagggtttcttgggccctaaaaagctattaatctcctaggtatttcttgggtcctttaaagtttgataactttgcactacactacactgctcctccaaagttatgcaagagaaagttatataaaaccttatctttggctgggtgtggtggcacacacctggaatgccagcattttaggaagctgaagtgggaagatttcttgagcccaggagtttgagaccaatctgggcaacatggcgaaacactgtctgtgtaaaaaatacaaaaaattagccagatgtggtagcgtgtgcctgtagtctcatctacttggcaggctgatcacttgaacccaggaggtagacagaggctgcagtcagctaagactgcaccactgcactccagcctgggtaacaaagtgagactctgccttaaaaaaaaaaaaaatccttgacaagctgcatgcaaataaaatttttgaaaatccaagcacattgtaatatatctgaaaggccaagtcccattgttaattatattctgaggttatgacattttaaaatgaattgcttattatctgtaagcatagaatatgtatcatacatttatagaaaacaagtactgttcttttctttttttaaactgcaacttatagaaaacaaaaatctggtttaatagaaagagcttgatgcttaagtccaaagttctgagtttgatttccaacagttatttactaggagtgaaatggtaaagtcaatcaatctaatttggttttctcaagtgtaaaataaagtaatatctccctcacaatcctgtcatgaggattggatacgggaaaactacctaagtacattttcctattagaaaaccattatattttattttttgagagagagttgcactctatcactcaggcgggagtgtactgacatgatcacggctcactgcaacttcaaactcccaggctcaagtgatccttctgccccaacctcctaagtagctagacaacaggtgcatgccaccacaccaggctatatatatatattttttttggtcaagagagggtctcactatgttgcccaggctgatcttaaactggcttcaagtgatcttcccgtctcagcttcccaaagtgctgggattacaggagtgtgccactgtgccagcctgaaaaccactatatttttaaaaatatcatttagtttcacccattctctccaccaacaaaatcaattactgactcctcccctcaaaagacttttaaaattacctacatgtatttgattacaacaaaatacatttctgttactatgtttgttttctgttccatcttagaacacaagttttggactgaatgtaccacattcggtctataatgccagattaggaatcctttaggatctaaaactgttttggtaagttaacagcaggtcatttttttttttgagacggagtttcactcttgttgcccaggctagagtgcaatggtgtgatctcagctcactgcaacctctgccttccagtttcaagcgcttctcctgcctcagcctcccaagtagctaggattacaggcacccgccaccacgcccaactttttttttttttttttgcattttttagtagaaacggggtttcaccatgttggccaggctggtcttgaactcctgacttcatgatctgcccgcctcggcctcccaaagtgctgagattacaggcgtgagccaccacgcctggctgtatgtcatcatttttaaccaaaatgaaaaggtcttaaaaataccctttgaatacattaacttcccctttaaatacagttggactgtagactgttccaaatacaaaaacagaattataaaatttctggtttattgtataatttgtggttgtaccttttgtgaatggactgtaatataatttaaaaaaataacagctgaacaatctgctagcattctgttaaaaagcacattctgaaaggaaaactgttaaaatatgctaactttatcagtgcatctattactcatgcaacatgaattagaaaatcaaatagaactgaacaaatacatttgttgaaattgcatcataattagtttttcacaaattatagaccatagaagagagtagcgagaactttatctaaaggtacaaacagctgaaaagaatggtgggcttaggccgggcgtggtggattgtgcctgtaatcccagcactttgggaggctgaggccagtggatcacttgaggtcaggagttcgagactggcctggccaacatggtgaaactccatctctactaaaaatacaaaaaattagccgggtatgatggtgggtgcctgtaatcccagctactcaggaggctgagacaagagaattgcttgaacccaggaggtggaagtgagctgagagcatgccactgtaccactgcactccagcctgggcgacagagcaagactgtctcaaaaaaaaaaaaaaaagaaaaaaagaaaggtgggcttagtaaattctttgttggttagctcttttaaataaaggagtctaagatttgggacatctgaatattgactttgtagcttgtcaaggatagattgtttacatgactttctcgtgcgtaactattgtagttaaagtatttgctttgggacctgccccaatgttcaagttctatcttaagaagtagtgaaagctagccaaaaatcaaatttatatcttgttaaatacctccaaggaggtattatatttctaaaattgctgctagaaatgtttatatacatatgggtaactaaattattgtaacattataatcctggattgaatgctctcttagaatttctacacatacataatcaagtcacaacatctgattccatgagattttatgactacaatatcatctgtttctaaaataggtaggtggagcttgagcaacaaagtattgtgattaaattctcatcaggcaaagatttttcctgggtaagaccatttttttttttggctcgtcttgaataataaccttaagaatctgaataattaactttccaaaataatttaaaatccattcaaaaaacaaacaaggtggggagtgagcacgaaaatcaaggaaaaggagagaatactttctaactcaatctataggccagcattaccccaataccaaagccagacaaaagataaccacaagaaaactatagaccgacatcccttgtaaatatagatgcaaaaatcctaagcaaatattaaaaaactgagtctaacagcacactaaaaggattatacaccatgactaagtaggattcatcccaggactgcaagggtggtaaaacataccccccaaaatcattataccatattactaagacaaaagaaaaaaaacacacatgatcatctcaattgatgcaggaaaagcatttgacaaaatccaacatccttaatgataaaaaacacctagaaaactaggaatagaagaatagagaagagcttcttaacatgacaatgagcatttaggaaaaacccacagctaatatcatactccatggagaaagactgaaagctttccccctaagatcagtaacaagacaaggatgcccatgttcaccactgccatttgacattgtactgaaggttctaaccagagcaattaggcaagaaaaataaaagacatttaaagtggaaagaagtagtaaaactatctatgtacagatgacataatcctagacaaagaaaatcctccaaatccaccccccaaccgtgacacacacacacacacacacacacacacacacacacacacccctgccctactcgaggtaatacattcagtgaagtttgcagggtacaagatcaacatgcaaaaatcagctgctatataccagcaatgtacatgtcaaaaaaagaaaacaattccatttacagtaatatccaaaagaacaaaatatgtaggaataaatttgaccaagaaggtgaaaaggcatatactgaacacaactaaacagtgctaaaagaaattaaggaaaatctaaataaatagaaagatatcccatgttcatagactgaaatacttaatattgttaaggtgcagtactacccaaagtaatcttcaaattcaaatgcaatacctatcacaatcccaatatgctttttcatagagataaaaagccaatcctcaaattcacatgggcctgcaaggggctccaaatagccaaaacaatactgaaaaagaataacaaaattggaggactcacacttccttgtttcaaaacttattacaagagtatagtaatccaaactgtgtggtactggcataaggagagacatatagacaaatagaatagagagtctagaaatgaacctatgcatctacagtcaactgattttaaataagggtgccaagaccagttagtggggaaaagaatactctcttcagcaaatggtgctggggcaactgaagatccacatacgaaagaatgaagttggatccctactccataccatatataaaaattaagtaaatataagaagcgacccgtaaaatagtttagaagaaaacattagggtaaatctctgtgatcttgaatttgggaataaatgcttgagtataacaccaaaaacatgagcaacaaagaaaaaaatagataaacttatttcaaaattacaaaacttgccaggcacagtggctgatgcctgtaatcctagcactttaggaggccaaagtgggagaaacttgaggccaagagttcaagaccagcctgggcaacaaagcaagaccctgtctttacaaaaaattttaaagttagctgggtgtggtggcacacacctgtagtcccagctactcaagaggctaaagtgggaggctcacttgggcccaggagaccaaggcttcagtaagctataattgtaccactgcattccagcctgggcgacagagcaagaccctcttaaaaacacacatacacacgcacaaaatttagaacttacatgcaaaaaaaaccatatcaggctaggcatggtcacttatagctgtaaacctaacattttgggaggctgaggcaggaggactgcttgagctcagaagtttgagacaatcgtggacaacatagtgaaactttgcctctacaaaaaataaaattagctgagtacagtggcacacacctgtagtcccagctattcaagtggctgaggtggaaggatcactttaaccccaacagatcaaggctgcagtgagccatgattgtgccactgcacttcaacctgggcaacagagcaagaccctgtctcaaaaaataataataataaatgaagaaagtaaaaaaaaaacctacagaacagaagaaaaggagaaaatatttgcaaattatatatctgataaaggtctactacttgaaacgtataaaatgactcttacatacagaaagaaacaacccaatattaaaatgggcaaaggacttacacactttttgaaaaaagatatgaatggctaacaagcacatgaaaagatgcttaacattgttagtcattagggaaatgcaactcagaaccataatgagataccacttcacaccaactaggatggctataatttaaaaaataggaagtaaacattggtgaggagaaactggaacccttatacattgctagtagaagcagaaaatggttcagctgctgtggaaaagtttggtggatcctcaaaacactaaatatagaatcaccatatgatccagcaattccacttctaggtacatacccaaaagaactgaaaaacaggtgctcaagaaacacatgtatatgcatatgcacagcaggactatctgcaataaccaaaaggtggaaacaagccaaatgtccatcaatagatgaatggataaacaagtttgtggtgtatacatacaatgaacattcagccataaaacacaatgatgtactggttcatgccacaatgtggatgacattcaaaaatattatgctaagcaaaagcagccagaagacaaaaggtcaaatattgtataattctgtttatatgaaacatctgaataaatcccaaggtgtggtggctcatacctgtaatcccaaggcactggaaggccaaggtgggagaattgcttgaggccaggagttcaagactagaatatataaatccacagagacagacagtaaattggtggttgctaggggcagggaagaatagagaatgactgcctatgggatacagaatttcctttgggggtgatgaaaatgttttagaaatagacagtattgtaatcgtactaaatgccaatgagttgtttactttaaagtggttagttgtggccaggcacggtggctcacatctataatcccagcactttgggaggctgaggcaggcagatcatgaggtcaggagttcaagaccagcctgaccaacatggtgaaaccccatttctactaaaaatacaaaaaacttagctaggcatggtggtgtgcacctgtaatctcagctactccggaggctgaggcaggagaatcgcttgaacctgggaggcagaggttgcagtgagccaggatcacaccactgcccttcagcctgggcaatagagcgagatgatctcaaaaaaaaaaaaaaaaaaaaaaaaaaaaggttagttgtacattatgtgaatttcatctcagtaaaaaaatgtttttaaagatcagaaatattcataataaagtaaataattttatttttattacaataatttttggggaacaggtggtgtttggttacatgaatacattctttagtggtgatttctaagattttggtgcacctatcatgtgagtagtgtacactgtacccaatctgtagtcttttatcattcaccccattcccatccttcccctggaaaccccaaagtccattacatcattctcatgcctttgcatccccatagcttagctcccacttacaaatgagaacataacgatgtttgattttccattcctgagttattcacttagaataatggtctccaactccatctaggttgctgcaaatgccattatttcattcctgagtagtattccatggtgtgtgcgtgtttgtgtgtgtcacattttcccttatccactagttggttgatggacatttaggctggttccatatttttgcaattgtgaattgtgctactataaacatgtgtgtgcaaatgtctttttcatacagtggcttcttttcctcctagtagatacccagtagtgggattgctggatcaaatggtagttctacttttagttctttaaggaagctccacattgttttccatagtggttgtactagtttacattcccactagcagtgtaaaagtgttcccttctcaccacatttacaccaacatctattattctttgatttttttattatggccattattgcaggagtaaggtggtatagcattgtggtttgatttgcattttcctcataattagtgatgttgaacagttttccatacgtttctgggccatttgtatatcttcttttgagaattgtctaactcatgtctttagcccatgttttgatgtgattatttgttcttttctcactgctttgtctgagttccttgtggattctggatattagtcctttgtcagatgcacagtttgcaagtattttctcccactctgtgggttgtctgtttactctactgattacttcttttgctgtgcagaagccttttagtttaattaaatctcatctatttttgtttttgctgcatttgtttttgggtttttggtcacagactctttgcctaggccaatgtctagaaggatttttctgatgttatcatttagaattttaatagtttcaggtcttaggtataagtctttgatcccacttgagttgatttttgtataaggtgagagatgaggatccagtttcattattatacatgtggcttgtcaattatcccagcaccatttgctgaatacggtgtcctttccccactttatgtttttgtttcctttgctaaagatcagttggctgtgggtatttggctttatttctgggttctctattctgttccattgacctatgtttttataccagtaccatgctgttttggtaactataggcttgtagtccagttggaagtcgggtaatgtgatgcctccagatttgttctttctacttagtcttgctttggctatgggggctcttttttggttccatgtaagttttaggattgttttttctagttctgtgaagaaagatgatggtattttgatgggaattgcattgaatttatatattgcttttggcaatatggtcattttcacaatactgattctacccatccctgagcatgggatgtgtttctatttgtttctgttatctatgatttctttcagcagtgttttgtagttttccttgcagagttctttcacctccttggctgggtatattcctaagtattttaattctttttccagctgttataaaagaagttgagttcttgatttcattctcaacttcatcactgtttgtgtatagcagtgctactgatttgtgtacctgaattttgtatcctaaaactttactgatatggtttggctgtgtcctcacccaaatctcatcttgaattcccacgttgtgggagggacctggtgggaggtaactgaatcatgggggcagctctttctggtgatagtgaataagtctcatgagatctgatggttttaaaaatgggagtttccctacacaaactctcttctcttgtctgccaccatgtgagacgtgcctttcatcctccaccatgattgtgaggccttcccaaccatgtggaactgtaagtccattaaatcttccttttgtaagttgcccagtctcagctatgactatcagcagcatgaaaacagactaaaacatttactgaattcatttatcgatctaggagctttttggatgagtcttaggggttttctaggtatacgttcatatcatcagtgaatagagacggtttgacttcctctttaccgatttggatgccctttctttctcttgtctgattgctctggataggacttgcagtactacgttgaagagaagtggtgaaagttaacatccttgtcttgttccagttttcagggggaatgctttcaactcttccccattcagtataatgttagctctgggtttgtcatagatggcttttattaccttaaggtatgtcccttctatgccaattttactgagggttttaatcataaaggaatgctggattttgttaaatgccttttctgcatctattgagatgatcatattgtttttaatgctgtttttgtggtctatcacatttattgacttgatattaaaccaaccctacatccctggtatgaaacctacttgatcatggtgtattatctttttgatatggtgttagattcaaatagctagtattttgttgagaatttttgcatctatgttcatcagggatactggtctgtagccttttttggaacaaagcctccaagaaattttagattatgttaaatgaccaaacataagaataattggtattcctgaggaagaagagaaatctaaaacttggggaaacttatttgagggaataatcaagaaaaacttccctggtcttgctagagatttagacatccaaacacaagaagctcaaagaacacccaggaaatacatcacaaaaagatcatcacctaggcacacagtcatcagattatctaaagtcaagacagaggaaagaatcttaaaggtcaggtgcagtggctcactcctgtaatcccagcactttaggaggccaaggtgggcagaccacttgaggcaaggagtttgagaccagtctggccaacatggtgaagccccatctctaccaaaaatataaaaatcagccgggcatggtggcaggaacctgtaatcccagctacttggaaggctgaggccagagaattgcttgaacccaggaggtggaggtagcagtgagccaaaatcacaccatgcacttcagtctgggcgacagagtcagacaccatctcaagaaaaaaaaaaaaagaaaaagaagaatcttaggagctgtgaggcaaaagcacaaggtaacctataaaggaaaacctatcagattaacagcagatttctcagcagaaactctacaagccagaaggcattggggtcctatattagcctccttaaacaaaacaattatcagccaagaattctgtatccagcaaaaccaagcttcataaatgaaggagagataaagtctttttcagacaaacaaatgctgaaacaatttgccactaccaagccagcactacaaaaaatgctgaaaggagctcttaatcttgaaacaaaacctcaaaatataccaaaatagaaactccttaaagcataaatctcacagggcctataaaacagtaacacaatgggggaaaaaaaaccaaattattcaggcaacaactagcacgatgaatagagcagtacctcacatttcagtactaaccttgaatgtaaatggtcctaaatgcttcccttaaaagatacagaatggcagaatggataaaaatccaccaaccaagtatctgctgtgttcaagaggttcatctaacacataagaactcacataaacttaaggtaaaggagtggaaaaagatattccatgtaaatggaaaccaaaagcaagcaggagtagttattcttatattgggcgaatcaggctttaaagcaacgacacttaaaaaagacaaagagggacattatggaataataaatggtctagtccaacaggaaaatattaccatcctagatatatatgcacctaacactggagttcccaaatttacaaaacaattactactagaccaaaaaaatgagatagatggcaacacagtaatagtgggggacttcaatactccactgacagcactagacaggtcatcaagacagaaagtcaacaaagaaacaatggacttaaactataccctagaacaaatggatttaacagatatttacagaacattctacccaacaactgcagaatatacattattttcatcaaaacatggaacattctccaagatagaccatatgataggccacaaaacaaggctcaacaaattttaaaaaaatcaaaattacatcaagtactctctcagacgacaatggaataaaactggaaattaactccaaaagtaaccctcaaaactatataaataaatggaaattaaataatatgctcctgaataattttgaatcaacaacaaaataaagacaaatttaaaaattctttgaactgaatgataatagtgacacaacctataaaacctctgggatatggctgggcacagtggctcacgcctgtaatcccaacattttgggaggctgaggctggcagatcacgagatcaggagttcaagaccagcctggccaacatagtgaaaccccatctctactaaaattacaaaaattagccaggcatggtggtgcatgcctgtagtcccagctactcgggaggttgaggcaggagaattgcttgaaccagggaggcaggggttgtggtaagccgagattgcgccactgcactccagcctggacaacagagtgagactccatctcaaaaaaacaaacaaacaaaaaacctctgtgatacagcaaaagcagctctaagagcattaaatatacattaaatatatattaactcatagcattaaatgcctgtatcaaaaagtctgaaagagcacacagacaatctatgctcacaactcaaggaactagagaaacaagaaccaaccaaacccaaacccagcagaaaaaaagaaataacaaagatcagagcagaaccaaatgaaattgaaacaaaacaaaacaaaaacaaaaagctggttctttgaaaaggtaaacaaaattgattgaccattagcgagattaaccaagaaaagagaatatctaaataagctcaattagaaatgaactgggagatattacaaccaataccacagaaatacaaaagatcattcaagtctactatgaacgcctttgcgtgcataaactagaaaacctaagggagatggataaaatcctggaaatagacaactctcctagattaaaccaggaagaaacagaaactctggacagaccaataacaagtattgaggctgaaacggtaattaaaaaaaaaaaaactgccaacaaaaaacaagtccaggaccagatggattcacagctgaattctatcacacattcaaagaagaattggtaccaatcctactgaaactattccaaaagatagagaaagagggaatcctccctaaatcattctatgaagccagcattaccctaataccaaaaccaggaaaggacataacaagtacagatattttcagctctattttaaaatgtttaaatacaacaaattcagttcattaagtctaagaaaaaaaatgagccagaaatagacgagcctatgagttcattacaatttctattttctaatatctatacttacgtcaagattttgtgccgtttgacagttaactggcaacctcacgtgaacataattgaagaacagagaatagggaaaaatgtgtttgagcaatcaaaaatacatattaaagtcaatgttataaagtatatgcccttgacaaagaagaaatttctcctatctcttttatggattttttttcttattttatacatacttttaatgagtttagcgatttggtaatccaatccaaagcagattaaaagatgacaaattaaaggaaaagggcttatttaataatagcaagttggcagtagagggaagtgatgggcaacattctttttagcaaaggagaacacgtacataacaaacaaaaaccccttaaatagaatttacaaagaattacaaatatatgggagtctggagttacttactaaagaaacaaataactccaaacattaattagtcatgtattcaacaacaatcactgttcctaaaagcagaggtagtatcctttatttacgacagatagaaatttataaattgtttccaaaacttagcactccaaatagtttggacaaaggagtcaaccttgtttatcaggcaaagttagttatgaagcgcttcatttcccaaagaaataacttatttccaagaaataacttattttccaaaaataacttattttatataaagctttacagtactctagccaatttaattggggtttcattacttcacttacaagtacaagcatattttccaaagccaaacatgaaagctgtttccatttctgttttggtacctgctgttatttgttttttgaaaggtttaactagtagcatagaagctaattacagtcacgtgccgcataacaatgttttagtcaacgacagaccacaaatgcgatggtggtcccctaagactgtaacagctgaaaaattcctatcacatagtgatgttgtagttgctaagttgcagtgcaatgcattactcacatgtctgtagtgatgctggtataaacaaacctatcgtgctaccaattgcacaaaagcacagcacatacaactatgtacagtacataacactggacgataataaatgactatgttactgatttatgcatttattatactttttatttagagtgtactcctatttataaaaaagttaactgtaggccaggtgcagtagctcccatctgtaatcccagtgctttgggagactgaggccagaggatcacttgagccaaggagttcaagaacagcctgggcaacatagtgagaccccatcacaacaaaaaatacaaaaatcagccaggtgtggtggtgtagacccaactaggaggctgaggcaggaggattgcttgagcccagaagttcgaggctgcagtgagctgtgattgagccactgcactacagcctgggtgacagaatgagaccctctttcaaataaaaaaaacagtgaactggaaatcagcctcaggaggtttccagaagaaggcattgttatcataggggatgacagagccatgcatgttaccgcccctgaaaactgtccaggaggacaagatgtggaggtgaaagaaagtgttattgatgatcctgaccctgtttaaggctaggctaatatgtgtgtcttagttttcaacacagaagtttaaaaagtggccgggcacggtggctcacacgtgtaatctcagcattttgggaggccaaggtgagtggatcacttgtggcgaggagagttcaagatcagcctggccaacgcggcaaaaacccacctctgctaaaaattaaaaaaaagggggggcggggggcgcttggtggtgcacacctgtaatcccagctacttgggaggctgaagcacaaaaatggcttgaacccaggacgcagaggttgcagtaagccaagatcacgcaactgtaccccagcctgggcaacaaagtaagactgtctcaaaagaaaaaaaaaaaagtttaaaaagtaaaaaacaaaaaaatactttaaaatagaaaaaagcttatagggtaaggatatagatatttttgtatagctgtacaatgtgtctgtgttttaacctatgttattacaagagtcaaaagttttaaaaatttaaaagtttgtaaagcaaaaacgttatagtaagctgaggttaatttattatcgaaggccaggtgtggtggctcatgcctgtaatcccagcactttaggaggccgaggtgggaggatcacctgaggtcaggagttcaagacaagcctggccaacatgttgaaaccccatttctactaaaactacaaaaattagccaggtgtggtggtgcacgcctataattccagctacttgggaggctgaggctacttgggagaatgcttgagcctggaagtcgaggctgcagtgagccatgattgcgtcactgcactccaacctgggcaacagagtgagactctgtcttaaaaaattaaaaaattgtgatatatttaatgtagcctagctgtacagtgtttctagaggctacaatagtgtcctactactatagtgcaacttcctaggccttcgtattcactgactcacccacagcaacttttagttctgcaagcgccattcacggtaagtaccctatacaggtgtacctttttaatcttttacctcacatttttactgcaccttttctatgcttagatatgtttaagtacacaaatactcaccattgttatatatatataattacctacagtattcagtatagtaacatgttggacaggtttattatagcctaccaggactaggccacagcacatagcaggtgtgcagtaggctataccacgtaggtttaagtactccctgtgatgttcacacaacaatgaaattgcctaacgaatttcttagaacatttccctgtccttaagtgacacatggctgtatttcccccgggtgacaatgcctgagattccaatagctgccactagcatggtgtggtacaaagagcactagatttgcaggcaaaaggctcggcctttgagtcctgactttaccacttgccagctctggaatgtctcacttcctcactgagtctgtttcttaatagggaatttaacatgtactcttccttcctcaaaattgtggtgaagaactttgtaagttctaatcgtactgataatactgaaaagcactcttacctttgtcatggtacctatatttagcagataggatctcttcaggtatgacagaaaatagaataaaacttgaatcaagcatgcttcttccttgaaaatatcactattcaaataacagtcaaactaatttcttcctttaaagtctgaacataccaggacttttactaaaagaaaggcaaaaactttgctacagacaggcccatgtgcctgaaattttaactactgccttggtctaggatatcttcccagaagcacacatcctctcttccttgagtccaaatcttctggactatgcacgtcctgttaatggagttcgtttaattgtaacagaagttttccagcagacagcctttagttattggcgttcagttcatgtctcctgccacactttgttatataactttccagtgcttttcctgataagaaactttacctccacgtggcttctctttctccacagctgcatccactctcactggtgatcaaagcaaattgacttgacctgtgggaaactcattccagcagaagttgttaaatcactgaatcttctagcatcccctagatcaattctcaatagtcactgtagagaattttgtgaaactttcattgtcaggtgtgtttacattctcccttcctttcctattttgttatgaacaaacatatcaggatagttttcaaaaagttattcaatgatttcttcatagttgtttaaaattttttcatagctactcttctaaaattgtacagataactgtgcctgctttgtaaactacagtaaaaataaaagttaaaacaaacttggcttcttttcagcacaatatggttgacttactttacatgaactgatgttgactgagaacaaagtgatttgataaccaagttttttgttcaaagcaaaagagagtttacaaatttgagatggggaaaaaatgtgcagcacccaaatcatagtcccctaaggagacgtcagctattaaaagcaggtccaaatcctgtcagaatgtaaaccctttcctaatccctaagtcatttctcgtctaattattttaagagtctttttggttgtactatttttaaagtagagcagagggacacagaaattagctgaagggtttttaaagccactgatgcattgggttgataaaagttaatcccatctaaaattgcaaatataatttcatcctgatgcctttcttagactaggcagaagtcagaagacttttcatcaggaaagagatgacagaagatagcactagataaagtctatcccgggaagagatcatctaacaagggtagttaacaagtattaacctaattcaagcctggagcttacctttacagagtctgccataaataatgaagtatcgtacttcttccttgtgacagatagtggcggtcacattgcctcaaagcaggcagcattttttccttttctgtttaattttaatcagttttcttctatacttgatcaaataatatatattttacagccaaagtggtaatatgcaatatcattatactctattacaactaaatgaagactcaagaaaataatcaagagtacatcttgaccttctaaattattctgaaattatactgaagtccaagtaactgaacttctcgtgtggctagatttttgttgttgctgtagcatttatctttaaggaagagtcaaatgataagacaatttcagggactgaaagacagtaggaggcacaaactgagattactgtccacatggatgaactgcttatctcttttctatttactatcctggacaatgagatgctatgaatatgatgcctctgaaacacaaataaatatactctatttttaactggactaatgtttagaaagattcatctattcattcaatgaatattgattgaatacctactacatgtcaatcactgttctgggaactaggaatacagcattgaacatgagaacaaaattcctgccctcacgtaacttaattccaatagggaaaaatagacaagcaaaatatatattatgccagatactgataagtgctatggagaaagatcttgaattataagattaagacaatatcaacatgtttttaaagagtaaactaggattaaaggggaaattttagtagtcacgtgtcccttaacgatgtgggaatgcatcattaggctatttcattgtgtgaacattatggagtgtacttacacaaacctaaatggtatagcctcctacacatttagggcatgtgatatagcctactgctgctaggctacaaacctgtacagcacattactgtagtgaatattgtaggcaactgaaacacaatggtatttgtgtatctacacttatgtaaacataggaaaggtacagtaaaaatacagtattataattttatgggaccaccatcttataagcagtctgtcattgaccaaaaatgtgatatgcagcacatgactgtatatatataaccaacaagaatgacagggataattgagatgttactgcacaaagtttcaatacagtcaaaagctaatatgctctatgtgctaccatataaaggttgtttagtttacgacccacataaccaaagataaactagaacttcttattcttcagtcacagcctgggctcatcacgaaaggcagccagcacttcaacggactcactgcctctacctttctccttgcttggatgaagaatctgaatctagaagcccaccaaattcatctaacagtagtgcaagcagatattgctttggaaaatatctcagcagagaacactcctgggatgtatttcatcagtctgatacttccaactctgccagggaacaagctcaccaaaggcttctcatcaaacagctctgccctaaacaccctggggattccccaacagtgtcttgcgggcctaatgacactcatgttccttctcatgcttacctttctttgcctgacgtgagtgcaaaaacctatcttaagcaagataattgtaaaaatacaaaaattaaatgataacaaatatctccagagtacttacaaaaactactgtcacatttaggaggccactctgagccaggctgtcatcaagggcatgagctccagagcaggccacctgtcatttgtcaaaggttataaaccaggaagaaagatgctgttcaaggagtcagaactactctagctgtggtttccgccatgtaaccatgagcaagtcacttaatacctttgtgtctcagttttcccatcagtaaaatggagatgagcataacagtgcctcatatacaggatttttgtgaagatcaaaataagcaaaaacatttaaagcacttacaaaagtgtctcatgcaaacaagtgctcaagtaatacgagatcttcttatcatggttttctagtccctttaaacagtataaaatttcgtattacatttatttagtagaggagatcctacacttaaatacttccttcactaataggattctatctttgggaacttttccttttctttccttttttttttttgagatggagtctcactctgttgcccaggctggagtgcaatggcacaatctcagctcactgcaacctccacctcctgggttcaagcaattctcctgcctcagcttcccgagtagctgagattacaggcgactgccaccacgcccggttaattttttttttttttttgagacatagttttgctcttgttgcccaggctggagtgcaatggcatgatcttgactcaatgtaacctccacctctcaggttcaagcgattctcctgcctcagcctcctgactagctgggattacaggcatgcaccaccatggccagcaatattgtatttttagtagagatggggtttctccatgttggtcaggctggtctccaattcccgacctcaggtgatccgcccaccttggcctcccgaactgccgggattacagacatgagccaccacgcctggccttctttccctttatttccttttaaagtaaatagacaatatcaacacttggattgcttttcttttaggaaaatggcaatggctccatggaaaagcagtatattgagagaaaagtgctaaaacaagagctggaagacctgaattctagcagggggctgtcaccaactagctgccctagccaggcattagttgtatagcatcatacagagaaatctgcattctattgaagggtagcatacattatacaaataataataatacaattttagacatattcactattaaacatgcttcatttttctgttatcatactgtatggtttaagtgttatttccttaagtcactaagcataaatttgacttcaaaataggtgtcaatcataaaaacacaggcgaatcaagtatgcaagtgtctacatattatttctaagtgcaaaatacaagggactgagaaggttattttctagatatttcataccaaacttgcaggaagagaaaggatgttatggtgaatatcttaattctcagcagtgcagctctgaactcagttgcctgacttaacaataatacctctccagtgatttttctccaatccattattatccctcagtgtattattccaactaacaaatttacatgatgaaacagaaagtggaaacggctaaagaatactaaaaaagagctgccagttaatgagtgtcctatggatgctattggtctttggtccactccatcaacgagatggtgggaggaaacaaagttgattatacacagggttacacatatgtaaagcaactagcacagggcatggaatatggtcagtacccaatgcagagctatcattcttactattacatgcagccatatcacatacaaaagaaacaaatcccagggaagttggtttcctcagttcacacaggtagtctgcagggatttgaacccaagtccattgagcaccaaaactttacctcttttcttccaaaaccccactttgccaaatgtagttgaatcaaatggtataaagttcaatgtgctgaaaattcacttgacattgaggttcatttgacaagtcaacgaagtctgagccatctaagtaactgtaacataacaagttgtttttatttttattttttctggagacagtgtcttgctctgccacccaggttagagtgcagtggcatgatcatggctcactgcagccttgccttcctgggttcaagtgatcctcccacctcagcctctagagtagctggaactacaggtatatgacaccatgcccagctaattttttaattttttgtatagatagggtctcactatgttccccaggctggtggtgaactcctggactgaagaaatcttactgcctcggcctgtcaaagtgctatgattacaggcatgagccaccttgcccggccaataagttgtttttagattcacatgagcttgccactcagcatgagattacccgtatattttcttagcctgagtaggcaaaataagtcaaaacttatttaaaataacaaaactactctgccccatatataaatctcaacactatacaccttttaatgatcatatttgggtaatctactatagaaagtggtacaaacccttgataggaagttatttctactacatgctaccaatcctcatgaaggatttgtgacatacacagtttcttctagtaatgttagcatcttaggcaaaaacttaaattgcctctgtatgttctgtcaattcattaaaagataaaggaaatctaagtgacatttgtttatgaacaaattgctcagagaactgaataggaaaatattcgctaaattggcatactgttaaaagaatgatgaatccttgttaatagaaaagaaaatgccatattcacataaagtgtgtatctgacaagaagaatgatacagagggctcaacaattggcctgggaacttgattaatgtataaaggaagaatgaatcatccattcaattcctgaagatgcatcacatacctgctgcctagcagggaagacagacatggatctaccatcagcaggacagtgggggaattcccactcatgacctcccctctgtcccccctgagaggggctttttccttaatagtaagttgtcccactgagcaatgaatggcccttcctgagacctaaagatgaaggccaaagaaaaaaagggcatctgtagtagaagggtcagcgaggggaggctctatattcagaggcaaattattattttttaattatgaaggtcttgaattgttcacaaatattccatccttccagcatctttcactctgggaagtagaagaccagggaagaaagatcctgctctgtgacaaggggagaaaaagggaaagactgccttaaccaggaagcctccaggcccacagcctaggcccatggatggacttgggggagagagtggctatgaaccacctgaaattgtatacaaaattctgtgtttgcatcagatctcaaaggggtccatgaccgccacaaatttaaaggtcaaagttcgagcagaagtctgatataaaatctcaaatcctgggtcttttgcttattagctacgtaatcactcaaacttttcttaagtttagtttcctaatttgaaaatggaaaagataatacaacgcctaactcattgtgaagattaaatgaggtaaataaagcttccagcacaataacgctcatttacccaaatggagacagcagaaagtcaaagcttctagagatattagaaggaatggaatctgattctatacaccaaagacagtgacagcacttagagcccccaaaacaccatcagttccctcatgtccaccattttgtaattcaccttacaaatctcgaatgagtaaattcatgcttaattccacatggtcctgagactacactactgtgacagactgatggtaagaaaataaggacatctggtatctcaagggaaaaatccaatactgaaaggaaaacatcttaggttattagcctttaagtttattaggcactaagtctaggttgaataatactctattcttcaaataaacaggtttccaaattctgcaataacttgtgattgtagaatagactttaaaatgcatatcctccatgtttgtatgtgtaatttccatacttatttatatggctaattcttaattacctagaccaaagaagaaaagtaacaaaacctaaacatcaagaaaaatccctgatcatttataattggtgttagacttgggaaagctttctctatctaggtgagaggccaaccaacctaacattatatttgcttcagacggtccaatagctctaactgaaaatattcacagattcttgtctctacctcggtcttacttgttttataacgtacatacctaaatgaataactacttggcccaaaaggtaaaaaagtttctgggtactagacttttactttacatatatatcagctatttttagagtccaaatgaaaacagctagtacacaaggaaataagcatgaaattcttgatgtctactcagataacagtcaagataaggtcagtggatatttggaatacctaagacactaatttaaaataaaacactttgatggccaagaacactttctaaagttgtgcttgagggttatggtttgcgttatatgcttgattcctctctattctaacaaatcccctagcgaaaaaatatccccatctgccataaggtgctatgagaagtatctgttcaaagtccagtgaggaagctgacactcccttgacacagcaatcttacatcagggagccactacaactagatcactttctaagtgtttcagaagaagccccaaagtgaaaaagaagagtctaaagaaaatggtgcttttctatctgtatacaaaactttggaaatgtttacctctctccaggaaataaaatcagagcaaacaaaggctgacttaattgtactgctgtccatgtttatcaatctaaattcaaaactaaactcttaatttttaaactaagtaaacatttattcagcaacaacataggtgcaaggtgccatcccagaccctggcaatgctccagtcaacaagagtcctactttgatggagcttacagtctatggaacaaaaacttgacattgtgtgtaacgcactaaacacacaatttaaaaaacatttcgtaaagatctatgataaaccaaagcctataattaagaaatgagaggccactatatatattttgctagactttcatcttcaacaaaataccctggaggtaatttttagcagtggctcagtatttaactcaacttcaaaacaatagttatgtatgaaggccatatatgggaacaacaataaagacgccccagcatgcacacacccccctcagaaacagctgaaagaaaactgtcctctaagttataaaactaacacaatataccacagcaaacatgaaaaaaataaccttgaagagacttccatggtttcacaacttccccatatcctgaggattaaaaaactttttaggccaggtgcggtggctcctgcctgcaatcccagcactttgggaggccaaggtgggtggatcacctgaggtcaggagttcaagaccagcttggccaacatagtgaaacccagtctctactaaaaatacaaaaattagccaggagtggtggcaggtgcctgtaatcccagctacttgggaggctgaggtgagagaatcgcttgaacccgggaggcggaagttgctgtgagccgagatcgcgccatttgcactccagcctgggcaacagagcaagactccatctcaccaaaaaaaaagaaaagaaaagaattcctatgaagagaatttggtcagttactacaacaggggataggagtcactaataacaataacataacatcaacaaaaatggtaataaagaagaacacttattgagagtttcccaaataccaggtcctttgctaaatgttttacatttaacaccgaatcctcataaccactatcaagtaggtactattattatccccaacttacaaatgaaaaatcaatgaacttgggaaattaagtgatttaataattacttaaatgacagcacttggatgcaacctaggtgtttctgaatactgcagactgtcttaaccactttactaagcagccatctcaagaggcagacaggcactgaagcaccactgaagcaccgcgcagaggaaaaggtgccctgactcaaaggaatttgtctggtcctggaggcagcaattctctgcttataaaaatatgtactttttcttttcttttctttttttttgagacagagtctcactctgtcgcccaggctggagtacagtggcgcagtctcggctcattgcaacctctgtctctcggattcaagtgattctcctgtctcagcctcccaagtagttgggactacaggcatacaccatcacgcatgggtaatttttttgtatttttagtagagatggggtttcaccatgttggccaggccaggctggtcttgaactcctgacctcaggtgatctgcccacctcggcctcccaaagtgctgggattacacgcgtgagccaccgcgcctggccgacttatgaaaatatctactttttcaaggtaacattcttctgattccatgttcaccaagaaacttctggtttgttctggttcccatgtgccctaactataggaaaatcttggcctaggcagagggcacacatacctgggacccttggcagttccttactgcttataaattactaaacttgggtcctggttttacacatcatttttagcgagctagattaaatcaggtcttcccatgacatgagatttttgagcctgactcttgcactctggattgtgctgattccgtcaaggtgatgccccaggcagtgcccatgcccaggtggccacttgtgtcaccacctccttcaagcctctacagcatatgcttttaaaattggagaaaattttctagctccccttaaattccacaaggactcacagcctctcttgaaaaaatgttttgaaactcagaagaatgataggcagggaatttcaacagctttgagaaactactgctataacgaacagcaatattttcctaagggaataattcattttcccatttttaaaagttactttggctcacgcctgtaatcccagcactttgggagaccgaggcagacggatcatgaggtcaggagatcgagaccatcctggctaacacggtgaaaccccatctctactaaaaatacaaaattagccgggcgtggtggcatgcgcctatagtcccagttacttgggaggctgagacagaagaatggcatgaacctgggagactgagacaggagaatggcatgaacctgggagacggaggttgcagtgagccgagatcgcgccactgcactccagcctgggcgatagagcgagactctgtctcaaataaaaaaaaaaaaaaaaaaaaagaagttactttctgtagttcaaatatggtgaatttaaaagaaagttagcaacctaagttaactacattggatacatgtatattaaccacgttgcttttaatttaatacaaaatatcttagacacttgtaaaaatatgacagctaaaaatacaaacaaaaaaaatacccatatacccagtgtaagaaacactactgatatagctgaaacccctgggtatagtgttatactattgtgcggcccttgtaactgtcattataggcccgggcacgttggctcactcctgtaatcccagcactttgggaggccaaggtggacagatcacctgaggtcaggagttcaagaccagcctggccaacatgataaaaccccatctctacttaaaaaaaaaaaaaatacaaaaatacaaaaattagccgggcatggtggtaggcacctgtaatcccagctactggggaggctaaggcaggagaatcgcttggacccgggaggcagaggttgcagtgaaccgagatcgcgccattgtactccagcctgggcaaaagagtgaaactccatctcaaaaaaaaaaaaaaaaaaaattgtcattatagaagtgaaatggtattcaattaagcaagagggacttttccctccatttatatttggacagtagcaaagttttccacccaaatctatatgcgataattccagatttgcttggtgggagaacagtgcaagaaaccaacatactgatatttcttggtatgaatcacacagagactatatgtacaaactagaaacaggtgtgaccccactcagattatttctgaacagtcatttgttaagattaggcctgatgcctgagccatctgtttatatgctacagagcagagcttctggggctttcaaagaaaaagtttgctatacaaactttctacccatgactgttacatttatgttggaaattgtgggacagactctccacaggcaaaacattttctagggaccatgcctgtttcctcttctgttaaaaatcaggctcaaaatatacccacagctatataaagttacttgttccctgagactgataacttctaacaagggatggcaatttctctggacttattaacagaaggaaggcaatgcctgtgggttcagttctccctgtatttactgaacacattccacacctggtataaaaataaataaaccacagttcctcaagaagctgactctctaggcgttatagacagacctggtgcacgaggaagaaaattacaggaagaagaaaccataataggaaaaaaaaaaaaaaagtcgaagcaaccaaagtaaataaataaataaataaatagaatataagccactaagccaggcaaggtggcacacgcctgtaatcccacctactcacaaagttgaggcaggaagataactagaggaaacaactcccagaccagcctgggcgacatagcaagactccatctcaaaaacacaagttaaaaaaaaaattagctgggtgtggtggagtgtacctgtagtcccagctcttggcaggctaaggcaaaaggatcacttgagcctaggtgtttgaggatgcattgagctatgacggtgccactgtactccagcctgggtgatggagtgagacctcatccctaaaaaagaataaatgcaagtaagcagggactggttactgaggcctgctgttctggttttctttcttcttcttcggcagtttcatctcagtttccttccaacactttcccctcctctaatctaccatgaggggtctgcgatgtcctctttttctcccctggagagcctcataccatcttctggctttaatgaactcacttaggctgatacttcccaatatcttccctctaacctggatctcatgcctgaactccagatcagcagatccatctgtctattcaaaacctccaactggcacctcaaactcagtatttctaaaactgaactcaccacacgctcctccttgcccctaatagatctgcacttcctttcacatttcctctctgttatagccccaccatctactgaaaacctgaatatcaaccaggacccatgctaacccttctctattactcggtaggtcctgatccagattccaaccacctctctccaaccctatccaactccaggtggctaccatctgtacctgaaccactcccctcaaatcattctccaaagggctcactcttcacagaaacaatcgtaccacacctgtttacacccttcattaacttccccactaccctcaggataaatctaaatcctttaacaaaaaatcctcattgtgtggcccttacagtcggcctttcctccacgcacttcaggcttcaggcagaccagcttcctctgcgtctttggtcctgtgcagttctctttgttggaactcctccagcccttgataggactcccttgccccatcctcaggtcacagctcagaatcaaattccctgagcagccttccctttgctgcacctccctctggcctatagcacaccctctacttcccttatcacagcatgcatcatgcctgttttcttactggcaacaacactagggtgagcttccaagtatgtatgtgcttggcacttacgcatcttcagtactgagtgatcatataagtgattggatggtcaccaggagcaaagttcatctattcctgactttttaggtggaataaccagtttctctaactttcccttacccaagaaccaggtagccaaaggtagggagggtcctaggtttaattagagacctttcttcacaggccttgcataacattttaaatttaagacattatatggatacatgagtactccataacttcctaccaactagattaggggtttcctgggcaaacctcccaatcggtactctaatagactagttagcagagcttacaaccttatgctactctgagaattaggtgtcacagtcatccccatggttcagatggagaactggggctcagagatatcacataacttgcccaaggtaacagaagcagatggtgaggaaactagaactcaaactgagttcaggcagtatgtttctagaacctcgatctggcctgtaagaatatagtcaatgaattttactcaatgaatgttgaaagaacgaagtcaagagccggacatggtggcacatgcctatcgcgggaggatcgcttgagcctaggaatttgagaccaacctgggcaacatagctagacctaccttgactctaaaaaaattaaaatgaacaaaaaagaaagaatgaagtcagtaaactgtactagagatcaggatgacctttgggggtatattagaaaatggaaatttgaacaacccaaagtgtattcacatttgattctggattaccttagagggggaatataaacatattcaaaataagaaccattagttcttatagggcaccccaaggggagacttcttaatctaatctattcctgcttcatgaggaggggactacaggctcaactcagacatcccagccagggacacacagtgagtggcccgtgggctagaacacacagccagcatgcgggccagagaagcctgtcgtgttttttttatttatttttaattttttttgagacagagtttgttgcccaggctggagtgcagtgctgtgatctcagctcactgcaacctccacctcctgggtacaagtgattctcctgcctcagcctccccagtagctgcgattacaggcacccaccaccacgcccagccaatttttttttttttttgagcaggtgtctcgctctgtagcccaggctggagtgcagtggagcgatctcggctcactgcagcctctgcctcccacattcaagcgattctcctgtctcagcctcccgagtaggtaggatgacaggtgcccgccaccacaccctacaggcgcccaccaccacgtccggctaatttttgtatttttagtagacatggggtttcaccatattggccaggctggtctcgaactcctgaccttgtgattcgcccgcctcggcctcccaaagtgctgggattacaggtgtgagccactgcgcccggccttgtatttttagtagagacagggtttcaccatgttggccaggctaggctcgaactcctgacctcaggtgatccaccagcctcggcctctcaaagtgctgggattacaggcttgagccacccgcgcctggcctgcagtgtctttaggtggcttacctcccgcagctccagcctctgggccacggcctcgaggctttcctggccagtgctctccacggacagggtgaactccacaaactcgttattaagcagttggatccgggcaaccaggcaactcttgctggacaccgtgtagcgccgggtgcgtttcagtttcaacccaaatggcagtggcatcttcttctttcttcaagaatggaggagcaaagagggaaaagctacccccaccaacccagcgctggtgacgccaggagaaagcgatcctctccggatgggacgaacactgtccggcctccagctgctcacccagcagccgctgccgccattaaaaagcaacggagtctccaatggcccgaggaagggagcattgacgccagcgctggggaaagaggaacgccgttagttaagcaaacgtaacgctgggctttgcttgtataaagaaaagccagtcaagctgtggccaaagaacaagccgtccctctccactggaaaaaaggcactaacaggacccggaaggcagggtggaattttatctcagagttgtgctaggctcagggtcagactccacccttcactgtatcctacaaatagggatagcaaactgggccatcctcaggattaaatgagataatagccagcactactataatcccaaattttgtagttagtaattgtgatcctcttcctattttggataaggtgttgttttttcataggtaactctttcaggttgtaatactccaaatgtcagagttctttagtccttaagtgagaaaagtgccaaatggccccaaaagagctaggtttcagtcccaatccctttagaaaattaaccctgaaggcaaatgggaggaataatccccactaagaaaggcaggtgtgtgattcaaacccggtgaggtgcctaacaagcgcttgtggaagtatttacgtcatcaaattgatttactgataaacatcataaaagaccctacaaatgctcgttatccatttaccactagaagagtggcagttctgaaaatccagaccccggcccctctccagggtggggacgcccaaacaggccttcacctaagcggagccgcggcccagaaggggaggcgggcgaggtcttccacgccatcctgagttaatgagcggccggaggcaacaaacccaagaagcccacggggccttggagcactcaggccccggcttctcccgcgtcctccccttgggaagagcacgcggcgttgccaggccaaccagtagactcggaggccccggaaccctctttctgcagccgcgtttctggacggacgcgctctaaaaggaccggtccctcggctcccgaagggaacatttaaagggaccagcgcgtgccctactggcggtggagaggttgggcgggccccataggatgcccgctttggagccacaggacctcaaaatacgctccttacaacgtgttttatagagcgaagtctcgctatgccacccaggctggagtgcagtggcgccatcgtagctcaccgcagcctcgaacacctgggctcaagcgatcctcccgcctcaacctcccgagtagctgggaccacaggtgcgcgccaccaagccgggctctaacagtttttaaccagacctgttgatggtttctggggcgagcactagctggggatttttatatcagctggattagttttttccccctaaacgagtctacaaaatcccggacatttccagggtcctgagacggttccctaccttccttctgcgcagagattgcctgttggggatgaatcgcttagcgagacccagccatagctggctacgctgagttccggcccgggaccgcgcggagaggcaagatctattcccgaccctctcatctggcagacagaacccaggcttcaggaagagaagcggctttcgcagtttcacgctaggacgggctgagctgggaatcgatcccaaattccacagtcccagtcctctcctgggtcctgctctcctgactgcgtctcaggcccagaggtgatggggcacttagggttagggaatggcagacctggagaaaagggttccgctactaccctcggctttgccaaacttaacattttgaaattccattccacaaatgtgtattgcgtctctgggaacaagacagcgtaatgagcatcgtgagaaatctaagacgaatccctaaaccgtcgctgtctttaaagagattacaaccatgctataattacatacagagctgtatctctaataaggacccaaccacggttttatctggctagtttttttgtttgttttgagctctggttatttcccatagccaggaaaatcaaaatattaaaaacaagggataggggaaggccagaagaaaaaaacaacgctgcaactacctaaagcactgtgttaattaaccgcatttgctgagtgccttctgtaggtaaaagcaccatactatggagggaaacagaaaataagtattaaaagatatggtttccacttccagtagttttcaatgctctttgctgtttcaggggtataaactaaataagtaaagcaagatggaaaaaaattagcaaatgacaactttaaataataagcttttaactagaaaattgataaaccaagagtaaatatttaaggattataaatatgcatactaaacaccctttcatgagatcagatggtgggtttcaattttacataaaaattatggtaactggaaaccgggcggattaagtagtgtagatgaacagacaagatattgcatatgtgtagaggaaagataaatatttgtattaggtgccattcaaatatggtagtcttttcactacatagaactatgccttgaaagcaatagatactacactgtataacttaattattaacttaagctctgattaagcaaactcagtaaaactttcaattgtccctcagacttgaaatgtattactgcatcagggataaaggaaaagtcaaaattatctcttattttggtagatgaaattgaaaaagttgcagtgtgtgtgtacatggtgcatccccccaagatctatccataagaatggcttgctttttgcttatttatataaaacccactatgttaaaacaatgattttgtttaataatttacaaatttatcaatgatttatacatcttaattttcagtaatatgcagtatttgttgccaaatggtgtaatacaattatgaatgtctgaagataataaaaccaagatgagtagaaatttaagagttctttggggaggtctgtttcaggtataaaataatatgcaataatatgaaagtgattgggtctggaattataatttactaaagtaaacataatttataaatagctattaaaggaaaactaggatataattttttctctacaaaatctttccgttttgtggtaagtaaacagatacatactagattctgcttcagtacaagtttacaaaaggcagtctgaactatttgtgaattcattttaattttccctctctacaaccctttccaaaagttcctcaaatacactttacctctcaatcttacagcgtttcccctttcctattaaggtccttaccacatgtaattttgccaaagttgctttaaaataaaataagcactaaaaggagagagtatgtgacatttttagagtaatatctatagctatagcattaaacccatgtttctcacggagaaaacatctgtgcgtagatgctccagaataaaatgccctagaaacgaaacggactatattcagagtaaaattactgtcgtgtcccaaacttaaaaaaataaataaactgtcagcaactattaggcatacagcagttgtcacttggagcacacgaatgttctgaatgtgtttgtgagcatacgctattagtataaggctttctcagcaaaaaagaaaataggacgagcatgccaagagcggccaatctaatcaggatttgcagaaatcacaagtcggaatttgcagatccaagaattcttgtttccagagtaaatactctactccaaaaacaaacccaggcgttaccaaacagtccttccctgcgccccttctcgccaaagttatctggcgaatttcacgtttatatattctgagaggcacaaatatgcctaacacatttaaaaccctgatccagaattaacccgcaacaatcggccagggcgttcggaatagaagttcaagactccttttagaaattactcaagtatatgagagcgaacctgaaaaacaagacttttctctttgttacgctcccgctacgggtctggccgccgcgccccattctccgggattccggggccgcgggcgcgctccggggtccgggcgagtggacacaccccaccgctcgggccagccgcccgcccctcccgccggccggggaccgcgccctcacctgctcccgctcccgctcccgcatcctcggggccgcgcgccccgctcagcgacccgcctcccggggccccgccgcgcggccgccgcagccgcacccgcacgccagcccgggccgcggcgcgctcatggggctcgcacgcctcacttcctgtctccaaaaacccggctcgcagaccattcccctgggcagagtccggcggtggcgacggcgaggggcgaggcctggaggtgggaccggccggcgaggagcgccgcacaaagaagccccgtgggggcggggggtggcaggaggacggacagaccgtcggaccgacgcgggacgcgcggccggagcagcggggcggccgggcccaggcgtccctccccctgagccgggcgggcggatccggggaggcggcggcggcccgtgacctcagagagttggaatgcgggcagccgcgcgggggaggcgcggacagctgcgcccggccgccggggagggggcgcgccgctgctttttttaatcgtatgaccacttattttaagagtttccaaataaagcaaggcttttaataaaatgagtggagggggtattatttaggttccagataaagggttttattcctgtgttattaggtaggctgtaaaatgctgttattgatggttattcgtttactctggtatatttctgaacactattggaatacatttcttcttttcctgcttgctcctaaggttatgccccatataactagacacttccagtactgggtgggaaagcccccccaccaaaaatggttcatatgcctcaaataacctgtcagtccccaaaagggagctgtctgcttatgcaatatagagcagaactgttaaggatggagacttgacaaagttgtcaaatcccagctccaacatttactagctggatgaccttgtgcaagtttcttaacttctctttacctgtttcctctcctataaaagagggatattaatatctttgcacagcaggggtgggggaaataaatactaagcaatatccaataacttgtgtaaagtatatatgaagtgtttcgtttaaggtttattatacagtattcttgtactgcattattactgtattgcagcacttaagctgaggaataaaactgtgtgaccctaccactattacaatagtgtaagatcttttcttggcatgtggaacacagaaccttttaatttatgtaaattttaatttcagtgattttgttttaatgctgttgtttctggaaagctttttaaagtattgtttcatgtaaatctcattttcttaaacaattaacaaaaacttttgaatacttaactctgcatgagacgtggtccctgcacaacacggacttttggtttagtgggtgataaacgcacctgcacaccacacacgcagtacaaggccaaagtggggagcattgtcatagaggtatgagtgctatccaagagcaaagcccagcaaggtgcatcttgggtcgtttagctaaaggcaaataagattacctgtgtttctaagggaaaaaaaatagatcaattctgtttgtaattgatatttcaactgaactctatgagggggtcaatttgtgtgtgagcaaagaaaagagatctaaaaagaagtcactttgctggcttcccaaggtagaaaaactggaatcatgtgtgacttctcccattatcatctccagcctgtcatcaagacctggtatttcctcctttgaaatgtctcatgaattctttgtttcctttctgttccccctggaacattctaaatccaaaccctcatcattttacatccggattattgcaacaagggtggtctcctggcatctggtttctcagttctctcttatttccttgctaataccaggcttccttctcttatcactcttaatggactcccaaggttaagttcttctgcctgacctatagggactttccaaacgggcctctctgaccacctatatcgctttctgcccctgtcaagctttgcccctggccagcagcccctcctgccctctttccacttgtctaagccttctgcttctctgcaagtaagactctgcttccaggatgactttctagccacaccattccacagtgatctccacacttggcaagaactgtaaaagttgtttcatgacggcttcttttatatctcctaggattcctaggacagtactgggcaaagagtaggcactaaataaaaacttgttaattgaatcaggaagaaaataaaagaattttaaaaatagaaaatgaccataaaacccaagagatgttagacaactgagttgaacttcctccctcacagtccacagatgtcatttactgaccaagtacctaagccctattttccctcagctatgttaatttggcaggaacattcatgggaaggcacttgaataacaccttcaaaatattagacataaaattattagcttgtgttgcatatctaaggaagtgagataatttatatggtgccacccccaaagatacaaaagggtgtaagtaaaaagtccccttctcaccctgcctgctagacacccagctcttctcctgggaggtaaccagtgttccctcattcctctgtatccttacaaagatgttctgcagagttacaagaaactacatataagtatctttaccccctcttgttatccagaaggtggcatacttacacatacttttacactggaagttatttcttactaaaataaataaaatgtaaaaagaaagcccagcacataaaatgatgaaagacaaaaagatgaaagaaggctgggtgcagtagcttatgcctgtaattccagcactttgggaagcctaggagggcagatcagctgaggtcaggatttcgagatcagcctagccaacatgaagaaaccccgtctctactaaaaatacaaaaattagctgggcgtggtagagcatgcctgtagtcccagctactggggaggttgaggcatgagaatcgcttgagcccaggaggcacaggttgtggcgagccaagatcacgccactgcactccagactgtgtgacagagcaagactctgtctcaaaaaaaaaaaaaaaaaaggaaaggaaattgtggtttggtgggtgcactgactagtgttttcttagaagttcaaaagttaatctgttttgatagcatggtgaatacccaccgtataaattatcatcatctgcaaaaatccaaattgaatgaatgccctgccacgcaaagataatgattcctgtctgggcgcggtggctcacgcctgtaatcccagcactttgggaggccgaggcgggtggatcacgaggtcaggagttcggaaccagcctggccaatatggtgaaaccccgtctctactaaaaaaatacaaaaattacgcccggcacggtgactcacgcctgtaattccagcactttgagaggtcaaggtgggcagatcacaaggtcaggagattgagaccatgctggctaacacggtgaaaccccatctctactaaaaatataaaaaattagccaggcatggtggtgggcacctgtagtcccagctacttgggaggctgaggcaagagaatggcgtgaacccgggaggcggagcttgcagtgagccgagatcgcataactgcactccagcctgggcgacagagcgagactccgtctcaaaaaaaaaattagccgggcaggtggcacacgcctgtagtcccagctactcaggaggctgaggcaggagaatcgcttgaacccagtaggcggagattgcagtgagccgagatcgcaccactgcactccagcgtgggtgatagagtgagacgctgtctcaaaaaaaaaaaaaaaagatgatccctgaggaaggggacagtgagggctagaactagaaatgtgtggccaggcgcggtggctcacgcctgtaatcccagcactttgggaggccgaggcgggcggatcacgaggtcaggagttcgagaccagcctggccaacgtgatgaaaccctgtctctactaaaaatacaaaatttagccgggtgtggtggagggcgcctgtagtcccagctacttgggaggctgaggcaggagaatcgcttgaacccgggagatggaggttgcagtgtgccgagatcgcgccattgcactccagcctgggggacaagcgccagactccgtctcaaaaaaaaaaaaaaaaaaaaatagaaatgtgaagtcttcggtctctgaatctgcaccttaagttctgcctaccacactcaatactgtgtcacatgcaacaccttttcagttgcaaaagagcaaccattttatggatagattcccctggacatcagagaaatgattatcttggcagtgtgtttgttgaaatggagaagcatgtctgcctcagtagcaagtgactgctgtgactgtaattcccaacacttagggcttttgatccaagtatgtctatgccatgtgataatcactattggaaaacacttgtccattcagcccacatatatttagaagccaggtgctgcaaggagaaaggtaaatagatgcatacccctgtcctcaaagactcaccatgtgaacaacagatgaatatgtaattgtagtaggtgaggaaatttatacatggttatactttatagtctgaatggactggtaatgtctcgttaatcactgtgatcagcttctgcttgagtctggaaaagcagactcaaaaggctgacaaaaaaaggttgactgagtactcaaagaaaagcaaagctttgggcctggcacggtggctcacacccagcactttgggaggtcgaggtaggcggatcatgaggtcaagagagcaaggccatcctggccaacgtggtgaaaccctgtctttactaaaaatacaaaaattagctgggtgtggtggcacgcgcctgtagtcccagccactcgggaggctgaggcagaagaatcctttgaacccaggagatggaggttgcagtgagctgaaatcacgccactgcactccagcctggcgacagagtgagactccatctcaaaaaaaaaaaaaaaaaaagaaagaaaagcttttcaagcaggaagacacccccactcccaccccaccttcccccatcccctagtgcttctacacactcacacacgcacacacgtgcaaaggatgtgcaacatccagctgaaatacaacctgagaagagattgcagacgtggttggggggcaatgttagaagactcatggctccatggagatggggttggtactcagcccttctgacttcaaagccaatgctcttttcagtcatcttctctttttggaagacagcccagagccctcttagctggcactttgggtttgttgaaatctggtcttcacactgtcccctagaggaaaacatgttgtttcccctaaatcagagaacatttccaagctgggaaaaaaaaaaaaatactgtccagtatagtctttttcaagcctagcactcctactccctctaatggcttctcttagggcattatcatgaacatcttcttcgagatgtgatgtagtttgtgaagctgcagtttacagggaagtgcctggaactgcactggaacaccaaatgaaccattggtttagtgggtttgcccctcctgtgatcgagacatcataacatcttagatctaaatgtgggaggtctcaagcagcctttcagtctcttttccacagttgtcctaaaagttagctcatggtcctaaaagttaacgctttcttgaatatattttaataagtttccctactctgaatatgttttaatgaaaacattactttttattaaatgttattctcaatattatgttaatattgactgagaattgggtacccagtaatggtaaaacatgtttttgttcttagttctgaaatggctggtaaaggaataaaagtaattcatctgtcttttgtattgtgagtgtcatgaaagcagggagttggtcttgctcctctttgtgctctggctcctaccactgtatcccagtgcaggtacttaatttttaatcagcaagcatagtactgctataagccaggcacagttcaatatacttcacaaatattaacttatttcatccttatagtaaccctttgcaggtgaaactagtatacctatatcacagataaggaaactgaggcacagagatgagaagcaatttgccgaaggtctcagagggagtggcagagccaggattcagacccagacggtctggctgcagtgcccttgttctgtgtcattctgctctgctgcctgtcatcaatgctgaatgagtgtatgatcactggatttatccttgaggaatgcttttgtaaattaggtctttaatttcttttaccctattaatatttaatgagtgcttactatgtgtccagcatcctgaaaggttggagaaatataaagccctacagagagtttataattttgttagggaagacacacacacacacacgaaataacattgcacagaatatattattatactaatagcttccatatagatgccataggaattcacaagaaaggattatatgagattattaaaggaccacgtgacagaccctaggtagccccacaactcctgcttctgctgtccccacaacccactcctgacccctagtgtggattgcttaggtaataaacatggcaaaaataagaggtttggcagatgtaattgaggtcgtgaatcagctgattttggggtcaggtcctgggtgggcctaacttaattaaatgaaagcccttggctggtctcaaacttctggtctcaagtgatcctcccacctctacttcactgagctgaaattacaggcatgagccactgtgcctggcttttactggcgtaagtgaacagacatgttagtgaaccctttggcaaagaactgtgggcagcctctaggacttgagagtggcttccagatgatagccagaaaaaaatctgggtccttactcataaagccacaaggaaatgaattatttttttttttcctgagacagggtctcactctctcatcaaggctgtagtggcatgatcttggctcactgcaacctctgcctcccaggctcaagcaatcctcccctctcggcttcccaactagctgagactagaagtgcatgccaccacgcccagctaattttttgtacttttgaagagacatgtttttgccatgttgcccaggctggtcacgaactcctggtctcaagtgatccgccagcctaagcctcccaaactgctgggattacaggcatgagccaccgcactcagccagaaatgaattcttgctaacaacctgaatgagcctgaacatagattcctcctcagtcaagcctccagatgagaatacagcctgcctgacacgattgtagccttgtgagaccctgagcagaggacccagtgaggttgacccacggaaaccatgagatgataaacgtttgtgttttaagctgctaaatttgtggtcatctgttatgcagcaatggataacagagaccactctcaggaattagtggatatgagggagaaaggagacctctctgtgcttcctctgtttcccaggttttgtgatcagggatagggagaattcggctattgatacaaataggggaatcaacagtagtaacctattgagtggaggaaggggagatgaaggcgacttctgtctaagcgctgagttgggagaaaataagagtagttacttagaatttgggagtggggtttgtgtgagaattcaaggctgatggaaaattcggtcattatcagcacagagttgacaacttaagtcctaagaacaaaagtgttgtcccacggagggtgttcagagaagcaggaggatgggattcgtctcggggagaggccacgggtggccctggaagaaggaaggcagaaccaaacccaggagggccagtgtactgcagagtcaaagagttgacggattggctctgttgctctggatagtccattttcccttcaagggtaattgcagtgcaacctctaatgggcagactccattttacaggtaagaaaagttgaaatacctggaccgataccatactgacagtaagtgagggctggatttgaactcgcgtctcatatcacagcccaagatctttctgctacacatttaattcattcttaccatccaagagagaataaaatgaataagcggagggccagcagagagactaacgaaaggtccccgaggtgcccgggaggcggagctgcaagaccacccgcacgcgcacgccgccgccctccttgcctgagcacaggtttcgcgggtagaaggcgtgcgcaggcgcggacacgggcgcatgcgcgttcactccggcgcgcagtgccggccggggcggggatacgccgtgtgcgcggccgggggcggaacggaggaggaggcggtggtgtcccggctgcggggtaggagtccgcggcagcctccgggtaagccaagcgccgcgcagtgctgagttcccgcacgccgcagagccatggagatcggcaccgagatcagccgcaagatccgggtgaggcccgtgccggtcgggggtgggaagccaggtctcggcgagcgggcggttgtcaggagtaacggggactgtgggcccgggtggacgccgcggcctggcctccgctggacgctcctggcgggctgcggctcctcctcgtccaggccgcctcggccctggggacatttgcggcctcggagcgtggctgcggctgaagtagccgccgggaaatggaaggacaggcgcaggcccggctggagccaccaccgcggcgcacggcgccgctttggatccgctgcgggaggtgggcgccgcggggctggggctggagctggagtggggtgcggggtggggggcggtgcaggcgaggctcctcccagcccccgcccgggggatccgaggtgcgcgcaccagcaaagtggcctcagccgctgcagagtccggtcttgttttcctagagccgcctttctcacatgcacgtttgctctttttctctcagagtgccattaaggggaaattacaagaattaggagcttatgttggtaagtgtttttttggttgttagtcttacagaatttagagtttgcagctaatagaattttagtgaatgcgtatttctcaccgtactttggacattgggagagactcccttctaccttcttcaaatcttatactccctggttacttctttatcatctttttgcaaccttgttttttttctcccaaacctccttctgttatggtgttttgaaatttagtttcctccgttaaggctctgtttgaccgaattttattttatgtttttcctattctctctctctctcattttaaattctagggacgggtctcgctacgttgcccaggctggtcttaactcctgggctcaagcaattatctgaccttagcctccctaggtgctgggagtgcggggattactggtgtgagccaccatgcctgtttaaagtttcctattcttgttactttcctcttgacatttgtttttagaactctgatgttggatgtgaatgtttgatgctttctggcatttgcttctgtaatggttcagtgagttttattttccgatctctttatgttttccctctctctctgaaacagtaaggctttttccgtctctttattcttttataatttgagtgtttactctgggtcaggtactgtgcttaactattgtatatgtattaactcaggataatccctacgagaatcctggaaggtaagtggcagtatctttgactgtgtaaacaaggaaactgaggctttgcctacttgagcaaggttttatggtttgcccccaaagctggtgcctcctataaaaataatagctaccactaatgacagtggttctcaaagtgtgggagactccaagggcctctgaagtcaaaactgttttcatattaatactaagatggtatttgttatttttcactgtggtggtggtgtttggattgtgtaaaactaatggttgataaaacttgtcagcatagtaacaccataatgaaatcatattcaaatcactccccccttgtagtttttttctttttgagccaattacacttaaaatgtcattgatgaagatgtgaagtccagggtttacaaaatatttttta

SEQ ID NO: 1166 - DNA, 485068 bp, Homo sapiens
caggaagaaacccgtcagccatcacccctctgaccctcccactctcccaggcctaggtgaccgctaaccttcttcctgtccccatggacttgcctatttgggacgtctcctgtgatggagtcaggcagtctgcggcctctcgtgtctggcatctgcagtgcagctgtgggcttcgagctccatctgtgctgtttcctgggtcagcgcctccttcccttttatggtcacataatgttcccaccataattttcctttgcagtgactttgaaatcttaaaatgctgcattgaaatattacctggacagtctgggcaacatagtcagaccccatctctaaaaaaataaaattaaaaattagccaggtgtggtggcatgcaccggtagttccagctactcgggaggctgaggtgggaggatcacttgagcccaggaggctgaggctgcagtgggctgagattgtgccactgcactccagcctgggcaacagagcaagaccctgtctcaaaaaaaaaaaaaagaaaagagaaaagaaagaaagaaaagaaatgtgacctggattactgagtttctctctctcccttttaatctcatgcctcagttgcctcccccaggcctgggcctgatttgttttagggagtttggagtctgacaagttcagctgggctggccctgagcacagcccttctgatggggggaagccgcaggggaggcccaggctcccaggtcacagcaatgcccactcacgcagcaccttgcaggccggctggtgctgggggagcccagtgagggaaagccatgccaccgctccccaccgtcactctgcacagaccacactctcagccactgtcccccagcatggcatgcaggggagggagagtgagtgacgtgcccaagctggaggccacgaggaccttggagcctcggacagaggaccagcggctgtcatgtgcagaggactttgggggtgtagggcaggtcccatcctggatgaaggtgaaggaggggatggcaggagtggagcggtcgcctggctgggcagattggttttctttgggtgagaggatggggaagagctcaagtgctgagcggggaaagtgtctcccgccacctcggcccgtgggagctcagccctctgccccattagtcatggattcttttcattgtcgtcatctctccgaacacaaatattgttaaactcttggctgaactccctgtgcatgttggcgctgaaaaatgtgaggccgctgtgtgtgggccgctcgggcctcctgggctcgcaggacacaccgagctcggtcaccccgtgctggccgcggcgtgtctcgctgacacgtttcttcctctgggtcagtttgcagggtccagtgcggacggcacccggcggggcatgggcgtggacatctctctgctgagctgccagtacttcctggctcagattctggtctccctggtcctggggcccctgacctcggccgtgggcagtgccaacggggtgatgtacttctccagcctcgtgtccttcctgggctgcctgtactcctccctgtttgtcatttatgaaattcctcccagcgacgctgcagacgaggagcaccggcccctcctgctgaacgtctgacatcgcggagcctcgactccggacacgcgcctgcacctgggggtctggagcaggccgaccagtgaggaccaaagggccttgttggacagggggactggctgcctactggaatgtaaatatgtgataaaataataaatgacagcggcaaagcctatggtttctaggcattgctctctggtggctgagaggtccccatgggattgagttaccctcctgaggactcgggcaggggaggtttgtaagaatctttttttgaaagtaaaggtgtaattcaatggttctcaaccaggggcaattttgccaccccacccccacccccaggaagacatctggcaaagtctggagatagctttggttgtcacaactcggggatgctgtaaacctcccacggcacacaggaccgccccaacagcaaggagctagcaagacccagctgtcaattgtgctgaggtagagtgagcctggtctaactggaccatacattctgtacattgcatcccagggtagagtcacagtatacaggtcttttggatcagaaggcctcatattcattcacttgtccattcatccatttattctctcatccattcattcatctacccatccgcatatccacccatccacataaccatccatccactcatccaaatatcctcccatccaaatatccactcatctatatatccatccatctacatacccacccattcatccgtccacataaccatccgtccactcatccaaatatccacccatctgaatatctactcatctatatatccatccatccacatatccacccatccacccatctaaatatccacttctccatatatccatccatccatccatccatccatccatccatccatccatccacatccaaatatccacttctccatatatccatccatccacatatccacccatccgtccatccacataaccatccatccactcatccaaatatttacccatctgaatatccactcatccacaaaaccatccatccacacatccacccatctacccatccacataaccatccatctactcatccaaatatccacctatccgaatatccactcatccatatatccatccatccacatgtccacccatctacccatccaaatatccatttctccatccatccatccttccacccatcctcttatccactcatccaccctccagatatccagcgagtgcctgggtgtggcagacagtggttggcctgggaatccagctgtaagtgtccactctgccctgctggaactgatgtgagaggaagggagacacatggctcactgaggttccgtgcagcgcaagcgcagggaaggaggacagggcgacagcagcgtgtctgggtggcctcagtagtgaggtgccgtttgagcagtgtcctgatgaagccagggagtgatctctgaagtgagcacttgcttgacaggctcgagggagcataggcaccaagatgctcagattgtaaaatgccccaaaagttgaaatctcaaagagtttggagctgatgtggctggccagcgcccatcctgccttttgactccacaggcagggactaggggctggagggcgaggttcgggtcattcttccccctccatccgccaagggttcattccacagatggacaccatgtgcctgctgcgtgcaggcgtcgctgggcctgggtctgcccgggctgtgcccactgcctcccagtgcccctttgtggatctggcaaagctctcgtgagtgtggcagtccctcgccatctggcctctgaccatcttcgtcacctgacgctggaagctcaccaaggccccttctcagaggcctgggagggctcctccacgcatggtgattaatggccatgaggggtcacggccgggtccctgttgtcgccaagctgggcctggtctgggattgtgcagcccccagttccctcactgcatgggccctgtgttctggggacatataagacatccctgaccacaaatccacaacaaacaacaggggttctggggcctgttgccagccttggggagtctggcgttcatgacagtgtcttatcatcttgctgtgaccacttagggccagtcagaaaggctacctccccacctgggccacagcctccctcccaaccacggcctccccaccttggttatgattttcccacctgagccccggcctcccccatgggccatagccttcctcagtgtcactgcctgctgcctcctggagccccaccactcctctctgcgcccctgctggactcctggcctcctgtctaccctcacatccatcttccaccctgaagctggggggctgtaaacacgggcctgagcccatcccctcttctagtcttccatgacacctaccctggctccccagaccctaaggaatcaggtagaaattccttccaccaaacagagcccagcccatcttcccgagccagccacccgccacgttgccagccccctgtactacagccacagaacctttgtgggccacaatcggttcctgtgtttaggatcttcctgcaggccaagtccacctcttctctgcccatcaatatctgattcatccatgtagacctgtctgaaatgccacttcctccgtgcagtccaccctgcttggagccagtgattctttccctgtgctttcatgtgatgctgctttacccttcatggtcatgagctcagtgaagcgggtctcacggtccctgatacacatgtagctgaagcacagagaggtttagtggcttttcaaagtcacaccgctcctttgagcctctgtagactcaggccctgttagtcccatgcttttcctggaactgcagacttaccctccccacatttatgttgtttggaagagcttcagacttcctagaaaatgtggtgttgggtggctgtcctctggtctgggctgtctttgcccagaactggtcaaaatgaagaataaggggcttcccgcttactcttggcttgtcaaatcttaggccctcttcctagaactttctaacaaaacacagattgcttctacacgtgggaatcgtccctgtcagcctctcttttctgagaacctgccctgcctcccgaactgtgggagtactgccctctggccgggtccgaaaagctgcccttgacttccaggtctattcctagcagatggcagtgggagcagccaccagctccaaaccacgaggcctaggactcactgagagccacattcgtttgactttcacatctcagagaggatttctctctacttaaaaatcaagctgtgggccgggcgcagtggctcacgcctgtaatcccagcactttgggaggccgaggcgggtggatcacgaggccaggagattgagaccatcctggctaacacggtgaaaccctgtctctactaaaaatacaaaaaattagctgggcatggtggtgggcgcctgtagtcccagctacttgggaggctgaggcaggagaatcgcttgaacctgggcggcagaggttgcagtgggctgagattgcaccactgcactccagcctgggtgacagagcgagactctgtctcaaaaaaaaaaaaaaaaaaagaatcaagctgtgatgatgagggtagtcaccgctgcttgctgtttgtgaagtcctcactacacacgaggccacgtgtgaatgaatcttaatccattctccgaccttgctgggaaagaggtatcattcccccatttgacagatctggatcctgaggcaagcacacccagtacctggcccacgtcacaacagggtggagtttgagcccggggagtctgagtccagcctcatgccgctgagtgccttaggagcgctgtgagccggccaagcccctgagggcgggcagcttcctgcccgtctgtctcctgaacactgtgctgctgcagggaggccttctcgctccccagggctcgctccccagggagctcagcttggagggagcttctcatcctattcagaggcgaggggacagcgggagaaggcctcttgctttatcgatcagcgctctgtgagactcatgcttctcaggccactcaaaacaaaaaccacatcaccaagatctgaagccactcctgactttcctgtcagcaaacttggaaagtggctcccattccttgatgccactcagaaacgaaacacacctaacagccatcgagcactgcccacagcacttagcatggaaactgaacgtcatcaaaggaattgccctagaggtcatcgcctccctgggttttgtgtttcttcctccctaggctgttgggctaaccctggaccattccctggggaaccgggacagggtaaggtggcattccctggagaaccgggaaccgggacccggtaaggtggcattcctacactcaccaggctgggctacaggtttctgggggaacagggatgatttccctggaatatgcaagaactgacaattgcctggcccccccgcagtcgggaggtcctggccctccctgcacctgctcagagtgtgtctgcagaatccactcgggtgcgtggggcgtgacgtatcatcctcagcggggagcgggtggagggcatccgtagagggaaggagcaggtgtctggaactgggggtgggtacttttgtggcacacaaggacccccagcagctgctcagggggcttgtcggggagtgggggcgcggttagttatgggagtcatgattcttggaagtcatccgctgctgatgccatcctgggattctcttccacacaaggaacattgagttcctaccgggtacctcccaagccttgggggatgcagcggagaacagaagaaacctcctgttctctagacaaggcctttgccctcattctcacagccgtgcccgccctgcctgcccacagccatcagcctcacctgcccacactcagccccctcttcccagccatctccacaacccgctctgctgaggcctgtccagttgcctgatctctgacccgcctgtccggccgcctgcctcgaggaaacgtcggatctcttacacaatgctcgctgtcaaaccctccagccttccccaccatcgccgggggccttgacttgcccctacaccagagctgcaggtcttgtggcagccgcgggcccagggcaagcacctgggccttgtaacgactgccacctggtggccaggatggggatggactctgttcgacggctgcccagcagcagggtccaaggggattggggggtgggggggactgggtggtcacatgcccagaaaacagtgggataggcaagaaatggcctcaggaatcctctctgggacaactaaaaggtgctctaaaagcctgtttttaatttgctccaatggatactcaaaccctaggggttcatcagaagctgatcccccaagccccattccccacttctacgatggtgtcaaccagggttggagtcagagggactgcagggcccacacggcaggcacagtcaagagaatgtgaagggagggtctccaggtgcccagcagaggcgtccctgggaagccttccgaagtcaacccaaaaggtccttctatctggtccttcacacccactttccaatagcacatctggactggcagcaaggaaccttgccctgcagggcccgtccgtccgtccatccgtccgtccgtccatccatccatccatccatccatccatccagcagggtccatccacccatccatccatccctccaatatctgcagagcaagtgccttccacaaacttggttcattaagaaggggcccgggtgcctgtgcatacacagaactgggctgtgggagatacagggggacttctgcagcctgggtccctgaggtgtcaaaagggaacaatgaccactcttgacaaagacagccactagagaagccaccttgagttggagaagcagagaaccaggtcccagaacttgagttgccaaggattccagggcagctaggaacccagtggggattcaggtaaaggacctcagataccgagactgtcaaaggccgacaatgccgcctccgagaggaccgggtgaggcatctgcagctggagctcatcaggggctgagcaggaggctgttcctggccccctggggatccacgatggatgccagctccagccaggccccgccttctaacgggaggtccgggaaccttatgaaccagaaagggcttgctttatcctgcagcccgtatcagtccaaccggatggccaaatgtgcggctgcatcccttggctggctcatctggcagatcctccttaggaggaggtagggaggccaaggaccccgctgttcctcggtctccattgggcagcaggaagggccccaggggtccagtgcaggacagacttttccactggttttggggcctggcagcttcatccccagtatctgggtagctggttctgatttcaaagctctgagttcagatatgtacccaagccttctgggctggtcaggtgaggctgatggtggtcactgaagtctgtgctggtgcccagtcacactgccctgggtctcaccatgtggtcaggctggggctagtgagggctcttagctcagatgacggctccccacatctcagcttccacacagaagggctctggccctgaccccccccccccccgccccccgccaccactcatcagctgatcacatccacaattgtatagctcaccagtgctgatttttgagggcctggaagcttgcaatctcgtgtgtgtgtgggaggccaccgctgatctctccacggtgcatccttgcccttcagatgcgtgatcttgacttacccaggtgaggcttaagtgaggtctctccctccctagacttaccatggacaattatcaacaatgcagccacacacccagctgcacacctacactgtgctgaggccctgggacttacaccatgccctgcaaagtgccatcttcctagcccacctgcagtggaaccagcggggctgctgagccaccatgctcaagctgaggatgcgtttccaggaacaaaggggcagagggcacgtgggacgtcgttggggcagcaagaggcgagggcctggctttggggtgctgctggaggacagcaccatttccctccgccccgtccacccagcagatgtctggttagcattcccggccctcttcctcacatgggtgcgtggcagagtggtgacaatggccacagctgttcatgcctgagaagctgcccagctctgatgaggccttgttgtagcatgaacctactatctcctcaagacgcttggatccaaccatttaaccacactgaaatctacacttcacagacctgtacctgttaaaccctgcagcttcctaaggggcacagtcccggagacccaccaagacagcgcctggattccagcctctcccagccaccccagtgccatcctctcacccaagacctggactgagagccacctggggctcctgtggccagcctgcgggcccatccctgtgccctggtcagccacgctgctgagcaggacccctgctgttcgcctcaagggccgtcatcgtgtgcgccactcgggtctttgcatggcgaagctttctcaggtcctgagcgaggcagtgcctggtgcctgctgctccccaagtctttaccacgtggcggaccctgcctggtttgaggacagtttaccaacagtcagctttctgggctgctcttgccccatgtctgcaaacacctagaaactgatggccctatcccagatgacaaagggtggacacacatttccggggacaatcctgaggctccaggaaaatgccctcaacaggttctgaagccacagcgcaattccaacgcctgcccccctgtggccatgtccacaccctgcaggctgcctgcagcccctttggagggttagagccccttaggcctgggatgcatcctccacctggagtgcagctctagagctgggtggctgggggtggggtgtgggggcactggtaggccacggggaggcagatgggggccaggcaggaggccgctaggatggggtggttccgatgtgtctcctgagcaggcagggtgccacatgcccatacatgctggtaacgcccacggattagaggtgtggggtgaatggcaaggggtgggggaagatgctcttagtcccaatgccagtgcctgcttagggcccatcccgctgcttggggagcctccaaagaaagacagcaccctcaccagggaaagcctcttcccagacagaggatgtttctggaagccactctgggatgcaaacagggtcccgagcagcagggaacagccgactctccctctgtcccttccccacctggggtaacagccaggatccccgcccactctccaggaatgagacagtgcacgggagacacccaagggttgtagtgtagcttggttttatttatgtccacaaatatttcaaaaaaattacaaaatactcaaatggagagaacacagaagtcacgatttctgggtgtctactgtttacactgtgttatctcatggcaaactactcatatatacatttagcttcaagatatatagaaacgtagcaaatccgagtgtgcacgctgcctctgccgcagtggagtgaagctcaacctcgaggacaccgaacaagatacggacacacacagaggagccaaaccaaaccccgaacaaagggaggaaaatccgaaggaaaccgagtggttgggcttcaaagacaccatgaaggtcagggcctcctaaacaaactgtagtttatctggtgagggtttcgggtcgagggttttttagatggaagaatctcagcgcttcgccttgggatatggggagaaaagcaaagctaacaagaatgccttcggacggctttcaagcacagacctcagaggactcgactcttctttggaaaaatggatgccaaaggaggagataaagaaggtttaactgaatggtagatgttgtgttctaccaaaaagaaagaaaaaccagaagccgagaaggtgggggcctggatgcaggagtctgggagcccagcaggaagaggcctcgctcagagccacgggaacaagcctgccatgagggcctgtccccaccccagaaggaaacgaatgccttcaagccaatgtggcctgaagtcccacgacaaaaggttcatgtcagctttgcctccctgtgaacaaactaaagttaaggcagaaatggaatgagagaaaaatgaaagaaaaaaaactagaaacattttcaacagacaaaacaagcctatcccaactgaaaccaaacacggtttttaagagaaactggaaatgtcgctatttgacgccagaacctgaatttgagccagtagctgctggtttctagatcaaactatcagcatctcttcctgctccctctgcggcctgggtcctggatggactttgtgtccgccgacccagtgtggtctctgtcctacaattcttgggatgggaccagcacaatggcagaagagacctccagtgtctgagagaaaaggatcggaagaggccacgtcctggcaggaagcagggccgacagagggcagacaccccagaacacccgccctcagcctgggagaaagtgcgttacggctgcagcctggaaacgagggcaggctctctccaggacggttccgctcagaagggcctggcctcctgagaagcagcccccacacagcatgctttctgaatgcactgtgggtgggactccagttcccacttccaggatgaagagtgggactcaaatggtttaccagtgcaatgtggggtcaccatgcagacctgcccctagggtaaaatacaggctgcccccaacacctgtcttaactccaggatctcccttgctcaaaagtggcctcaatctgtggcaagaaagatggggccgtcctcaccacaagatccaagtgacaatgcgcatgagaaggcagccttctaacacatccctttggcaggcatatgtcctgggtcacttgtgtgctgagttatttgtatggaatcattttcttagatgatgaaattttcggagtattaaaaaagacattcatccagaacaatcaagtgtgtgtacacagaaatctagaaggaaatctacaatggacacaggcccatgcgctttccatcccgtggaaacagaacagtgacactggagaacagaaagtgaacattcacctcctgcactccctgtgcaaaatggaagaggtctgatggagcagatgtctgtgctgctggcagagcacaggctaggagcagacacaagtgaaacgccaggcagaaaacagagtctgtaacatcgtccctgcaaaccctggatgctcgctgctgtgaccaggcctcggtccaagcctctgtccatgtggaacgcccctttgctccctttaattaaagggataattatatataactttttattaaaaaatcaactctgtattctgtcaatagttggtaggaattcacaattagtgacatggctggaaaaaatagatcacaatagtagtttatggaagaaaaaaaggctgttctaaaattatttatttacagacgtaaaaagccatgctgcagaactttctccaattatgaagatttcctacaatgtattaaaataaaagatttttttttttaaaaattatagctcttggattccaaattcctatgcccccgatctgcaagcctcgtgggctctggagcactcgtggcggagtgtgtcagtgtgtctgcacgcacagtgaagggtgtgaactggattctagcacctactgagaaatcaaggaaaagaaaactaaagccaaaccccaagattgcagggaagctttctggatgttcagtccagtccaggactcactaagtttctgggggactgtcatgcagggagatccaaaccagtctcaggaaatcctctcgacaaacgaacactactatgtggatacatttttagttgtgggtttttaaatatataaagaaatctttagaagatattctttttgcttttgcagctcctattttatgtaaaaagtcctgtttctccccccaagaactggggtttccacagccagcgttaacaaataaataacttataactgcttgtcaccttctttcttcagtcgactggaaagacaaaacaggaaagcgtatttagtctcaggcctaggcaggcagtcacgcaggctggaggcaaccccaaagacaacagccaggcaatccaaccccaagcccgcagcctcctgtgtagctgacctaccctcccaacacctcccttcctctgtttctcccatcaccatggttccacaatgtcccctccagggcccagcaggcagagggggaggagcctggccctgggcacacggggaggttgggagcctgggctcagataacccctccactccctcccagcaccccacctcacctgtaataatcttcctgacttggtaggtggccaccatgcatgtgggggtgtccatgcagccactgctgctccatggccagtctctgcagctcggccgactgggcatgcatggcctgcagctggtgggctgctgacatggggggtgggatggccccaggcaggtcacgggggtagggggtgcctgccgaacacaaaacaacctgcgctacagaaatagccagaggactggccaagaccagggcggcacaggcacagcaaacggcaaagagcacaggagaggtgccagttcggacacaggagccagcccctcccagactctgcagacagccagagggcagagcctctggggaggcaggaggtgcccttgggtgcctctgcctggacctgcctggcccctcctccaaggcctcagcccaagtgcttctccttcagagacctgccgtgagtcccctctgctactttcaccggctcttagcaaggctgatgcatttatgacccctaccccagacagcccccagagggcaggaggcttgttcccccacggaccccctgcatgcagggggagcgaacccacctgctcaatgcatgaatgaatgaatgagtaatgaatgaagacagcagaccagaccccaacccaaccctcacacggcctccccgcccctcctggaggggaagtcttaccgaaaactgggtggcgaagcatctcgtgctcgtgtgggggctgtccaagcagagggttggggagagtgccaggcgggtaggggaagcgagccaggtggggaccggcagtcagggggtcgaccagcgggtgaacggggcctgctgaacctaaggaaaggacaaaacgccagatggaggcggtgtgcagctcttcaatgtttgtcccccttggctggaatgaccgatgacttcctcctcacccaggatggctcctggtcaccagggctggatgcaccacctggctacaggtggccctgccccaaagtggctgcctccaccttcagcaagagctccagaggccgagagaagtgacgagcccaccgctgatgcaggcactccctcgtccgcttgtggagtgcccctaacaggcaatcccaggccagttttgtcgaggacccgggatcagcagggtccctctcgccggccacctgggcctgccctctgcctgtcaggtcacaggaacacacagccttgcgccagtgggtgttgggctggcaccccctgcccagggctgtctccctgctcttcactcgcagaacctaaaggaggccagcagagtgggtggcgcagaatggggacctggcacagcactgccctctcctctctgctggcacaaatcttgcgtctctcccttcagaacgttgccttgatctgacctcactgcaccacctcctgccctcacctcctatctcccagctccagccaacacaggcgctggcagggatttcagggttgccacctccagccatgctgccctggggtccctggaagattgggagcccccgctctgcctctgtggctgctcttgccccgatttcccacagcttgccctttcatctcctccatgtttctgctacctcctcagcggacctctcctgacggccttctcgaaaccgccatactgcccctgcgcccagctctcctgatcccctcttctggatttatttttttccagaacatatactttctgcctctcacaacgtggcacacgtctttcaactatctccccaaactggaaggtaaatgtggacaggggttctgccagcacctacaactgtgcctggcacattccaggggttcagtaaacacttgctgaatgaatgatgcatgaatgaacaaatgactacctgtcctcaacactgctcatactgaggcttgtaaggtctacaccaggtgccaacagagcttcagatatgaggacggcaatggtgagtgctctcccatgtcaggactgggtacaggggcaggggaggcgcctggtgcctccaagcaaggtggctccccgccctccctctgggccctgctctatcagtcatcctgccccacactggagggtggccagtgaggaagccctgcacgtaggctgtcccacaggacctgtactccaagtcccatggagcaggtgaacctgcctcctcgtaagcacagtagccaccccctgcgccatctcaccaggctgcagagggagtgaggatgccagctgggcctgcctctgcctcagagcagcctctccacagctggtcaatgagtggccttaaggagctcctacttccagggtggacaggactgagcagccctggccaggtgggtcagctcggaaaactcagccaaagccagcaggaggcctgcccagcctcgctcctcaagggaagaggactgtgcttttcattctccctcagccacccttgagtagcccagtgccttatctgtacgttccttggctccaaaggccacatgacactgctctgctgcccttaccctgccctgtgggcctaggccacttccctccatcccaggcacagggccaagaacccaggcttcacccgtgtgctgcagctgtctgaggccttgcagttctggagagctgcggggccgaggagagactgcgatacagcaaaaccatgacggtagtggatgctgagctcttctaagatctgccagggatgagggatctgttcagaaaagaacagtttccgctcctggatggtgactgtcactcatcaggctctgcacccctccccgtgcctctgtcccacctgccacgctggggcacgcaccttggtggagggggtcctgctggtggaggtggaggtgggagtgaatgtgagagtgctggtgatggtgcggagtcacgttgaacatctgcagtcgggccaggggatcgctggtcagcgatgccatgcgctctgcgtggatacgctcggctgccagtctgtcagggtagctcatctcgggccgcagctgggggcccgccagggccagtctctccctctccaaggggttcaggcccgggtggaaagaagcaaaagggtggggcccggcggtcggggggatggtgagggcgctgtgccgggcaaagtgctccatggggttggcggctgggtgcagggggtccagctctgggggcttcacctcgaagcccggcttcatcctctcccgcagctcccgctctcggatctcccgctctcggatctcccgctcccggagctcccgctcgcggatggtggggtcgacgttgtagaggccaggcatgtggtaggccagcagggggtccgtggggttaaggggcatgtagaaggggtggttgcggttggtgggcgacatgacgtggggccgggcgtactcgctcagagtccgaagggcaggtgtgtcgggcccgatgtaggggggcacagcagcaatggtggttggtggtggctcgaaggatggccgcatgtggccaggaccactgagctgtgggtcactgaggcgaccttcatgcgctgagctggacgccttctgcagaaggaaaagaaagcgtgaggggtcccccgagcgcctggggtctccgcttggtccacactgcggaggtgggcctggtcctgctcctggcctgctctgacaggccaacctggtccctccacggagacccggccctgccttggcctgacaccaggatgcagtccaggccccacagggtcgggctcacctgtgcccgcagctcccctcaggcccagatgggaatgtgtccctgtgagactaagctcatgcatgggttgtctacgtgtgagggttgtgtctgggagtgacagctggggggcatgggtgagtgagcccagcaggccaggaacctcactggcagtccctcatgccacttcctgggttggctgccctttcctccccgcgacagcagagagctggccaccaccacagcacccagcccacgagggggccacaaaggcagggcagctggagaggcccctcgcagcctgcttatcgcctgagtgctcaggtcttctctcaaggcgcccccttgtgcttctccccgactccttcaaattacttagaagttatgaacccaaaggctgcaggagaaggacaggccctttcctcgaaggccctccggtaggaggacgcacagtcactgctgggagtcagcctagacctgccatgcgcagttaccccggcagcttcggatgtgcagcacccgtcagaggtgtggagacagggtgtaaatagcacccaaccctctagctgccaggaggccgagtcaggcagccaagggcagagctcggtggcccagcgtggctcccaggcgcaggatggaccagcgccccccgtcacacctcgccaaccctggactcacagccgcccgctctgcctcgcgctcccgctctcgctcccgctcccgctccttctccttctccttctcccgctctcgctcctctcgggctttctgctcagcctcgcgcttggccttctcaatggcctcctccctcttcttggccagcttggacccggccagaggcatgaagtacaggtctgtccgggcacacgagttgtagccccggtccaggtgtttgtagaacctgagaaaagccacagatcttgctgggagctcctgccgagacccaccccggccctccctcccaccagaacttgcccccaccagcccacctgtgcctgacccgtcctggagccctaggaagcgtacctagctgactggctggcgtgactgggggtgtccaccacagtgggctccggggacgggctccttggtgggggaggggggctctcaggctcctcagcgtcgtccagagcctcctccttgatctggacggtggggagtgggcaggacgacccccccgctatgctgcctcctgaagccgccgcaccagagcagggtggctgggccgaggtgccaggtcccgccggtggggtagaggtggaggggcaggtcggaggggtgatgggaggagggcctccagggacaaaggggtgctgagcaaacgggggttggggggccacctggtggaggcctgtaggggggtgggaggcagggggcgggggcaggttctggctctgggtcagcccggggggctgggcgggcgaggagggcaatggctggctctgaggcatgagttgcaggggtggggggtgagccgacggggggtgatgtgtggacagggagctcaggggcttcagggctggagggggaggcaggttggcattcatggagaagggtgagggccccgagaggtggggagggtgcttgtgggcctgtggcgccggcagctgggggatgggagtggtaggcgggggcttgatgtggggcatggccaagggcgctggtggcaggggctgctcccgtggaggctgttgggactgcagcgctgactgagaggctggcagctgcagggaggtgtgagggtacgctgctgctggggaggtccccagaggggcctggccttgggaggcctggggagggaggccaaagggctgtggggggcctgggtgctgcagcaggggcccagcctgcaggctgtgagggccgggtgggccctgaccgtgcagtgggggctgggcatgagagggtgcagaaggctggcccgccgacccagtcagaggctgcagcgggggatgtggcgagggatgcggcgggggatgcggtgagggcggccgctgggggtgcaaggccggtgcctgttggatgtgggtgtggggaacaggcgctgtgggagcctgtggctggttaggggcctgggaggccgtgggggagccctgtgggggaactgcagtggcagagggcgtgggccctggcgtgggcagctgaggggtccctggaggagctgaggagggagctggggtgaccccagtgggagcctgcaaggctgggggctgggcctgcagcatctgctgctgggctgacgagtccgagtcactctcattgtcctgggggctggggatgctcggggacgtgctgcgattgtcctggtcgatgtctttggggtcactgctaccctcatcgttgacgctgcgactgtctgaactctctccctcaccttcagatggcgagttgggcctgctgatctcctggagtcagagaagggaaggatggaagtcccaggagggcagagccctgtctgctctgcaccaccagtgccggacacacagtaatgtttgtgcagatgaagcagcaagcttggctccgggaccacaggtcgtgccctgacccagccagtgtcaaaggccactccagccccaccctaggagacagggcacggccaccaactagggagaaccccggctgggggcttctgaagaagcattagctttactcagcaaggctcagcagcaaacctcacctgcgtttttgtcttcttggagctggtcctgtcagcctcctccgtatcagaggccaccttctcccgctggcgtttgttactcttaagaggggaagaggcttcctccttcaccttctgcaggggaaaagcccacaaggagcaatcaggccaagggagaccatcccatcagcctcagcaaggaaatgacggtttgcagacactttgctccctcattctgagttccatctccaggagcaaaaagctctagaagggtcaactggggccaagaaggaacacgtatctgggggtgggaatgagagccagccctctgcacctgtgggtttgcatcctcagattcaagcaaccatggactgaaaatgtaggcaggactgtgatggttacatctatactgaacgtgcacacaatgttttcttgtcattatctcctgaactagacagtggaaccactgtttaaactgcatttacattgcactgggcagtagaagtaacctagggatgatttagagtctacaggaggatgtgactggtcacatgcaaaccatgtgtcgatgtatatgagatttgagcacctgtggattttggtatcctgggcggtggaggctctggagccaatctctaatggataccaagggaggactgtacttggctctggagggagccgttctaaccactccccacactttctgagaacttgggaagcttgaggcagaggtggcccccaagagttggtgctcgagcccccttctctaggcccccagccttcggtctgcagcccctaggccaggacaatgctggtgtccagacaggctccatgaatgagctgcatcctcgtgtctgagggagctgatcacgaataccagcaaaccagttttaatgtgagggagggacagagtaggccctactatccccccagcacctgaccttggccgacttcttcactgtctctgctttactgtcattgctggaggtactggcagcgctgggggagttccggccgctggagcggatgtcttcattgatgggtgaggtgcgaccatcagggctggctggctgcttcttccgaccactgcgtagtgtcgacatctgcccacccaaaccgaagactggtgacaccagattcccagtccccatgtggacccacctgagcccaacccacaggcagaagcctgaaggcacaccctatcagcctctcagcaaatcccagaccttggcaaacaacaggccgccctgcctgtccctggctgcatgaaggtcggtgtggagctcagggaagaggtggggaaatcagtgggctcacgccagagggcggttctcaaacctaaagcactcatcccaagggactgtcctgaacaacgtgtgctggaaatgaaccacactttctgagcggcagaaagtcgcctggggccatctttaaagcaccctacaccctttctgtttattcctcataaccgtccattctcccaaccaaaccaaatgaaatcaaacacttgtggatttaatctgacaggacaggaagtgacccaaagagatgaagctgtcaagtaaagcagctcagctccccaagccgccaagcgcttcagcatgtttctgcaaagccatgagggctcagaagagatcaggagacaatggttctggctggttgacctgctcccttctgagtgagcgggggccgggctgccagcagcctcaacggcatacaaggggcagaggaaagtggatggtcccacccacctgccagaaggggccataagggaggctgaagggaaagaccctgtcagtaccctcagccccaaacctggaaaaagcctctcccaaagtccctggcacatttccaacctaggaaacaaagtctctttatgggaggagctatgcagtgagcagaaaaatgtatcggaagtttccaaaacgggatcaaacatttaaaaaaaatcacaaacacactaacacaaaagagcctgcaagtttaaaatagcagagatttgatacaatggaagtgacaccacaagcagcagccttggagagcaagaggggccttggagagcctgcactgagccagaagctaagagcttgctacaaaacccagagcaggatgccaccctggggcccctcgaaggagagaacagagaactcttcccagcccacaggcaagctaccgcctcgggcaaagcagctcccctccaggactttgtctggtaaacaagactttcgcttcctccccctgggaggctcaagcccccacacatcccaggaaactgaagaagttgccaggagccccatggccccaggggactcaccgagccccgactccgccgtgtcctcatgctatgcttcccactgagcccatcatcctcttccttgacgggtttgaacataaacggtggcgggtccacgggcttctcaatgggcgggagctcaccgtatttcttgaagtggatgcgacagtcggtgcaaagcaggatgttctcccggcctccgtggtgccaatctttggaggctgtgtgagggaagtggtgggggccaaccttggaaaccatccctctccctggggatgtctgggcagaggggcccttctgtgggctctacccaaacctgatgccaccagcaccatgcagccctgggccccaacaccccagggctagtgctgccctgctcccccaaggccaggagagggtttcaggggcatctgctgcccacttcaacttggggtgcccaggaaaagctggcagcaagctcctgggaactacagtgtcaaccccccaatcccactcaatctgtcctgcctaccagtcagtattccataccgactgccaagcagaggagtaaagtaaactaaacatttctaactttctcgaatcccgaagcacaatgcaaatgtcaaatcaagtactgtccctggcaggtttccagctggatgcatgaaatgttcagaacatggaagtgcttgtgcccccgccccgccccaggagcgtgacgaggccacttactggtggtgaagcagtggcggcaggcgtaccccttcagctcctgctcactgtcctcactgtcgaagtcatcttcactggctgaacttaggtccactgggcgtggcaggcacatagtgggggtgggggagacaccatcatgctcagccaaggctgggccggtggggtgggggggaggggggaacacctgtgacctctggcctactgcaggttctggccaccagtcagagcggctgggtgcacaggctgaggtaggacagtgtctgcaaaggaccacttcgagctcctcagtgtcagtcaccaggacagagggcctgtgtgtgaggcgccatacccaagggcctgccctgccactgatgcccgtaacgggtgagtctgaactgggacaagcgcgtccatgctgcctccctccctaatacgcccaggcaatcctgagaaattccaacttcaccgagcgcccccaacccgtcctgctaggtgatttctagtcgcctgcatgcgcaacaccggcgcccctcaggttcagcgtcccgggccaggacagagctataaggcacttttgctacaccccagttttttaggggtgagaaggtgtgggctccagcatcattagattgtacatcatactgggaccaaaaagaggatcttggtgaagcaggaggaaaaagaagaaagtgttaatctgatcttcttacaaccaaaagtgcaatgagaattcaagcaggacatcaagtacatcatctgtcaaatggaaaaccttcccaggacaaggccaaaaacatcccaggccaagacgtgtattttttgtaaaaacctaagatgatgttgagtttatgagaaatatttaaatgtacaaataatgttttaaagtctccctcctgaatccttgtcctgctccccgcccccaccatcggtctatgtttaggtcaggcttcacacatgcactggagcacgggtgcacaccccctcatgcttcccggagccatcagctcctacgggcccagagtgggacaggctgcccgtgaacagtctcccctccgcccactgtgatgccaagacccctactcacagaattcactggacgggggtctggagggtgtgttgacgggtgtggacgcggtgcgagtcttaatcctcctgaacacggcctgcctgcggtgcctacgatgggctcgggagctggctgcttcgggggtcttcttccaatagtaatagaaggtgatcagctccccctgcagaagagaagggctgactgtgggggagggcctggggcttttccgtgccccacgcaccctctctgccacagtggaaagctgggtgtttaacagctgtgccagagatgagaataaagaccagtcgctcctggagttgggagaggaactgggcttgcccaagaaacagccactgagctgcccgtggactgcatgaatggggcccgcctcctcagcccagcacagcttgacttccagacaccaagaacaagtacttgttgggtgtctgctatgtcagaccccaccgctgttgtacacatgggaggtacacatcatccacaatggacgaaaaggagagaagattcctgcccacgaggagcttacattctagctgtgtgtgcacgtgagtctgtgcatgtgtgtgaacacaacgatgctttctttacagtaatgccagtgaaatcacacaggtgtgagaaggaaatgcccggccagttagactcccccagaaacaaccaaccaaccaaagcaaactgcccaggtggtgaggaaccagggccaaacagaaggtggggaagaacagagaccgcatgctcaggaaactgctccacagcctccacctggctccatctgaaggcccacatctgacatgccggcacgacgtccagaggcaaggactgggcttggcaaagaaagactacaagaggacagacacacagtggtgctgatgcaaaggtgaaatatcacacaccacaaggtcaggcttcttttcatggcccagcagaaacaaaagcaagatacctttttggaaatatagcaaatgtaagctttttaaagaaagggcactttgggcacccccagccctcagggcgctgcaggctgccatctcaccctacacacaaaagacgatttcttaaacatcccaagataaagtctctttacctagaactgaaaaaaaaaaacaaaaaaaaaaaacaaaaaaaaaaaacccaaaaaacaaacacagccaagtgagagagcacagatcacttggtttccctctaattaaatcaacactgtagaaagtctattagcttggcgactagatgctgggagttgtcttggaggtacctgcaccctcactttgtctcatcaaacactgtcttgtgaatggaggaggcaaaaagagagaggggaaagtgagagagggggatggaaagactagtgttggaaggactaaaatagacaaaccaaacaaagacatgtagctgccacatgacaaactcacccatcagaccagatttcatccaaaacacccccagaggaaatggcctcagaacacagtgacaagagaggtgggcagattttaggtggtggggtggcttccgcaaggcaggggatgccgtgccttgagtacttgactgcccacagctgcatcttatgcctgggcatttttgtaagaagtgggaccacggctgcggtccctaaaggagggctggaatgccttgaaggagggctgactggcctataaagcccatcacatgtatctcctggagcactggacgtgtctcaacctccccaagcacttaacacttaacaaattactcctgatcaccaatacctagcagatgaagcataaccccaggccagcagggccagggagccatctcgggacaagcacactcatgtccctacacgtatgtgcatgtgcccacccctcggttccatgagatggtaactgaatgataaggagaaatgcagatactgccattggaatttctgactggctcctctcccccatgctagtctaggaatgcgagctacaactgtcccagcgggcatgagcatcctggcccctaaggtcatgatctgtgaacctcctagctcttttcacttcctgctttccagacttggaaatgcatttatctatactgatccttgggtgttggctagacggaaaagattcgtaaatcccactagggggttacaagatcactgctgacataaacgctgacttgtgtctggttttcctctgagaaaatatggaagagaaatcaaggcagggagcagtcacactccaaatgctctgtccaaggtcatgcttcatgagctcaaaagggcaactggtgctgtgataagtcacagctcaaattccagagcttgaaagaagaatgagaaaaaactcacagtggttccttctacttcctcagtccaagtcattttaggggctactgaatgataaaagcttgggatgtggccaggtgcggtggctcacgcctgtaatcctagcactttgggaggctgaggcaggcggatcacctgaggtcaggagattgagaccatcctggctaacatggtgaaaccctgtctctactaaaaaaaatacaaaaaattagctgggcctggtggcagatgcctgtatttccagctactcgggagtctgagacaggagaatggcgtgaacccgggaagcggagcttgcagtgagccgagatcgtgccactgcactccagcctgggcgacagagtgagactctgtctcaaagaaaaagaaaaaaaaaaaaaaaagcttgggatgtaagaagaaatgcaaagctatacgagacaaaagggaccaaaaacgggagagaaaaatcgagtgagaaggtggtacctgagcctctgccatgccttcaagtcttacctgaaggctgttaaaaagcagcaacctgacttttctaaatagcatttgtctataatgcaatattgctacacacagttataatcaattatttctatttatcaaatatatatgttttgaaatggctttaaaagatagtaacctgcagatcccaggttaagggaagaagccaggcgcagcagtttacgcctgtaataccagtactttgggaggctgaggcaggaggatcacttgaggccaggagttcaagaccagcctgggcaacatagtgagatttagtcccccacctcaaaaaaaaaaaaaattatctgggcatggtggtgtgcaccggcagtcccagctacttgggagatcaaggcaggaggattgcttgaggccaggagcttaagacaagcctgggccctacaggcccaatctctacaaaaaagtttaaaaaattagcccagtgtgctggtgtgtgcctgtaataataccagctattcaggaagctgagacaagaggatcacttgagcccaggaggctgaggctgcagtgagctacaaatgtgccaccgcactccagcctgggggacagggcgagaggccatctctttaaaaaaaataaaagaacacttaaaaacaagaagccagagttcagtgaggtaagaaactgccccatgccagacagaaaaaaggcttaactttcaaacctttgctcctggcttcactgatctctgccaacaagtgaaaaaaatcaagacccaaaagaaagaaatctaacattgaaatcaacatcaactttttgttgacacttaaagaagaagtagtccagaacagatttcaccatctgagtgccaaggatgaaaatgaccaggcaactggtttctcttcaaatcgaataaatctttcgccttttactaaaaaaaaaaaaaaaaaaaaaaaaaaaaagaagaaaagaaaatgaccaggcaggaaggactgtcctccacagcagtgaagtcacaggtggtaagaacggtaaacttacaattcaggaaggtgacagggtgaccagaactgtcatccactgctggtggaaatacagaatgctcaaaccacgatatctaccaaacaacccagcaattcttctcttatttacccaaaagaaaaaaaaaattctcacacacagactttcacggatacattcatagaaactattctatatatatatatttttttgagacggagtcttgctctgtctcccaggctggagtgcagtggcacgatctcggctcactgcaagctccgcctcccgggttcacgccattctcctgcctcggcctcccgagtagctgggactacaggagcccgccaccagcccggctaattttttttgtatttttagtagagacggggtttcactgtgtttgccaggatggtctcgatctcctgacctcgttatttgcctgcctcggcctcccaaagtgctgggattacaggtgtgagccaccgtgcccagccagaaactattcttaacagtccaaactggaaacaacctaaatgcccacaagcaggagaatggataaacaaataatggtatccccacattcactggactacaacttggcaattaaaaggcacagaccaccgacacatgcagcaacaccatgctgcatgaaagcaggcagacagggacggtgggtgctgcgtgagtccttcccagagatcacaaaaaccaaactagcggttgccgagagcctggagggtgggggacaagaaactaaaagaactcaggtaagcactccagggtgatgaaaatgctctgtaagttgaatgtggtgtcactgacacaaatgtatacagtggtcaaaactcatgaaactgtgtacttaaagtgggtgcatttttacggtattcataccatatatggcaggttacgtcaataaagctgaagaaaaacaacaacaaatccaggccgggttttattagctgcctctcaaccactgttatgcctatcaagggattcaacactggaatgaagcgagtctaggatcggaaatggcatattggtgactgcatgggtggcaaggtcttgagcacaaacaaaagaacatgtcggggaaagctctggttctacaaatagggagtgaagcagctagaggcctcgccaggaatgaagtcaattgaactttaatcaaacatgcatagtgtgtgctgcagagacccgctgcacataaattcagggaacaaaagctgttgcagaaatcaatagcttactgaaacattaacacaggcaatcattaatcaaaaggcagctccacaaaggcagccttgcaaattagctcctgattttgcctgcaagcaaacacagaggtataaaatgttgtcgacatgaatggcctataatgatcattttgctcctgatgctctcacctcatctcacaacaaggtctcacagtcaacatatcttatgtctcggtgctataattgcacacagcatgaggaactcaactggtttagtgcctgggcagaaatgggaaaggaagagggcgaagtcatctccaactgacagtgttcccggctgcagctcttgccaagagaagtgctcaaatccattgggctatatttagcagattctctctcctttcctttttcttttggcggtgggggggctaaatttttcccacaggtcatatgcaaaaagcctttggcaatgacaggagcttggctcctggacttaggagtctcttcccagcagaggtgtctttccaggctatacactaagatggagttaggaaaataagcaccattaggttcctttaatttcccacaaaaagaaaaacaaggggaagggagtgccacacatggaagagagagggaagaagtagtaagctgcttggcaccaggcaatctgggtgaagggccttaggagagaaggaaaaagctaaggatgcagagtcagctgactctgggcctagcggagggacagctcagcggcagccgctcctgccatccaggggcctgctgggctcaggccactttctcctcctcagccaccactttatttctgccccctccagggttaggctgcaagtctatcaagttcacacagacacaacgtaagacatcagcacaggtctttaagagctccctccgccgcctgggcaatctgggctggagcaacaggggccggggctgcctacctcctagaggctgcctgtacccatttcaggtattaatactggttctgctgttctggccaggcccagttctgctttatcttgggtaagtgataggcaacccgacccaggggccaagtgggtgcccctgtgtatgtgcatgtgtgcacagatgtgagcagggtctcctcccaggctttccaacaggccaacttacctgtgcgcatttggtaaactaaacactatccaccaacacaactgctatttaatttcccacaggcagtggaatgctacgggaagagaacctgtaacctgtcctgtgataagccacatgtcttctctctctttaggggcatgggggagtgaaagagtagaagagattgttgaagaagaaggcactggaagcattttgactataaaaggctcactcgtagcaagcatgcctgtttcaaacagtatggggcccagcttctcttctgcccgagcccagcatgaactgctcagacaggatcctctgagaagctgacatggaggcaggagaaggttaaatcaatggtttctgctgtcccatattagaagcataagggtacacccaagattgagtcccactttttttggtaattatatcattattaccacatcacccaagaagtctggacactcccctgaggaaggggagggagtgcaatagaagatgaggtctggagactcccacacacggtatccagggtgtctgcagcctgccacctaccatcaggtcgtgtgtgtgtgtgtgtgtgtgtgtgtgtgtgtgtgttttaaattaagccaaagaaggactcagtcctttgtaaataaccgtatgcgcaccccctttcgattcagttcacagagaacagtgagaatcttccactgtcacaacacagttttacgaccaacagcaaagaatgatgaggactgctggccttacggctatgttaaggaaggccctggaacaccagtttcctgcctccttgcccatgcagacagaggggagatacaggcaggcaggcatctaaaccagatccctgcaacgtcacatatgcccaggctctggccttgtgccactagtgagggtcagctgcagctcctttctttttcacaaacgaagtttccaatgggcaccctttctgggccatgcatcgcccactaaaaaggagggggcagtcggagagaagggggatgaggaggcaggcctggaagcttctcatggataacaggattataaacacaatttctttccgaagctatttcacaggtcttcgaagcccacctaccactgtcagctgagcagactgtagttacgtgatgggacaggagccaacaggggcagggctgctgagtgcacatccttgtacgcacctgaccccatcgcagagtcttagaagtaagcatttagaagaaatcattttaattctttaagacacaagattatctgttcctatggctaaacaaatattttaacatgaatacagaaggagcagctaaataatctctacacaatgccttaactctcggtgctaatgtgcaattagagtcagaatgttgttcccctgcttaaacttttgtttgaaaaaatgccccacagtgagcatctggctccttctttggtggtccacgtaaaggggatgaagaaatccaccccttccttactgaagtggagagatctaaaacttttttttaaggtatgttttttcagggagaaatcccagcaagcaacaaataataaaaaacaaggcctcaaattatgtagggcagagagggagaaagaagcatggtgtagagctgcttcctaaacccgggcccagagagtgacccaggccatgaggaaagagctgtggccctgagagccggtcccaggaagtctgcatgcgacgctgtcccctgaagagctgccctaactggagtgctccaacgctgctgccgagtgcagtcaggaacatttcctggcatggaatcctatgcgagtcattctttcctttccctccccaacgattcaagggctggatctgacaactgttcagaacatctgaggtgagaagccgggcactgggcagaaccagcagcgatattcaggagcagccaccttctacagatctttttccaggaggcaaccggttgtcttccagtaacaactctggtaattaaagcactgttctcctgggctccttcttttgttaaccaaccgaatcctctaatccctaaaggagcctggcactgtcagcgggctctgctgctaatcgttaaatatcacctctgtggtctctgagtgcagcagggagaatgatgatctgcttgaaggcacacgcagagaagtggaattctgaaatctcagcctcctacgttcaagaggccgaagggctctgatctaaaccgccacccacgaggaagcccacagtgaggaggcagctgcctccaggcaaggcagtccctcggtgccacctccagatcctcttctggggaaaggcaaagggaaaggagggaagtacgtgaaggtcttgtggctttaacttgtaaataggtggggccagtctaagacactcatgaagatgttccttacccaggcacctttttataacattttaaaaaatcagttaaaaaaaattttttttttaccactacatttaccactccatttgtacagtgcaaaggaactgcaatagctcaagatttctgccaacactgaacactgtaatgagatttcctaagctctgtgttgttctggtggatgaactcagccatttgctaatcccaccctggccccacacctccactcagacgtctggacctgaggtcctgccacagctcttccctgggccggccctcccatgctgcacacagaccaggtgagtcttcccaaagccccgctagtaccttgccacttcttctccaaacggtcaaaggttcctcagggcctaaggaacaaaggcccagctgcttgactacttcttctgagactttctctgtgttaccggaagacttttctaccatattcctttctaccatattcccccgcctcacggcctttggcttatgtcaaacacaatggccagttttctgttcctcagcactctcctgcctgctgggtgagcccctgagccccataccacccccacctcctcctctgtccaggccctgtagtcctcctcatcactcaggactcaattcatcacatttgctgccttcttctccatgaagccttcccttcacttcactcccccaccactggatggcatcatacaggtttcactcctacatcttttcattcccgcctctgtgctggcacagacaggcttccctgtgctgtaaccatacatgggcccacccaacttgccaaagtacgtgctatctcatctgtgagtaccccacaggtctaagacaacatcttgaataagtattcagtaaacatctgatgaaatgattatttctggagaattaaaattcacctgaaattaaaaggataaaacttttgagaaatggataccgaattgccactttcttattttgccatgtaaggtcattagaagtaactgcctcctgatctcatcattattttgtaaaagaaatgacattttatctccaaaaaagtaaacagaaaaagttctttgattacatttactgttaggaaaaatggctacatttatttcttatgggccagtgaaaacgcaatccacatgccgatgtttggaagtggctgctctgaaggtgagtatcatggaatggtggcttaggaagccactgaaaatgcttcctcactcagcagccactgaaaatgcttcctcgctcagcagccactgaaaatgcttcctcgctcagcagccactgaaaatgcttcctcgctcagcagccactgaaaatgcttcctcactcagcagccactgaaaatgcttcctcactcagcagccactgaaaatgtttcctcactcagcagccactgaaaatgcttcctcactcagcagccactgaaaatgcttcctcactcagcagccactgaaaatgtttcctcactcagcagccactgaaaatgcttcctcactcagcagccactgaaaatgcatcctcactcagcagctttatttacaaacaagcaaacaacattttactatgaaatctacaataactaagctaagccatatctttttatatcttaatatatatttatcttttacatatactttatcttcatctttatttatattttatcttcacagactcccaaatagataaaccttcattttccctgctttacaaatgaggcaactgaagcacagtgagatgaagccatgtggccaagctcagtttcaatgaagtctaacgcccttaaccttagactctgctgtgctgctgctctaaaacgtttgaccatcatggtttaaagcactaagaggaaatagccatctagatttttttaagtgaggggggcaaatttgggctatctttgatctctggaatctctggagttcaacgcaatagcatcttaatcttcatacctggaccttcgcagttatggctgaggagcacaaaatatccctgtgcctcctggtaataacaggatgccagccttcccagctcagggtagagcccccatcccagcacccatggactacagaactgcacctgcttgaagcaacttcaggggcacacaaatcagaagcacatttggtagccatgagtgaagatttagaattatgcacatgtctatagaaacgctttctgcttcctataccaagaacaacctctatgacgacatgagacagacgctgggagcctacaaccatgaaccctccccacctcactacctacttaccatacctcacaccacccaccagcttctgatacaggagaagccctctggcctacttttggctctaggcaacatatgtcccagaaatgtgccaataagtggccttcacctgcctcttgatccaaaagcagtgatgcctgagtctagataaggtagagtccctaaagagatacgggctctgcccaaaaaaagatgtttgcatacacctactatacaaagcatctttccaaactgcttccagctagaagtatctatttaaatcagtggttctgaactgcggctcaaaaccgtacaggtgttggagggatcccagggtgggtctgctgaacctctatgaccttgttgctacccactgcaagcagatctattaaaaaaaattatattcattgatcaagcaatagataactattggtttccttgtttgtttgtaaataaagctgctgagtgaggaagcactgacagtggcctaacttcaacttaattaaaaaataatagtaattaaaataatttaaaaataaataaataacagatttggaaaccactcatttgaaggcaaagattgaggccactgcaaaacagtctaaagctcaggctgaactgaaagactcccacgacatgaggggaatcaccccggcctctggcctggaagccctgggcagttccaacacaatttcacttacatggaacccacacacacaagggcccccttggaggcttgtatttctaaacctcttggaggtttatttcttgttttactgaactgtttgtttaaatataggatgtaaatattttaagtgtaataatgctaataccagaaaaatcttgttttctcggtagagcctcccaaaccctaagaattcatttgttgacatcacttttctttcccacaagctgaacacttcattatttcctgaattcattttattagagttcagaaacagggcaagtgggatttcactgccgttggttctatcgccacctcacctttcttgatgttttctaccagcaaagggggaggagacgaaagaaaaaacgaaagccataaaactgttaaaactaccattctctatctcgtaaacatttttctatttattggcctttcattatatgtgcaatcttattatccctgcacagcatcaaagtgacatccgtcagggtcaccttataaaatatacatcggcaatgtaacgtttaatgacgggagcgggacgaacgatgaaggatgagagagcgaggcctgccgcaggacgtttgaaagggatcatcagttatatctgtgcatttcccgaggtgataattgaatgacaggggctggagggaaatccatttttgagctcagaaaagatagttaggagaaaaatgtttttgtattggaagcatgtaatgactgccaggaaatgggaacagctactctaacaacacttctcttatattttatggtttttatggatgcacagcaaattatcatgtataatccatttctgcaagttgaattttaaaattgctcaatacaaagaaaggaaaagaaagggtacttaattttctcactgcattacctttaataaaaggagcggaaacaaaaattacacttcaaagcacaaaaacacaagtacagtaccgtaccctcttcaagatgtgaaatgtctcatctctttcacctgaattttggacttcacctaaggcaaacatcttagaaaaattcaggcaagcctgcaaaccaggccctggcttctctgtgctcttgtgtaaacgtgcaaccagagccctctagcaaagaagctccaggaaggaaggggagagactgcagctgtctttatgcaactgtattggctgaactgtgtcctccctcaaattcctacgttgaagctctaacccccagggcctctcaatgtgactttatttggagacaggctcttccaagaggtgattatgttaaaatgaggtcaagtgagccctaatccagtacgactggtgtccttataagaagagatgaggacacagacacccacagaaggaagaccacgggaagacacagggagaagatggcatctacagccaaggtgagaggcctcaggagaaccaaccctactgaactctggtcttggacttccaacttccagaactgtaagaaaataagttctgttgctgaagcaacccagtctacggtattctgtcatggcaaccacagcagactaatacataagcctaaggacagggcttcatggtgagcctcgaggaaaggagaggaaccagcagagaagtgaggcctgctgaatgaacctctaagccctgggctgtgagacggggctcatggagctgactgtcagcagtgaagatgcagtctgctgggggagaagaacaggtgccaaagggtagagtaatgtgggaaacagcaaaataattttctactttaagtggggccaaacctcgcagcttatcctagcagctctaaagggcaaatgccacacagttccctcacgacggctgcattctgacccaggagaaccagcccaactccagaacagctctcagatgctgtggatctaaagacagctggctcgcgtgaagggacacgggggaaggaagagaaccacaagatgggaaggaaaactgctgccagcagaacacaaaggaagaaccctccagagtctctgtgggcctgtttctgaccacttaattctggtcagtttccacaggcaagagcccagctccatggggctgggcccgccccgcacagcctcccatgaagctgcgaccggggaaaggagggtcatgcagcccatacttcacagacagacaaatgtgtgaggctctctgaccaccacagctctgtggttccaggggtttccaagccactgttctgggttcctcacatcaacagacacactgcagttgagaaaacacacacaacgggaaccaccaggggttcgggtgtaatttatgaaaacagccatggatctccgaatctgtgactgtgactgtgatatgggctccacggattctctcctggtccatatctaggtctcctcaaaggttctttacagagggcggctggctctcccttaagaggcccaggaagtgtgggactggcagcgccaccccatgcaggctgctatgcatgtggggcccacagggggcacgcgggggtcactgtctagagactctaggaaaccgctccctactccaaagggaatttgcaaagatgatggggctaactccccagaggagagccaggagctcccttttccatttaacacacaagttgaatgccagatggacctagatctctgcaacacgctgtgtagtggggaagcctgcggggctgggtgggatcacttcacctaatgcagcacgtatgccacaaactcaccacagcacaccttagcctgcatcaaatcctggccgctcctgttctggagacaaatcaccactgttgtcatgatgggtgacctcagtcaccccactccaacgcccacctcacggctgacatggcatgtggcaggaggaggtatgtcactgtgctcccagaacataccataaccccatccctcccacccatgcatgtttatgctgggattggtctgtgatgcaaaggtgcccttggccctctctcgggaagtaattttttccttcatgcccacatggcaaaaggcctgcctctcttggcatgagaatctctaacagcctcagagcaagccatgctgatgatgagctctgcgtcctcactgctcaagcctaggtcccagacacaactcccaaaagtcaacaggctttttttttttttttttaaacgaaacaaaacagagccttgctctgttgcccaggctggagtgcagtggcatggtctcagctcactgcaacctccacctcctgggtttaagtgattcttctccctcaacctcctgagcagctggaactataggcacgtgccaccgcacctggctaatttttgtatttttagtagggatggcgtttcaccatgttgaccaggctagtctcaaactcctgatctcgtgatccacctgccttggcctcctaaagtgctgggattacaggcgtgagccaccaagcctggcccatcaagagcttttttaaaagcttgattttccagctgcagaaagcttcagaaacttttcaacacaagtcaaaatcctcagcaatgaaggagaacagaaaggtagagatttctctttaaggtgacttcagacttgagcccatagcccaggagcccctctgctgatgaaggaaccaaagtcagggcagagaggggcgttccagagctggaccttggagtcctggtcctgaaagtgctcagcgctgctgtaacgtctgccagggcttgggagcctccatctcctaccacgttcggcttcttgagtccttccctgggtaaaagggaccaatggtttttcccacatgtcctgcctctgaccccaggatctccttgggtgcagacacctggaacgccttctcctggttgctgctggcccacccctccagctctatgtgctgtcatccacaccacctcatacacactttactgacccataggaagcgagtttccgatgcgcctgtttccatgattaccaactctctcactcagctgtgacctttttgtggctcatacatcactgagtcctgcaggatatcaagttatgtctataacatgattcccctcctccctttcctccgactggactctaaactgcaagtgaacaggggatgtggccactctaaaccttgtaacctgcgcaatcattagcagagtgcctgacacaagatgggtgctcgggaaacgctaacttgaactgagatctatcacagacacacagacatagaagaattatactgcaccagaaatacataaaacagaggagtcactaacagtcataaaagtgaaataactcagtttcagtgataagaaatttggaaatctttcagtgaaccatttcaaaattgagctaaacacacataggtggaaaattagttacgagaatcaaaattattcaaggtaattattatttcccttaatttatctgtacattaaagtaaaaaacaaaacaaaatgaaaacaaaacacaaagagtcccttgatccatttaattagttaaggttactctcaaaaatgaaaatgatttccccagccccggggacgcgccagtgtgaaatgagaacaagagtcttacagggagtgttcctgcacatacacgtatgcactaatgtgcgcttggaatttaccagaacacacgtgttttttgttttacaaatctatgatgaaaccacacaggccttggcttgacactgttccaggggctaagtcttaacctgaattaaccaagctgcactgtggtccaatgacactttggcactaaaagaataacttccatttttctgaggctgagcgttttctcatttcacgctgtgagaatcctctggacctgccttaagagcactcaggaaagtggttacagtcaaaatcttcctctaaggattagtaataacacaggaccaaagctcaaaagcaggagaaagtgagcaccaaattccttcagtgtgctggagcacatagagacttcctgcaggcagatagcaagaggctctgggattatgcctgcaagctagccatgctgctaggctcttaacaaaacagaacaaggacagcctgctgagctgtggcctgaagcaccagtaatgacagctctctgccaacggcagtggtcaacacttccaccagcttggctccagtgatctcaggtccacctttgtgcccacaagtatcccaatttcttcaggaccaggtggcactctcagctgcctccacatgaattaacgaaactcaattcgcagcttaggctttggctcagccacgtgcgcatgcgtgcgtgtgcatgagagagcgcgcatgctggggaagaatggagaaaaacaatgaacaaacattgactgtctagcctttttcaactggagttcttaaaatgaagtgactattaatattttctcaattctcctatgaacggaacataacaggtacctttctagatgcacaggcaagacgttactacgttacacacaatggatgcccggcttctgaggcttacctctctcagaactccgagtgagaacagctgccactggctgcacgaccttgagcaaattccctaacctctcttggcctctgtttcttcattttaaaaatggagaaaaaccaccacaggaaggttaaggaacctcctcgagactctccttatctagaaacctgggctgcctcgccacgagctccctcctttatagggttgtggtgaggatggaagtgccaaaaaggagccggcacacatgctcagtaagtgacaggattttttcttgaaaatccttttccatctgggaaaaggaccagaaactcagaactaagttcaccttaaaggactattttaattgactaagttaaaaaaaaaaaaaaagtctttcaaagaatggtttctgcaaccaacttccttcctctatcatgtttcccctagaacgacagtgccttatgtagtcaaagaataagagaatgttagagatggtgaatggtaatggtgtctgggcctagttcacaatctgaaagataagcgctggtcaaggagaagagtattctgtctgaagatctcagctgcaaccagcagaaccataaatgcccaacagcccactgaggccacctaagaagcctgtctccacccaggtccagcttctctcttacacaatcggcaacagaatgacgccacacaagatcattaaacatttcagcaggaataaaaacgaaaccaagagaatgcacctgccaatctatatcaggcaactatggggtttgtgagccgtccttgcactttaatgcagaattagctttgatgcacagattggaaaggtccagcttaagggacttagaacatcccattatttaattttatgacaccatcactccactcttaaatgtgtcgaagaacatacacttatgttacaatttatgcccaagggccaggtgcggtggctcatacctgtaatcccagcactttgggaggctgaggtgggtggatcacgaggtcaggagtttgagaccagcctgaccaacacggtgaaactttatctctactaaaaatacaaaaattagccgggtgtggtggcacgcacctgtactcccagctacttaggaggctgaggcaggagaatcgcttgagcccgggaggtgaaggttgcagtgagctgagattgcgccactgcactccagcctgggtgacaaagtgagactctgtctcaaaaaataaataaaataaaataaaataaaataaaataaaaatgtatgccaaactacaatgaattctattgccgaattttaaaaatattcacttatgataatgtggggctcactagagtgtcacaaactccagaatgaaaattagtggcttagattacaaactctcgtagtagaaaggtctaaagactctttagaattaagcttgaaagaatctgtgtttctgatgctgagaagagcatagggaacaggttgtacaatcaaccgcctcaccccaaagcctccttgggtccactgcttcctcaggtcggggtcttactgtttattccacatcgtggctgtccctctacccctctaggctgtgtgactgggaacatgtaagctgggatgcacggaggtccagtctctccctgagtcatgcgcatcctgttcctgctgccctagttttttcttgtgggatacaatgtcagttctgtaatctgtcccctctgtaggggtaaagagatgtgctgacgtgctcagaaaaggaacatgcttctctggatgccatgaggtactaaaacacctgtatcttaaaggggcattaataagaagagcagggatcctctcctgggaactcaagcaatcatttaaacagtgctctcatacagcagcaaataaagaggtaaatgagatctgcttaaggtaacagcaaaggtgagcggttgtatgctaactccagataggagtgatgaatatctgaactgatgaatatcacttaaaaagtcttgtcacatatgatctggatcagaaggctgtgacatcacaaccagatgctttgaaggcattttctctgctccctctagttacagacaattaacagttctgtacactcttactcatctgttccagaaggctactaataaagaggttgggctacttgtttttcactcccagctaaactttctgtctcctgctgtgggcaggaatggcagtggcatgtgaccagcgttcctgagtggcagagggcaacagctggccatcaacatgccagtcatgggcacagctctcagccgatgcaacaaccacattgacttcaaggacaatctaaaattgaactcaaggcagcacctaacaagtctctcgtgcttgcaccttccttctgggcccatctaaaagcagctctgcagggcgatttctgccagccacaggtcctgtgtcctccatcttccttccttggaattcctagcaagactgagtcaagcatggccttgggtctatgctgttctttatgggaagcaccgaggaaaatacatctcttgaattattctaattgtatcttagaatttaacatgttcactgtctaaaatcaaaatgagtttcacatataaatgggcaattgaattaataatatcaacacccatcacagtgtaacaaataacttgattattaacttctactgacagccccatgcttccttcctcaagagtttcagactgcccgtttgtgctttgtgcagctagagggttccgaactctcaagaggcctcagggaaagttgactctgtgccttaagcagaaatcacaactgatccaagggagaccctggatgcaactgcaaaaaactgaatggtagcaggggcaggctaccacggagttttaaatcctgccttacattaacacaaaggaaatacaggaattacccagatgccaaaaggaccctgaagagtatcagataatgatgtacttccagctcctggtgaccaaacaaaacaatgtaacaaaacacaaccaactgtggcctcagaacgcctgaccagctacccggagagcttttatttcttgaagggaagccttctaccaaacaaacaaacaaacaaacaagaaaacaccactttggcggatggatcactaggtcaggagatcgagactatcctggctaacatggtgaaaccccatctctactaaaaatacaaaaaaaaaaaaattagctggacgtggtggcgggcgcctgtagtcccagccactcgggagactgaggcaggagaatggcgtgaacccgggaggtggagcttgcagtgagtggagatcgcaccactgcactccaccctgggtgacacagcaagactccgtcttaaaaaaaaaaaaaaaaaaaaaaaaaatatatatatatatatatatatatatatattttttttttttttttttttttttttcttggttcacagcagtcaaaagaaccacaaaggagcagtagtttctaagcttccatgtaggtgaagacaaaaatttttataaatttcatgaatacttatatcccaactgttcaaaatatcaagatatttaagaaaacttgtaggactacagttaactattctctcctccaaatttttctttagaatcagagagaccaaaaataaaaaaattaaaaaattaccattgctcctatataaatcataagaataaaatagagccaagagaacttcttaggaacccctctcatcccaagccaagagattcttcccacattgggcattatcaataatgagaacattcctgagatcctatgagcttgtgtggccctgtctcataaagacagtaaagccacacaaataagggtttccactccctgggcctgagctctgaaacccagccaagacagaatcccaaacagccagagagcttcctttctgaaggcagtgaactgaacatacattatttaagatgaatatctagaactcttacaaatgaaaaagaaaaggacaatccattgaaaaataagcaaaagacttacacaggcccttcatgaaaaagaaacacaaacagccaataaactcattataggatgcccaatatgattagtaaccagggaaatacaaactcctcaaatgcccaaattctttgtgttggattttcaagtaaagtttacctcaaagagttaacacagaagacaaaggttttgaaatctactatatattctctcaggggaaaagctgcaactttgggtgcagaagtagtgtgaggaaaggaaagaggataaaaatatgacttgaaaggacttcacaaatagaaaaaagacggataaagggaacgtactcaaatggattcaacactatctcattcaaaatcccagctggttagtttgtggaacaagacaagctgattttaaaaattttaaagaagaataaagtgccactaatcaagacactcttgaaaaacaagaaaaaggtaggggacctgctaagtcaactatcaacaattatcctaaagctagacagtgaagcactggaatagacagagagaccaacagaacaaaacagcttagaaacagattcacactcttatggaaatttcactttgacatagctggcaacacaaatcagtggagaaaaggctggacttctccagagatgacactgggacacctggtgatgtattacagaaacaagtaaatctggtctctttctttatgctacacaatcaccaaacccacggactaagaacttaaatacgaaaagcaaaattataaaacttttagaaaacagtaagtataggagactgcctaaatgaccaagagagatttctaacaaataaaagctcaaagtataaaggctgatacatttaaggagagaggataaaatcgttaaaattaacaacatattaatctttaaccaatcataaaaagtgtgaaaagataagccacaagccagaaggtatttgcaacacacattatttaagatgagtatctagaactcttacaaatctagaaaaagacaatcaaattgaaaagtaagcaaaagatttatataggcccttcataaagaggaaacacaaatagccaataaactcattaaaggatgctcaatatgactggaaaccagggaaatacaaattaaaatcactcagacatttcaagtttataatgttggtaagcattttaaggtctgattctatcaagtgttggctaggatgtgaagttactggaattcttacatacagctggaaaaacaacaatctgcttttcttggtaaaatagcagatacgcatacctgtaactcaaaaattgtcttaactataccctaaagaattcgtgtgcatgtgtgccagttgatgtgtgcaagaaagtttacagcagaactgtatgcaacagcaaaacactggaaccaactgaaatgtccatcaacagcagaaaagagaaggaaaagacgctctattcatacaaggctgtgaagtaccacaggatgcagagctgcctctcgggataaaggggaatgaaaacagcaaggtgcaggacatttttcctccatgactccattcataggaagttcaaagacatgcaaaactaatatactgtgtagcaatacacatatatgaggcaagccataaggaaaaggaggggggttatagcagaatacccagtctagtggttatctttgcgtggaaaggacaggggattgcaccggagaggaaacagtctgtgcaatctttttttttttttgagacggagtctcactctgtcgcccaggctggactgcggactgcagtggcgcaatctcggctcactgcaagctccgcttcccgggttcacgccattctcctgcctcagcctcctgagtagctgggactacaggcgcccgccaccgcgcccggctaattttttgtatttttagtagagacggggtttcaccttgttagccaggatggtctcgatctcctgacctcatgatccgcccgccttggcctcccaaagtgctgggattacaggcgtgagccaccgcgcccggcccagtctgtgcaatcttaagctgcgtggtggcgacagttcaccgtgtggctgtttttataccatacacaaatgctatattcttttgtaactcttcaatatttaactaaaaaaaatttaaaccagaagattgtcaaatatattccaattctgcatttaaagaaaggtttctcttctctacagataatttggaaatgatatgcaagtgcttccttgctcattagacagctaggtaaggggtttaatgacttctcttccacctgacctcacttttcccactgccacctgcccgcccactctaaaggtgctgtccgagctccacagcacacccactgcagggatactcccacttgggagcacacttctgtgtccctgctcttcaaacccaaatgacctcccttctctttcttaggatcactgttttcctgagtattgtattatctttaggaaagtacagtgcttatgaaatgacacttcttagaaagacatgtgtcagctgggaagggtgacatgaaatcttcaaaattatcaaaatcagtctaaaataagcagagctgtgcttctagataaggccgaaaatgactactccataggtgtcaacagtctccaaatataatctacagcacaagtagcctcaggggtatgaagaatatgtctgtgaactcatgtcaacccactctcatgtctgtgtaaaacctgaaaaactaaatacatacacgggaggtactaaaaccttcatccccagcatccactggcgtgtgacgtcaacgccttgttctttattcacggccatttcagaaacctctgtgccaccccgtccatttacttctagatttctgctgctgtgcggctcagtggatgcccctactttagggaatcccagcaggcgcaccctagcacgaaaagccaaggtcactgtgcctcttgtttacaacaacacaaaaaaggtcttaggcaagacccccctaccgccacacatgctaacaaaaaaccatgaggaaggggtggaattctctttggtaacccatgctttgcagtcaatttgaggttcatgttgggaggagaagtcggggagccaccacggaaggtcgcatggagggaacctcaccacttccctctataaatgaagccccaactgtagtatgcgaataaaacaatccgtcagctaagtgcacgttgttttgtatacattaatagttttccatttgtgaggagaaatcagggcagcaatgacgaccctgtctcttaaacgcatccacttctgcaaacagttcatcacctccaaccaccaatggccaaagagtatctcccctaggatcctgttcaatctctctgtggacctgtcaagacacaaagccaaactagactgaatttctctggcaggagtgaaaatacatcacgggttaagaacaagagtagttagacagtgaggatgttaacataaggaggtgggcatgtaccagaaaaaggaaaaccaataccagacacctaaaatccaagacctagaaacagtcatcctgtgacctgaagcagagccatgtgccacaaccaaccacgccacatctgaacccagaggcatcctgtgacacatctgacaagaacgacggcatacagaagagcagagaccccactccagacagctacactcatgtacagagaggcctttggcacatcttctggccagtcgtcaccccaccccaggtagggaagctgcttatttggagagtggaaaaaacaaacctggcatgcatggttcagcgccctggtagttttgggagctagctgctctttttgatcctcttctccagggtaggctcttcccctgcccactaatctatgtcccatagtccgaactgtatcaataactataggtaatattttgaacccatctctctttcttcagaacttggggaaggaagaaggggcactaatttatcagcctcattcagagacccaaacaaatagtgaagacagagccccagaaacctaagtccaaaattctcccaactaattcctttctatctagtaaatattttaaaactatttttaaaaaatcatatttatccagttaaaaactatgtacattttgaatccattcttccataaaacaaacatacatctcaaaaccagctatacaagagggaactcctgatcttcacttctccctcctaaacttacctccccatcttaacaagcagcacttcccctacccagtggctctgtgccagcggggggtcctccctgacgctgtcctctctgatttgccacttctgattcaacaccaaatctcaccaatcctgccttccaaaatattatctcaaaaaaacaaaacaaaacaaaaaaaactttacttctctctgcctcaactgccaccaccctcatccaatctcggggtcaccttccatgatcacactgactcctacctggcgctcagtttccactccccttgacctactacaacccaaattccacactgtgtcttaaaaataacaaaataaacaggaaaactgatgttacttccctgtttgagattccttatcaacttgtcacattctcagcacaaaactctagcaaggtgttcaacagcatggactttaaagccagactgcctgagagtaaatcccagctatggtatttccaagttgtacatacttgggtaagttacacagcctcctatctatgtggtcaatgaaccgatgtatgtaaagcactgagaacagtgcctggcacctgagaggccctcaggacatcctattactgccatggagcacacaaggtccccatgacctgacctctccccatcactgttacttcacccctctccattctcctttttgctccacacactccagctacacttactttttcagcttcccctgagttccaagcctatccttctccagggcctctgtacaggctgatcccttggcctggggggctcttctgattctatccttccctcctcatctctggggtcataactgaaatatcttcagatattcctttcttaagttaggtccccctgttatgatttctcataatactcagcagatttccattattgcacttatgagaatttataattatatatctaattattcacctaatctgtcttcttcatagaattaaaattctagaggccgggcatggtggctcacgcctgtaattccagcactttggaaggccgagacaggtggatcgcctgaggtcaggagtcctacaccagcctggccaaccctgtctctactaaataatataaaaattggctgggcatggtagcaggtgcctgtgataccagctactcgggaggatgaggcatgagaatcgtttgaacttgggaggcagaggctgcagtgagccaagatcgcgctattgcactccagcctggacagcagagtgagactctgcctcagaaaaaataaataaataaaattctagaaaccagggaacatgtcttttgtttattgctgcatttctcacaactcacacaatgttcagcattctacagatcttcagtaaatatctgtaagatgaatgagtataaagaaatctaataacaacttgacttaccttgtaaagaaataacctaaaaagccatgtacatgctcaagaggtttcaggttaatgactcattcttgagaccaaaaaatgtcacagagggcatttgtaagaaatagaaataaacaaaatacacaattgaaaaaataaaaaaaggtgaatctaacaaaatccttttttaaaaaaatccttttatgcttatatttttacctaacctggaaaatgaatatctctatctatatatctctctgtctatccatctatctatctagataaaaacaaacttagccaaaactttttcctctcccctgggtctcattcttcattcctagctttctaaaaattcagcaaagacaaaacatttgccttttcctatcaaccataaacacccactttgaacacagccagtatctacccccacccctccatctaggagctttaattatggccctgaagtacgcataactcacactagcagtagagtccatctatgagggacgtggaggccctcaagagatatggtcagcatctgttacgccagcacaccagagcaaacatctgctgcaaggttgtgctgaaaacatttctatcaagtgggccatcctgtctggaagattaccagccctggagggatgtttgcgagcaaagtttcagctcttcgtgaagcagccctctgaccaaagcaagcgatacagagtgctgcagagaacacgatgtgcattctctgggggcattttcaagggtttccatttcatagaaaatgaaaggattctaaaccatgtagagacggtggaaaatatagttggatactacccaatgaagatgtgcaccaaaataccatgatgaagtttatcctgaaagtaggagaaggagaatgtggtgggcttactcatgagaaggaatagcaaggtgctcagattggacttctgcagggattcgtccccaagttcccaaagactcaacctaccaagaaggaggctactttgccagaaactgtcctacactttatagtacttgatcttacctttccagatgtttctgtgaattttttagtctagtgcaccatcagttcaccaactgctctaggaagatccaaatacaacagttcttatttccgcctccatcaagggtaataaatgccaagtaagatgcagtatcctatttagcgtggcctgtgtgactgggggcccaaagccaggaaccatagcatccacatcatctgggcctttctgattggaccgtagcatgacaaagagcagtggcttaggggaccctcctttctcttgctgactcaatctaaactgctctgggtgagcactccccctttccaagtcctgtttaattctactcataaaatggggttggttttctaacagctcaaggtgttttaagaataatacacagtgttcataaagcataatgggcatctcccaacaaatggacccaagcgcaggcaaggtccatttctggttatttctgttatcaatattatttgaaaagcataggtaagataaaatagcaaccctcaactctgatgcatccagaactgggcaactacataatacagagacaatttacatgaatgaaagtttaatggcatcaaatcaactatggattactagtatccaggtaaaagtaaaaactatatagagttgaaaatgttgctaagaaaatatattaacatataaaaataccttttaaaacttccttcattttttgtttataatttgaagggcaattagaagcttcagatgataggagctcaaggcccacgattttgccatgaaggctggccacctccaatctccacctggggacttaaaacactgcaaaatcctatacaccataacccaagaaaaatccctgatttctccactaagggctcctgagaccagaaagacaagatgaaggatggtgacctatactttgggaaaaccaaattagctgccatttcttgacattctataatcccaactttcaatttctaatgcaggtggctctaactgcacaggtaggacagagctgaaatccaatgtaaacagacacaattcatcttgcacacaacactatacagagctttccccattattaaaaagcttcaccaaaatcttgattggaagtatgctaaacatactgcccacaattccaaattaaacaattttgagaaatatttcttgcttttcagattctcaaaatatttgaagttcgacaactacatacaggcaagatcattctgaccatcaactactcaattaattctcactactgtcctgggaagcagataatattatcaccattttatagatgagaaaactaaagcacagagagatgaaataatttgtccaaggacagcgggagtggaaaaggaattcacacacatttccgttttccagtaatttaacttaagaaaggagctactgcagagaacaaacttatcagtcatggaatcccacatcactcagtgctggagagggggaatgagcaacaaaaaagtgacaaatcataaggtctgagtcccaactctcagccagagtcacccaattgcttcagaagactgttaccccaaggaaataagaaaaaaatacgttaacttgctctgtaaaccataaaatccactactagtatatatatatattatatctccatgaagcacttaccacagttacacttggtttttgtttgcatttcttagcaggtgattaatactttaaggggagagaaactgtattactcatttttatatcctcagcatctatctaaaatgtctttcccatagaaactcaaacgtctgttgagtggttgagtgagtaaataaatgtaaataaaataaaaaagaaaacatattttaagggccaaacagcccaaaggcattccatgagggaagtttgttactaaactttcagataaggtgtctagtatttcctgtaataagatattgtatattccccttctcctgcccacagaataaatcaagtacaaagaaactaaaaataataataccaaagaatgagcaatttccgggtcgggtgcagtggctcatgcttgtaatctgagcactttgggaagccgaggcgggtggatcacaaggtcaggagttcaagaccggcctcgccaatatggtgaaaccccatctctactaaaaatataaaaaattagccgggcgtggtggcacacgcctgtagtcccagctactcgggaggctgaggcaggagaatagcttgaacccgggaggcagaggttgcagtgagctgagatcacgccactacactccagcctgagcaacagagtgaggctctgtctcaaaaaaaaaaaaaaaagaatgaacaatttcctctttggtcttgtctgcataaaaaaggaacctctcctgctcagctatgcaggcacctggagacatttgaagctggaggtaggaaaaaaaaaaggtgaaggtgagcttgacctagaagggcaactgtgaacaaggtgctttgaggaagcaatgtcaaacctgtgtggacctttttgtaaacaggttaatttcctaaattcttttgtgggaatataagacatccgtgtttctaaaacgggagaggagaggaaacaaaaaccaaaaccaaaaccaccaccatgcactgaaggcctgcagtgggggcacaggaggaagtatgagaggttccatgcctgagttgtgatgtttgcagagaattagccagtgagagtgcccaaggaacacgggagcacaaatctgagaaggaacactcgaacgaggaccaattctattattattattctgctctgtaaggcataggtgacaccacccctctctctgtgcttaaaggacagccattccattaactacccaccttgaatggattccagagaaagactttgttccccaagaaatattagcaaaagccttcaagccagggctaagagccttagtgacaagtgagaaggcacagaacaactgagcagagatcatctcttgaaaacctatgctaattatcctgtttctaccatcaggaaagtgggaggggggaagggctgctgtgctatcacttggggtccattctggggtcaaatttgaatcccagcttctagagctgaattcaatgtggagtttgttgtccatgccaaaattcaaaggctgatcaagttgaagaacgtgacatggacataatgtgaagtacatgaaaactcacatacaaagtacctgccctcctggaaccagtccccagttatcacagagccgagaggaaaccagtcccctattatcaaatcctcttactcttgactagagtgatggaatttgggaagaatgcagcagacttctaaagactgctcagctacaagcaggatcttcatctccttttcagctgtggataacaacggaagcagtcagccgtctaataaatcaagtttaattttaacagcatgaagtattgcccgctttgtaattatacttccaaaggtaaaacccaactcgaattaacttaaaaaaattgttattgaggtaaaattcacataacataaaattaatcattttaaagtttacaattcagaggcagttaatacatctacaatgcgtgcagccctcagatctaattccaaaacgctttcatcatcccccaaaggagacccctccccctcattaagcagtcaaagtgaactttttccacaatggcattctttgtgatatatcatgctttctccacagtatcagtttattcactttcaacagcatctttgcattttaaaggtaagggaaaactcaaaggaccatgagaactaacactcacaaatgtgctttccagtctaccacgtgactgtatacacatctggtgagacagttatctcaggcaaaatgtactgtgtgtcttccctgggaggagaaacaggagctgattctaatggaatgtttactatgtgacagatactgagtcagaaacagcacagcagctaagactgggtgctctgcaaccacactgcccaagttccagttccaattcagtgtgaactctgtgttctttgggcaagtcatcataatctctctgcctcctttctcttcacacgtattgtgatggcaacaccaccacttgcctcatggagatgctatgaaggttaagtaagttcaagtgcttagaacagtgcctagtgcataataagagctcaatcactgctgccttattcgactttcactacgactctgagggaggttctatttgtgcccccatttcattactgaggaacttaaattttacagcatctaagagacttaccccaaacccccagagaataagtgggatagctgggatttgaactcaattctgagttctgttggcttagcaaccattctgtaaaatgtaccaaggaacaaaacctttctgatcccagttaccaaactcatgttgagcaaaatcacactcacacaggaaaaaaaaaaaaaaacacatgaaactgtcaccaaaatggcaataacccaactgtgctacagttttatttcctgctggcttctcagttctctaagccttgaggatccacgcgccttagaccattattacctcctcccccatatgcagtaagttcctgactcttctgatctttcctgttcttactgggcaccatcccccaagaccttctgctatttgtactttctgatttcaggctctttattctctgatacacactgttgccagaataatcttcaaaaagattgactgcaactttcaactttaattcaatcatacaaatatttcttgagcatctaggtgcaaggcaccatgatgaagataatgtgagtaagacagtccttgccttcaggagctcaatccaaaaagggaggtgtaagatagaatttcataagacaatgcagagccagagaaaggccctaagagaggcatgatgttctacaggggtattcaaaggacagagttatatcctcctcagattagagaaagattaatgaaggaaattaagtttaaaaatgtagagcatttccacatggagtaacagaagggcaggcattctgggcagaacactgcaggaagaaatggcagacaggaagcctgagtgtttggcaagggccagaggtgcagaaagaaaagcagtagggaaggggcttggagaagctgatttggaccacagtataaaaggtcttgactctcaggcaagggggttagtactgagtgtggctgatgaaatctccatagctttgctctcctgtgtgctttgctcagggttggttctcaccatctccccatcactcaaggcctagttcaagtctcagcttcttcctgacgtgtgtcttgaccgccccagtgtaaaataagatcctcttctattaacaacgaccatctctacaatttatttggcaattaatcacgtagtgcttctaacatctgttatcagtcttaaatgatttttcctttttcttattatttatcatgcgtatttatgttttgactccccagtgaagtattcactgaactctagtgtgggggaggagtcttccccaactctggaagatcaccagaaaatacgcagcctaaaaacagattttgtcaggtgactctgatgaccagttgggtatgcaatccactacacccatggaatctggcacagggccttgctatacatcgaaaaatttgctatttttacaggtatctgtgattttcacttcatatctcaacaacaaacaggtgcatcaatgtgcgcggccactaggagtacatgagagtacctgcttttcaacaacctcacttctacttagaactgataaacttttttgtaaatataacgggtgtgaagtaatatgtgtattttaatttgcatttccctgttagtgaggctgcaaaactttgcagacttttcagattttctcagctaaaactacctgttctcatctttcacccatttttctattgaactgcttgtgtctattatagatttctacaagttcttcatgcattctagatactaatccagttatgttataaatatcttctctcagtctgtcacttttttctcactttatggtttcctataaaacacagactttttaagtcttaatatagataaatatattatcatttactttttgagttgtactttttgtactatttcttataaacccttccctactcagggaacattaaaatgttctattttcttacagttttaaagtcttgtttttcctggctttaacttatctgaaagttacaatcttattttattttgttcccatatgccagctaagcccattggtcccaaaccatttactgaataattggttagttccccacggatatcacatagttctgcccccattacactgacgtctctattttgcatcaataccaccaggtcttaattactctaactttacaagtcttatctcatttgtataaagcctatcttccttgtttcttactcaattttcttgctattcttggacctttattctaccacacaaatcagtctgctggttccacaaaaaaatcctgttaaagttttgattgaaatgatatagcaatgagagagtaaggggatctttataatgcagagtactttttccattaacatcggcgcatcatctctccatttatctacgtcttttttttaggtcttttaatattttattatgtctttttttaaaaaaaaaaataaagaatttgcatatcatttgttgtacttactgctaggaatcttataaactataagtttctgtagccactgtgaacagcatttttttttttaagagacagagtctcactatgtcattcaggtgggactccaactcctgggcctaagtgatcttcctgcctcagtctcctgagtagctgcaactacaaggtcatcccactgcacccggctcagtatttttaatatattacattttctactttgttggtggtggtccataggaatactaccaattttttaaaaatctttaaactgtaaaatttttctatattttcatttgctccactaattaagtgtctacatttttaatataaatatatcacctacaaatcagttttgtctcttcctttccattcctgtgtcatatgtgtgtgtgtgtgtgtgtgtgtgtgtgtgtgtacatatatattatagtttgacaaagtcatgctctgttacccagactggagtgcagaggtatgatcatagctcactataacttgaacccctgggctcaagcaatcctcccacctcagcctcccaagtagtgggactacaggcgcatgccaccatggccggctaatatttttattttttgtagaaatgaggtctttctatgttacccaggttggtcttgaaattttggcctcaagtgatcctccctctttggcctcccaaagcactgagattataggagtgagtcacctcacctggccatatatttatatacttttctataaacacacatatatagggtctttgtccaattgtgtcatatagaaatctgagtgaagagtctaatattagtgatgacagtaggcaaccttattttgctctttattttcagtgaaggactgacagtttcaccattaaatatgatgcataggggctacatgagtagctcacgcctaaagtcccagaactttgggaggctgaggcaagaggatcacttgagtccaggagttaaagaccaccctgggtaacatggtgaaacaccatctcaaaaaaaaaaaaaaaaaaaaaaacccaaaaattatccaggcgtgatggcgtgcacctgtagtcccaactactcagaagactgaagcgggagcatcactggagcccaggaggttgaggctgcagtgagccatgactgcaccactgcactccagcctgggtgacacagtgagactctgtctcaaaaaaaaaaaaaaaaaaaccatatatatatatatatatatatatatatatatatgtcacttaatagtttttgggagttattcttttttgcattaagcacatgtcctgtcattcctagtcttctataagtcatcgttacaaagaacactgcatttcacccactgaattttatgcaactatgaaaacaaatgcacttgtttctcagtgagttatattacgtagcaaactgcattttcaaagacggccaagacagtatctcccacctcacataatctttaatgtgaccttgtaactccccatcaaaagatggggtcttccagagcccaaggtgggagaatcgcttgaacccgggaggtggagtttgcagtgagccgagatcctgccactgcacgccagcctgcgcaacagagtgagaacctgtcactaaataaataaataaacaaataaatatcgggtctataactgggtgcagtggctcatgcctataatcccagcactttgggaggttgagacaagaggatcacttgaacccagaaattcgaggccagcctgggcaacagagagagccctcatttctacaaaaaataaaaatattagccaggcatggcatcatgcacctgcagtcccagctactcgggaggctgaggtgggaggactgcttaagcctgggaggtcgaggctgcagtgagccgtgatgtaccactgcactccagcctaaacgacatctaaaccctatccaaaaagaaaaaaaaaaagcctactttcccttcccttgaatgtgaattggacttagtgactgctttgtaaacaatacaacacagtgtaagtgatgctgtgtaaatttattttattttattttatttttttgagacagagtcttgctctgtcgccaggctggagtgcagtggcatgatctcggctcactgcaacctccacctcaaccttcaggttcaagtgattcttctgcctcagcctcccgagtagctggggctacaggcgtgcgccaccacacagcaaatttttgtacttttagtagagacgaggtttcaccatgttggccaggatggtctcaatctcttgacctcgtgatccacctgcctcgacctcccaaagtgctgggattacaggagtgagccgctgcgcccggccaacgctgtgtaacttctaaggctaggtcagaaatggccacagaacgcagccaaccatcatgctgtgggaagcccaagccaaatgcagtggccaagtataggtacgccaggtttccatcccagtcgagctcagcctcagagtcaccatcacagccaggtggcagaaatgtgagtaaagaagatcacagctgtttatgtcacacacagccatttgtgtcttcccagctgaggccccagaaatcacggcacaaagataagacacccttactgccccattcaaaattcctgaaccatggaatccataaacagaacaaaaaggttggatgggttgatatggtatgtcatgcaacggtggacagctggaacacaagactagagtctctcatggtaactatctttgcattcccgggataactcctacttgctcaccatgtagtactttttatacattgctgggttcagttcggtaatattccacttaagacgtttatgttttgcttggtgaagggagagattggcctacaaaaaatgtttccttcttagatcgtatttatatggttttgagatcaaggttaaacttagccttttaaaaaaagttgtgaagcttgccttcttttcctagcctctgagaaatagcttaaagatttgttaattaaatatcaggtatattcacctgtaaaactgcctggggggcgctggtgctgggaaaggggtattcaaaccaatgatccagtttctttcgcttttttttgagatggagtctcgctctgtttcccaggctggagtgcagtggcgcgatctcagctcactgcaacctctgcctcccgggttcaagtgattcttctgcctcagcctccctggtagctgggactacaggcgcgcaccaccacacccagctaatttttgtatttttagtagagacggggtttcaccatgttggcctggctggttgcaaattcctgaccccgtgatctgcccatctcggcctcccaaagtgctgggattacaggcatgagccaccgcgcccggccaatgatccagtctctttaataattattagcatatttggaatctctattcttgagtcaattttaagaattttgttgtctcttttgaaatttcctatcataaaacttttcacagtagcccttacatgtgtgggtttgtgtatttaaaattctctcctgcactggctctttgtttctaatactgtttacttgtccttcttttttacaagatcagccttgctgtattatattcatattttctttttttttttttttcctgcttctcgggttcaagtgattctcctgtctcagcctcctgaatagctgggattataggcgcccaccaccacacccagctaatttttgtatttttagtagaggcagggtttcaccatgctggccaggctagtctcaaactcctgacctcaagtgatcctctggccttggcctcccaaagtgctgggattacgagcgtgagccacagcccccagcctatattgctattttcacataatcagcttttgatttaatgtggatcatctcattttttcctcccatttcattaatatctgctattacctttatgtttccttgttaaaaattgctttcttttgtggttattctttttctatttttcttaataaaatcttagctttttttttttttttttttttttgagatgggagtctcactctgtcaccaggctggagtgcagtggtgccatctcggctcactgcaacctccatctcgcgggtttaagtgattctcctgccttagccacctgagtagctgggattacaggcacgcgtcaccacgtccagctaattttcgtatttttagtagagacggggtttcaccatgttggccaggatggtctccatctcttgacttcgtgatccgcccgcctcggcctcccagtgtgctgggattataggcctgagccgctgcacccagcttttttttaaaaaaaatagaggccgggtgcggtggctcacgcttgtaatcccagcactttcagaggctgaggtgggtgaatcacaaggtcaggagattgagaccacggtgaaaccccgtctctattaaaaatataaaaaattagccaggcgtggtggcgggcgcctgtagtcccaggtactcggagaggctgaggcaggagaatggcatgaacccaggaggcggagcttgcagtgagccgagatcgcaccactacactcctgcctcggcgacatagtgagactctgtctcaaaaaaaaaacaaacaaacaaaaaaaagagatggagtctcactatgttcagactggtctcaaactcctggcctcaaatgatcctcttgcctcagcctcccaaagtgctgagactacaggttcgtgagcctggccaaaatcttagcttttaaatttcaaatcaccctacgtttttaaaagcagagtgtcccacagattctaatctgagattactctcccacagtaattgttgactaaactacttcctgattaacagtgagacagagaagaagagtccttgggcaatcaaaaaccatagtaaaatcacagcagggtcgacaacccatacagctccttacaagggtgggctaggtggcagcagactggtgccaaccgtgtcagggcgaggtggaaggctgctctgggtgaggtgatatggaggacccagagcacagtcctgaaagcttggctcctcaccccaccctccttgagaatgacaattagccctagacagtcaccaaaatattgccaaagctggagagatgaagcccctggtccctgtgccacttctctgactctggataaaccaactgactatatgtcggttttctgagtttgctttttggggcgtgggggagggtgagggagtggcagaggtgttgtttgaagtatcataaagttttcgaagaaaaaggagactgcaggctaagttaaaacactgaaagaatagtaagtgatggtcaagagtgagaagggagcatggctctgctggtagcggtatgccaatataatctctcaggaggatgcaaggcactggctaccaaaggccttaaaaatgcacacactacttgaaataaatatttctaggaatgaatcttaaggaaataactgcccccagataagacaaagtcactcattaagaaatttttttgcagcagtaaccacccccgaaaaataccccagaaactgaaaataaatgatcaaaactagaagttggttaataacatgatatcttttaaaaatgcaaccatcaaaaatgactccatagatacatgcgttaagcaaaagatcaatacagataagttttaaatagtcataaaataaaaataaaattaaaaattaggttatagaactgaatgaggccatttctgtttaaaatatttattgatatatgcctagaaacagtcggaagaatatgggccaaaacgttaattagtggccatctcttagtgatggaattactgatttttctttttattttcgagacggagtctcactctgttgccaggctggagtgcagtggtgcgatctcggctcactgcaacctccaacttcctggttcaagcgattctcctgcctcattttcctgagtagctgggactacatgcacacgccaccacgcccagctaatttttgtatttttagtagagagagtttcaccatgttggccaggatggtcttgatctcctgacctcatgatctacccgcctcagcctcccaaagtgctgggattacaggtgtgagccaccgcagccggcctgattttaattttctactgtaaatttttctgtgttttcaagggggaaaaaaattactaaaaacagaccccttccctttccccctaacaactacaaagccaaacttaaatgtactatgatttttaactgcagcagtaggattctgagtgagtcaatccaccagattaatatttttttaaatcgagacagggtctcactctgtttcccaggctggagcgcagtggtgtgatcccggatcactacggcctcaacctcctgggttcaaatgactacaggtgtgtggcactacacctggctaatttttttatttttatttttttgtagagacagggtctcacgatgttgcccagactggtctcgaactcctgggctcaaccgatcctccctccttggcctccagaagtgctaagattataggcatgatgctgtccccagtcagattaatattttcaagagaagaaagcagtaatgcaacttttttactttttaaggtgcatttttaggaataaaggggcaacaggtccgcaacttactctcaaatggttcatgtggggggaaaaccacacacgcacacacacaaaaggagggttaaataatgtgataagatgttaatatttggagaatctgggtaaagaatatatgggaatgctttatactcttcttgcaaattctttaagtttgaaattattttaaaccaaatggttttttaaaaaattatgcatagaataacccaaactttctgaaagtcaagggttacacacaaaataaatttgtgtgtatctgtatgtgtttttgggagagggagaatagttcagaataattagaacacgttgagaatttagaattctcttccatttagtccagtgaggatcttaaaaaacctaagaagtactacgtacatatataattttagaccgcattttcagcccaggcaagagtcagagctcatacaactttgtggagggtgaaaagaaccctgccacaaatgtgctacagagcccgcatcatctccacaacaaaacacccgacacccgaggttcaaaaatctacttcatcaaagatcaagaataactctggttagaactgttaaatcagtggaaagttaatgaacatggaggatgaagtccagaaagtgctgtctgcagtgtttggggcaggcattcgcattaggaaaccctctgtggtacaggctctctcagtggccaactatttggtgatctgcacatttttagcatagaaccttgaaatgatacagctgtgctggtcattacggaattctctttttgtgtgacagaattgtgacaggctcccaggacctaaacccagaaggaagcaggaccatattgctgcctagagaaggggatggagcagattccaggacaccgatgaaacagaagcttccatcacagtgctttctgctaccttatgagacagttcgcatctcaacagctctaggatacaaaggaagcacatacatttatactttataaggtggccaaggaatcctactgtgaacaaagaatgtctaagataataaaattccactttttttttctataaaaagcaaatcttgtcccagatgcaagcacttgcaacagaagctctgtgggggaagcctacctctcaaggccctagttcttggctcatccccaccccatgacctggacaagacctgtgagggtgccatttttagtatcaccgtgcctcagtttctccacctgtgcatgtggaatgatactggcagcccccgtagacttatggggatgactgctgagctgatgtctataaaatgttcttaatggcaagggcgaaagagctataaatacaaggtcaaagcagcatttaaaacctttttaaagctgcagccacttctttcttttgaaacagagaaccacagggaggatcaaaggcgtgctgctgttaactgcggctctcaaggccttgccctccacctggcagaaaccctagagaggtctaccatgatttttaccttgactaacaaaatctcaagacaagttgtacaatggtttcctggaacattctgagtaaagaaatgggaaaccaatacagcttacctagcttgttaccttctatgaacgctggcattaaaagtaaaaggcagccttgggaggaagaaatgcaaacacagagggagaacatagcttccccttgtctctctctgccacaaaagcctggccaaagtgactctactaggttgaagcagcctgcataataaaacgcttaaccttggctaagttaacctcctcagccattaaaaaaagggagggtgggggaagggctagcaaaatcaagcttacgggaaataaacctaatcaaagccgagtagtaacaaagggcaccagaaacatttctactgtatcacatcccacaggctggccaagagcccggaattttcattacaactttcaaagagagcaagaggaggagggaaaaagatttcacaaaagcattatcaaggccccaacccaggatgccctgctgtacaaccaaaatttgtaagaggtcagcctttcagggagtcaaaaacccagcatgtggaaactggcaggccttttatatagtgggaggggttcttaaaacgactactgtttcgcactgaagtctctgagcttcacagatcattaaaggtttctgaaccacagagaaaggagggcagagttaaggaaataaatcaaaagttcctctgggacgcacaaatgcctacttggaacaggctttcagcatgaatatcctccacattaaacaacagggaggacttttcaaaataaaagcagaaaagagattcattttgttacaagcaatgcactttttccttttggtgtaaaggttatgtgtgctataaaaaatgactcctgccgtgagtgctgcggggaggtggaggctgggcttggggcaggaggtggtggtggtcaaagaaaacaagtagaagtgaatacaacgcctgagaatgctgtgtttgggggtcccccaaacaagtctaaatgtcccgcaatgatttgggggtaggatgtgaggtaggagaatggtatcagaaaggaatttcttctacatttattccttgccatccttgcccaagaactgaaatcatttccccacagccagaaagaactgtcttctttgtgggtgtgcaacacacacagttgcagatctggggaaaagagactgtgccgttttgaaggcagagcctcacacttcttaaggaaatatcagttgtctcaaaaccagcagagggagtacaacgtttgagaagaggaatggccaacccgattgctgaggattcatgtttagccccgacaatggttgtaaagctgagctatctaccataacttctgcccttgctctcctgtcacccagcaatagtaaacagaaagaaaagctatactacctactcagatggaattagcttgttctaacaaccgcatgaggcagcagagagaaaaggagaactgtccacacttctgtcgggacacagttcctgtgagcagcactgttttggggagaggaatagaagcagggggaaggctcaatgaaaagcagaaagtccaatttggactgacagcaaatcccaaagcaatgattttaccttaaaatccagggctcctaggccagtctgtgaacagctcatttccagaatttttgtttatgagagggcaaaatggagaactctgtctttcaagcttttctttcaacagatgatttgaaacaaaagcagcacactcatgaaggcgtatgtctgctaaatggttgctatcttaatctttagccacagtttatcaaaacatgtaggaatgggttgagaaattaactggtgctaagattatcagcatggacaagttcctggggagggcctggcgacatgatcaaagctaatggtccctctcccaggagcaaagagcctactatttcatgcatgatgatgttgggctctggcactggaaatctttgctcaggtccattctaagtgtcgaaatggtgtaattaatggttagcctgggtatgcactattcaatcaggcaattttttttttttttttttttttttttttactaaatccgaacattaatgctttctcattgtgggaaatgagagctgggataaagacatgctcaactcaacagaacaaacacaacctatatgtgactttatgttagtctaggaactgtgcactgatgcacacccaggaggcactaagttaacacacatgcatgcatacctgcctgcctgctgggtaaggagggctgggcaggggaggggggccgccctggctgggggacacggctggggccattgttgccactttctcctctttgtagacatcaatttttacaaagggccgaatgataaaggtccacaagacctcacccagaacggctgttgcaggaagcagaggcctgagcagcctatagccagaagcccaggcagggggtgtgccaactacacaggcccacatgaagagcctccatgaggaagacgttatggcaagaatcctctaagtctccaagggacgagatcagaacaatgtatggaaggtgaagtgatacagatttcagcttaataaaaggaaggcggcccgaaaaatggaactgttcaaaaccacaatggcttcatttaatgggttcgatgtccccagtctgcaggaatgctgtagaagattcaggtagtgagaaatacctcaacagacaagaaagctacttcaaggacttccttcggcaaggcctttcaaacaagttttaacattgaaaacacccatccttcaaagagcttgaagccccaagtgtccatcttccaggatgcacaagactccccaagccttcatcctcccattactatttaatatccacactacattgttcggcacttggtttccctccagtatgcaccgtggcagccagtaagacacccccagggagcacaaccgcagctcactatttttctccccatgctcaataagttcagtaagtgcttgatgattgactagcatcaggaataaactaggagcattttacattcacactatctagttaaacattccaaatgacagatttccagaaaaatgttgcaacaaatgtaagtatttatagacatgcctggtaaggtatgtagcatttggagaaataataactagaacagagtactgtacaaaagaaaatggtacacttttgtatgagtctaagatatattggacaaatgggtattcctattggtaaacatggacatcttaataaaaatacaaaattactacataaagaagcattacatccttcaactcatctggtggccataaaatggagagaggcacatggacttttctcctgagtcacctgatagatttacaagatcaaaagaaataagggcttcaagtctttttttttttttttttaaagagatggggtcttgctagcttgctcgggctgaactaaagatatcctcctgcctcagcctcccaggtagttggaactatagtaggagtatctaccctgccctgctagaacttcaagttttgatgggcaaatccaccccagaggacaggacaaatgccagtattctggttaatagccccagatgagccagcttcccacccatctcccgtaaggtggcagacacataagggaagccaccttggacctttcaggtcaacccatctaccaggtgatactacagagtgagctttggatacatgacatggaaacaaatggccagctgagtcccacctaaattcctgatctacaaaattattaaaactataatatttatagttttaagccagtaaattacatatactaaaaggttttggtttttagaaatttatttaaaagttttagggtttttctttttaggctcacattatccaaaacgtgtagtttgcccccagttcactggctctgtgctttactttgcgaaactagccatctatacagattcatcgggcctatttcctttagaacttaatcctattgttccacaaattacagattctcgccaaatgaaaacacctccctcgacaacttaaggccacaaacctctgacataattcaatgtgtgtcattagcacatttccaaaacagagcacttgtgggaagaagaaccaagttctgatcttagaagccctgtgcctaagtcaataaccaccaaatcccaaaggtgctggacagatgctgctccggccccgaaaataatcaaacacacaaaagttactattaatatttcttgccaaacaacaatcaaaaaaatccaactcctgcacatgggaacaaagcgacaatggcagcagctgcaaatacataagcgaagcatcactgaagaaagtctccagcttaatattgctcccgacaccctctgtggtggttcactcatacagcaaagacacgggataaaaaattccacagactgttttcaagataataaaatggcatatgatgatgactcactaacagactaaaaggaaaaaatatccgtcaacagtcataggaagcttacaaagctgcagagatctggcaccactaaagctcctccacctcccctggctctcacctccagtacacacatgtatgtgggacatacaaagtgtgtgtgttcatgtgcacaccctttagggattaatttgaagccaagttgcaattggctaatggcttactctactgcttaagacagtattttattcttgactggctcaataaacctgctgagaaaaataaacaatggatttcaatcttataaataatctagaacacagaaccgctgcgcaaacaggagagttgatttactgcgcacaataaacagaacaggaaggaccagtgtggcagagtgaaccccaagtcctagacccattgtcctgggacagtagagttcacaggggttttctgtctattacacaaagtctaaggcctgggatatccaggtttcaaactggtcttaaaaagagcatttcaaagcagatcaggtggagaagctttggtggtgccagatctccgaagctttgtaagcttcctatgactgttgatggatttttttttcctttggtctgttagattttgctcacactgaagagcaaaagatgaggaaaatgttcgtttaaaaacaatgaagagttttcacgtcttaggaccattaattatctacccatgattacaatgtatttcgaacctattatttatacatgcgtgaacacacacacacatacttcattttaagcaaataaaaagtaagggctgttacaggactctaagggtgccataaagaggtattaaaatgaggtccctgcccagaaggctttatattctatataaatacatatatgcattcatgcacacatgtgtgcagagtaaaaatgcatggaaaagaggaatcagagtcaagtccaagaataaaataaaataaattttaattttgttttttgttgttgttgttgtttttgagactactctgttgcccaggctggagcatagcagcgtgatcttggctcactgcagcctcgacctcctgggctcaagtgatcctcccacctcagcctcccgagtagctgtaactacaggtgcgtgtcaccatacccagctaattttttgtattttttgtagagatggggtttcaccatgttgcctaggctagacttgaactcctgggctcaagtgatcctcccacctcaacctcccaaagtgctgggattacagacatgagccactgtacctgcccaatcttaatttgaagagggtggaacaaaacccaactctgctgagatgaaatgggccctttgtgtaacagcaaccagcctggggaggagcagaggcagccccagcaagaccgttagaaatgagggaactttagcagggcaccatggctcatgcctgtgatcccagcactttgggaggccaaggtgggtgtatcatctgaggtcgggagttcaagaccagcctggccaacacagtgaaacctcatctctactaaaaatacaaaattagccaggcatggtggcgcatgcctataatcccagccattcgggaggaagagggaggagaattgcttgaacccgggagacggaggctgtggtgagctgagattgtgccattgcactccagcctgggcaacaagagtgaaactccatctcaaaaaaaaaaaaaaaaaagaaatgaggggactcagatacctttcagagaagacccctggcccacctggccccttcactaggggccatgaaggtaagcacccttattcacctcagacatcccatcctagacagcacaggcctggggttaccaaaagctcccccaaaatcccaactttgtcaactgggatagtttagatatttcaatagtcggccgggcgtggtggctcacacctgtaatcccagcactttgggaggcagaggcgggcgaatcatgaggtcaagagatcaagagcatgctggccaacatggtgaaaccccatctctactaaaactctactaaaaatacaaaactcagctgggcatggtggcgcatgcctgtagtcctagctacttgggaggctgaggcaggagaatcacttgaacccgggaggtggaggttgcggtgagctgagatcgcgccactgcactccagcctgggcaacagagggagattccgtctctaaataaataaataacatttcaatagtcaaatcctggggattatgataccacaattgagaggattcagaagaaggatttaagacacttgagcagaacaaagaattatatttccaaagtgggggggtcggtggggggaagaaacatgggccattaatactgaaacttaattaaaaaattcaacatctcggaaaacttagcttaatggaattctggtatcccaaaggaaggttgctcctgtttgcttttcctatttacctaacacaattaatggttttcaaattatacatgacaggaaaaaaaaaatcttactgggagtagggggatgcctttcccatgctgagcagctgggactgagactgaggttaatgctttgctttacttttcaaaacaatactattaatttttactctattttcctaagtattactcaagggtatagtttcaaataagattaaaaatgaactagttattcaaggattataatttcagatacattttgaaacttagttttaatgtcggtttcctaacagactagatagatatatttttaaaatatcagcaaactagttttcaaagtcagaatagatcttacaaggctaaaaaagaatctatgatataaaatataagctccaagtggataaatccattgactgttaaccacagcaaccacaacttgtaagtctttctaaagaccaattcaaaccttccatttgttttactagctaataaaatggtgcagactatttaggcttcaaagtcataaatgtctccatctaaaagtcatccaggtaaccaagacacagccaaatcataagaaatataggttagcaaataccaacagcaaataaatccctgcaagcaacattttgttcaataacactttaaaagccccaagcatacttcatttgagtgcagtttctataagtaatacatttcaaataattaaagcattctcatgccatccccactagttttcatatgtaggataacgccaaggtcaggctgtttacactgagaacggcaactgtccaaggcccttggtttaaaaagtcacccaattttttaatacctccttttctttccaacaccagcaccaaaagtctcttacgtacttcacttacacaagggaatatcagccagtctctcatagattaccctcacgaaaactggaccactgcccaggcaaatatccctatagttcagactatcacaattaatagattcgagcctcggctccattttaatgggaacaaactctcagcacaggaatagctataggatcacagtacttactgccaaaatgcagtgcctgtttctactggcaatcactttggcctcaaatggaaaattccaactgtttatatctatgtgagcacaaattattaagaaaaacagtatggcacataaatgtctttcctcttacccatcttgccagcccctcaaataacttatatttctttttcatacataaggaatgccaataaaagaaagcaatgcccgaaaacactgtggtattaaacctttatgactatgtaaacttcagttaacaagagaaggccatccttccacataaaaaggcttattaaaaactgaaatagaatctggcaaggtctaactagactgcatgccacaaggtaaagagaacaagagcttttgtatcaagtaagacaggagttacaatcatgtttctagaaaaacatgggagtgggaattgagaagaaaactatattgagaagtcctggctcacggtcaggcgcggtggctcacacctgtaatcccagcactttgggaggccaaggcgggcggatcacaaggtcaggagatcgagaccatcctggttaacatggtgaaaaccccgtctctactaaaaacacaaaaaattagccaggcgtggtggcgggcgcctgtagtcccagctactcgggaggctgaggcaggagaatggcgtgaacctgggaggcggagcttgcagtgagccgagactgcataactgcactccagcctgggcgacagagcgagactccatctccaaaaaaaaaaaaaaaagaaaagaaaagaaaagaaaagaaatcctattattgacaatggaaataagccctgatacttttctgtttgaaatattttgcaataattagaaaaacaaaatcaagccctaatagtgaaactttacaattttaacagaataaagacagtatcattttaagaatgatatactatgcaggctcagaattctgcaagtctgcattactgtaaatagcggtgcttcctaaactttacagtactttggaatcctctggggggtccgttaaaatgcagattctggctcaagagacaaggacagggcctgagaatcttccattttaaccagtgatgagagtgctggcctgaggagcacactgtgagcagtgaggatagacaacgtttgtagaagagggacaaggtttaaaaacagagatcttctaatgtactggtatgtggccgtgacacatttgcacattctcagtagcatcaaccgactaaggaagtccatactttgttatgcaacattagattaagcattaatgaggctaggaaaattgtttatttaaggttataacctgaaattaaataaaacttcaggctggaagctcatattgaatactagaatcatttttaacctcttaatattaacagaaacctgattactcagtcttaaagccctttctcaatagcatttattctctgctgcaggaatatggtctatgcaaatgacattttgcctgaagaaaaaagtacagttaatggccagtagttacgtacgtatttaatagaattcattcccagaaatgtggctaagaaaggtggttgattttcatgttatttattaaattaaaaatttaaatctctaatacctttcatcccattacttaaagttaaaaacgtcaaaactggctgccctttcactgggcccttggtgccaaacagtgacacatttccaatagagaaaatgaagatagaaggcaggcttcccttcccattaactttgaactttcaagtccctatctgtcttcctacaagactaaattataagaagagcctcctctttggtcccatcctatacatacttcggtagcacagccctcacttctcttcttaaaagccttaaatgggtcccatccccacactcacccatacacattctttggagggaattcaaggtcccccaaaatctaccctgcagctataatttgggcccaagttctactgcatccgcttatgcaacctcctttccaaccatgctcatgtacttgctgggcacgttttacaatttcctgtctccgtgcctttgttcatagtatttcctatggctggaaagttgcttttcctctaccctcccaacctgggcctgtcaaaaatgaatccttccttcaaagcccagttcaaacaccgcccctccaattagctttccaggagcctctgtgctcactttgtggggcctgaacctccacccaccagggccctcagcacattctaccaagtatggcaggtatgtaaatgtcgtgctggctccctgcagggcagggatggcaccttgcttctctttatagataccctacccattgcagtgctcagtgggcacccagaactttaaaaaattgaactatacacaaaatttagttctgataatgggaagtgaatgaaaatgagtttccagtgtagtaagtgtcaatgcaccaccaactgggattacaaatgacacaagcttaatcttcactgggctaggtgctcaaaaataaaaagaaagagacgagaaagacagccaaagcatgtcccctttcaccttccatctccctccaggggctaacactttgggaacacctcttggctaccaagctggggtagatcacattgtcttctcaccaatcttagttgcaccagagacaagcaacggcaggtcactgaggaagcgctcctggactacgacccagtgccagctgaatttgtctaagtaataggagacacagctataaacaaaggccaggattcaagggacaatcatccaggtgccagacacaaaaagtctttggttcaaataactgatatgtcctcagagaagagatatgtcaccactgcttgaataattatctcatgattttgaagaaaactgcaatgtatagacaaatcaaacaaaaaattatttttggatcatccacgattttgtgttattcctaacatggattcacctttaggtaattaagattctctattaggcctcctactttttcaggcattaccttaacatcaaagctcatgtaccatccatctacccaacaataagtggcagggctcaaagcagaatcaagaggcctagttctccactgtcctcccaaaagttcagacaccgggcgctctgtgacttatacaaatatactaacacttaagactctgatgtggtttatgacaaacagtggcttgacagagaagaggtatacagccaaggtgaatctaaaatgctccacccgtattcctgactacatttcacctactaattatatactttataagcatattgaggggaggtaaatggttatagagaaacagagaatgggaaaaagtataataaactacaggatatttgcacaaccatgacactaaaagatttgacttgtagttattctcttgggtaccctgaggttaacacgtaatacccattcaactaagcctctataaacagttgggttttccgcaatcacagccactattcccacttcagtgggcagcagtgttcagagaaaagccagatttagctcttgtgcaataaacaccagaaaccaaaagagctaggaaagctgtttacgtctatgcccaccaggaacccttctctgctataaccgcatgaatgaactggtaagaatgaggtctcaacaaagcttcaagacggacgttgttaactagttgctgccctccaagtttttggcaagacagattaatgaaaaacaggtaacttatttttatacaggctcagtatatttacaagcagaaaggaattctgtacttttcaaagcatttagctaccaccttatgtagtatttaaggtagacaggaagaacaatcatttccaagtatttctatgcactctttacaaacattatctcatttaaattctcaaaataatcaaaagggtaggaattatcaccccattttacaaacgcagaaattaaaggacagaggggatgaataatctgcctaaggttccagagcaagtaagtagcagagaaggcaagaatcatcacttcgttctcaggcactgcagcaagtaacgacgtacaggcattttataacgaccacagcacctacacaattctcatgcagagaaacaccattttacagaaaataacttcccagtgttgtcaagatttgacctgagctttccaatgaacagctcaaggcagactgcacaattaaaaagagatcatcaagtactatagttaccagtaaggccaagaatagaacacaggtctgctgacccttgcaccaatgcccaatcaggcatgttcttttggatgctgacacccttctcaagttccaagtcacttgcgaataacaaagaaatgagttaataattctggtagacagaagaaaatgtaagccaggcatggtagcgtgcacctgtaatcccagctattcaggggaggatcacttgagcccaggagtttgagaccagccagggcaacagagttagatcttgtctcattaaaaaagagagagagagaaagagagagagaatgtgaaaagtatctatattagagggatttgctatcaaaaggggcatgactataagaattctacccagcaagttctgaatcaacaacactggtacatgcaaatctcatcttctgcagcaaaaagtaaaaaatgacctctgccctcccctccctgtgggctgtgaatgattagcttggctatgttgataactagagaaaataagaaaacacaagatgagtgcctctcccagctcattataatacttacagatttaccctactaccaaactcctccagtgcaatgcaaaagacagcaaggacactatgaatatttagcaaatgtcaggcataataaatcctccattgctgcaaacaactctctcattagttccaatgatggtgactgatgaagactttggaaataggaaaactgctgggtgctagagaagggagaagagctacagcgtgggaaactgtgaaggcggaggagtgatggggaaaggtctcagcaaagaggctagtggaaaagacaaccagagaactagctcaaaaggttggtgtactgagaatgcctctgaaggagaaaaaaggctatttatttacggagtcacacatcatcaataagaagggaaaatcaagagcaaaaagaaaaacatagtagaagaacttaactaggttaaaggttactcacatctgcttccactacggagataaaacactaagtaaaattaccgagcatttccaaatgccagatggtagaatttagatttaatgcttaatcttccaattatgaatttattttttaaaactgaaagataaaataattgtcaagatagttctgtatcaaattcttcatggtttgcaacttttagcagagcagagacagagaacttgagaggctacaatctgagcgatcaggagaaatctactcactgatctcttttttactcagccaaaccaaacttcctacactcgggcaaaggcattttaatttttaatcatatcaaacttcaagtcactgaaatccccagaaaacttaaaatatgtatctcaatattccatattaaataactctaccctgttctgggaagggtaagaaataagttgattatatagattggcatcataatacatcttagtttaatgttcataaacaggtttctctctctctgttttttaccattctcaatatgatccatcctagcatatgagatgcgtaatacttaaatttaattgtcattgactgatgcaaatcatccatttatatatacaagactatacttgaaatcacaaaacccttcttccccatgagttatcactgtccttgaggtactatacagtaagtgtccagaaaaacagctcatttttaaaaagacagaattaaacaagaggaaatcagtaaacaacatccaattaaaaaattaagccaaaaaacccaaattatccgcatacttttatagtagatattcttgcatccatctcccacctccactccctaaaaaagcagctcaatgtctaggcagattaaacatggatcactcctcccaaagtcctgaagagtgtttctggttaatgagtcctcccttcgccttcagacagtggagtggctgctccaactccatcccatctgccctatcccgtggcctagccagagggaagactctctccccatctgcctctacaccaccagggaaggagatgaggagggaggcaaccacagggaaatgagaatgaatcccttccccgcattctcttcatataatttcactctgtattttcctcagcaaatccttctacctcacgtttatcgggcacatttgtcagctctgacccccagctttgtgaaatactaagtagttttttgtaaagctccatttaagcaatttataagatccccttgtacatctgtccagtggaaagtgcaaactctcagggatagaatattaaagagttaaaactcctcttcaaaacagagcaacattgaaaaatggaaaaaatcccccagaactcaaagtataataagccacaaacctctggtttggttgatgatttctgccaattaccaaattcaaactagtgataaaatgctatttcctattccagccactatgtttaaaatttgatgttaactctccaacaatccttcccccacaactaaccctctgttcccaaagacctttctgttctcagagttacaacagaagtctatgttctccaggcggataagcataatctgtcactttactatctaaaaattatgaactcaaattaaaagtcaagggagtaaaacggagagaattctggaggccagcccgagtctgagcacagcgcagggttaaaggaaaccatttcataagatcaaatgtggagaggcagcaggagcaaagaggaaaaaatcaagttacataaagtccaattgtactcactgtttccttattgggaagcagctcctttctaattctgaagaagttcttcccgtactgcctgagtcccttaacgaagcgtttctgtgataaaaagaaacaaatgggatgtaaaaaccaaaaacaaaacaggatgtcagcaaagcaaagatatctacaatcagcagaataacaaccacaaaaaaagtctcggctagggaatactgccgaggctcggagagtatgtcagcagctcagctgggacccactggccagggcaggccccagctaccttcatcagaaccccaatcccacccaccacgcagggcagcgcgtttaagagaaggacgtcctgcgtctgaggctaagaagcaatctgtccccctcttccaccaggcacacattctggtgcacgaaggtataaatatgctccatgttttaataaaacacaactgctttcccacctgagaaccaagcttcccagaagtgtcgagcagaaaggggaaacagaaccaaacccggtgactcttctccagaagggaaccctagggggttaaaaggccgctttccttaatccaaagaatttgccaggaggcaccggaaggcaccagtatcacagaagcccaccgggaacacgaaagccagcgggcctgccccaccgtccgtcattaaaagccactccgagacaccagagaataaccagcaccccttccgccctcccgacgccactcgccgcccccatccattttcgcagcagactcgtccctaaccccagcccggagactttcactttgtcccatgcctcccgagcacccctccccgccccggtgggggcagctcctggctccgagcccccacctcggggctcccagcctggtcccgggcggccgaccccagcagccacaggtaagcgcccggggtccggggcggcaagaggccgtcgcctgtcactgggctccggctccacaaagcgcagggcggaggcggccgcgggtggctcggcgtgtgaccgcggcggggccgcgcggcgcggggcccggggggcgcggggctggggccgccgctgacgggggaggaggcaggagcgcggcgcgcagagcccggcgcggccgcgggcggctgcaaaaggcggcctggattgccgccgccctcctgtccgccagccggggccccgcgccccggccccggccccgcccccggcccgacccccaccccgaggccggagcctccagggcacccggcgctggaatctgtgtcctccttccggacaggagaacatcaaggcggtaaagcacagaaacttcctccctaccgcagcaagcgtggggagagggcgcccacagggctggggcccttcccaggctgctgggtctccagcccacgttccggatggacgaagtcggctgcgccccggccgcacgccctccgccccaaccccgcctcagctgcgaaacggggggctggccccgacgccccccgcggtcccttccggcccgcgattgtgggcggcctctccctggcggcccaggcattagcctgcacttccccggccgccgcttcacaactaaatcaccgcggaagcttcccagccaataaatcacctgcccaccgggcagagggtccctcccactccctgtgtttgagacccgccaggcggattcagtgaagggccagacttagccttttaagaccagtctgcaacctcctactccagtagtggaggctttgcgtttttgaatttcacccttgctgagatatgactcatcattgtcaattttcaatataattcatacagttcgaagggaaaatctctcaaggcacaagaaagcagcaagctctcctctagtgtgaggagtgacctttgttacttgacaaaagtatcgtttatatgatcaacaggcatcctacgctgtgtgcacacagcatatcaccgggagagacggcacggaaagatggccctgccctcaaggagctgcagtctgcccaggaaggcagacaggtaaacaaaccagtcctagggcctgcaagaaaagcagcagaggaacaaagggtggtgggtgaagctaggaagaggaagcaacttactctgcttgctgatgtcttagaggaagtgacaaggaagagtgtgagcctgccaggtgggctccagcagggcttccagcagaagtcagccaggaaaaggcacagggaacattctgggaactgcaaggaggacagggtgtgcagaatggagtgccagcagataagacgaaagaggcaggcaaggatccggttgcagagagcccttcaggccgcacggaagagttcctaattgtaggctggcagaaaggctgaagctggagctttccatgaaaagactggatgaggactgtgccagtggcagtgtggcctaagtgtagattagggacagaccagttaaagaggctgctgacacagttcaggtatgagatgaggacctcaactactggcacactccacctcagtaatcagaattcctgccgcttaatccattcttcaagtattcaggtatttactgagcacctagctgagaggggtctaggaagataataaaggttgccatggacctttactgaactgtgattcatttttgcacgtaagataagtatgtgtgaagtcattacagaacattctgagatgtcatctggccaagcataaagaagtgaggtgcagctcatcagtgcagcaagggacccaagaaggctagactgcagtggtctgtagtagttcagaatgccttcgccaaggcagtgacatcagcgagatcacaaggggtgggcaactattgcaggggtgggaggtggcttggtgaccgggccctccgtgaaggtcagaggtggagaatgggaggtgggttacaggggacagtctacacagacttggggcgggcaatctggagtgagccaggctgtggaacgccaggaccatgcaatcggaacgtgggcttgataccaagtgacatctaacaggtccagtaaaagaggcctacacaataaaggcagcatgtgagaaaggctgactctggaacatcagggtaaggtggcagagttggacaaacaaattcagatcctgtttcttccatttattgtgatgcaatcctttgaacatcatccattcaaccaatagttactaagtacctactatatgccaggagcctcatatatattaattcgaaatctttacaacctaagaagaagtacaattattatccccattttacagacaaggaagctgaggcacagataggtaactagatcaactcctcagagacaaagccagaattcaaacttaagccccctcaaatcctcagagccacactctgtaaaatgcaggcaggcgtctacagtggtaactattttctgttaccattttctatgagtctgtactttcctcttctcgggtccaatgtcaaatcataaagtcctcagtattcttcctaagaagtgtctttcagccgggcgcggtggctcatgcctgtaatcctagcactttgggaggctgaggcgggcagaccacaaggccaggagatcgagaccatcctggctaacacagtgaaaccccgtctctactaaaaatacaaaaaattagctgggcatggtggtgggcgcctgtagtcccagctactggggaggctgaggcaggagaatggcgtcaacccgggaggcgcagcttgcagtgagccgaaattgcgccactgcactccagcctgggcgacagagactctgtctcaaaaaaaaaaaaaaaaaaagtgtctttcaacgccctcctttcctgctcatgctagtggcagtcccaggccagacctttatctctctttcctaataactaggctattaaccatctcccccatccagccatttaaaagcctctgccaaggaatttttcccaactatagatttcatcctgagtcccactttatctggcccttagcccctacctaagaacagcatggtggtctctgcaggacagtgtttacactccttagccctgaattcaaggccctccaggatcctggccctgcccacctttccagccagatgtccagtaatgccaactggcccacactgggggacctctgtctcaactccagaatctgggtaaggcatctccacgttcacctcaaaatctctcctactcccaaatgaaaccagatgtccagttactctctcattagtttatttatttgtataaggcctgcttacccaaaaagtccataaactcttaaaataattacatcttacacctagtgcctccatataacactaggcagttgatgctcaccacattttttgtctcctttaaaaattatttatttattaacgatgaggtctcactatattgcccaggctggtctcaaactcctggcctcaagcaatcctcccgctttgacctcccaaagtgttgagattacaggtgtgagtcaccgcacccggacaagtgaaaccaaccatgagatgctgagggcctgggctagggtggtcacagtggaaatggactgttgaaagccagaaggtccattttgaactctcctaacagagctgacctcttgctccatgatgccaaactctcctagttttgctcataccacttggcctaattctctactcaacctctaaatgctggagtctccccaaagctttgtcctagggctttctgctatatatatcctctccccatatgatctccactgttcccttggctctaaatatctttcgagattgtcactggtatttctaagactaaatctatggtccaagtccactgggaacactcaacttgaacgtttcacaggtatctcaaactaattacttccagaaataggaatttgacatctggtggtgaacacagacctaccacagctgtcaatgtatgtcaatataatgctatcaagagcaaaagcacccttggccccactttaaaaaaaaaaaaaaaaaaaaaaggaagtaaaagcttcatgtggcctgtactgttacttctctatggaaagccacaaggcctcaaaaccagcaaaacatctgcttctcagagaccagcctttagcttgtggtttaccagaaatgtagagtagccctgaaaatcgaaacaaagacgaccactcacagtagtcaatgattggaaggggtcacacgtgaaagagacttctgttgcggctgtctcctttccctctataaattcatcgctcttcaaatgaagaccccgaagtttttaagactttaacaattaacactattgacttataaatcaacaggccctataagcctctaaatgcaagttcatggagacagtctgtttcttaagagtcttctagttgttgagctgaaattcggcatttccagtgctgaaattcaaggtctcatgaattatttctgtgtccattagtttttctatcactcccagtgtatagatattagaatagcaggatgccaagggtaaaggaggaaggaaatatagaaggcaagtcactgacttggccactgctgccagcgctgggcagctctgctgtttatgctccccagctcatagcctgcccactctcagacgcacgaactgagcgtcttgagatgttggcacttgtttctctggtgtgttcatgcccaaccaacccaactaggtgctgctccttggaaacataaaacaagtccttttctgtttgtgtacccccatagccaggtgagatccaaatataaataaatatttatggcaaggagattgttgctttgtgttacaacttacgtttatgattttgtgctctaatttttagataaactgctatagttttccactattgagctgaatttcgtatcaccatcaaaagttacctacctacaagtccctagtagagaaaatttaacttctggctttaaaaaagtaagttacctgaacccagcattactagccttgggttttaatagaacctggaaagctctgttttgcattttcgctacagtggaaagaacgcaaggttcagacttggaagccatgtgatctagtctgctcctatgttccaaaaaggaaattctgacatggctgtttagacctagccactttagaaacagctatattggaataaaaataacaataacataaaaataaaaataaccacgtcaaaatgcattaaattaatgtgttcaaaagttcctcatgctattgcttgagcccaccccctgtcatagtcccccaagccttgtgcctcagcctcactggtctgcctagatactggtcctcacctctccacctttgggatggcacgtggacctggtgcaagtagcatcaccattaacctactgatgagtacaaacggcattgatttttacatgcgtcatggtatgagaaaggcagggaaacaccaccctagaacaataaaaatggtgaacactgagcgctataacgtgccagccactgtcttaaaggctctaatgcactagctcatttaatcatcacaacaaccttatgaggcagaggctactgctattcccatcttttaggtgggaaaagtaaccatgtatcactaaatccttgaaccaggctgggagggtcaagggggaccagtgtaaaaaattgggaagcctcagagctgtggtgggcctaggaatggagccgagggtgcagacaagggatgtgatgatgtggctgctgcctgtgtttgcatcccaagatattgtttcccaaaaattctatgtgtggatagagaatactgggctgagagtaaaccctgaaagggtaaggtgtgcaaattcccctcatctacacatgaaactcccagcacatctcattctggcgtcatcccaggtgctggacctgacccctatctgcagtagcaagagagcagaagacaggggctaagctacaaaaatggctaaaagatacctctgcattaacccctggctgagagctttcaaaattaactccctctggtgaattttaactagtgtatcacagtcagaaactcaccatgacttctgaaaagggacatctactcagtcctcttacataactgtttggaaaacactgtaggtattaaaatgattcccactgtgaaaatggctccttctgttttaccctgatttctgcacaaaattttatgttaataatttattggttcacaggggacagaaaagcaggcagatctgctagtaagcaaactacagctcccccgaggagacacacaggcagtgggtaagaggaacagacccatggctccactgaagacacagagcagcagacgaaaaagacatgtcctaaatgttaaatggtaaggaggggtagggtgaaaaaagggaacatggatgccaggcagaagaaataaaagcctttccaaacatttgtattacatgatgctggctctcactgataaaccactggatgagaactgtacttcatccatatcatcctgttggttgcagatcccgtcaccccatatctaaaacatatttccttctggagctttactgttgatactgctttgagatgtatcatttggttttggttttacatatttaacattttaatgaaagggtgacttgagtaaggcactactttttcaataaatagcaacagaaccaatttgcctgggaggagacctgccagcaagccatgaggggcatttccaaaatttccagtataggctgctcccaatttctgcctccactttaaaaacactttgcacttactagtgttattccaggagagccagttaatagtttaatgaaactagttagagtttaaaggcagcaaatgggataatttaaaataatcatcccatttttattgatggttctcaaatctctctccagatctgacattttgccctagctcagacttgtacctacactttctattcagactaacgtcctccatagttttaggacatcaccatcccaacttgggcactgacagcccacaggccacatcctcctcaagtagcaactcatgaacccagagaactgactgaaatagttcagtgtttcttgagctccccaaggccttcaggcttctgtgcagagtggaagtggtagtggtagtggcacaagtatgctaattgccacagtacactctccaaggtaagtgtaaccgggcccattctacagataaactaaaggttaggtaaattaaatctcctggcccatccacatctaatcatcatcagggccaggattcaagtccagttctaacaacaaaagccatgccaatggtaacagagtgcgtgtgagctgctaagtacttctgtgtattaactcatgccattaaagtccgtagatgccatagggtgacccagagccacactgggtaggcccctccaggcattcctttgtcttccaaataccaactgaggtgcaggcttattacccttacgttactactggcacaagtaaaacttcttcctgcatataccttaagacgggggtctccagtccccagggtacaaaccactaccagcctgttaggaactgggccacaaagcaggaagtgagcggcaggcaagtgagcaaagcttcatctgtatttacagatgctccccctggcttgcattaccgcctgagctctacctcctgtcacatcagcagcggcattagattttcataggaccacgaatcctattgtgaactgcgcatgtgagggatctgggttgcgtgcttcttttgagaatctaatgtctgatgatctgtcactgttttccatcaccctcaggtgggactgtccagttgcaggaaaacaagctcagggctcctactgattctacattatagggagttgtataattaattcattacatattacaatgtaataataatagaaataaagtgcacaataaatgtaatgcgcttgaatcatcctgaaaccatccttcccctcagcccatggaaaagctgtcttccacaaagctggtccctggttccaaaaaggttggggacctctgctgtataccactgtagtcttataaacactgtttacttaattaacctaaacatttaaaatgtttcctttcttcaataataaattaaccttagcttactgtaacttttttcactttataaagtttaaaattaacctcatgggcctagcacctcaaatctcccccgcttctctctccccaagccagcttgccctctcttagctccctgtggccctatttctgtcagctgcagcagagttctagaagaagtgcctggcgtgctctctgtccattcccactccttccatcagtcaccatgccctctagattcattcttcacttcatggagtttcctgttcggcatgctcctcggtttttgcaagggctctgccaactacagggccacgtcatgccagtgactgcactggtctcctccctggcctcagtgtgtctccacacccctccccccaacattccagttctgggcattctgtatattaatgtgttctcttatttgaagacctgtgacaattcctagtacgtccaaactatcggtctgctagttagttaacagcctccacaattgggttcccaatcacctacaccaccatgtagtgaagttagttactgcagtaccccatcctgattcctttccctgggtttttaccaatgcctttctctcttacccaatctagaatgtcccctcttcacttctgcttattcaaacacatcaactcaactaacattcattgagccctcattctagtgaacacactgtgcaaagagcacagcacgaggcactgagtgaacaaggagcacagcacgaggcactgagtgaacaaggagcacagcacgaggcactgtgcgaagcatgttccagtttcaactctatccctacacagagtccgctctgctctctctcccttctctgaaaaacaacaattcctgtttatgactagaattaataagcacttctgccattaaaaggtctatagatcttccaccaaattgtggattcctttccagcaagaggtgagtatttcatgtcttgtgtaatcttcagagtgcctggcaaactgtaaccaagcaatatgataactgttgggtggctgcatgggtattgtttttggtcctagagttctccctgaaacataatacatgtttggtaggatggaaacaaaatttctaatcaatgttagatttgtttctttttttccaagaagaatggagaagtaaatcatattttaaaatgggattgattacttggactctcagtgcagaaaacactgttttatatctattcatctcagaggaataaagggtgtgatacttcttaaggtacttcttaagatactttaaaggaaagtttacatatatatacacatatacatatacatatacccaaacttaaactcttgaaataaaagcacatgtcggagattatatgctgtatgctggatatccatgaggaaaattttcccacaaacaacctggcatggttcagtaactaaataactacatcccccgtactggtaactagccctatctcaggactactgtgttcctgggtgcaagatgggtgtctaggcctccaccatcttcaaagcctcaatttctatgtccctggttctcttaacaatggaacagtcgtaaagcagggtagcctcttggtcctacaaagagacaagaggaggactcaactatttccaaaaagacatcttgtcttgcatgctatgttttgtcaactgtcttaaatacctttaatatctaataacaccacttccacttggttctccctctctggacatgtgtctttgaaataaatcctagtttcagcacacacaaaaaagacctgtttcccaggctagtcccagaagattctatggtaattacaacaggatcccaaatccaagccctctgagtaacagtccattcatttcttttttttttttttttttgagacggagtctcgctctgtcgcccaggtcggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccccattcatttctaaaagaagtcctctctagggtcaaatatggcagctgtttagctgacacagaggagtaataccaaagagttctcttttctgtttcctttcttttcctctttttcctaatcttccaaaggccaaagagaatgagaaggagcacttgggaaggtagatctaatataatcctgcctggctgttctaccctcctcagttcatgagtatcatgataatggacagctcctggtttaaatcattgttttattccatcaccccaccactagcaacccccagttaagattagctatagaaacataacacaaagggtgactgaagcgccaggtctttcagtgtgtgaggccagcaagagtccaacagcccctcaatgtcccagctgactcttctgatgatatgctcagaaatgtctacagaagctgagcagctgccagctcaacacaccctgccacacctgcgctatcggtggaatcagagaatgagaaagctagaaagaagctttagagaactacgctggttgaaaccctcatattactgatgaggaccataaatcatttaactgaaattaaaccaacaaatcaaaccacacatacccacaaaatctttacatttgtgacaaactatattttctagaggtggccactccaatacagattccatcccacatgctctaacaatgtgataatgacactccttcattgacaggtgggtctctctgttctctcctcctgagcctgggtagacctttgtaactgtcttgaccaacagaatgtgacagaatgataccaggtgacttctaagactacatcatacaaagcaacacagcttctgctgggctctccctctctggacacgtgtctttgaagccctgagctgccagattaaacagtccggcttgcctaaagtcaccacgctggagagaccatcagggatggagaggtgctacagaaaccctagctattctagtccccagccatttgagtcttcctagcccagactcataagtgaagaaaccttcaagatgattccaatacctcctatcacttgactgcaacctcgtgaaagcctaagccagacctgcacggtggagccattcctaaattctggtcccacagaaactgtgaaagataataaatgatcatcattgctttacattgggctaatttttattatcaggggtaacgtgttacatagcgataggcaactaatacaagattcattactaaaaccactaaaaactttaacctgttagtcactattaatttaagcaaacaaataagcaatcttccaatgatgcttccccaatttgcatgcctctctataaccttactctgccttcattttaaggcctagctcttatcaccatatgtgatatgattagataacacgatataggctacgttactgaatatatgaggaaagggcctttgttttgttcactattatatccccagcacctagaacagcacttgacaacatatagcaggtgcttgacaaccactggttcagtacaagaatgtatctggagatgattgggcttagtgttcctccaaggctatttgacctctcatcacctgttctccagtttgactcaacgtctcttaatatatattcactgcactgttaagtttctaactctctaactactactgacaaaaccattagatgttcttcgttcaaacccactagaggaactacaccatcccctccgtgatgccagctcagcatccagagtagagccagtgatttcctttgtcaacacacctgcatgccaaaaacccttcccaggaggtctcaaatatcaaataaaagttactccatttttcattcaaagaccatgtgcccaatgggaaaatgacctcatgttgtggtttaaacagcaactgcacccactagcacagcccattgagctatcctatatatacatctctgtcagtgcccctctgggtctagataattacactgagtacactgaagtcctttcattattgcaggcccaacaaaaagtactgccactgggtgaatatcagaaagcatgcatcaatgcactttcaagtcaaatgagaactggctagttaagcagcagcattaacagatgtagagattgtgccagccaaatgcctcttgccaattatggccacacagctacgcccaaattaaaaataacccaacacggccaggtgcactggctcatgcctgtaatcccagcactttgggaggctgaggcaggcagatcacgaggtcaggagtttgagaccagcctggtcaacatggtgaaaccccaactctactaaaaatacaaaaattagccaggcgtggtggcgtgtgcctgtgatctcagctccttgggaggctgaggcaggagaattgcttgaacccgggagacagaggttgcaatgagctgagattgtgccactgcactccaacctgggcgacagagcgagactcaatctcaaataaataaataaaaaataaataaaataacccaacactcataacagaatccaaatgggcatgggaggctccttctctccctacaatatcaccctacagtcgctacataaatgcccctgtaaagtggctcctaagttatgtcattaaaatgttcacctttccttggcaaagtagatctcaacacaggaggaaagagaaataagctaaaaaaagaaatgtggattgtctagaagttacaagggaacaaaaaagtagaaatcctccgtgagaggattttgcaaaaactgtaattaaaggaatctagaccagtggttgcccgatagaaatataagccaaaaatgtaagttttactcttctagtaaccatactttaaaaagaaacaggtaaaattaatttaaatgttttatttaactaaaaagatcaaaaatattatcatttcaacatgtaatcaatataaaagttagtaatgaaatattttacattctttttcttcctgctcagtctttgaaatcagtgtgtattttacactgaccgtgcatctacacttgggccagcacattgcagatgctcaacagccacaagagaccagtggttaccacattggaaagcacaggtctagaataatcctaacttctttttttgtaaaatactgaaacatccaaagcactccaagttttctattagggaggcaaaataactatactgttagaatcatgggcaacgatatcataaattcctaaaataaaaccacatagggccgttatttcaaattacataaaacttgtcttctagaagaattcgaccaaatgccaaagttcttaagatctgccccacttcccaaacaagggaaactgaagacctcgaccagcaccagggccttccgtcagctcctgatacaggaggggctcctggattttgtttccccttcttgacaatacaacatgggactgggttcctcatttgactcggttcatttaaagaatgatctcaaagaagaaaggaaaatcaatgacccctttaggaaatgtagtccagggtgggggtggaggaagcatttcaatgacaaaagccaaacctcagtcataatgcagatccctgtctaacaggtgatcattgttttttttttctattacaggcactctggtctcccgcctaccccatgcaggatggctatccccatgcagaatggctgtgactttcaagagagtcccccaagggagggtcccaagatcaggggctggtaatgggccccaccacaaggctacgctgctggcttttgtttggaacaatagcgctcccatgatacctcactcttgctgacaatattggtaatacgggagcatgaacacagctgtgtgtaaattacacacacaaacagattagatctgtatatttataaggaatacaaacatactaatagctcatttacatacacagctggatacaatgggctgcatgcagaggggagtttgagttccaaagtatttctctaaaattttacaaaaagaaatgctcagattactgctaacccaggctgagacttctgctccccccacccccatgcagtatgtcccccgaaatagagtccttttcatcctcgtttgtgatatttgagatgctatgaaggagaaacctcaacaagtgctgttagatttcacttttattattatttattattatttttagagacagggtcttgctctgccacctaggctacagtggtatgatcacagttcactgtaacgtggagcttccgggctcaaatgatcctcctggctcggcctcccaagtaggtcagactacaggtatgtgtcagttaccatgcccagctaattttaaaaatatttttttgtagagacggggttctcactatgttgcccaggcttggtcttgaactcttgatttcaagcaatcctgctgcctcagcctcccaaagagttgggattatggcatgagccactgtgcccagccagatctcactcctgtaggaaaaaaatcaatataggataattttcagttaaaaagatgtatatacatacgaagagggagacctactaaaacatctgttacaacagcatatagtaaggcagaatctttgcattttcaaaatgttttcataaactttatttgttagagcaatttcaggttcacagcaaaacggaacagaaggtatagggatttcccatatagatgggtctctggatttttcagctaattttgaaaaatagggaaaagagcaatcagcattttgtgctcactacagtaaaccaggaacacaggcatcaggagagctgggctctgattcaaaggcctgattctagcaaggcctcacagtttacttccggctagccatgaacactctctgcgcctgaggttttcgtggaaagacagcatcacaagtactcaaatgtagcgtttaaaagtactaacttttaaaatgttgaatgttccagtaaaacagttaaagaaaaaaaaaggtaataatccaactaagtaaaaatattaacttatacatatctggatagatgataagctcattacaggccctaattttattatttaaaatgtttacaacaaaactctctaattgatattctccctctctctctctttttgccttgatatggtttctataaactcttggtttaaaaaagaaaaaaggtccatttctgaggcttgggtttactgtacttacagttccaccagtaaatcgtctcccagtctgggctggagaagcgctggccacggtttgattgctccagccccaggttgccaggcaacccacacaagggggaagtctgagaaccgctgacagatagccaagtggctgaaacaacagacttctctctgtcaaaaatgtgtttgagagagccacttgcccacctctgctctctgctaaacactacatgattgtaaaatcaaaatcaaaaggccactgtaataaaaacacacttcctgctcaattactaattgttctaaagctgtggggaggcccagatcctacagtgtatggcaacagaaatgcgatactgtaaatgagataaagccagcagcatgcaagaaacctgatctaaatgcatctccgtagcttcaagtcaggagagctggtgtgtggaggaatcaactgcctaagaaaacaccaggaagaaaataatgaatgtcaagatgttaaagaaacaaaccaatcaataactacgaagctagaggtcaagactacttagtaataaaaccaagaacattctccattgttttgaaacacaatctggaggcaatgaaagttttctccctcagatggaaaggaggagcaagaaaggtcaatgacccttgggaaccacaccccctggcggttccaggtggattccctgatacttgactgtaaatgggattacaggaaatagtagcatccttaggataatgcaggacaataacaggtctgagagtctaatgcaacatttaaaatacctatggtgtgagctgggcacagtggctcacgcctgtaatcccagcactttgggaggccgaggtgggtggatcacctgaggtcaaaagtttgagaccagcctggccaacacagtgaaaccccgtctacactaaaaatacaaaaaattagctgggcatggtggcaaacgcctgtaatcccagctactggggaggctgaggcaggagaattgcttcaacccgggaggcagaggttgcagtgagctgagatcgcgccattacactccagcctgggcaacaagagtgaaactccctctcaaacaaacaaaaacaaaatatctatggtgcatgtaccaagccagtaacattgtgcccaacaccaactctatgcagcatccttccatgaaaccactgtattgaaactgtcatcttggactctggaaactatttgtagtatgtggaaggggccagcactgagtgcacagttctttatctcttctgtgccatggaccctttggcagtctggtaaagcctgactccttctaaaaatggtttatggccaggcacggctcatgcctgtaatcctagcactttgggaggccgaggcaggcggacatgaggttaggagatcgagaccatcctggccaatatggtgaaaccctgtctctactaaaaatacaaacaattagctgggcgtggtggcgcatgcctgtaatcccagctactcaggaggctgaggcaggagaatcacttgaaccagggagtcagaggtcgcagtaagccgagatcatgccactgaactccagcctggcgacagagcgagactccacctaaaaaaaaaaaaaaaaaggctgggcacggtggctcctgtctgtaatcccagcactttgggaggccgaggctggcggatcacctaacgtcgagtttgagactagcctggccaacatggtgaaacctcgtctctactaaaaatacaaaaaaaaaaaaaaattagctgggcatggtggtacatgcctgtagtcccacctacttggggaggctgaggcaggagaatcgcttgaacccaggaggcggaagttgcagtgaaccaagaccatgccactgcactccagcctcggtgacagagggagactccatctcaaaaaaaaaaaatagaaagtatgccagagtaatataactgctctatgaacacactaaataacaagagctagcagagggttttctttagctcatgcaggttttttgtttttcgggggggtgggggggctgttttgctttattatgtgacctcagatgataaacccttggagggcaaggacagcaagtttttcatcattcaatttccagtgcaatatgcagcccggtttcctgccccaagctcctaagctagccctcgtcacaccactagcccagctcctatgggggcgtgggtttccttgactctcccagtgcccagaagtgggcctggcatataagatgtgtaagaccatagtccgcaaaatgggatgtatggacacaaaagacatttttttcctatgttctctttccaacaatccatcagcctgagaaggcacacgctcctgtgaggggatgcagcctctcttcttctatccccaccactgcccccctctcacttcacaaaggcagcctcctctcccccgctcccatctggaaggctaccaggcagcactgccccaggggcactgaacaaggggacaatttaaaacattgacactggtgctgacacagtgcctagctctgaggtcaggatgagaaagactccacaagtcagacattttctgattctctgctttcaacaaaacacaaggaggtcctagtggaagtgtcatctgatagattgcggaaagtcatatctgacgacaaattatacttttggcattattatggaaagaattcaaataactgagtgacactgtaacaaaactatcattcccatctacttactcacataaacaaggtttctgggcacttacgtgtttaaaaaaaccatacaatttatttccaataaatgttaagcaaaaatgaaaattatatcaacatttacattatttcgttgttttcatcaactgtgctctaataattataatttgaaaaaacatttcttctatacttaagagctttattattaaaggaaataaccatatgcccgatttcaatacacacactttttgttgcagggaagtactaaaggtcaatcggacactggactttcaaacataaaatgtatcatcttagtataaagtccctggggaagtagaatggaaataaaaattaaagggggaaaaggataagatgcaacattggactgcttttaaaaaatgaacttgtcgggcatggtggctcacacctgtaatcccatcactttgggaggcttaggtgggcagattacctgaggtcaggagttcaagaccagcctggccaccatggcgaaatcctgtctctactaaacatacaaaaattagccaggcatagtggcgcacgcctgtaatcccagctactcaggaggctgaagcagaattgctggaacctgggaagcagacgttgcacagtggaccaagatggtgccgccactgcagtccagcccaagtgacagagcaagactccatcttaaaaaaaaaaaaaaaaaaagcttattttaaaaatagatgatagttcttgctcctcctttcatcatgtgatgtgcctgctcctacttcgttttctaccataagtaaaagctccctgaggcctccccagaagccacacagacgccagcaccgtgcttgtacagcctgcagaattgtgggccaattaaacctcttttctttataaatcacccaatctctggtgtttctttatagcaatgcaagaatggcctaattcggaaaattggtgccaggagtagggtactgctataaagacacctgaaaatatggaagcagctttgcaacggggtaatggacagatgttagaagagtttgcagggctcagaagaagacaggaagatgagggaaagtttggaacttcttaaaagactggttaaatggttgtgaccaaaatactgacagtgatacggacagtgaagaccaggctgagaaggtctcagatggaaatgaggacattattgggcactggagcaaaagtcacccttgtgatgtcctagcaaaaaagatggctgtgttgtgtttctgccctaggtatctgttgaagtttgaatttgagagtgatgacctagggtatctggtggaagaaatctctaagcagcaaagtattcaagatgtgacctggctgcttctactagcttaactcaaatgtggggacaaagaaatgacttgaagttggaatttatacttaaaagggaagcagagcaaagaagtttggaacatttgcaccctggcaatgtggcaaagaaagaaaagcttttggttgggcgtggtggctcacgcctgtaatcccagcactttgagaggccgcggcgggtggatcatgaggtcaggagttcaagaccagcctggccaacatggtgaaaccccatctctactaaagatacaaaaaattagcccggcatgatggcacacacctgtaatcccagctacctgggaggctgaggcaggaggatcacctgaacccaagaggcagaggttgcagtgagcacctctgcactctagcctgagtgacaggtgagactcagtctcaaaaaaagaaaaaaaaaaaaaaaaaaaagaaagaaaagctttctcaggagagaaattcaggcaggctgtaaagcaatcacttgctagagatatttgtgtaactaaaagggagccaagcgctgatatccaagacaatgagggaaaggccttaaaggaatttcaaagaccttcccagcagcccctcccatcataggatgagaaacctaagaggaaagaatagttttcagggccaggcatggggttttgctgccctctgcagctttgggacactgcttcccacatgcccctgtgactacatccttggctcaaagggcctctgatacagctcaggctgctgcttcagagggtacaagccataggctgtggcagcttccaggtggtgttaagtctgcaggtgtacagagtgcaagagtgatggaggcttggcagcctctgccaagatttcagaggatgtatcaggtgcccaggccagaagcctgctgcagagatggagccctcacacagatactctactagggcagtgtagaggggaaatgtggggttggagggcccacacagagtccccactggggcaccacctagtggagctgtgggaaggggccattgtcttccagacccaagaatggtagatccatcagcagcttgcactgtatgcctggaaaagctgcaggcattcaactccaatttgctgaaccctgcaaagccacagaagtggaagtgcccaagaccttgggagcctgcccctcatcagtttgcccaggctgtggcaaatggagtcaagggctattttggagctttaagatttaatgattgccctgctgggtttaggacttgcattgggctcaatgcctctttcttttgactgatttctaccttttggaatgggaatgtttatccaatgcctatacccgcattgtatcttggaagtaaataacttgtttttgattttacaggctcataggtggaagggacttgccttgtctcagataagacttaggacttttgagtttatactggaatgaggtaagactttgggggactatcgataacggataatttgtaatgtgagaaggacatgtggtttgcgggaagccaggaatggaattatataatttgaatatttgtctcctcccaaatttcatgttgaaatgtaatccccaatgtcggagatggggcctggtggaaggttactggatcacgtgggtggatttctcatgaatggtttaagcaccatcctctgggtgctgtgcttgcaatagtgagtgagttcttgcaagatctggttgtttaaaagtgtgtagcagccccacccccttgctccttcttccaccatgtgatgtggtgttcccgcttcagcttccgccataagtaaaagctccctgaggcctccccaggaagtgcgtagatgttggtgtcatgcttgtacagcctatagaactgtgcgccaattaaacctcttttctttatttaaaaaaaaaaaaaaagataatgggtataaatcactatggtatttaaaattcacttgtaatatttaaaagagtgaggggacaattttatttttaaatgtcaatgtttgtaattttggaagttacatccttatcataaaaaaagtcaatttaaatttgggagtgggtatgcgctttcaggcaaaattcttttaggggcttcatagggataaaatatttttcttagctttgtatctacctaaaggaagacccagaaattctttggggtaccaagcatgcttccacatctcagctatatttagtctggttttacctaacagaaacaaactagggtcactgaaaacactttcttgaaccaagacaggttgcaccatggaagatcttgccgtatgtaactgctgttccaccaaggtacagacttttcttcactggaattccaaagctgactatagctctgttcaaggacagtaaaaagcacaaattcttcagtgtgccaattaaagtgcttggcaccttccattctgtcacttcagcctggactctcacatacccacaccacacccaagcatctggactcttttttacttattttatttttcagccatcatctacacatgtagatgggccagccccaacacccagtggttgaagacaataatcttcataagcaggaaattacagaggtgatcttggttctgaaccaactgcagaagaagacagatagacaatcgtctccatcagcaaccacctgcggcaggaaccccacctttttttttttatgttcggggatacatgggcagaacgtgcaggtttgttacatagtttacacgtaccatggtggtttgctgcacccatcaacccatcatctacattaggtatttttcctaatgctatccctcccctacccgcccccaccccccaacaggccctggtgtgtgatgttcccctccctgtgtccatgtgttctcactgttcaactcccacttacgagtgagaacatgtggtgtttggttttctgtccttgtgttagttttcacagtgtcgacggtctttacaatttggcatgtttttgcagtggctggcgcctgttgttcctttccatgtttagtgcttccttcaggagctcttgtaaggcaggcctagtggtgacaaaatctctcagcatttgcttgtctgtaaaggattttatttctctttcgcttatgaagcttagtttggctggatatgaaattctgggttgaaaattcttttaagaatgttgaatattggcccccacggtcttctggcttgtagggtttctgcagagatccgctgatagtctgatatgggcttccctttgtgggtaacccgacctttctctctggctgccctaaacattttttctttcatttcaaccttggtgaatctgaagattacgtgtcttggggttactcttctcatctgatatgggcttccctttgtgggtaacctgacctttctctctggctgcccttaacattttttctttcatttcaaccttggtgaatctgaagattatgtgtcttggggttgctcttctcgaggagtatctttgtggtggtctctgtatttcctgaatttgaatgctggcctgtcttgctaagttggggaaattctcctggttaatatcccgaagagtgttttccaacttggttccattctctgtgtcactttcaggcacaccaatcaaacgtaggtttggtcttttcatagtcccatatttcttggaggctttgttcatttcttttcttttcttttttttagagtctcgctctgtcacccaggctggagtgctgtggcgccatctcggctcactgcaagctccgcctccgggttcacgccattctcctgcctcagcctcccgagtagctgggactacaggcgcccactgccacaccgggctaattttttttttttgtatttttagtagagacggggtttcaccatgttaggcaggatggtctcaatctcctgacctcgtgatccgcccgcctcggcctcccaaagtgctgggattataggcgtgagccactgtgccgggcctgttcatttcttttcgttcttttttctctaatcttgtcttcacgctttacttcattaagctgatcttcaatctctgataccctttcttctgcttgatcaattcggctattgatacttgtgtatgcttcacaaagttctcctgctgttttttttttcagctccatcagatcatttatgttcttctctaaactggttattctagttagcagttcctctaaccttttttcaaggttcttagcttcctcgcattgggttagaacatgctcctttagctcggaggagtttgttattacccactttctgaagcctacttctgtcaatttgtcaaactcattctccatccagttttgttcccttgctggcaaggagctgtactcctttgaaggagaagaggcgttctggtttttggaattttcagactttttgccttgttttttcctcatcttcgtggatgtgtctacctttggtctttgatgttggtgaccttcagatggggtttctgtgtggacatcctttgtgttgatgttgatggtattcctttctgtttattagttttccttctaacagtcaggcccctctgctgcaggtctgctggagttttctggaggtccacttcagaacctgtttgcctgggtatcaccagcagaggctgcagaacagcaaaggttgctgcctgaggaaccccacttttatgcagaggtaaaatctaccaagcatgtggattctgaggtttcgtttcagctccagtggaggctgtgctgtgttgaccgtgtatgcaatggacacagaagaatgagtgtgcggcacttgcctgcgtctgccaccccacctccagatccaactcgagccaggctctgcctgcttctccgaatacatcctgcactctctgtgtctcctcacagggtagttctgctgtctggggagccgatattgggtgtgatgatctgacttggattcctgagtactccactcaccactgctgcggctctgaacaaattcccttactatctcatgcctatgtcatgtcgtgctcctctgtgtttccatctttctgtgtgccccatggaacttccccattctgcccagcactatgttctgggcatccaagtccaccactgccattagaacatcatcttcttgaggtggggagttcctgtccagggccacctggaggcctctgcacacgacaggcatttaataaatgtttcttcgatgacgtttcctattatcagtatctgggcctttcagagccagaaggggactatttaattattattactctcatttcttagtgagaggaccaatgactctcccaaggtacagcaactggtccaaggcacagactcaaccagaaagcaggtttaccaacacttttgtcttctcagcataaatattctaaagaaaataattactattgggtgcattttccacagatagatgaagagttatctgaaaaaagtagaagtgagggaagggaataaaaagggggaaaaaaaaaggccaggcgcagtggctcacgcctgtaatcccagtactttgggaggccgaggcgggtggatcacgaagtcaggagttggagaccagcctggccaacatggtgaaactccatctctactaaaaacataaaaattagctgggcatggtggctaataggaaacgtcattgaagaaacatttattaaatgcctgccgtgtgcagaggcctccagatggccctggcgcacatctgtaatcccagctacttgggaggctgaggcagtagaatctcttgaacccgggaggcgcaggttgcactgagccgagatcacgccactgcactccagcctcggtgacagagcaagactccatctcaaacaatcaatcaaacaaacaaacaaataaacaaacaaaaaaaaaaaaggaagaagaaccagaatttcttgtttttgaaaaatcaaactgaagaatgactggacacgatgtcagcaccactcacacaggaaacctcacgcatgaaacctcacacaacagcactgcagctctttcgcttggttaacttggggacagccctgagacatgagatcggcctttacagccttcttcccaggctggtggaagatcaggctgctctgaatccaggccggctggaattggcggggcctctcaacacagtcaagaatggctaacggcaggcagaaacattttgtggcctaataaaggatcaaagaaatgttccttacaaagaggaaatgaattatccacacatcaagctccttcatgtcttctgtttgtttgttttaggccctccagcctgtttggataaaacatgttacactgagaaagcatcaaagaaaacgaaacaacagtgacatttaaagggaactccgccggctagacagagccccattttgggttcagctccaacttctccctgttctgtctctcctggccatggggagtattcacccacagctgacataagattatcagcaaaggttttaacaagaaccagacctttctcttctaatctttcccccaatccaaaatgtcatgaaaaaacttcaaagaatcttgttagaatttaaaaatattctactattgtgtaactcatgctgaaaaatgcacatctaggtatgaaaaacgcacagattgctctgtcaaagaccactacgtgactgcacttccatagcagagatcccatctttcctttcagctaaatttaatctgttctaaactctgaaagttattgagtcctaaagacatttatttagcaggtcctaacaatgagcagtttataggcaattgtgaaacatgaccacaaagattattggatgggggtcagtaatttgaattgctagaaaaatatagatcactcttgactgacatgaatgatcagtggtatcatttacccagaattactcaagagagaatagtaacatggaatgagaagctgcttctaccctgaaggagtcacttttatagctatacaacttctaccctactcagtctgtgtgtggcaaaactagtttatcctcctcatggcatctacctgaattcatcttatttaagttaatttgcttatttgtctgtggtccctattagaatgcaaatcccatgagaacagtacctccacggttatttctattcccagagttgagaaggtgcctcgtacacagtcagtactcattgttgagtgactgaggagacaaacagcaggaatatattctacagccaacacttgaatctgcgatcttagtctacatagtcttccattcacaaaactctatcttctcgtacctttcctccaccttcaacctctccatgttaatgcacttcggctccatttaccagttaacgatttagtgatcccactgagaagccaggagctccaacagccaccgagaagcacagcacccagcagagctgcgtgtggaggcaacgctcacctccctctccatgggacctaaatgaccagcatagcacacgcttccttccttcccagcccttcctgtattcccagcccagtccagactagacgtccttctgaccagaagctcaccttagcaaatcccaactgatgcctcgcacgacgtcccctagagacctactgtcctctcacacgcagttctccaaaaggcctcataccccaacccccgagccctgctgcagctttctcactttcagatccacacagaatcccttttaacccctccagttatagggccagaagttgttttgtcaacagtagcaatcctgtctcaccgtctcatcaaccatgcccatccgggttcccccatcacagtgtcaaccacttgccaaacccatctccttcttatcctgtgaccagcaccaaagtctcttcctagctagctaagtctcttcctccatcctacctttcgacagcactctcaggaacgtggaaaaggttgcccacggcccttctaatagtctgtgtctaccattcttggtgctctttattccagcctagccatctaccggtagccatacctaagatgtgaaactacagattttccctatttactgcacagctaccatgacccccacaacatccctcttcttgactgtgtccctcaactcctctaccacttctgtactggttccccatgttctctatgcagcctggggcttaactatccattatgtcaacaatgcagtcaatactcactacctcagctgggcgcggtggctcacacctgtaatcccagcactttgggaggctgaggcgggtggatcacttgaggtcaggagttggagactagcctggccaacatggcgaaaccccgtctctactaaaaatacaaaaattagctggggtgtggtggcacatgcctataatcccagctactcaggaagctgaggcaggagaacagcttgaacccggaaggcagaggttgcagtgagctgagattgtgccactgcactgcggcctgggtgacagagcaaaattccatctcaaaaaagaacaaaaaaaatactccttgcctcaacatcccgacctcccaccaattttctagcccaatcttccacccactttggctgcatattagtgtcctaacatcctgggacactggaaacttgtaccccagatgaattaaattggacccaagtttctgctctgtgtgtctgaagttcctcatgtgactccagcgtgctaatagtgtgaagtgctgctgtacaccgacagctctcaacgtctctcactaggggcatagtcctgatccagtccagtagttctcagggcctggatgcccatgtcccaccctagggattctgctctgacttgctggggtacaggccagcattggggcattttcaagttctcccgatgactctaacgcacagccaagtttacaagacgtcctcagcccacctccactcttccaatgctactgccagactggtcttcaagggcagctccagtcctatccttccccacacattcaaaaatatataatttttcctcgtttcctgttgaattaaacataaacttctcagtcaaaagtggaaggctctgaattagctacctcacatcctcccccacccataagcttcatccaaactgggcaacaacttgctactaaccaaccactcaaattcttttagcccttgttctccaattaactaacctctgtcaactctgcccggtgaaatcctatccatccttcaaggtcctctcaaataagcctcctctacagcacccttcctgatctccctgtccaagagcagggagcaagctgctcacctcagcaggccctgtgagccccagaacaccatctgaagcaaaagaggcactcaaaacaaattttcaattgtgtggctgctgtcccctctctagattctgtggtgataaatccaactcaagcactcatttacacccactacccaaatcagtcaaggataccacagtgggatggcatgtcacctgccatactgccaagcagttaccaaggttggtggtaactcctgcagagatcttagcagtgaaagaacaaatgctgtttgtttaaagtcactgatacgctcccttccttttgtacacagaaatcaataatgttttttctaagtcttgtttccaaaaaactaagccaaataaaaaaaaagtcacttgaataatagaagaacaaactaacaatgataggaacagaagattcaactagaggaagaattatgagagcaaacagtggatacaacggtctcaaacatccagcagagccctgcacacaagagtaggaatggaaacgcagtagaattaaattcagtataagatgaaaaataaagaccttcctttttccatgtatatttttaaggtaaatttaattatccagaaacagacaaaaatgtttgctcttcaccttcaagaatccaccaccccttttgtgaagatactcaggctcagtagagtgcacccgtacacatgcccatcttcgtaacggaatgcctgagtgcctaagatgttcaaaccagtggagagtagcatggcgtgatgctcatggactcctctaaatgtgtgagcaaccggattacacatctcagagtgtggcctaaaagcaagataaatctacgtggatcatttgaatgttttacagatatttaaaaagagagggagagagaggaagggaatgtgagctgattatgaagtcagagaatttaatgagggagacaagctaccaaggtcagattgctctggggtcataaacttggaaagtgactatgaagctgacaaagaagttgggttgtctcaaaggacgatctgaaaataattttctacttttgttattgctaaaggactggagaatttcatttccatggactgaactgagcagtaggatcccaaaaatccagagcccaccccactctttaagctgctctgagaattggaacagctctgcctgatgaaatcaagacttcaacgtgggagagatcaccacagatcaaagctccaggtcttctctaggcaaagctcctttatttcttagattaatgttaggtgggtttttggtcgaggtcaaccagtttcccaaacctttgcttatcaagatctccttaggccgggcatggcggctcacacctgtaatcccagcactctaggaggccaaggtgggcagatcatttgaggttaggagttcaagaccagcctggctaacatggtgaaaccctgtctctactaaaaatacaaaaattagccgggtgtggtgacacacacctgtagtcccagctactggggaggctgaagtgggaggatcacttgaacccgggaggcagaggttgcagtgagctgagatcacaccattgcactggtccagcctgggcaacagagcaagactctgtctcaaaaaaaaatttttttttaattcattttctaaaattctcttttaaaattggataaccaagcttacttagctctgtcaccctaattaattagaggccctatctgaaaaaagaaaatgagtaatatttaggatgaacatgtctgtttggaaaacagtttattagcaaatgtgtgacacctccacagattttaatattaaacagtggctcccagagaagactccaagctgctgttgaggggagcacaagggacagaagagcacagagcatggctgcagtgatgggccatccttcctcccactctggtggagtctatggtactcattagcctgcatctctgtagcctaggagatttggtttcattactgtcaatggcaaagcttagaaaaataaaagtatgatcaaaacttacaaatcagcttcaagggagatcccagaactttcagtaacaaaaggacactgtgtgtgtgtgtacgcacacatgcatgtgtacacgtgtgttttcaaatttcttaaacaggaatgactctgttagctttagataaatcatgtggccaatttttcacctgggaagtgaaaggatggggcaggcagcagaccaagatgggcttaatcctgacctcctgtcaaacacagctgccagcacctcagaattttccccttccctttccttctccttttcctataattttttagattaaaaaaaaaaacttaagacttgctgggtgtggtggctcacgcctgtaatgccagcactttgggaggccgaggcaggtggatcacaaggtcagaagttcgagaccagcctggccaacatggtgaaacctcatctctactaaaaatacaaaaattggctgggcgtggtggtgtgaggatgtaatcccagctacttggaaggctggggcgggaggatcgcttgaacctgggaggtggaggttgcagtgagccaagatcgcaccactgtactccagcctgggcgacagggtaagactctgtttcaaacaaacaaacaaacaaacaacaaaaaaaaacccccacaaaactgaagactcaagaaggggagtggggagatcatactttcttgaggccacacaggtggcagccaatctgagtactgatacccacacctctgactctcaggccagttttctctccacaaaccaccaggcctgtttttcctgcttctgcccaccaacccaccccaaaaatgagttttccatataggaaagagaagagcctggcttatcttcttcaggaggtaactgtgccttccccagagagctcaggtgccaggacgtcagcagccctcagacagcagagccaggagggacacggggcagtggtgacgaagctgttcagggcaactctgggcatcctcctattttcagaataacaatcttcctggtgttcttagcagcatgattcctttttttattattattttttattttttagagacagggtatcgctctgtcacccaggctggagtgcagtggcgagatcacaagggagcacgattcctgaactgggggaacagtgctgagttgtatgggaaggtgtgttagaacagccagattcacctgtgctgcccactgagctctttccttctccatcactcattctcccataatagaacatctcaaccacacgtatcatcagtacacatcaggtgatgttggcaatgaacgagtttttttaattggaatttagaaaataaaaccacaaactggaaggagttggttgctccttccaaagcaagctactgagaggaaaagaacagggacacatccagttaattaattctccctagacggtggcagctcaagagctcagccaaagaggtcactgcactgaagcaatgtgaggtttctcttctgttccacccactcaaatgatattttcttattatcaatcctgctccaggtgctgggccaggttctgtgaatacaaaaagaattaaactacaaccctgccctcaagacttcctagttttgtgtggaggcacctaaatgaacttgtcaaaccaacctggtgcagcagggcctgcaaaatgcagtgacgtcccggccttcatcagtcatgggccactcctcattctaaagtgcctcgtgagcaccctaacctctcagaagaacgagtgttggggaaagaagaatatcagaacactactagggaacattaagcttggcccagcattctagttagtcagtgcacgtagcatccatcctccagacattaagaataatcaccacaggcctagagcaagcaaatgccggccgacaagggaagctggcctcttctgtcaaacagcagtattagagggactctcccctgagctgagtctcaaagccagggtatttgactcaagaaaggaagatttttgagatgactcttttcattaggtgttataattcagagcatgacatctacagttttaagttttccacagtgttcacttcctgaattaaaatttgtcaggacaggctgataacaagagtaatgactgctccaagatagaggtagagcaggtacacttttctttccaggtattttcttgctcctactcaggaaaaacagctcctctcacaaatgctgaatttatagtaaacttatgtagtaaatattgtctaaaccagttacaaaacaaaaacgcttcaatcttgacacaatgagcagctgcagaagtcagaggaatgcatgactcagagtcctacataactgaagccgtaaaaacactgttatgagagatacaatgttaggagaaaacagaacagccctcaagaattcctcattaatttgataatgtaatttaactgtgaggtacaaaataggagtgaacatctctggtctaagatcctggtggccttccgacttcatcttctccatccactccggggcatctttgctcttcctggaacacactcaggcatgctcccacctcagggcctttgcactgtttccttggcccagaattctcttcccctatgtatctgcaaggctagcttcctcactttttaaggtctttactcaaaagtgaactctccatggctaccttaagaaaaagttcaacccctctacctggtatttcctatcactttcctgcttttaattttttcaggactaacacactatacatgtcacttagcaagactgttttaatctatcctccttccccactacaatctcaactccatgaaggcagagaattttgtctgttttgttcactgctgtatcacctggcagagtgtcaatgctctaccaatatttccagaatgaaagaatgaatgaatttcaactagtgagctaaaatcagaactgaatgagaaacttggtaagtaggaaggaatcattctatcttcatgttcacacagtcaacaatcacaggaagagccaaaccgacaccaaactcctctgcaaggaatgcagagccagacagacagatcctgaggccccatgctcaggtggtgaggccaatatcaggcactgtctttctccccttataaccaccaaacacatgctgcttcctgatagctcagtactttgcctcataaatgtggaaaacacactagaattcacctatataaaggtacttcggaaaaatgtcttaaggcaagtgcaaaaacaaaatcaaatctaagtgtcaattagttgcatgcagggtgttaggaaaagaataacaaaacactactagagaagatacaaaataggctggcactctagtgaagatggcaattagggggctaccaaggccatcactacttctacctaagggagacttacttacttactttatatatttatttatttatttttttgagacagagtcttgctctgtcacccagactggagtgcagtggcacaatcttggctcaatgcatcctctgcttcctggggaggtgattctcctgcctcagccttccatgtagctgagattacaagcacgcaccaccacgcccagctaatttttgtatttttagtagagacggtgtttcgctatgttggccaggctggtcctgaactcctgacctcacttgatctccctgcctccgcctcccaaagtgctgggattacaagcatgagcctctgcgcctagcctaagggagactttagatttaagacagaagtatgccaggagagaggaggtagctttaaatgaatgacttcctctcatggtagggttctcatttttcacttcctgtttccttctcccaacattcaattccagttaccaatgtaatatgtctcacctgtgaaaatgtaagactccaatgtcactatacgtagaatgttctaagcacacgcattaaaactgactccaattctgttgctaagaaactgcacaagaaaagggttttccatcctcttcgtttataaaataaccactgtctatgggagaacaaatgcaatctctcaagtccccttgtgccttgttctcattttttaaatgaacagagaaagatgatagagagtggctgaaagtgtatgctatctccatttttttacatgcccttgaaaatgagatggaaacatggcttcaataacccactgctctagtatttattaatctttcaagctgaagactccccccattactccccttactccccgctcaagcaaaaatgaaaaatataccgtcaaaagtactcttcgatttaaaaagattatcccaagcagccaggagtaatttaaggtgtgcttatattcaatgtggggttactttccaggtctctgtatagccctgatgtctaaacacagacgtgtgcgcatgcgcgcacacacacatatacatacacacacacggccctaaagaacagcacaaggtatgctggcttttatttttttaatctaaaagtagggctggggatgatggacttaaaaaaagtaccggttaaagacactaagaaaagaataatcttgttaaacacaaagagcaaaatgggcatactaacttctttgaccacagcataaagaggaagcctagaaagtagtgagccgtggatgtgaatggaaaggtcacagctgaatctgtacatttatcccagaggcgacttctactgacatgaactactgaaatacatttttgaaatatctcttcccttctaataaaatgcttgtcctatttcatttactaaagggttttaaaaatacatttctctttagagcttgttaaacagtagaatctttctgcaaactaattgacagaactgactgccttacaccaacttttctgtgcatataattgatttttaatttgctgtctcatttccgaaaggacttgacaataaactccattctatccatactattgacttctttaagcaagggtttggttcaaaggccgatgggaattaaccataggaaaaatagtccaattttattaatagttggaacttcaggcaaatctcacttgaatctacatttttcttttttaatattaagggctaattctcactataggtcacattaagaatacataatatggagtaatatgtacatacgtgtaatatatcaacatttctatttctcttatttttcctactctcatatatacaaatttagttcttcataagaaacagtaccactgtcatttaaaactggaggaagggtggttagtagagaggagaatctactgtgattcaatttaaaatgtactaagtacctactatgtgatgcagtagatacattgtatctatattttgggttaatggcaaaggttccaaatgaattgtaaaaattttcaagttataatttctttagaaagataatttcaatgttctgactcaactcacatgtatgcaaacctgtacacatacgtaagttgacaatgacataaaaccacgtacgtacataaacaaagaccagaagagagcaagaagccagcaaatgagacgatgaagccagacactgtgagacgacgtgttagtggtgaggttttaaattccctttaatgattttaggatgttgttctaacaataaaaaaaacaatctgcacaaaaccctaaaaagaataagaaagtgaaaaggttcgtactagatgacctacaagactctcctatcatcatttttgaatgactacataaaatggtcaacaactctggaaattttaccattcctaaaataaatataactaacccttcccctatattgtggatgtaaaattttaaaacaaaatcaccaagattattagtatctgaaatccacgtaaccataactacaagctctgagagcctctctccctctttgtcattgtcctccttgctgttttcacctccacaacctcctgctgctattggatcttaacggggattttgctgtgaattccattttcctcagctgccatgcaaacagtaaataaaattcattgtatttttgccccactaagcagccccgtcttctggcacattcagatgcctagcttgaaaagagtgaacaatgaaaacaatgttttctcaagcagacattccaaaaagggcataacaaaggcatctggagatgctgctggggaaagacaccctgcaaatagttgtgtgtattctgtgtaagtaattccttgaccggccgcacgggttcactggattacaaatatttagaaaattactttgccatctcatgtcaattttgaaagaaggattttcatttatatttatgatagactgagctttaaattgaaggaagatttagatgttttaaaatttatgagcttgtaaataaatccatgtacatggccaattaaggtttatcactaccacagattaactatttttggataaaaatttcagagcttatttgtatctagattgttcacctcaatgtattacatcaaaattgatataaaatatttaatgggtagtgtatttcaagataaaagctatagttacccaagatgaaataaaaacaccctgtagtaacatggtaagcaacagaaccttcactttgtgcaacacctggattgttgcggaaagcgaattcaacatgaaaataattttaaaaaccaaaacgcagctaagtggataggaagcaaagagtgagatgcacagctcactggagcacccaatcttacaatcttgcaagtcaaaccaaactccacaaggaaaatgcaggccctgaattttaaaaagaattcaattagcatccccagtatttccataatcaacagctgaatgctaattaagagcacagcatcaagcggcaacggaatcccagtgcaataagcaccaacacaacagcagcaaatgctaccttcagctcgcatgcataaataaacagaattaataaccacccaagcatggaagggtgacttaatctgtttcgattaggtgcagttcagcctggggcctttatgttatatttgaatgtgttcatcatgtttaattaaaaacctaataatctaagatttgttttgtttgggtttttttttttaatgttttaatctctatttcctcctctttatcttcctaagttctaccaatctggatgacttcctgaaaaggaacagtatttttagcataatatatgtgaaattgattaaccatcaatgtaactctcagaggcagaaggcagccatttactttggctccacccttacccataccttggtatttaaagcttcacaaactgacctagcatttcttccaaaatgcttctctgatcaaaccaagtttacttagcctgaaagacatgacccaggtgttgctcacagacactcggcaaaagcaaaattaatttgcagtatccggtacagaatttgacagaaactggcacattttggcttcagttcaagatttgaagtgtctcagccccaaagcaacttcaattaggaacatcatacacgcacactgtcagagaaataaactgagagtttgagatgaaaggcctcctattgtgtgattctgaggtctaagatctccagaattcatgattatctgaaagacctaggaaaaagaggtcaggtgataggaggaggaggaagaggagaaggaggagtaggaagaacaagaagaaagagtttaatgtgtgagctttttccaaaagtacttttattattattattttttttggagacagagtcttgctctgttgcccaggctggagtgcagtgccatgatcacggctcactgcagcctctaacccctggactcaagcgattctccaacctcagcctcccaagtaactgggactacaggcacatggcaccatgttcagctattttattatgtttttaatttttttgtggagacaaggtcttgctgtgttgaccaggctccaaaagtaaaatttttaaggttggtttctgaggcatgtaaaagtttttctctttaatgtgctgattcataactattaactattaaaagttttaaaatgctggattgaagacactcaattatagtgaagaactttttaaaaggattaccttgaacaaagagtcatcaatattcttcaagcctctcatatggagagaaactatcttcatcattaagtccttacccttaataagtttacaaactcggaggacaatcaactcagaaataagaccgcaaggaatgaagagctggggatcagaagtcagcacgaggaggcagaggatgaactgccaagcgagtgacgcgcagaggggagacagtgcgaagagggagcactggccgcgggatgggccaggaaccgagctgagactggagaacgagtagggtctgcactggcatgagaggttagtttcttcatagagcagcaggcctgccaggcccaggaggtgcagaggcccagcctgtccgctgcacagcagggaactcacaccttcaggtgcttatttcaccaaccctctcacagagcagctgcttcaaagtattcatgtaaaaatgccaagggaaacccgttcatcaagactgttgtagtcagatcagacactgggtagttagaacaaattaatatgccagcggcagcgaagtttagtaataagtagccaggcattgtggcttgcctgtagtcccagctgctcagaggctgatgtgggaggatcacttgagcccaacagtttgagtccagcctggacaacatagcaagacccccatctcttaaaaaatagtaatgataataataaaaataataattagaatgttccaagtatatagaaaactgggaggaaaaaagggggaggtaggcccatgtatttatgttagctggaacacatttgttttgcttattcctgtgattcctgaggtgagaaaatgtggtaaatttaacagaagggggccacatgaacacagcaggtgttttttcacagccaaagccaggcgagggtaaagaggggactgccttgttgccacataaatctcttcaaagatttgatttggatccattcaccagaagcttccttcaacctctcaattattcagtcagtctctcttcttcactgctgaggttttcaaagtgaagcttcacttcctacacataagggaaccatttgatcctgaggctctacaagggctggatggctgccaagacatttttcaaaccaagaagcaaacatgataaaaatgaccccaaacggatacggatgtatacagttaaggatcattattccatactcaaaatattcaccactttggagtcctgttttgtttttcaaaataaaccaggctctttctgatgtgcaaaacttccctctcagctcacagcgacaaatcctcaagcagcagcaatggggagacaatcaacagctgcctgatgttacaagcaggcgctgcaggaaaaggaaagcagctttctcttcagcaggaagagaggactttggctgtgtatttttaaaattccagagggaatgaaaggtcacaagagaaatgaaagaagggagagaggagagccatggctagcgaggggctgggaggcatgagtgaggagtggggagggtgggagacaccaagaagaggcagggaagtggggaaggagagaggacgccaaagggcatggagactgaagagagaggagatggccaggaactgagggaaatgcagaagcagaagcagccatggattgcaagctgacaaggccctgaggccgcctaggccaggctgagaggactgaagacaatctcacaaagggtggttaaacgaccacagtctatacacttgttccatccttttcatctccttatgtgtttcttccacacaggcttttcgcagaattttaaaaccttgtcaatcagatctcttatccactcctcacataaacaggcttacagtaaaaaaacagtatcactacgacttctcaaaactgaatttaacgttgtctaaacattttaaaatgtttaagatgtttctttctctttaataataacgttaagatttttatggttttgtttgttttaaaacagcttcatgaactctgtaagtctgataaagttaaagtcttaaggaactattcaacaagcactccattaccaaaccctagggccatttcagtgcatctcagctccgcctagcttttcccattcctcagcccttgcccaccctcacccacagccattctaggagcaaattctcttttctctaccttcaaggtgcagcctggatctcgctgcttcttatcacgaccactgctgccacaccacccagccaccagtcccagcctggtgtgcagcaacccccagagaccaccggactcagcggccagtgtgagccccactgtcggagcaagtcactcctctgttcagaagctgctcatgtggggcacatcaccatgccctgacagcaggccaacaggtcacacctgatctgctccctctagggcacccctcccaccactcccctccttgctgtgttgcagaaacattcctgcctacttcttgaacatgccaagcatgctttcaccttagggcccagaattctctaatatccaaaaggctgccttcctcaccttactaaggtctcatctaaatgttacttaccaggactttcctgatcctcccttagctaagacagtaccccacccagctgattctccctcattaccctattctgtatctgcttcaccacccccggcacatactcatttatgaaggtctcccctcttaaaacttaagactcccaaggagggacaacacctggcacgcaagcaggcactcagtaaatattgctgaatcaatgaaagagcgggatcaggaaagcacatacaatttctaaacattctttcttagcatattttaaaatacaggagaggaacttgcaatcaataggtgtattagtgccagccttcatttaaatttcattcgacctgaaaggcaaatgtcaagcggtaacattcatactgaagactgtatttgcaaaagcacaagaaatccgtaagtcgtttacagcaatgccttttacaagtcacaagatggagatgtagcttcattaaaactgtctgctggatgggaatccatgggtttgcaaggctgtatctgtgggcacatttctctccccccacttccttcaacaggccacagcaatacaatcagtatgtaaaatccagcatatttatttcatcaactctctgcttcccgcttgtaatcaatgtcctttaaggaggtcaggggtcttacaagccctataaaaacaagtcaccaagccaagcatggtagagcatgcctacagtcccagctacttaagaagctggggcaagaggactgatggagcccaggagttcaaaaccagcctgagcaacacggcaaaacccccttctctaaaataattatgattaaaaaaaagacaagtcaccaaccctactttaggttatatgtccacgggttttaacatgctgtctttaaatagggaggtatcacaagctagcttgcaccaaaaacaagttcaaattaactttttttaggagtaactatcaatttctcctttctttccatgaaagttggacaatctttcccgacatctatgaagcctaatcttaataaaatcaagtctttctgtacaattaaggggctgaagggccccatcctcctgcctggcgctgccacggacagccattctgcatgactgaagcttctgctttccctgagcagcagggaggtcacacactgagacgccggtggcccgatgccccagagcacaaggcaaatgctggttcctgctcaccacttcgtcctcggtccagcacttctcgatgagcttgggcacaggcttcttcaccaggcgctgcagggctttgccagcatcgtaaccgctttcatgcagctaaaacaacaacaattatagttagctaactgcaccaaataacagacaggacacaatcgatccaaggcaagctcctcattgactatctcccacagaagagtcaggaaaggggcactgagactccatcatttcagtaggcgcaggaatttgttctcatccaagaccaccctatcccaacccctattctactcactctgggagagggaggcaggcaaggcagaaaatattttggcaaagataggaataggattcccctatattcccataaagcaaacatttagggaatgtttggccccgcccagtgctcaggacattccatgcaatcattatcttacttaatcctatggggaaagtattctctcatttaatctacggtttaggagctatcatcgccctacttcacagatgaggaaactgaggcacagaaagatcaagtaaagatgttcaccacactgagccagcaggtggtgaagccaagactccaacccagccaggaggacccctactcttgcctcattctccgcaaagcagcgtaaagtcacactagattatgttctttctttttagcatttcttaagttttttgactgtgctaatttcacacaaaaacaaaatatttaaagtggctaaaatttaagagctttttaaagaaagtaagtctgtaatagtatgctagtttttcagtacatatgaataaagatgcaggtttatctacatattccctttaggaccagacttgtttcttgtcaaagctaatcaacttttctcaccctgcgtcttttcaaccctgtgtagtgtctggcaccatggacaccttcccacctcgcaaagatgctccagacactccaagtttctgagttccaacttgcagataatgtagagaaacagcaggtacaaagatcctcctgctctatctacctccccatactgtggctgtcactcagaattctcattggaaatccacctttcctgtacacatctagtcttcttacacaaagattggctttgtctaagacttgcatctccagtgctgaacacagtccatagtataaggtaatactccagaaaaacttgctaacttcctaaataaaatactaggttctgggacacagcagtaaacaacacagagatccccgttctcatggagtggacgttctgatcttttcactcgtgcttcaatctcttattttaacaatgagccagcatttgccgaacattcaggtcaagtaaagctgaacattcaagacatgtaaagaataaaccttaataagtcacagtccttatttccaggaaacttacaaattggtacagatacaaaacatacaaaatgacaagatcaagtaggttgtaataattactcttgcttaggtttaggcaaagacctatggaatcacaagaggagacagccatgtgtttcctctttctaacagaagactccggaggacatgcagatgccttcctggcaactgctggagcccctgggctgggcacacagtaagctggcagtggtaaatatttgttgaatgaaatcaataaataaatgctgagacacacactgcaagtctctcttccaaacatttaactgccaacaaaaggaatatcacaaacattcattttcttttatttttttctttttttttgagacggagtcttgctctgttgcccaggctggagtgcagtggcgcgatcacggctcactgcaaactctgcctcccgggttcacgccattctcctgcctcagcttcctgagtagctgggattacaggcgcctgccaccacgcccggcttattttttgtatttttaatagagatggggtttcatcgtgttaaccagaatggtctcgatctcttgacctcgtgatccacccgcctcggcctcccaaagtattgggataacaggcatgagccaccgcacccggcccaaacatccattttcaatgctcactcagcaaaacagaaagtattaaaaatttgaatttccagagcattctcacagtttagagggcactaatttattttaaatcaagactgggaagtccaggttgtacattagctataagaataaatcaactatcttaaaacaaaacaaaacacctacaacaatgatcaatactggatcccacttgggagtggtggtgcaatgaataaatattaacttatttatttttattattatttatcaataaattcgtatttattattaccattagactcttttaaaaataaaatactattatgatttgcaaatgtttgaaaactatccaacctaggcttctttcagacgtataaaaagatctgaaataaagtcagattctcatactttgcctaatatccagaacaagcagacatttgtcaagttctataacacaatgggggtttataatcacaggtcaacgtggattggaactgaataaaaggaagaattacatgcctatttaatgcaaaaagcacacattttagtgataatttgaaatcaaatgaagttgatcaaatcataaatttttaatgaaaagctcatggcaaaattaacaacttttataagaggtaattatactgtatggggtaattataagaaaagtatgaggctaggcacagtggctcacacctgtaagcccaacactttgggaggctgaggtaggaagattgagttcaggaattcaagactaacctgggcaacatagtgagacctcatctctactaaaaatttaagaaattagctgggcgtggtggcatgtgcctatagtcccagctgcagtcccagctactcaggaggctgaggtgaaaggacggcttgagcctgggaggttaaggctgcagtagtcttgatcacaccactgcactacaagtccgggtgacagagtgaaaccctgcctccaataaaaaaaaaaagaaagaaagaaaaaaagaaaaaagggtaagtaggaaaaactatggactttggagtcaaactgcctggattccaactctagctctactatttactaggtatgcgaccttgagagagttacttatcatttttgtgccttaattttgacatctttaaaaatggataaaataataacatcaacctcttagcgacatgtgaggataatattagaaaatatatgttagctacatcttttaaaaagaaaaaaaaaatcggcctcaagtgtgatcagctttccagattacagagtagtcttctcagaaacaaaaaattttgttaagctataaacaaaaaccacttatgtgtcatataaaattacccatgttaaatgagatttgattaaaactctggtctcacatacaggaaaaaatttgaatttcaaaatcttggctgggcgcggtggctcacgcctgtaatcccagcactctgggaggctgaggttggtggatcatgaagtcaggtgttcaagaccagcctggccaacagggtgaaaccgcatccctactaaaaaactataaaaattaggcaggcacagtggcaggggcctataatcccagctattcgggaggctgaggcaggcaggagaatcgcttgaacccaggcggcagaggttgcagtgagctgagatcgtgccactgcactccagcctgagagacagagtgagaccccgtctcaaaaaaataataatagtaataagaaaaataaaatcttatgtgcctgctaccaggaaattgctcgtgagaacataaagcccactccaaaagcaaactgctgagtggatgaagctcaatcaaatatcattaatccctgtggcattccggccttttggtgaaccaagaagagttttaaactatagctggaagagatgcttccactgaagtgttgaacatctcgttgtggttgttccgtttgttagagagcatggctgcagcctgcacaatgcccctcagctgaatttctagtgatgagcttaatggggaaagaggcactcctctgaacaagtcctggcattcctacttccttcacaaaactttatttcagatggcagtttctcctgaagaagctattccagtgacacggtaactcgagcttccttccctactctgttctctatataatggcggattctctccttttgtttgacctgttgtctggctggcctcttaaaatatccctattcctcaaaaaaatagtccctattcctgagtttcccatgttatcagtaagtattgagagtccctacccgtcctcacccctacacaaagacacatctgagaagtaaaaagtgtgggattatttacccaaagtgacaaatttttttctttctttttggagatggagtctcactctgttgcccaggctggagtgcagtggcgtgatctcgactcactgcaacctccgcctcccagttcaagcgattctcctgcctcaacctcctgagtagctgggactacaagcgcccaccaccacgcccggctaattttttgtatttttagtagagatggggtttcgccaagttggccaggctggtcttgaactgacctcaggtgatccacccacctccaaagtgctgggattacaggcatgagtcaccacgcccagccccaaagagatatttcttgaatggatgaaggaagaatattattgcgctatcatcagtgtttcacaggggcaagttcaaaacttggtcaactggctgttctggtgtgccctcctccttaggaaacctaagggactctttcctccttagggaaccaaggggactctttctaaaggggcactatcttcttaatgttatagacattgacttctaccttgtagaaatcttgtctgagaaaattctgagacatctttaaagaaataccttttttttttttttttttttttttgagacagagtctcgctctgtcaccaggctggagtgcagtggcacaatttcagctcactgaaacctccacctcccaggttcaagcgattctcctgcctcagcctcccgagtacctgggactacaggcgcgccaccacacccagctaatttttgtatttttagtagagatggggtttcaccatgctggccaggatggtctcaatctcttgacctcatgatccccccctgcctcagcctcccaaagtgttgggattacaggtgtcagccacagcgcccagcctttttattaaagatacacttttaacatactagaagttgttatggactacaacagcttcataatagggaaacttacctttacaacatttggggaaaattactggcgatcaggacatctttctttccttcgacacatttactgagtgctcaactatgccaggcactctattaggtgctgggatatatcaaatagcccttctttttttctctctttgagacagggtgttggctctgtctcccacactggagtgcagtggcacgatcatggctcactgcagcctcaatctcctgggctcaagcagtcctcccacttcagccgcccaagtactaggacagctgtgcaccatgcctaacttttgtattttggtagaaatagggttttgccatgctgcccggggttgcttttttttttttttttgagaaagagtttcactctgttgcctgagctagagtgcaatggcacaatcagcccacttccgcctgaattcctgggctcaagcaatcctcctgccgcagcctcccaagtagctcagcttacaggcatgcgccaccatgcctggctaattttttttattttttgtagagacaggaactcactatgctgcctagtgcggtctcagactcctgggttcaagtgctcttcctgtctagacctcctgaagtgctgggattataggcatgagccactgcacctgccccaaataacccttcttaagacagagtctcactcttgttgcccaggctggagtgcaatggcatgatctcggctcattacaacctctgcctcccggattcatgtgattcttctgcctcagcatccagagtagctgggactacaggcgcacgtcaccacgcccggctaatttttgtatttttagtagagatgaggttttgccatgttggccaggctggtcttgaactcctgacctcaggtgatctgcccacctcggcttcccaaagtgttgggattacaggcatgagtcactgcacccagccaaagtttttctttctttagatgaggataatgttcaataaagagctaaactggatatttcaactatattccttacataaagtagaattggtaaatttatcaaaacactggctatcttaaatctctaaaaattgccattagaaacattcccctctaatacaacatcaagttctgaaggattgccataatttcatactgtgaaaaacattacgtagatttcaaattctaaacacctgatcacgaccacacagctacgtctatagtcaggaaatttaacacaggcttccccatattgctaaggtaaaatgtcctttaatgtgaataagattttctaccgttttcctaagaaggctgtgcaaaatacattgcaatgaagatggggaaaaagaaacacctctcaaacatcttacagcttcactttgtagccacagaaaagcaattaaagcaaaataattaaacctttctgtccattttgcagccaagtcaggctggtaaaatctgggattaaatgcaattttaatgtagagtatagagaactgtacattttggagctactgtaaaaagatcagtacaaaaagcagggaccaagataaagcatcttgactcagtgagcttacaatctttgaaagctagggaggggagaagcacttagatcttatgctgcccccacgcaaccactatagcaggatgtcattcagcagaaagcactttcagattcatcaccacaggtgtgtggcagtggtgcttttttttttttttctaaatccaatgatcaaggaaacatttacttgtaaatctttccgcctcttttccacatcactaaactgcatgactgcacttctacccaaataaaacctgtcttccctaaaccacaggttaagacctaggatttatgattagggaatctgataacaaaacactgatttcttgaacaatccaccagcctttcaagtcattccatctcagaactatgcctgttttgctgttttctagcaatcggcctttggtctctgggtgtgctccatggaatcctctgagatgtgattttttccttcgtttttggttgttcattgtgaaagaacaaatgtgagtgaactctttccctatgtggtgtctagccctcttctgccacaccttctgcagcagaagtccttggtgtccttgaacccagtaggacattccagcctcagaggcaggctgctcacaccatactctctttgcttccattcattcaaccaagaggtaccaagcaactctgcctgctagcaatggggagggatacagtggtgtgcaaagacaggcatgcatgaactatgcaaagtggacctcatcgcggattttggtgctaaaaacaatagtaacttctgaataataaacacttaatttggctccactataacaaaagtaaccactgtactgattcattcagagccatactgtgccacaataactagacatatttagctagttgcctaaaaagctctcagtaactaactctgggtgctacaataaattaacaactagtcaataccttctgcagcctactgaaaatagtacaggatgtgaggcaagtgacagattcttgctaatagccctgtcccgaaccagttgagttgaggttttcatctgttaaatgggcctaacaccaccagccctcagctgggtcacagaaaaatggaaagtgctaaatgagacaaaatgtgtcaagacactctgaaatgtaaaatagctgtaagctgtacagtggtatcatcatggggagtaatattttagatacatggctcttacctaacactattcaaacaagaggttcaatagagccaacaatgccggtagtcactacacatctgcaattgtcttactacagcctctgacctcctcctgattagcagaaagaaaggatcatgctacaagaaaaacatttctgcataattgcccaagttaaatctgctactctcactctgcctgacaaatcattccatgcttactttctataatttaatatatataagtgctttactggcaagcttctcgaaagaataaataatacttaatgactgcctacagtttaattaactcatgattgaacttctcatggattgctataaacattaaattatatccttcctcaaagctaccatggataaaaatcttgtttaaagctttaattctcttgcctaaacaattctgaaattccagcaaatctgtatgttgcacagagaggtgagagaatccaccttaacgcatggttataaagcatgttattttatagagcaaggatgaggccttaatttttataagattgaaaatgtgcacatgtccaagcacctcattaatattacagcagtcattaaacatctctggatctcaggcagtcttattagcataaactctgcgtattaccacaaggtttcaagtttctattctggcttctcatcttagctaccattttctgtctgcgtgatgttgcaaataaattttccttttggcatggctcagctgtcaggcacctctgttctataatgaacccatgaattacatctccctgctctgacatctctggtctcacacatcaaaatattgttcttcaattgtaatttataacttaatttaaatgtcccttttcccgtgacctttttagatcaaatggcattgcatctggcagtttctactatgccaaagcatacttttcaaatatagccattataataactatataaaaagcctacttaagttagactgcattcaggctaattaaataattccagtccatgaagaacaatattagatatcaaagtcttttgctatgcaaaatatctgtttatacatcacaagaaactgtcaaaataactgagaaaggaaaaaagtatttggaataaatcttaaaattcttcatatagttttaattaattatttcgactattaagataagtgagaaagaccttgccgaaatatgttcaaaacaaaatttaaaaatttcttagccacgtgcagtggcttacacctgtaatcccagaactttgggaggctgaagtgggcagatctcttgaggtcaggagttcaagaccagcctggccaacacggtgaaaccctgtctctaccaaaaacacaaaaattagccgggtgtggtggcgcgcacctgtaatcccagctacttgggaggctgaggcaggagaatcgcttaaacctgggaggcggaggttgcagttagccgagaccgcgccactgcacgccagcctgggtgacagagcgagattctgtcttaaaaaaaaaaaaaaaaattcttggctgggcgtggtggctcacacctgtaatcccagcactttgagagaccaaggtgggcaggtcacttgaggtcaggagtttgagaccagcctggccaacatggtgaaaccctgtctctactaaaaagaaatacaaaaattagccgggcatggtagtgtgtgcccataatctcagctactcaggaggctgaggcagaagaatctcttgaacccaggaggcggaagttgcagtgagccgagatcacgccactgcactctagcctgggcgaaaagagtgagactctgtctcaagagaaaaaaaaaaaaagaaaagaaaaatttcttataaccataattcacaaatgtcaatacattttcatttatacctccatcatcgataacctagtgccaagtcaatatatatgaaacatgtaaatgttaaaaaactagaattgaaactaagagcacaatatttatttttatttggccattatcatttcaaataatgctattaggtaccagagaggctaaaatttgtctgaatggtcttacgggagcaaaattcagggataatggaaaagacaaagaatttaactgcagagggtagggcttgagagaaaggtctagttaattttcagaaggaaatatagttattgaaccaatcttccctccctctttccatcactttctgaaactacaatgttccaggaattatgcgccagccctggagtcacatggaagaaaggagggggtcgcaacatttgctgagcagtgcacagtgtgctaggaactgtgttaggtctttatgatttcatcattccacacacctctcttccacagccagagtactaaaaatgaggaaatgaaatccagaggttcagtatgtttctctaggccacttccctagcaagtagcagcatgaggattctaacataaacccatgttctaggaagatgtccctaccctagaatgttgctactggggcagtttaggacaggcaatctggtgggagcaatgggtacggggactttttccgctgcagtgacaaagcaagcacactgtcttttcttaacttggggctaggggatgagggtgggtggaggaaaggagggagccagcagctcagaaaagaggaaagacacacatgtaaacaaactaacaaaaaaatccccatccatgaaaacactcacagtgctaaatgaaagctgatggggatgacatttgctcagtctggaaaatctaaaatgcattcacaggggaggttttgaaaatcaacaaccagtataatatgattaacttgcctatgctttatgaacagcaacaaccacataaaaaacactattctaggagaaataagcagtgctattattgcagtaaaaacaggctacacgaggcagggcggacctgcgtccttcgcttctttcgctgtcacagaagaggctgaggtaggtcatttttggaactttccagtattcaacattccttcacttaacaaagattttttcaaaggcaaaatattatagaatattcttctaaaaaggaataaacaaatggtaataatgttaatacattaatttagaaaaataaaaaaacaataaaaccattgaattaagccacattccccacgccaaacactaaatgaatggctcctgcacaggcttcacttacactttagggattaaggttgtgcctcttaattttcaagtctctgtgaaagctgaagtttatgccacaggtctttaaatgcaattatggataattaatcatttacatagttaacatgtctacagcctgacttctttttttataaatgcgagatcagccacagaatagtagaaagggagggtgcggagggtgtaggctgcttgccggggcaggaggactccacagacgcagtcaataatctactaagaagactcagcttgaggacccacaatgagtctaactctggccacagggagaaaagctcctggcacattcgtgaacctagactgtttatgctgcttttctcaataattatttgtcagctgagaaagacctatgtctggccacaagtggaaatggttcaggaccacaaatggaaactaaaatatgttttcacttactcctggcatcctcatagccttgaaaacagaaaaaaatttgtgacatgaaactgggcagaaggctggaggatgacataaaaaccacaggtctaagcatctcacgtaggcactagtgaacctactcatacatgctaaattgacctagaaagtgtatgtgaaaggctttcacacaaaaacacaaaatcaagaccagttacatcagtattaagaaacatttacagtaactgctttaaatcctacttagtagaattgaggtacagaaataactgcccccaatccaagggctcagcagtctgaatctcagtgctttgtgatgagtgattctaaggttatgcaaacaacagtccacctaatatttttggcaatgataatgaagttatggaacaacgaagaccgaagaggcatacactgatgcatataaagctccagagttgggaaaatatacaagcgactgtactttctaaaaacttcagccaagaacacagctttagtaactaagaaataagcaaaaagcctctgggcaaccaaaacagtgtccccaaaagccaaaggccctggagagccaggaagctcccactctgagctttagacacttagttacctcacaattctagctttcccaatctaataacaggtctcaaaagaaaaaatcagaaagactgtatgatttcaaaagagaagagcagcagcagacagcctgactgtgggagacacaaaaatttagcaactattatgcaaaccaaagagctcaaactctaacagttgcacattcttttgttaacggacaccagtaatgatcactcagaggcatcgagtaaaggtggacttgacttgagaagatatgaaaatgtattcctcctcatttctaaaatggaagaaaaaaagtaaagaaagaagaaaaggaggagaagagccagttttcctaaaaatgctgggataactagtactccaaagtgctgcagtggctggaatacacagcccaacaaataccaggtgtggggagaaggcaggccactcaacaaataggggagcaggaaggacaggagtggggcgccccagtgtcattacctatgaaccccagaaagttgctgggtaagggggaaacatccaagattctggaggacagggctggccaggacaacacaggttgtcagagtccagtggggctgggctctgggcagggctgtggaactgaagctaaaacagacaccagagacttgaaaaagctacagcttcaaggattgcctgagtttatcccaggccagctcaaagaccaaccttaaaacaacacaacttgcccacaagggtcactaatgagcaacaccttccctactctatcaggcccaggctaggactggtgcaggctggacccagagttttgaggggctagggtagtggctgaggaagaaacaacctgggaggtcagaacatatcaattaatatggtagttatacatgacaattttgttatctaaataaatatccttattctttgcataaggaagccaaatactccctattttataaatcaaatgtcctcacattacagaaatatcatagccactactagaaatatttttatacattctcaatatcagaaactccacactttaaataagtcataacagctgggcaaggtggctcacacctgtaatcccagcactttcagaagccaaggcaagaggacttcttgaggccaagagtttgagaccagcctggacaacacagtgagcccctgtctctacaaaaaaatttttttaaataaataaaaataagcaagtcacaacagatgcaaaaataataataatgagctattttttaaattttttttaaattttttttaaatttcaaaataagtaatatattttagtaatattttatataatagtcattttaactgtggtaggccaaaaaatgaccaccagaagatatacacatcaaatccctggaacctatgaatgtgaccttatttgggaaaagggtctttgcagatgtgctaaggatcttgaaataaaggagatgattctagataactcaggtgggccctaactccaatgacaagtacttataaaagagaggtggtgaagaaacccagactggagaagacacagacacacagaagagaaggcagcgtgaagatgagcagagaaagatggggccacagccaaaatgtgcaaacagccaccagtagctacaagaggcgaagagtgggctctgccaggaggagccggagaggtaccccactgacaacttgatgtcagatttctggcttccagaactgtgagagaacacctctctgtcgtttaagccaccaagtttgggtaatttgttacagtagccacaggaaacaaatacactaaccttcaaaaactggggataaaaaattatttaagagagctataaaaaagcattctgaggtgtttccaaaatataggaaatgaatactagggcaaatattatacattttagaattttgtagtatgctgtagaatacatgagcccttctgaaactcatgggcctgatttgttctaacaatgaggtgttcacttagattctcatcaaacaccctccccacaagggctgcagaaactcaaacatgttaattaccaaataaataaatgaatatatgattttattaaagcctttttttgttttttttttttttgttttttttttttttgagacacagtctcgctctgttgcccaggctgcagtgcactgatgtcatctcggctcactgcaacctccgcctcccgggttcaagcaattctcctgcctcaacctcctgagtggctgagattacgggtgtgcaccaccacacccgactaatttttgtatttttagtagagacggggtttcaccatgttggtcaggctagtcttgaactcttgatgtcgtgatccgcccgccttggcctcccaaaatgctgagattacagacctgagccaccaggcccggaaattttttttttttttttagacgaaggcttgctctgttgcccaggctggagtacagtggcatgatctcggctcactgcaaactccacctcccaggttcaagcaattctcctgcctcggtctctcaagtagctggaattacaggcatgcaccaccatacttggctaatttttgtatttttagtagagacggggtttcaccatattggccaggctggtcttgaactcctgacctaaggtgatccacccgcctcggcctcccaaaatgctgggattacaggcacgagccaccgcatccggcctaagcctgtttttaaatgtaaaaaggctaaaggtttttttatcaatttgctgaagacattgtgttattaatactaatataggctcaaatatgttaaaattctaactgatcaaacggtaagtggatgtttttataaataccacatatatctcaaaacattttaccactctttaacatggaaaaaaatcatctgataaagaagtttcttaaatgagtaaatgaactttctaacttatgccaaacaaaagtaaaagctgaatcacatcacattcctcagtccctgctgagcacctaggaaacaggaaggagatgcaggaaaagctgtggcatgaaggatttctgattggctaaacagcaaatcctccaaattacagattaaccagacatttctttctgtttctgagacggggtctcgctctgtcaccaggctggagtgcagtggcgcgatctcggctcactgcagcctccacctcctgggttcaagcgattctcctgcctcagcctcccgagtagctgagactacaggagcataccaccatgcccagctatctttgtatttttagtagagacagggtttcaccatgttggctagaatggtctcaatctgttgacctcgtgatctgcctgccttggcctcccaaagtgctgggattacatgcgtgacccaccgcacccggcccgattaaccagacatttcaagaaggcgctataaggtactggcctcaatttaaaccaagtttaaatagttatgtatataaatattgtgtatataaataagtgtgcttattaatttttagatgataaccacacttgcctcatagaattgttatgaagattaaatgaattcattcataaaaagcacttaaacttttgcctagcatataaatactcaaaccacaaatacatttcaattttataatcaggaagctgaccaatagttgataccttaaaaaataaaattaatagtgatgaacttaaggtcctatgactggctcaaaattcagtggaaaagctcagggtgggaaagaaatggcttatcaaaagcacatatacaaggaaaaatgaaacataacaagattacaacacaggactaaaaagaatgtgatgagcagacattcttataagctgagactgcactgagcagatgagcttttaggataactgaggggtatccctgggtcaccttatgttggtcagacctgaggagtgttgcttagtgcaggtgccacattttaaatgacaggcgaagcagaccaggaggataaataaaatggtaatatataaaaatggctaataccaccacacggatgatgcctgaaaacagtaccccctcagtaaaagaaagcagtcacaaaaggccacttattatatgatgccatttatatgcaatgtccagaataggcatatctatagagacaaaaagcagatgagaggttgcctagggctgctcaataaaaataaaaataaagaacctaattggattgtaaaagtggccttttatctccccatccaccccagagaagtttaggtaatgctctctctcatgtttagggaaaagaagaaagtggggtataaagtttgactttaaataaagctacatattatctaaaaagaaacaaagtactaaattttaaaagccatttcattcaaacaagacaaaaaataggctgggtgtggtggttcatgcctgtaatcccagcactttgggaggctgaggcgggtggatcacgaggttaggagatcaagaccatcctggctaacatggtgaaaccccgtctactaaaaatacaaaaaaaaattagccgggcgtggtggcaggtgcctgtagtcccagctacttgggaggctgaggcaggagaatggcgtgaacccaggagttggagcttgcagtgagccaagatggtggcactgcactcgagcctgggcaacagagtgagattctgttgcaaaaaaaaaaaaaaaaaaaaaaaaaagacaaaaattaaatcacgcaatttgtgttaaaatgttgttacatggaactttagaagggaatttatgaatttcttagcccaaaggaagccacacaggtgaacacctaaacacttaattttcaaaacaatagctcaaaatgtttctaaaactaaaaaattttcaaaaaataaaagttgaaaattatatattattatgctaataatcagctgaaaaggtcttggttataccagaaaacctcaactgcgtgatctttttctgcatcctcactaatgctatgattaacagcacaactttctgttgacttcaatatcctgttattacataaataaaacactggcaacagtgcctgtcaaggctgatttatatgatgtgctgttctgaaatttattggatttccataataagaaatcatagagcctatcagctttacccattagactttccaacaacaaataaaaaatcctgaacgacaagaaaacccaacatcttaccttaacccaagccagcaaacactaaccatttaatgttgactcatctggatagaaacatttaagtaaagggtgtgggtatggaatgaatgtcagaaggctcctctcacatgcttagggaaaacttatgaaagggcctcccggcaatgccttatttgggagctgagaaatattccacattcaagtcataagcactgcaaagctaatccaggtccagatactttagtgaaggccatttataatgaacaaacaaaaaatctgacaaaaattctatggacttaattttttagaataaaagagaaatgaaaatgatccttagaatagggttatctgcatattctgctatgccaacttcctaacatcaatttctggatgatcaagtgtgatatgaacttgaacttgatttatctattcaatcattcaacaaccatttagtatctctctaccatgtgtcaggcatcagactagggttagaaaacacaaataattaatactcaacagttaacaaatagtgatatttatagaccagagatgaaaaactatgaagccactgggagccttgaattctttgctgaaggagatgtgggtgtgcataaataaataagcaaacaaacatgtactctcttgaatacataaagagcttaatccaaacgtctaaaagccacccgtatctcagggaataaaactgtccaggcggaggtgaaatctttgttgcatgattataaattttacttacacacagtgaatatatagttatgtttagtgttggtgagaaaatggcaataaattactgagaaagaaaaagcaaaataatttgaattgtattagaaaccaggaaagatacctgagcccaaagaaggaaatccaatatcagtttagtaaaaataagttggcaagatatattctagaaaaccttagtctcaaatgatggggcttttctgcagtttctaagtaggaatataaaggtctattttgtaaatagccaaataaatgtaagcactcaaaggtggctaaattaaccccattaggataagacagatcatctccatgttatatagcatgatgtttacaaattatatgtcagctgcaagtgttcagatgagcctaatgcaaacactgtatgaggaaacacacacagaaatatttccacacaagatctttctggggaaacaccattacttcttcatatttaacataagcttatatttaatatataaaaatacaaataaaactttttttttttttttgagatggagtctcgctctgtcgcccaggctggagtgcagtagcgccatctcggctcactgcaagctctgcctccaggccacaccattctcctgcctcagcctcccaagtagctgggattacaggcgccaccatcacgtccagctaatttttgtaattttagtagagatgaggtttcactatgttagccaggctggtatggaactcccagcctcaggtgatccacccaccttggcctcccaatgtgctgggattacaggtgtgagccactgtgcccagccaaataaaacaattttacatttataggtgttcacatttgaaatattaaaataaaacatatcattgctacatacaaaaaggaatacgcccaatgttactaagaaatccctcttttcctaatgagagagaccaacatgtttattacatcttcttcctctacagcggtacaaagctgtttcttatgtatgaaaagataagaaatgcatgttaacataaatgaacaaacaaagaacaactgtcctgaactatctgccagttcactattggaccaaaagtagcaagtcatgtggccatgaaaataagatatttattaactacctctgtgattcttcaatgaggcctctactattaagaatgtgggccggatccggtggcttactcctgtaaccccagcactttgggaagccaaggtgggcagatcacctgatgtagggagttcaagaccagcctgaccaatatggagaaaccccgtctctactaagaatacaaaattcactggacgtggtgccgcatgtctgtaatcctagctacttgggaggctgaggcaggagaatcacttgaacctgggaggcggaggttgtggtgagccgagatcgtgccatcgcactccagcctggggaacaacagcgaaactctgtctcaaaaaaaagacatacggctaaagttttatataacctgaaaaccatcttcattaaattaaaacagactcaacactccaaacaaaaggcagagcttgccaaactagataaaaaggcatgaaacaactaaagaatacaggagatgttaccttaaatacaaagaaaaaacaagattcaaagtaagaagttgtaaagagatgtaccatgcagacaacaagcataagaaaactagagtggctgtattaacattagacaaaacagacttcaagacaaagaatattagtagacacaaaaaaggttacagcagaaaggtaaaagggtcaaaagacagagaaagacacaaatattttaagtgttcatgtgtctaataaccaacttcaaatatatgaagcaaaaattaacagaatcaaaaggagaaacaaccaactctacaatcacttttttttttttttttttttggagatggagtctcgctctattggcaggctggagtgcagtggcgcgatcttggctcactgcaatctccgcctcccagattcaagcaattctcctgcctcaggctccctgagtagctgggactacaggtgtgcgccaccacacccggctaatttttctatttttagtagagacggggtttcaccacattggccaggatgttctcgatctcttgaccttgtgacccgcccacctcggcctcccaaagtgctggaattacaggcgtaagccaccgcgcctggcctacaatcactattgaagactttcatacatgtctctcagtaacatacaactaggtgataaaaaaaattagtataagagaagatatgaatactaacgtcaaccactgacactgcataacagcacacccagtaactacagagagcaagttgatggcaagtacacatgaaacatgaaccaagacacatcacatgctcagccaagaaacaaggctcaaaagatttcaaaatactgaaatgttactgagtactctttgaccactgaattaaattaaattagaaatcaataacattccaaaaaataaaacttagagaagccccaagtatctggaaattaaggaatttagtactaaataattcatgggtcaaagaaatcaccaaaaaattcaaaacatttttgaacagaataatagatcacaacaaatcaaaatttgtggtaaaatcagctatttaacatcccactttagaaagctaggaggaaaatgatcaaattaaaccccaaataggtagaaaaaaattaataacgaacagaaaccaatgaaatataaaacaaacgggaaaaaataataaaaccaaactctaaagagatcaataatgttgaaacgtctttatattgatcaagaggaaacaaattaccagccttggcaacgtggagtccatcttaaaaaaaaaaaaaaaaagaaaagaaagaaaagaaaaaaagcactttctatataaaaaaatttagatggctaaactgtgaattctggcaaacatttgatgtagaaagtaatatcaatctttcataaacatcttaagaaaacagaacaggaagaacgatttcccaactaattttttgagggagtattactctgatatgaaaaccaaagttcttattaccaaactccttattacaaagaaggaagactacaactcagtatctctcatgatcacaaatgtaaaattccttaacaaattattagcaaattgaatccaatagtacgtagtgaccaagcaggattcatcctaggaacaaacagttccttcatatttgaaatcaatgtaattcactatattaacaaaataaagaataacaatcatataataatctcattagatgcagaaggaaaaacaaagcaactgacaaaattcaatgcccattcacaataaaaactcaacaacctggatatataagagatcattctaacttgattaaaaaaacaaagaaaggccaggtgcagtggcttacacctataatctcagcatttggggaagctgaggaggatcacttgggcccaggagttcgagaccaggctgggcaacatagtgagaccccgtcactacaaaaaattttacaattagctgggcatgatggtgtaccctgtagtcttagctacttgggaggctcagacaggaggattacttgagtctgggaggtcaaggctgcagtgattcaagattgctacactgcactccagcctgggcaatagaccctttctcaaaacaaacaaatacaacaaaaactgcattgtacttaatagtaaatgactgaaaactttctaagattagaaagataatgtccactctcatcacttctattcagtattatagcagaggttcaaggaagtgcaataaagcacaaaaaagaaataaaacacatagatcataaaggaagaggtaaaactatatttgcacacgacatgtttagcaggaccaaaaaaagccaacatataaaaactgattgtgtttctatgctatcgaagaccatttagaaattaaaattttagttacaacagaatcctcaaacaggaaatacttaggagtaaatttaacaaaatgttgtaagatctgtattcccaaaaaatcttattgtaagaagtaaaagaaagcggggcatggtggcatgcacttgtagtcccagctactcaggaggctgaagcaggagatcacgtgagccaaggacttcaagcccagactgaacaacatagcaagacctctttaaattttttttaatcaaaaaaaaaaaaaaaatcaaagacaacttctttaaaaatagagaaatatcgtatttatggattagaagatccaatattgttaggatgtcagtatttcccaaactgatccataaattcaatagaatcccaattaaaattccatcagactttttattttttattattattatttttttgagacagagtttcactcttgttgcccaggctagaatgcaatggcacggtttcggctgactgtaacctccgcctcccgggttcaagtgattctcctgcctcagcctcctgaatagctgagattacacgcacgtgccaccatgcccggctaatttttatatttttagtagagacgaggtttcaccatgttggccaggctggtctcaaactcctgacctcaggcgatccgctcacctcggcctcccaaagtgctgggattataggtgtgagccactgcgcctgcaagactttttaaaaattagaaactggaaggctgattctaaaatttacatggaaatggaaattacctcaaatagccaaagcaatctttaaaatcacatttaaagcagaaagacacccctgaggtcaagacttcctatatagctacagtattcaaaacacagaggccctaataacgatcaatgagacagaatagaatccagaaaaagatccaaacataaaaaagcagctgattttcaataacaatgtcaaggcagtcaaatgagaaaagtttttccaaccaatattgttcaaacaacaggtatctgtgtggaagaaaatcaattttcactccataattaacgcatcacaattcaaaatgaatcaaagacctaaatgtaagaagtaaaacttctagaataaagcacagaaacaatctttgtaatcttggagtaatcagagatagtaccataaaaggaaaataatgacttattaagcttcagcataactatatattaaagtcaacattaaggaaaaaaagtcaggccaggtgcggtggctcatgtcttaatcccggcattttgggaagctgaagtgggaagatcacttgaggccaggcattctagaccagcctgggaaacatagtgaggccctgtcactagaagaaacaaacaaacaaacaaaaactctaaaaaaaattagacaggtgtagtagcctgtagtcccaggtactcaggaggttgaggcaggaggattgcttgagctcaggagtttgaggttacagtgagctataatcactctactgtactccagccttggtgacaaagtgagacttaaaaaaaaaaagaaaaaggaaaaaaaaatttttttaaaagaatgaaaaaaagtcatggtatgggacaaataattcccaatacatatatcaaaggacttctacctgaaatattaacaaacaatccttataactaaattgtaaaacaaatttttttaagtaaacaaactatttgaacagaggcttcacaaaaaaagataaacaaatgggcaataaaacaggaaaagatgctcaaccctattaaattaggaaattccaataaaacctcaatgagataccagactacacatccattaaaatggataaaatttaaaaaaaaataactgacaacaccaagtcttggtgaagatgctaaagacgtaaaattataacacactactgatgggaatctaaattggaaccactttagaaacctgtaggccgggcgcagtggctcacgcctgtaatctcagcacttcgggaggcccaggtgggaggatcacgaggtcaggagatcgagatcatcctggctaacacagtgaaaccccatctctactaaaaatacaaaaaattagccaggcgtggtggcgagtgcctgtagtcccagctactcgggaggctgaggcagaagaatggcgtgaacccgggaggcagagctcgcagtaagcgtagatcgcaccactcactgcactctagcctgggcgacagagcgagactctgtctcaaaaaaaaaaaaaaaacctgtttgacagaacaggcgcagtggctcacgcctgtaatcccagcactttgggaggccaaggcgggcggatcacgaggtcaagaggtcaagaccatcctggccaacgtggtgaaatcctgtctctacgaaaaatacaaaaaaattagctggacgtggtggcacatgcctgtagctactcaggaggctgaggcaggagaactgcttaaacctgggaggaggaggttgcagtgagccgagatcgcaccactgcactccagcctgggcaacatctcaaaaaaaaaaaaaaaagaaaagaaaagaaaagaaacctgtttgacagtttctgagagagcttcctacgtacaaacaatcctgccactccaagtatttacctgagagaactgaagataaatgtcaacataaagactcatacaacaatgttgaaaaaacttttatttataatggccaaaagcttataaacaaccagaatgttgtttaacaaggttaaagaatatgaaaaaattgtgaatatgcatatccatacaagggaatacttatcaataaaaaggggatgaactatcgatacatgaaacacaactggctctcaaaatccttatgcccaaagaagtcacacaatatgattccattcctgtaacattccgcgaaatgcaaactactccaaaatgattttaaaaaaataaaaaaaacattgaaaacacgatacttcaatggctatctgaggctggaagcagaaaatgattataagaggccatgaggcaacttttgggggtgttggaaatgttttgtatcttgacattatagtagtttcacagatttataagtagtttcacagatttatatatctgaaaaccctcaaattttttactttgaaacagagcagtttattatacataaatcttacctcaataagttgtttcaaaaattacacactagcaatctcttttgttaataatgaagaaaaaacagaataaaaataagtaatctaagagcttagattcaaaaataggtccacataattgtcataaagaactgatagctctgggcaacattgtgagacatcatctctgcaagtaaaaataaccagctgggccaggcgcagtggctcacgcctgtaatcccagaactttgggaggccaaggcaggtgaatcacctgagatcgggagttcgagaccagcctgaccaacatggcgaaaccctgtctctactaaaaatacaaaattagccgggtttggtggcacatgcctgcaatcccagctactcggaaggctgaggcaggagaatcgcttgaacctgggaggttgtggtgagccaagattgcgccattgcactccagcctgggcaacaagagcaaaactccatctcaaaacaaaaacaaaaaacaaaacaaaacaagaaaaacagctgggcatggtagtgcacacctatggtaccagctactctggaggctgaggtgggaggactgcttgagcccaggaggtcaaggctgcagtgagccgtgatccaccactgcactccagcctgggcaacagagcaagatcctgcctcaaacaaacaaacaaacaaaaaagaactgacagctcaaaaattttctaaaccaattgcagttttaaaaatgaaacgatttatttaaatttactcgtatttaaatactcctactggatgttcaacacactttaatgtggccatatagcctatttcatttaagttctatgttgccctaggaagcaggaaatatacactaattactcacaggtttcttctaaactgataaatgcctaaccttgttttaaatctatgctatactctaagaaaacaataaatgctttccacacaacaatgtatatatctttttaacttattacttaacacagctcaaatcttctattactctagggaagtaaaaaatcccagtaacttctctcacaggatattttcattcatttttcattaggaaaatgcttgcaactgaagttttcggagtcagttcaacagtgaagtacaaaaattaaaacagcacataacttttcaattcatcacaaaatatgtacacataacctaagacacctgagccatgtcaggctagtctgaagagtttcagtgtcataaaaatgaaaaattgtacaacaaaaaaatctctgggagtgctaacaaaaccttcagaaggagcttgccacaaagaaccatgggcaaaagtagccaaaatgatttctatactgaagtatggtctacagaattcttaagagagtttggaataaaaaggggaataaatcatatacattcaagaaagtgccaaaaatagacatttaattaaatatggcaagatcttcattattcaaaattcaactgatagcacagttatgaaagcaggatttttttcacaaagcttttatacagagaacaactggccagacatggtggcccatgcctgtaatcctagcactttgggagtctgagacaggaggattacttaagaccaggagtttgaaatcagccctggcaacaaagtaagacgatgtctctacaaaaaaaataaaacttaaaaaaaggccaggtgcagtggcacacacctgtaatcccagcactttgggaggccgaggcaggaggatcacttgagcccaggagtccgagaccagcctgggcaatacagtgggacctcatcttgacaaaaaaaatttttatttaattagtcaagcatgatggtgggcgtctatgatatcagctacagctcttgggaagctaaggtgggagaaaagcttgagcctgggaggttgaggctgcagtgagccaagactgtgtcactgtactccagactgggcaacagagcaagatggtctcaaaaacaaaaattagctgagtgcggtggcacatgcctgtaatcccagctacagctactcaggaagctgaagtgggaggatcacttgagcctgggaggtcaagcctgcagtgagcctgcagtgagctgtgactgtgccactgcactccagcctgggtgacagagcgagactttgcctcaagaaaaaacaacaacaaacaacaacaacagaaaaaagttcctatcaaagactttctctttgtacacacacttttaaggtattctgaattcacagacattcatatctaacctaccacagcctctactgggcagtagtatcatcaacctctgagtttcagcttcctcatctgtaaaataatcttaaaggccccttctggcttaatcatatgctcaaaataaagattttgtatttaaaactaaccaacaaaaaaatccccactaactatcctatcgaatcagtgacaatgtacacaaacacacaatatttatgacaatgtgaaaaaacattctcttatttacagaatggcatatccctagcaaaaccactcaaatgttatatcatactcaagaaacctaattatactaggaataaaaatcagccatatcacgcagatatctacgtttcctcaaaagcaagctgcacagtagatttctaaatcaggaatggggactactttcttccctctgttaggaacttttgggactgtcagtatttaagtcatctagccgcctcggattctcctatttagaaactgggacagatgatcttgaaagtctcttctaactatagtgacctctcaagaaattaaaaaaaaagaaaaaagaaaaagaacaaaggggtgcttaaatgacatttggttaatcatcagaagaggtgcttagcctcatactcaacagcctacatacacatacacaacgatgcagactatcaatatatcagaaattgattccataaatatcattagctcttcagatttaatggtttcacattagtaatgatagagaggaattatttcatgtaactttaaaatacattaatattcctatacagccccatgggatatagcctaaggccaaaacaaataaaaacaacaacaacaaacaaagaacgaaagacaactggtttcagtaatcatattgtttgcagcagtgtgttgttatctgagctgctgtgtgtttattatgggattaaagtagatgagtaattatgatggtatgtcatgcaaccaactcagtaacattagcctcatttccctttacttttaattttttagaaattattcgtgtaaaactttttatagtcatgtaaaatattaacatgttccaaagtatactttataaaaaacaagtttatgcaaaaaagtttagcttcttcccatccctccatgtgctttaaaataaatacatggtctcagaaacagtgaagtacaaaaacacggcttctagattccaatcttgggggtatgaccttaaattgtgacttaatctctctcaacttatttccttatgtctaaaaaggtgataataatagaacctagaggccgggcgtggtggctcacgcctgtaatcccaacactttgggaggtcgaggtgggaggatcacaaggtcaggagattgagatcatcctggctaacatggtgaaaccccgtctctactaaaaatacaaaaaattagctgggcgtggtgggtgtctgtagtcccagctactccggaggctgaggtaggagaacggtgtgaagccgggaagcggagcttgcagtgagctgagatcgcgccactgccagagcgagactccatctcaaaaaaataaaaaataaataaaaataaaaatagaacctagaggtggttgtgaggattaagcaagatcttctatgcacagtacttggctttgtgaggcctcagttaagtatcaggtgctattattaggatctcatttgagagtcacctcaaacctgcagcacagacacagattaggaaatgaacctgcaggtgccacatcactggcctggagcccccatggcacccaacagccaagaccacaactcactcctgagtctacaggcgacttcatgctccgcactcatcacacattccctacagccagttcaggggaaaaagaagtgtcttcccactcagggtgacttcaaaagacttactgtgttcagtgcattcagagtggtgtcatcccgagaggctgcgacacagccgtcctctgtagagcctccatcacacattcctgcaaatgccgccatgctccttcagaagaaaaggtttttcctttattagtacatagtaatatcaggacagagacttagaccttcaattttcagaggacatttccagcccagaacaaattccattactacacgcatgatgaaccagttcccagctctgcctctgctcctatttttttttttttttcttttgagatggagtctcactctgtcatccaggctggagtacagtggcgcaatcttggctcactgcaacctccacctccaggattcaagggattctcctgcctcggcctcccgagtagctgagattacaggaacaccccatgcccagctaatttctgtatttttagtagagacaaggtttcacagtgttggtcgggctggtctcgaactcctgacctcaggtgatctgctcacctcagcctcctaaagtgctgggattacaggcgtgagccatcacgcccagaccaaaaataaatttaagttcctcttcactcacgcagaaagacatatgttacttttagtcagatccatttgtattgtttcttcccacgttttagcagtactaagattttagatttgagagcatgaagaatctaaatctatgagccacaatatttcagtagatgacaatcttctgaaagaaaagtctccagaaaacatgtgaaattaagtcatctaaaattttacttaattcctctcattctgcatatcaactacctttaggtgaattaaaagtaaaaaatcatggctgggtgtgatggctcatgcccgtaatcccagcactctgggagcctgacgccagaggactgcttgaggccagagagttcaaaatcagccctgacaacatagagagagaaaaaaaatatattagccaggtatggtggtgcatgcctgtagtcctagctactggggaggacgaggtgggaggatgacttgagcccaggaggttaaggctgtaatgagtcatgattatgccactgcactccagtgtgagaccctgtcttaaaaaaaaaaaaaaaaaaaggtgagaaaccagagataaaacctcttagtcattcactccacttacacattctcatctctactgaatgccaccatgcacaacaccgttgactagaaaacagccaggtaactggggcaacacagaaaggaccccatctcaaccaaaaacaaaattaaaaatagccgggcatggtgccacgggtctataaccctagctactcaggaggctgaggcaggaggatcgcttgagctcaggaagttaaggctgtagtgagctataattgtgccactgtactccagcctgggtgacacagcaagaccctgtttcaaaaaaacaaaacaagtaacaaccaaaaaaaaaagaaaaaaagaaaaaaaagaaacccacaaacccatccagggttaaaattcagatgccctaatccttgctttcatgtttttgttgtcgttgccaagacccagaatcactacatacaaagtctgcctgcctgctctgtgacacctgctctgtgacgaccgctctgtggtgcccgctctgtgccgtgtgaggagcgaattcacacttctctctgcatcgaaggcatttgtatgttctatgcaactgccacgagggtgatcacagataaatattctcatgtaggcaagccacaaaaatgtcaagttcaggacaggcactaatgaacagccacaaagtagagacagaacatgaaatctgtagagggttttgtttttgttttaaattttactttaaggtccaggatacaagtgcagaacgtgtcggtttgttacattaggtatatgtgtgccgtggtgctctgctgcacctatcaacccgtcatctaggttttaagccccgaatgcattagctatttgtcctaatgctctccctcccctcacccccacccctctgtagtggggttttcagatgagctgaatgactgaagtactcaactggattgagaggttttggtaactgtatgtatggcctaagctgttttcctcttgaaaagttccaaaatttgatgtggggcaaacaccaagaagaaaaacattacttcatcatgaaaaaaattacttcaaactatttttctctggtaagaagagccagggtcccgattacagagggtgtaaccaaacttaaagtcagagaacgcccaatatagaaataaaatctcaggggaaatgcaaagtttactgcctataatcagttcagatggtctaattcagaaagcaggatgggggtagattcctattaccttgctgccctcaagtacataaggaggtcacagtcgttaactccaggcatccagaccagttcctcatgttgggtcactgtatcaccatctggagaaggaaatggttgcagatctggaagtttggcctgtaagacagggatgagtaagtcacaatcaaggcatgtattaattataaagagctatctcaataagcagtctttaggaacatatacaatgttttactgagactctttccttggacagcagaaaaataacaacaaaaccatgagtcatttaaactgacctatttcacatgtcaggatcatttcaccatagaagatttcacaatagactgcttaatatctgcttaacagtgtcaaagtaaaccagtgccagcatgataccaagagtaaaactgaagcacacacatatgcataaaataaacaaaaaaacaaaataatgtctttagatgataacagctattgataaagaaggaaacacacatacatttccaatataacaagttgacaaagaagacatatgcaaatgatacctcacctaaggatatttgctaaaaaattaagtgagctatcctattagaatagtgttactcttaagacagtcaatagcaatataagtcatggtcaataccaaaactagatgagtattaagtaaacattaaaaaatatagttgaggccaggcctggtggctcacgcctgtaatcccagcactttgggaggccgaggtgggtggatcacaaggtcaggagttcaagaccagcctggccaagatgctgaaaccttgtctctaccaaaaatacaaaaagtagccgagcacggtggcgggcgcctataattccagctactcaggaggctgaggcagagaactgcttaaacccgggaggcagaggttgcagtgagctgagatcgtgccactgcattccagcctgggagagacagagcgaaattccatctcaaaaataaaataaaattaaactaaattaaattttaaaaatttatatatagttgaggctgggcatggtggctcacgcctataatcccagcactttgggaggctgaggtgggtggatcacctgaggtcaggagttcaaaaccagcctggccaacatgataaaaccccgtcactactaataatacaaaaattagccaggcgtggtggtatgtgcctgtaatcccagctacttgggaggttgaggcaagagaatcgcttgaacccgggaggcagaagttgcagtgagccaagattgtgtcactgcactccagcctaggtgacagagcaagactccatctcaaaaaaaaaaaaaataaaaaaaaaaaaataaatatatacacacacacacacacacacacacacacacacacacatatgtagttgaattgacctgtggtaacagaaatcagggcagtgatttctttacgaaagaaggaattgcttgtgaagaacaggaaggacctttctgggatgacagaaatgttctgtgccttgatacgaatcatcacggcagattgaaaagcatacataagatacgaacaattcgctgtacatagagtatacctcaataaaaagaatttaaaaaaatattcgagcaacagtgctccccaccaagactgtaagtgatcagatttaaatacctgtggcattttctcacccacactctgctgggacagagcaagagcaagcaggtgccatgaccaccataaccagcagagacctgtgaaaagtcagatatttgcaagatactcatgttctcatcctgtcaaatgatgaccatgggcacatgagtctgatagagctccatgggacatgaagcctgggcaaacaatttaagtgaatgcagcaggctgaatataagccagcaccatccaacagaaataaaataagaattatatatttaattttaaatattctagtagtcacgttaaacaaaatgccatatcccaatctggactagccatattccaagtgctgaacagctatgtgtggcagtggctcccgacctggatgtgcaggtgtgaagaactcaagagtgaagtggaccacggggaaatggagatagaaccgccccatccagggaatgctgccacacaggaatgggacccagtgtgtgtacatcctccatctttttccaaattccagaaatcttcacatttatgtaaaagtttgtggttttaaatgttggtattcaagtttttgaggcaactgcatagcaaaacatcacattagtaggccatgtggctctcaggctagccatcagcacccacacagctttacaggctgtcttccatgcctctaaatgtgtatcaagctgactttctccaagcaaggatgttcttctttggttaagtattgacttctctaacattgaactgagtgtcacaattagttctgcttaacacatagtgaaaatagtgggataaaattaaaacacaatgggcctggcgtggtggctcacgcctgtaatcccagcactttcagaggccgaggcgggcagatcacctgaggtcaggagttcgacaccagactgaccaacacggtgaaaccctgtctctacgaaaaatacaaaaattagccaggcgtggtggcacacgcctatagtgccagctacttgggagggtgaggcaggagaatcgcttgaaacctgggaggcggaggttcccgtgagctgagattgcaccactgcactccagcttgggtgacagagcaagactctgtctcaaaataataacaacaataataataacaacaacaataacacaacaaatgttggagtcaaaaggtctttgacactagtactgagttctgcttccccagcaccgagtacagtactgggtacagcagttctctaatgtctgttattaatcgaaaagtactattactgtgagcaggaccaacctcccccccattcttgagaaaaatggactagaaatataattagacagtttacagaaaaagaaacgaaaatgcctcttaatcataagaattgatgagttggagacggggttttgctgtgttggccgggctggtctcagctcctgaccgcgagtgatccgccagcctcggcctcccgaggtgctgggattgcagacggagtctcgttcactcagtgctcaatggtgcccaggctggagtgcagtggtgtgatctcggctcgctacaacctccacctcccagccgcctgccttggccccccaaagtgccgagattgcagcctctgcccggccgccaccccgtctgggaagtgaggagcgtctctgcctggccgcccatcgtctgggatatgaggagcctctctgcctggctgcccagtctggaaagtgaggagcgtctctgcccggccgccatcccatctaggaagcgaggagcgcctcttccccgccgcccatcgtctgagatgtggggagcgcctctgccccgccgccctgtctgggatgtgaggagcacctctgctgggccgcaaccctgtctgggatgtgaggagcgcctctgcctggccgccccgtctgagaagtgaggaaaccctctgcctggcaaccgccccgtctgagaagtgaggagcccctccatccggcagccaccccgtctgggaagtgaggagcgtctccgcccggcagccaccccgtccgggagggggggggggggtcagccccccgcccggccagccgccccgtccgggaggtgaggggctcctctgcccggccgcccctactgggaagtgaggagcccctctgcccggccagctgccccgtccgggagggggggtcagccccctgcccggccagccgccccgtccgggagggaggtgggggggtcagccccccgcccggccggccgccccgtccgggaggtgaggggcgcctctgcccggtcgcccctaccgggaagtgaggacccctctgcccggccagccgccccgtccgggagggaggtggggggtcagcaccccgcccggccagccgcccagtccgggaggaaggtggggggtcagccccccgcccggccagccgccccgtccgggaggtgaggggcgcctctgcccggccgcccctactgggaagtgaggagcccctctgcccggccagccgccccgtccgggagggaggtggggggatcagccccccgtccgggaggtgaggggcgcctctgcccggtcgcccctaccgggaagtgaggacccctctgcccggccagccgccccgtccgggagggaggtggggggtcagccccccgcccggccagccgcccagtccgggagggaggtggggggtcagccccccgcccggccagccgcccagtccgggagggaggtggggggtcagccccccgcccggccagccgccccgtccgggagggaggtggggggatcagccccccgcctggccagccgccccgaccgggaggtgaggggcgcctctgcccggctgcccgtactgggaagtgaggacccctctgcccggccagccgccccgtccgggaggcaggtggggggggtcagccccccgcccggccagccgccccgtccgggagggaggtgggggggatcagccccccgcccggccagccgccccgtccgggagggaggtgggggggtcagccccccgcccggccagccgccccgtccgggagggaggtggggggggtcagccccccgcctggccagccgccccgtccgggaggtgaggggcgcctctgcccggctgcccctactgggaagtgaggacccctctgcccggccagccgcccagtccgggagggaggtggtgggtcagccccccacccggccagccgccccgtccgggagggaggtggggggatcagccccccgcctggccagccaccccgtccgggaggtgaggggcgcctctgcccggccgcccctactgggaagtgaggagcccctctgcctggcgagccgccccgtccgggagggtggtgggggggtcagccccccgcccggccagccgccctatccaggaggtgaggggcgcctctgcccggccgcccctactgggaagtgaggagcccctctgcctggccagccgccccgtccgggagggtggtgggggggtcagccccctgcccggccagccgccccatccgggaggtcaggggcgcttctgcccggccgcccctactgggaagtgaggagcccctctgcccggccacgaccccttctgggaggtgtgcccagcggctcattggggatgggccatgatgacaatggcggttttgtggaatagaaaggcgggaagggtggggaaaaaattgagaaatcggatggttgccgggtctgtgtggatagaagtagatatgggagacttttcattttgttctgtactaagaaaaattcttctgccttgggatcctgttgatctgtgaccttatccccaaccctgtgctctctgaaacatgtgctgtgtccactcagggttaaatggattaagggcggtgcaagatgtgctttgttaaacagatgcttgaaggcagcgtgctcgttaagagtcatcaccactccctaatcttaagtacccagggacacaaacacttcggaaggccgcagggtcctctgcctaggaaaaccagagacctttgttcacttgtttatctgctgaccttccctccactattgtcctatgaccctgccaaatccccctctgcgagaaacacccaagaatgatcaattaaaaataaataaataaataaataaataaataaataaataaataaaaaagaattgatgagtcaacctctctgacaacagaaatgcaaattaatggcacatattcaattttgcatctatcatactgacataaagccaaatgtttgacaacacataaagccacgaaaaaaattagcactcatattagttgctagtgtcaacacaaactgatacaatctctgtggaggggaatgtggcaaaacccccaaaattatatatgcacttgtcctctaagtcagccatcccgcttctggggatatagccccaagatacactggcaaaaacatcaaaatctatatgcacaggctattcactgcagcattacatgtaatggcaaatgactggaatcaactcatatgcctattaatagggatcagatgaataaactgctacattcatacatggagttctatgaaatagtattatagaagggaatgagaaggagctctatatactgctatgaggagaacacaagaatatactgttaaaagaaaggtagcaaaaggatgtatattatgttattatttatctaagaaggggcagagggaatgaaaataagaagcttaaataataataatctcattaaaactacaccaaatggaaagaaatgcaacaattgagctggttctactctaggaactgtttcaagtaactctaagatatattaatttgcttatacagccctggcaggatatacataacaaaatgcaataccaagctgttttcaataagcatactgtttgtagccatgtgattattgctattctgggctgttatatgtgtattatggaattgaagcaaataagtaattttgttggtgtcattaaaaaatgggatttgagtcacgggaaaaaaataaagatatacataaaagaaggacagaattagtataaaggccatagaaaaatctgaatttgaattggatgtatcagcataaatttagaatgtattttatctttaagaaagtagggaaataaaacacctatttcctattctgtctactgaaaaggcctcgaaatagcaaccaacccagtaagaatgaataccccagcacccagtatgtaaataccacttcccactacaataaaagagggctcttctgagacaagtttaattccacatctagggaagacaatgtataaggtgaggcagtaaaatcatgtcttactagagaaaaacgattaagtgaaaaggacaaaaaccactgggattaagtgaaaaggacaaatacgaaggaagatgctcctactggcccaaaatggatcttttaatcatcaataagaactgattaaagttgattatagattaaaaaataaaatccactggtaccatggaaagataagggtgaagtttcatttatttgtacaaggaataaatggatggcagaattagaatatcactgttttgaaatccctaataaaataatggatctaagaaataatcagtggtggccaggcgcggtggctcaggcctataatcccagcactttgggaggccaaggcgggtgtttcatgaggtcagaagttcgagatcagcctggccaacatagtgaaaccccgtctctactaaaaatacaaaaaagtagccaggtgtggtggcgggcgcctataatcccagctactcaggaggctgaggcaggagaatggcttgaacccgggaggcggaggttgcagtgagacaagattgtgccactgcactccagcctgggcgaccgagtgagactccgtctcaaaaaaaaaaaataaatgatcagtggctgctaattacaattaaaaaagagacatatgagcctcctggcagaagcacttaccaccacccaggaagcatttttctggaaggcagggtaccaaactagaatgaggccgaacctctagatttaactactaattctcaagtcatgcaaagagcaaagtaacaaatttaatgcaatcagccaaatctagactgcagaacaccctacaggatgaaatagcttctttaccacatacactgggggactaggggaaggacctgggaattaagagagatttaagagatgtatcaaccaactgcaatgaatggctctcatttagattctaatttgaactatgaaaatataaagaaagagagaaagatacagacagacaattagggaaatctgggcatcgtatacacttgaatattaagaaattggtaatttttatatgttctgatatattgtgattgtgtccaaatcccttatttttggaacatctacaaggaaaatgatgtatttgtgaggcgtttaaaataacggcaggaagaggtgtgagggggaataaatgaaatgggtttgactaggatttgatacttgaggaagctgagtaatgaagagaaggactttactgtattattctttccctgcttttgtatatgttaatattttcctaataaaaaggttaatttttttttttaaagactggttctgtcaccaggctggagtgcaatggtgtgatcgtggctcagtgctgcttcaaccgcctaggctcaagcaatcctcccacttcagcctcctgagtggctgggactacagacatgcatcaccatgcctacctaatttttgtattttttgtagagatggggttttgccatgttgcccaggctggtctcgaattcctgagctgaaatgatctacccaccttggcctcccaaagtgctgggattacaggcgtgagccaaaagtcaaaaattttaaaaaggtaaatgttgccaattcatttttaaaagttttattatttttggtgctccaaaacatttctttttgaaaatgaagcacacagaatacatttaaaatctgatgtaaaaaaccaaacatctgattttaaatggtggtatacaaaaatccaatcacagtaaatttgctccttttccaagaatgtaagcatcttttccttaggaactacattttcttttatggtaggaaaaaaaaaatctataaaataaaagtctggtacaaagatctcaagacactggaaatacacagtgagagggaaaaaatgggtagtaaaatacagtgcaagagaaagtagagaatgggagacgaaactgagtggcattaggttgagtatcaggttcccagaccgaaaatacagccccgaggtggcagtcaggcccacctaatggaacacaccaacaaaagactctacttgaacaagcagacactgtcctcctgcagcttctttcagtctgtatcagttataaccccaggtctgggatgagaagtatcttctataaactatgtgaccctgatagtttttgtgttcacttcacttcataactccttcacttcttaagttctttcattacagagttaaaataggttatttaaaaatgtaaatgacacacaatttagaaatgctcaaaatctagacagaaataataactagacagacgactgaaatctctatgcacttccaaggctcactgctgcctgtatcccatgtctttagacatgatggccttagctgtggattccccagcatccattccaactcaagtgctaatcatgttaaactctttcctcatggtttagaaatagacacatgacccaatccatggcaacaatatgtgggtctactggggacctgctggggaaattttccttgctcctaaggggaaaagaagtccaattctttcttcctctcaacacttgctaaatttcattcattgtaagatccactgttattttatgtgcactgagaaaggataaaatatagccaataaattataaccacaccacagaatgtacaatgaagcccaactataggagcaaatgtgaaggaaaaaagtgtatcttagaattagtcaaactgagctgaggatgacgccacctccatggaggccagctgggtacaagagagtctcagagaagcacagcagagccccagtcctgcctgaccaggatgtcatgacatgggagacagaaacagagccagagtcctgtcagtgaaagcatcctaactgatactgagatcaaaacagaatatgccgggcccagtggcacatgcctttagtcccagctactcagaggctgaggcaggttggactgcttcagcccaggaggaggtcaaggctgccgtgagccgtgatcgtgcctctgtgctctagccttggcaacagaatgagacctgtctctgaaaaacgtaaaaacaacaacaaaaaccaaagagctgtaataaatgcaatgaaataagaaagagcaacagtcgtgacacagcaaccctctgactgaaaagtgtcctaaccatcttgactctcctgaaggaaaagaagttgtttatttttttgcagacagtctcgctctgtcgcccaggctggagtgcagtgtcgcaatcttggctcactgcaacctccgccccctgggttcaagtgatttctcctgcctcagcctcctgagtagctgggattacatgcgcacaccaccatgaccagctaatttttctatttttagtagggatggagtttcaccatgttggccaggctggtctcaaactcccgatctcaggtgatccgcctgcctcagcctcccaaagtactgggattataggcgagagccaccacgcccagccgggaaaagaggttttaaacatcttttatctttttttttttttttttttgagacagagtcttgctctgttgcccagactggagtccagtggccacagtcttggctcactgcaacctccgcctccggggttcaagtgattttcctgccacagcctcccaagaagctgggattataggcgcctgccaccacgcccggctaatttttgtatttttagtagaaatgggatttgccatgttggccaggctggtctcgaactcctgacctcaagagatctgcccacctcaaccttccaaagtgctgggattacaggcatgagccattgtgcctggctttaaaaatgttttaaataaaaatatgtgatcaagtgttcatcaatggatgaatagataaacagtgatacgtacatacaatgggtcatttagccttaaaaaggatagaaattctgacacatgctattaacacggatgaaccatgaggacattatgctgagtgaaataaatcaggcacaaaaagacaaatactgtatgattccattcacatgaggtacttttatgaggcagaacagtcaaaaacagagagaggaaggagaatggtgattgccaatgctgcagaagagaaatggagttactgtttacgggtacagaatttcagttttgcaagatagaaagagttctggagatagatgacggtgatggctatacaacaatattaatgtacttaactactgaactttgcacttaaaaatgggagatggtaaatgtatgtggtgatctgaggagggtggaaaaaaaacctctgtatttataaaaaattcccgatagcaataaccacattctaagatgctgcgcaacagaataaagtgccagcagagtaataagaaacaaaaacctattaaggaagctatgaaaatgaacttcacctgatgactaggaccgacacgaatctccccctgggtactgttcagcctcctggaacagaaatagagcagattaagttagcgcaatacagttttgacataaacattcacacatttttcaaaaaaagtaattctcttcaaataaatgaggaaaaactgaggaagaattaacgtccccactacttctaatgttctgtatacatacaccacccaccaccacacatgcacctctaaaaccttttcctttgaaaatcctaagaactgcagcttcctttcatgagaaccttcctacatcatcgttctttttttgagacagagtctcactctgtcgcccaggctggagtgcagtggcacaatctcggctcactgcaacctccgcctcttgggttcaattgattctcctgcctcagcctccagagtagctaggatttcaggtgcctaccaccacgcccggctaatttttgtaattttagtagtaaatttcagtaaattttgtaattttaataatttgggttttcatcatgttcagccaggctggtctcgaactcctgaccctcaagggatccgcctgcctcggcttcccaaagtactgggattacaagcacgagccaccacacctggcccctataccatcattctttcatgcctcagagagatggacattcctgtagtacaattccagtcagacatttcttccgttcaaaacatctcagggtgccctaccataagccttataaaatacaaataagaaaacttatcctaggacatatactgagccatccatccatccatccatccatccatccatccatccgtccgtccgtccgtccatccaacaaatatttaagtacctactataagccaggaattgtcctaggtgttggggataaagcaacaaacagggacaggtacagaggctcacacctgtaattctagcactttgggaggctaaggcgggaggatcgcttgagcccagaagtttaaaaccagcctgggcaacacagagtgacgccatctctacaagaaaattaaaaatcagctgggcatggtggcgcacgcctgtagacccagttactcaagaggatcgcttgagctgggaggtcaaggctgcagtgagccatgttcgcaccactgcactccaacctgggcaacagagcatgaccctgtctataaaaaaggcaacaaacaaaacagtgtcaaagaagatggcctaaaaggaggcacatgctcttgtttttctctcatggatctgatacccatacccactgtgtttgaaattgttaaaaatacattttggaaagctatcgtttcctttagggcacctgggcccagtactttcttcttttaatccaatcattttctcatgaagaatcttgcttgggcaaaggtggtggtaaatgtgacaaaggaagaaaaaaagaagaggaggaagaaggggagaaagggaggaggaagacaaggaggaggaggagaagacgaagaagaggaagaagaagaaatgtggtggcccagtcatcaagaatcttacaagcctccagctggcgaggcagcatctgtaccaaaacaccagaacaggccgatgcccgtattcatcaacataagacacttcaaaagacacagtacaaaaatgtgaaggggaggtaccaaaatgaggcggcttcaagagaagacacagaaggagataataggcctagcagcaggaaaaaaaaagaggactttccaagtagaaatgaaagcatgcagaggtggcaggctgaaagggaggggcggtgacagggaaatgcttgcatgtgggctgacttcatcatacaagtcatcttcatttcttcattaggagaatggtatgtggaaaaacgaagctaaaagatggattgttctcataggtttatgcaggaaatggaagaagctgttttaggaggtatgtaaaggaatcaaatcagccacaagttattttaatcacaagcgcttctttaagaaaaacaagcaagcagtcagcgttaccactatttcccttccaacttgtccttttctattttctaactagctgtgagcaaaacaagctgccaaaagctctaaatactttccaaatgctttcttgcctacaagtaggtctagccagaatgtatcatttcagaaaccttcagccacagcccattcagtaacttctgcctgcagctcaacctttgggttcttccagaaggtctgttactctggagttctccagtggttggatatcatttccatatcatggctacactgttaagtccttgataattccagaaaaaacattcctgcttgatttttattttattttggagatgaggtcttgctatgttgcccggtctgttctcaaaaccctgggctcaaagggacccccacctcagcctcccaaagcgctggaattacagacatgagccaccgcactcaccgcccaaccccatttttattttaataagccaatttatcatcatatttagcttaaaaaaacccaatgtaccatggtaatgaaacaaactcccaaataccctgttgactagaactacttatatctcacgtatttccataaaaataggatgcagataattattattaaactaataatacaaatgagacaaaaaaatgtattgggccatcttaagagacttgaaaattgtttaagtttataacagggaagagtactaataagtaggctataacatgaaaaccaagataaaataaggaaacttcttaaaagcttatttaaaaatccctctttgcaacaaaagtatttttaaattgtatgtaacttttaaatatcagggttctatagcaagaaatacaacaaagttctttttgagcaggtaggatctgaggtgcagacaatggcattagcctactatatgcaagagttacagaatatagaataaatggcaaaagtactttttaggtccaagatataaagaggtagatagcaacacaccaccttagacaaagcttgatgcagctgacagaaaaactgtcagaatatgagctgaaggtgaaagacaagaagtacacatggtggggaagtgccagcatccagctgtatctggatccaccgagcaatcagaatcctccttactgaactaagtatccctcccctgctgccgcactgctctcctctcttttttctttttcttttttttttttttatcctgtatccccagacagctgcatcacccttgataggtcaggcagccacaacaccccagaatgtttccctggcacatggaaaaagcacccccatgaggctgcagccaggtgcaaagtgagtctgtgaactgctcccttcttgaatgcacctttgtggttcacacctcactcattaatgatatttaaacatgacagtatcaacagcttgtaggaaacactcttttttttttttttttttttttttttttttgagacggagtctcgctctgtcgcccaggccggactgcagactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccaggaaacactcttaatcatcaattgcaatcttgatgcaatgactacattttgtcttttacttaacatttctcaaacttttaggtctctgtacccttttacactcttaataattactggagtgtgtcttggtggtcccagaatctgtctcttgtttcaacaatgtctgaacagcacatatcctgggactccatctgttccagcctccaactgccctccaatctcccctccatttgcaacctccagcacccttcttctcggccatatcctgcttctgggaccagccaccactgtttttgtggttagctcctcaaccccgcaagctctgggaggcatgagtgacttcttccacgaatcggccaagaagattcagggcactgagtgtctcttgaagatgtgtgtgtggcagcggcacccatttccaggatgtggagaagccatctcaaaatgagtgggggtaaaaaccctgggttccatggaagccaccatggctctggggaagaacctgaaccagatcctcgatctttaggccctgggttctgcctgcacagacccccatcttctgtgacttccggagagccacttcctagatgaggaggtgaaactcaacaacaagatcggcgactaccagaccaacctccccaggctgggctgggtaaatgtttcttccaaaagactcaccctcaagcaccacgaggagcctacagagcccagcaaacttttaggagcccctctcaaagttcagggctactgcctaagcagcgcctccagccactaccctggacccctctcccaagccgtggacaaaacagaaataaagcttattacaaaaaataaaaataaaaattactgaacatcccaagaaatctaaatttttgaaaactttcaaaatattgatttaaaaatagcaataagcccattacataacaatatacatattcttataaaaagtaattgcatttaagcagaaacctttagtaaaaagtgaggcattattttatgtttttgcaaatctcattaatatttgacttaatagaaaagacagctagattctcctatctacttttgaattcaatctgctgcaatatattgttgtggttaaattatatgaagataatacagcctaacacagtgatgtaactagaaaagggaagaatatagcctttttgatactacaccaaaaactcaacaagttcccggcactctggggggccgaggtgggaggatcacttgaggtcaagagttcgagactagcctggccaacatagtgaaaccctgtctcgactaaaaatacaaaaaattagccgggtgtggtgttgcatgcttgcaatcccagatactcaggagcctgaggcagcagaattgcttgaacctgggaggcagaggttgcagtgagccaacatcgtgccattgtactccagcctgggcaacaagagcgaaactctgtctcaaaaacaaaacaaaacaaaacaaaaactcaacaagtaatcatttcttaaagatgtgtacacaaggtgagtctaaaagcctatcaatagtcttttgactgtgctactctgaaatccattggtctgtcttgcctttgaatgaatggatcttctactcagatgtgattttgtaatgtcatgcattggttttatagagaatgtcagtttactcagttctgcagatctttcaaatatcaaccagttctttatacagcattttttaaaaatcatattaatatcacctatctcataagaaatgcctttcagtgtagagaagctgtcaggctcagagtggtgagtacaagcttttcgaaattctaatttttacttgaaagttcaaatcttagccttgtcaaatagtatcagtgttttccttgaaataacaagctcacttaattcatcttcaagaaagtttctgccaaatgcccacgtctgaatgaccacagtttgtctgtcagttgttctttcaaagagtaactgatattccatgaaaaaagtggctagcttcgcttctaactcaaatgtctcgacggaaccaaggcttctcctcaagacaatcactgtcttttggtatagggcagaagacttttaagtcgggaagccaagtcttgggattaaaaaatactaataggctgggcgaggtggctcacgcctgtaatcacagcattttgggaggccgaggcaggtggatcacctgaggtcaggagttcgaaaccagcctagtcaacatggtgaaaccccatccctactaaaaacacaaaattagccataccgggtggtgtgtgcctgaatcctagctactcgggaggctcaggcaggagaactgcttgaacccgggaggcagaggttacagtgagctgaggtcacaccattgcactccagcctgggcaaaaaaagaatgaaactccgcctcaaaaaaaaagaaagaaaagaaaagaaagaaaagacaagacaagaaaagaaaagagaaataataataataataatgaggtccacaagctatgctctgagaagcactgattatggcacattctgaacttcagcaagtgctggaggctaaaattcatctagaagactccagctttcttctttgatgaataacaacagtagctaacatttcagcacttactatctgtcctaggtgctctacagtattatctcatttctaggtattaaggcatttaattcatgttttgatattaacagacatgttagtattgctattcacagaaattcaggtgtctttctatcctgtgttcaaagcaacacagcactacacgtggtggtgcacacctggaatcccagcactctgggacgctgaggcaagaggacagcttgagctcaggagtttgagaccagcctgggcaacaggctttataaaaaatgtttttttaattagctggtcacggtggcacgcacctataatcccacctactcaggaggctgagccaggagaatcacttgagctctggagtttgaggctgcagtgagctatgatcacaccactgcactccagcctgggcaaaacagagctagactgtctttaaaaaaacaaacaggccgggcgtggtggctcacctgaggcaggcaggtcacctgacgtcaggagttcaagaccagcctggacaacatggtgaaaccccacactactaaaaatacaaaacttagccgggcgtggtggcaggcgcctgtagtcccagctactcaggaggctgaggcaggagaattgcttgagtctgggaggcagcggttgcagtgagccaagatcatgctactacaccccagcctgagtgacagagcaagactgtctcaaaaaacaaacaaacaacaacaacaacaacaacaaaacatagctactaaagaggtttctgcttggatgtacaatgctgctgaattaacaaagtaggtctagtcaaagccagggtggtcatcaacttcggaagaaaaatccagaccaaaggcagtatgaatcctagccaagacatataaaggatactactgtatgaattaagaaaccaaagatgcaagtaatatccagaataatgcaacatacacacacatctatctttatcctcatcttaagagttttcacatacgttatcttaaatctaggtgtaggccgggtgcggtggctcgtgcctgtaatcccagcactttgggaggctgaggtgggcaggttacccgaggtcaggagttccaaaacagcctggccaatatggagaagccccacccctaaaaatacaaaattagccaagcgtggtagtgggtgcagtagtgggcacctataatcccggctacttaagatgctgaggcagaaaaattgctcaaacccaggagatggaggctgcagagagccgagatcccgccagtgtactccagcctgggggacggagcaagactctctcagaggaaaaaaaaaaaaaaaaaaaaaatctaggtgtattatagttacataacaaacacaagcaaaataataatactagctatcaattactaagtgctttctatgctgggcacatattatttcattattccacgacaactctatgaggcagtatctccataggtaataataataacaatactaattttaacattaataaagcaactaatatatccattgaacatttactatgtaccaggcattgcaaggtaagcaatttccatttattttcttatctaatcttacaggcgaccctgtaagataggtgctattgtagtaagtgtacaggtcaggtcactgaagccaagagacgttacgcagttgcccaagattaaacagcaaataagtggagaaatcaggaatcctactcaaggtcagctgactccaaagtcagagctctcaatcacactcccatatggcagaatgattaagttactgaaccaaaatcacacaattaattacaaacagaatgatgagaatccatatccctttccctattttggttctatgtttatttcaaacacccaagcaagacaaaatgatcaaaagaatttttttaagtttgaaagtcatgatgaaagagaaaaacctatcaaagttagaggccaatgtatataatactcttgaaatgacaaaattacagaaatggagacacattcgtgattgccaggtgttagagatggtggggagagggagggaggcggagggtgcgaccacaaagggagagctttgtagtgatggatagctctgtctcttcattgttgtggtggttacacaaagctatccatgtgataaaatggcacagaactacacgcacacaatctactaatgccagtttcctggttttggtatcgtattacagttacaaaagatgagaccactctgtggtatctttgcaacttcctgtgaatccaaaaaatttaaagttttaaaaaagtcaaatgaagggggggatatactacaggcagatgggaaatcagaaagaacaccagacatgagaaaagctgattaaaggacaaacagatcaacctcaaattacactgtacacagctgaaccagtaactgaagaaagagggccacagcttattagcaatgagattcaagaaattaactccaagtgacatatttattttttccttatgtttactaaggatttctgctgtggattcatcatcttggagacatctttatactgtgaatcatattacaaaaaccgaattaagaagtgtcactatcatccccagcaaaagaaggaatttctctgtgtagctaatgtaaataatatgtttttcaaaacaacttaagttcagcctacattattctacaaatctttgttttagaatatgaaaaaaatagttccagaagccaaattacaacaataatggtaagttgttgtttttattcctgaagtattaaaaaaacagaaagtcattgtatatgaaatctgatacaaaaaaaccccagtgtaacaaagcagtatccatagcaactacaacttaatatttcagtcctcttcaactgcagtggattaaataaaatgacaagatgttccctttgaaaagtaacctgttaccatggaaacgttttattctaagaagtaaacagggaatggacagaaaggagcagggagcctgtaaatgaatatcaaaaagggagaagcatctttgcagaggagatggaggtggcgatggcaggcaaagggagggtctgtgagaagagcatgcctgctagatgcaggatcccagcccaacccagaggcttggcccagaacatgatgcggccacttcttcaccctgaagaaaggggaaggggcaggaaggcaatgttctgtgaacattcaccaaagacgcccaaagatctctatgtgatcacggtgactgcttaagataggcacttgattctacaagggaagatgagggaggaggatagagatatgggaagaacacatgaacagaaggcaccaccatgaagcaactaagggcaagagctgaccccctcattcagcccctccccaagccttgggtcctaacagtcgtgtagcctgtggcccattcccaaggtgctgggacagaaaaggctcaagtcagacccttgttctgtggctggcgtcatgtatgaatgagatcactgagaaatctctctccctgtccttcagatggtaaatatcacacagcagacattcttatcttttccacagggtattaagttgagcaggaagactgacatggcatcaacagaatgaagatcttagaaacgctacttagtacacatttagaaaatgaccacagaagaagtctgtgggtccagaacaaaatacactacattttaagaaaaccaaaaggcaatttatcagaatcacttttttagatggattgtgaggtaggagtgaaagcgaggattaagaaggaagactagtgcaatatgctgggtttctcaattttccccagcatgaacacatacttcaaagctgccctgaacaagtctgaaatttctttttaaaatctaacatagtatcttaaaaagccatgcgaatgttgtattctatcccatcatatattcccattcatttttagagaaaaatttccataaatctgaataaaatcattgtgctggccgactctgggcacactttctgtgggttagccctgctccttaagaaacagcaataaataaataaacaaataaacaaacaaacattaaaagaaacatcattgtacttcctattaggatctcccatgacactgtcacacccacacctgagtctagatgttcaaaagcagggaaagagcatggtcttcagaattaaatgaacctgaattaaaattttagtatcaggccaggcatggtggctggctcatgtgtgtaatcccagcactttgggtggccaaggtgggtgggtcccttgtgcccaggagttcaggaccagcctaggcaacatagcaagacctagtctctgcaaacaaacaaacaaacaaaaaacccaaccaaccaaccaaacaacaaaaacaacaaaaattaaaaattagccaggcatggtaaaatgcacctgcagtcccagctagttgggaggctgacacaagaggatcacttgagcccaggagttttgaggttgcagtgagctatgatcacaccactgcactccagcctgggcaacagagcaagaccctgtcgctaataaaattttaaaaataagtttcagtacccaggttttgtttgctctgtgattttgaggacacaattaaatctaattccttagtttcctcatctatgatatgaagttgataatgttattatgcaaggttgctataaaaataaaagatgatttatggaaagaactagacatagtacctattgcttaggggtcattaatattattaaactctatatactggcaataagtgagaatggaagctaatcctgctattatgagttcccgaagtaccacttacctctccttccacccatatcacagtcaggattttatatttattttttgtagttatttctttgaatggctgtcttgccctctagactggaagtacatgcgggtaagaactaaaactggttttggtcaccataatgcagaactcactggctcttactagatacatttttaataaataaatgactccaatattctaactcaactactgcttagccacagacagcaagcaagggctctgctgcaaagcttagctagtgaagtccccgtgacagaaagccagccctccaagcaaaattaacttaaacgtaggtttgattaaactgcctaacaggaacaaaattcattattcaatcaaaaataaaactaaaaacaaatacaaatgaaaaaacaaagagatttagtcaacttaaagttaccacttccatattcacacacaaataaatacaaaggccaacacaagaacttgtccaaaatccaaaatcataaaattctaaattttctctgtggaaagttcctgagaggccattgatccaatcttctagcttaatagaagaaatcaaggcctgaggaaagaaaagtgctcttttaaggggtcacactgagttaattactgaagaagactccaggccacaccggcagctctcccacagggtcctcctaaatataattcagggtccagaactagaaatttggcattgcctgaagaataataagaatttccatgctggtaagatgcagtaaatatggcctccacacacaataatgtatgagtaatgtcaggaaaaaaactggtcaaaaaaatttaacaggtgagaaagatccagtttcaaagtgctatagtgactttgctccgttgtctaaatttcttatctgccttctctctcttctccattatgtggtaacctaccgtgtatctggcaacgtcataaaacaacattccaccacaggctcctagggaactttactgtaatggcctgtggcaaagtttaggggctgcggcctaacaaagctgcctgcacacacatggagattcagccaaaaaactttttaaaaaaaaaaaaaaaaaaaaaaccactatgaccgaaacccacttacaaagcagcagtcactgtagattaagctgctctcctgacccaagatggtgctagctttctgcatattgaaatcaaactgtataacaaagctgaatgaagcacccccagaaaaaaaaagggactttggaccaagcaagcatgtctacaacacgtctaaaggtttctttgtcccctcagggaaatgttataaaaaaacatgacaattgccttattcctcctcgctgcagtggtatgaatatagaaggaagagaacacaaacaggcaataactaacacacacacatgcacctagtgtgtgtaagtgagaaagtggcaggaaatgtttaatgctgaacacacccaatattataaattatggaagtagagcttctttttttcaaaaaaaaaaaaaaaaagaactccaagatgtataaagaaaaacataaacactcaaagagagtaagaagaaagtggatcagtaaatagttattaaacatactggtggttaataattagtgtaattcctaaaacaatccctagcattgtcttagttgaacaggctattaaaaataaaaagatgttggccaggcacagtggctcatgcctataatcctactattttgggaggccaagacaggaagatagtttgaggccaggagttcgagaccaacccaggcaacaaagtgagacctgcatgcctattttttttaattaaaaatttaaaaatatatgttgttgttgagataatcatatctacatgagcttgagactgtacatttgacctgcgaattaataacaataatgtactaagcaactatgtgccaagcacttccaagttgttttcatctaatctttacaaaaactgtaagaaatatttatttccagattacccatgagaaaaatgaagctcagaggagggaaggaacctgtcgaatgtcaccgcttgcccaattgtcacttattaggtggaatctgaaccacactacctggctccaaatctagcctttcctcttaccacagatgatgcattcatttattcaacatattcataccaaagacccatttgccaggtactctactagaaatggagaccgtaagaatagacttggcccctgccccaaaagcttgatgtccaatagggaaaaaaatcaaataatcacaaataaatgtgtagctcaaagaagtttgatagaaataatctctaattttcccagttgaattaagtgttttaccttagactcaaagtatcatagagtatacaatatgagatcagttatctttcagaattgttttaaaagtacattcaagcatgagtctcattagaccaaaaagaaaaataaatcagactcatgctttatcacccacagttgcaggaatacaggcatgcccctatcagaaactgctcagaagagatgataactaattatctgtgcttatttaggagaagatttgtgaatgtacacaccatctaaaatattcctttagctattattttctaccttctctctcatcctgtcagacatttatgttacagtcttagaatacacggttttctggtggaagacaactcggttgagtaacaaacaaaaagtacctggcaaatgcgtctttggtatgaatatgttgaataaatgaatacacaaagtaaaatggaaaagaaaacaaattcagaaggaaaagaatcaggaaaaaagaacaactagagaatcacagacatctggtcttagatatattagagtcttctaattcataaattaacacagtagccacgagtcaaggaagaagtgaaaagaagattaagaatgaagtgtcagccgggcagggcggctcacacctataatcccagcactttgggaggctgaggcaggcagatcacccaaggtcaggagtttgagaccagcctggccaatatggtgaaaccccgtctctactaaaaaatacaaaaattagccaggcatggtggcagatgcttgcaatcctagctactcaggaggctgaggcaggcaaatcgcttgaacccaggaggcggaggttgcagtgagctgagatcacaccatcatactccagcctgggcaacaagagcgagactccgtctcaaaaaaaaaaaaagaatgaagtgtcaggccaggcacgctggcctgtaatcctggcactttgggaggccaaggcagcatggattgcttgaggccagaagtttaagaccaacctgggcaacaaggtgaaatcccttctctacagaaaatacaaaaaattagccaggtgtggtggcgcccacctgtagtcccagctatgtgggaggctgaggcaggagaatcaccttagcctagggaggtccccagggaggtcaaggctgcagtgagctgagatcacaccactgcactccatccagcctgggtgacagcgtgagaacctatctcaaaaagaaaaagaaaaaaaagtgacatgtcaattaaacacaatcaagttcattctagctttcaaccaaagacagactgcaaaacttatgttgacagaggaacgctttaaatgtgaggctccctcagattcgaattcgagattctattacaatgataagaacaactaataagatattaactttgtgaacttctctattttttgaaacatctacttgctacattcccaacatttcctgatattctcaagtgcaacagaagcagaaccataagccaaaatgaaacaaactagcatcttttccatgttcaagctacacagaccaaagacttcatcaaccaccagagtaacttcccatgtgctgttccctcacctcctccaccagacaagcacagaagccctgaagcaagcctttagcattccaaaaaatatttttcccagacaggataatatagaagaaatacataccacactcattagagttactttattggatttgaaacatagacaaattcgactcttaacaacagaatatccacagatcacagtcagcaaccacaagtcttcaccatcaaatagatggcggcatccaagctccataaatacagatttgtactaggcccacacaggccagccacaccagtggcaggaacctgatccagagctgattcggctgtgagcacagcttcctgttcacatttttatttgttaactgtaaagaaagtttcagaagaggtaaagatctagaacagaaaggcaatattctcctgactcaaacaatgagtttgttccttgagcatgaaatgtgagtcctgcccagatcccacaagtgcatgacagaaagtggtgcagtgtccagttcctctcgtctattgaagggatacttttattaaaagaagcaggaaggaagagcaatggtgcttttaaacagagtaaaataaggcgagttccagaagcaacattatatggtatggggtacctccccaaaactccccagtgcaatgcccaaataaatatggtcacaatgggaagaaagccctcacatgggtaaaaaaattgatcacaaaaataataaacgcacaccctaaattatccttctacaattcatctccttagttgcaatcccaaaattgaatctgtaagaatacagattatacttcagtaatattttcagtgactagaattcaccaacattagccttcctaaaaactttccactaaaatcaagggcctccctggaaagagttgaccatgcaacactccaaattcacactacaccactaagagcttacacaaggaatttctccttgtatcaatgcatagtaaatttcttctccttcctatgagggtttttcagttgcacattcttctatattgtatgctttcttccatcctcacaaatgcacaaaatttaggtggcattcaaattttttctaacctttatcagaagaaaaaggagtggaaacaaaaaggagcaaacagtataattcaaaaacttcatttaatatctacttgggtaagaattcaatttgtcctaaatcttattctgactggctccctaaataaaccacagtgaaagccatctgtctgaacctgctctgcaacaggacaccccaaaagcacaacttcccctgggtagaagaaactagtgtctggctatcaagcagtgggtacgaaatgaggccttgtcaatgactgccttctcagcaccaactactctttttactccatttaagagaatagaattccaagtcacatgacaacatacacatatgcaaaaaatgctatccgattctaaaacagatacaaaaataaacaaaatacctaaacttcaatttctaacacaaaagtcaatgcatactttttttaattgccaaagaattttccataagctctaaaaggaagatgagtctgcttccttttgaaggcaagagactaagtaaaaactgatgtgacataacctttcatttttaaaaaaatcaattttaaggtgttattgttgcaatcataattcacaactgttccctgaatatgtcagacttcagaaaaagatcacaaaaattataatttgctctggcaaacaggctctcaatcaaaacaaggttccacccaccttcaaagcaaccaatagaagcccacctaccatccttcctaaaacatccaaacagagctgctctgcggcccaggcattccatactagccacaaggcaagggggcggcctgcaggcttgctctgcaggtcttgaaggcaaacaagcttggcaacacacacccagcacgactgaggttaagattatactacgagccgaagaggtaaggggaagaggacagggacagagggacccgcaaagcttcacattctatatctgctgaatgcctctccggtagtccccattcttagttctgattttacgcttcacaataccacctacatggccagctagggctgaattaaaggctctcaggaacatgcactatgaatgatgaaatgattcataaacaccttcagaagtgagaaagagcagcaaaacccatcactgtttcggtgaggccaggggaagatagcctacctgcaggggctgaatggatcatccatgactaacacgggctctggtgagtctagctggattcctgaacctttactttctgctaaaactctgcccttttctacactaacaactcaaaatggaggcacatgcagtctcagagacctcatagagctttcactgagcttgtgctatgacctaagccttcacgcagaacgcagaaacttcccctcactctgacaggactgagcatgtgctgtgaccctccctcatccacacactgtctctccacgacgcaatcaatctcaaccctgctgtttccgtaaataaagcccagccaacagactctgcagcttctccctgcacaccaagctagtgtgcagggaagtggggccttagaaaggggatccaagacagccaacagcagggaactgagcaagcccagccatggagaggcttcagttaaatgccctgctctgtcaggaactcagcaagccaagccacggaggagcgtcagttaaatgctctctgctctgtcagcacaacagcaagttttgtctttttttttttttttttaaggtaaatggtgattttaaaaagcaagatcaccaagaaatagaatcaaaagacagatatgaatgactacacacaagatcaactaatagaaatactgcaacacatttaaaaacatagtagtagctacttaagagaagcaacttcacaaatttctttttgaaactctaaacattttgaaaaagaccaaacaatccgggtaaagttatggagtgcttggccttgtcacacaggtacagacacagtgtagatggtattgtgagcagggtagctaaagaaaactgtattttctgcaaacagcttaatcttccttagataagaaactaaaaataataaataaaacattccccaaataataaattaaaacatttcctaaagtaatactagcccaatcaagtctagcttgaagaatctaattctaacaattagaaagacaggaaggttcaagattcaacatcgtgccacaaacacatgaacatccaaaaatctcatttgaggtcctgattcaaaatactaaggcagatccatataagaaatcctagctttggatgtgcaggcttagtttccacttacaaactaagaggtgattctatagattattaatcagttacaaaaagaaaaagaaatggaagaccatgaacctcgccaaaattataaaggacaagatagggcaggaaagggcagtgccaattctgtttcccagaaatgtaatggaatgtcaggaaattaaagcctgttgaaaagaacacacagtgtcctcaagattcctacagtgaatgcagaatcaattccatttccatagcactcccgtttatgctatgaaataaactaaattctgaaactatgattcaataaactcttatcctgccgataatgtaatttagaaaatacaagaaatgccaagtacacttaaatacgttttcctttgacctaacacatgaaacaagtatctacaggctggaagaacattttcccttattggtatgtgagacaacatattcccaaaactgctgttactaccaacagtctagagaaaaatactttctaaacacaaaagcaatggaattagaacctagcagccaaataatatgaatatgagcagcaaagaatttcctcccaaaagtgtatatattaaaaaaaaacaaactatctaaccctttcatatggaaaatgtttacttgaagaaatcaacacaaaataatatgtaataaattcatcagtctctgaaagcccatgaaactgttacatagagcacactataaaaacggttactgtaacagcaagttaagaaatgtggattctaattttggtctcattagatgccctgagttaccaaaatccaatggccttcccctgtgataatggattccaatggtggcgccagcctttgtggatatcctcttcattgtctttcctggtgctggcatctcacagttggcttcacatgccatgccaccaagacagacagccctttctcttgttacccctcaggggcagcgtaccccagcggccacaccccagatctcctctccttcacactctctcccgtggaaaagtcacccacactaccaccatgccagccagctccactctgaagacacttccttcctggcagcagctcagaaatgcaggagcccccggaatcctctcactgtacctctctggggaactgcacctctcttattagattctaagtccttcagggacaaggacactacctaaatcatctttattggaaccacccaactctcctattttgtacctcaaagaactctatctgaagcagtggaaagggcacagtatcactcatatagtatggctggccaaaattacataacctagatctaatcgtggggaaacgtcagacaaactcaaactgaagaacacttgacaaaactggcttctaactcttcaaaaaggtcgatgtcataaaaaatctttaaaaaaggtgaggaaacatgttgtgaaaacaaagagagacaagggatattaaagagacacaacaattaaatgaggcttatgatcatggggaaaattactatgaaggccgttgttgaaaaaactggcaaaatctgaatatgaactatattggactatatcatattgtattaatgttaccttttctgattttgataatcataccatagttatgtaagataattttcttgttcttgggaatacacactaaagtattcaggggaaagggtgtgatgtctatatttcattcccaaattgttcaggaaaggaaaatacaggttgagttatcctaatcccaaaatcccaaaccaaaaatgttccaaaatctgcaactttctgagcaccaacatgatgctcaaaggaaatactggaacgttttagatttttggattaaggatatagaataagcaaatattccaaaattccccctcccccaccaaaacatgaaatccaaaacactcttctaaccccaagcgtttcaggtaagggacagattcaacctgtaccacagagagagtcagacagcaaagatggtaaacacagacagcaatacagcaaaaaaagagatagaggttatctcataaagtgtatatttctaataattttgtgcatgaaacaaggttttgattgggttttgattgtgatctgtcacaggaggtcaggagtggaattttccacttgtggcatcacttcggtgctcaaagcattctggattttgaagcattttagatttcgaattttcagattagagatgctcaacctataatagagcaaacctataataaagtttaaaaggtaataaaataaaataaatataaagcaaatatggcaaaatactaacaactggtgaattgagtaaaagatatatggaggttctttcttgtactagtctcataactcctctttgaattatgaatataaaattccaaacagaaaaattttaaatatattaaacaaacagaaaatatatccaccagcctccacaaccatcagttctcccttcttttttttttttttttttttgagatggagtctcgctctgttgcacaggctggagtgcagtggtgcaatctcagctcactgcaagctccgggtcctaggttcacgccattctcctgcctcagtctcccgagtagctgggactacaggtgcccgccactacacccaactaaattttttaattttttttttttttttagcagagacagggtttcaccgtgttagccaggatggtctcaatctccagacctcgtgatcctcccgcctcggcctcccaaactgctgggattacaggcgtgagccaccacgcccggccacaaccatcagctctcatggcatctggagagctgacacaaggggcaatgaatgacctgcctccctgcctgcagtcatggtgctctcacccccaaacagaagtcaattaacacccagctccaaactcactccaatctcaagaatataggatcagtcctcctcctcctcctcctggtcagagaatctcaaggagtcttgaaaccgagcagttccataattaggttagccactaggtcacattcaaccacaaattccaattttagaaatggggctctgattccatggagcaagccttgctttacactgagttcaccctggtaccctactcagtgcttaagggcatcccagagaggggccttgttttctctcctagttctcttgaacacgggctgcctgtgtactgatgctgactacccacctggacctcactcctgccaccacattttctagcccatcgtttgccagcctgcagggatgtacatacaatctgcaacctggcaccctcgtatttccatctgttgccaactgccaaggccttcccagaagtcctgtgatccccatgtacatctataatctctggatcccagacatccttctctcctcctattaatcccaagtgaacaacaggtgtaggattagcacttctgaatagactaaatgagagctgagtgggagagaagaatacacaattcaaatcaattttttctaaaattaaaaaaaccactttgtccactataatacttaaatttgtagtgagtagattatgtacctctatcaaaggtaagtaaaagctgtaacatgaaaattgcctaagttttatcttaaagaatttcctacttcccagaaacaaaaaatgtctacaacgttgtattcattaacaagaaactttaaagccaaaatggggaggcggggcggggaggggaagcaacactcaggaaattctagagaaaaagtttggaagagatattctaattagtactaacttcacatcaagagaggagaagtattcagaagcagtttatttaaatttcatttactaattgccccgcatatctagacatggaactgagttttcgttttctttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtcccgatctcctgacctcatgatccacccgcctcggcctcccaaagtgctgggattacaggcgtgagccaccgcgcccggcctgaactgaactgagttttctatctatctatctatctatctatctatctatctatctatctatctatctatctatctatctaactttctatctatctgtccatctttctatctatctgtccatccatccatccatccatccatccaggaagcttgctgatttacctattagctttaacaatttggatgggcccgggggctcacaaatataatgagaggccgaagtggtgggtgacttgaggtcaggagtttgagaccagcctggccaatggggtgaaacccagcttctactaaaaatacaaaaataagtcaggcgtgatggcatgcacctgtagtcccagctactcagtagtctgaagtgggaggatcacttgagcctgggaggcagaagctgtagtgaggccagactgcaccactgcactccagcctgggcaacagagcgagactccacctcaacaaaaaaaaaaaacacaacacaaaacaaaaccaacaccaacaataaaactaattttttcacaagttttctcagatttcctatggtgaaaattatactttattaataaatgttcattttttcatttccaaccctcacatattttcttcttcaagtcttaatggatattgaaatcctgctattgtttctggtttcagaggaaaaagtttccacactctgcctttaactatggtgcttgctgtaagtttatggtaagtattctgttagattaaggaaattcattctacaattaattttccttttctaagagtcccctccccaattattacagagcgttgaattttatcaagtgctttttctacattaagatgattgcatgggtacaaaaaaagaatgaatgaataaggtctagtatttgactgtgaaacagggtgaccatagtcaataataatccaattgtacattttaaaataactaaaatagtataattggattgtttttaacacaaaggataaatgcttgagggggtggacaacccattttaccatgatgtgtctataatgcattgtatgcctgtatcaaaacatctcatgtaccacatacatacgctatgtatccacaaaaattaaaaattaagaaaaagatgattgtctatgttttcttcttctatatgtcgaagaggcaacatatgctaacagataaattattaaggcattcttatattctataaatttggacatgcatatttaccttgctagactccgtttgttaacatttcatttaaacattttacattcatgttcataagattgaacctataaattttatttttttaacctggttttataataaaggttttattagcttcataaaatgactcaggggacccataacaactttctctgttctctggaacactggtagaattcacctgtaaagcatgagtctgattcatttttctttttctcttttatttggggggggtccggggaggggggagacagagtttcacttgttacccaggctggagtgcaatggcacaatcttggatcactgcaacctccacctcctgggttcaatagattctcctgcctcagcctcccaagtagctgggattacaggtgtgcaccaccatgcctagctaatattattatttttaatttttttttgagacagaattttgctcttgttgcccaggctggagtacaatggcacaatctcggctcactgcaacctctgcctcctgggttcaagcaattctcctgcctcagcctcccgagtagctggggttacaggtgcacgccaccccacctagctaaatttttgtattattagtagagacggggtttcccatgttggccagactggtcttgaactcctgacctcgggtgatccacctgccttggcctcccaaagtggtgggattacaggcataagccactgcccctggccctttttttttgtatttttagtagagacagggtttcaccatattgatcaagctggtctcaaactcctgacctcaagtgatccaccgcctcagcctcccaatgtgctgggattacaggcatgaaccaccaaacccagcctgatttatttttcttttcggtctaatgagattaaaaaaattatccaatgcaaattataaaaactgcctttaaagggagaaggtatgcagtttttacctatttcctctttcttccaggcggaaatctggatgtaatggccatcactacattgccaaccttgaaacaagagaacagtggcagacaaggtagtaaagggtggacccctgatgactgtgaggtcctagtctaggagtgcttcctttcaaactctgcttacatgagagagaaatgaaagtgatattttatttaagccttttacacagtctctttctgaagcttccagtatttgaagttctcgggtgtgtcttgctgtttgtctcatctgaccacagttaatggtacatggtttcttccgatatttctgacggtgagcttggcattcaaggatattttatctgtggggatcctacaggatcttggatgagggtgtctcccattaaaaaacattttacatatgcttctgccaggtatcttgaagggtttactggcatgagaccactttttatattgccttcttatcctagagttctcatattctgaagggcccagaatcccaaccctaaacaggtgggtttccctgttactcccctctaggttggaaaatgttaacaaactcaatccagcctcaccatgagctactgaaagatcagcttactgctttagttttcagtttctcttaattctttggagctcagctccgcagttaaaagttttgttatgtgttattccattactccaggtaacattcctagatgttatctgacaaagggtttttgaaatgatcaaagggtttttgaaatgatcaaatcaaatgatcaaatgaaaaacaggcttttgtcctgttttattaaagttatcttaacttcagtaggctttgttttccaaaaatacatgtactctcaaccatctccaatattttccatctcaggtaaatgtttctgagaattcaaatgtgatggcagataaaagcaaacaggaaaaaatttgtatccagctctagctgctcatcttcaaaagctacacaaagaccacgagctgtggtgagtggaaaagggaactgttactcaaatgcaagtaaattttagaatgtctcaaattcaaattagttgaaatacaggtgttttagattgttaacttttccacttaagtataaagatttatgttgaggaaaaaaatggtcccaaggtcacagagcaaagtgacagaaaattaagaaataaagacattaaaaataatgaaataaggtttcttaatgttaaagaagaatgttacacataaggaaaagggaataaactagcagaaattctgtagtactggattgaacttggagaatttcacatgaacttatgaatatacacacataaatacaaaactataggtgcaagtgtgtgcattatatatgcgatagatacaaacacacgcactccctagctctgtttctcagaaggtcagagagcagcaacacaaagtaatgagcacacttagcaccaaatctaggctttaaaatatcattctccaaacactgggacaatctgacctcaaaatgaataacaacagcagcaggttataaacaattaaataaaataggaggccattattccgctaaataaatgaataaatcgaaagtttgatgaagatgagatctacacagtcacaaagcaacctcccacaaaatggttattaattaaaaagggaaaaagagacaccgtacaatggcaaaacctggcagacatcacgtccagcaactggtcaaagtgaacattaccagcaactggacaaataagaattgtatactgacaggatacagaagaaaagaacacaaaatttctgtgatacacgatctaactctaataataaggaaacaccataaatgcaaactgagggacagctgggcacagtggcatacaccagtagtcccagctactagggaggctgaggcaggaggatcacttgagcccgggaggatcactgaggggggagggaggatcacttaatctaggctgcagtgcacttaaaccgtacctacgaatagccacctcactctagcctgggcaacataataatactccattgctatttaaaaaaataataacaataacgcaaactgagggacaggatacaaaataattggcctattctcttccaaggtcatgaagccaagaagcaactgaaaaactgttccagatttagggagactaaacaaatatgacaactaaatccataatgccaaacaagatccttctgttgtaggtttttattaggaacaccggcaaaatttgaatagggcctgagaataccatggtaataatattttcattgttaatttcctgattttgagggctgtattgtggttatgtaagaaaatgctcatgttcataggaactacacaaaatactggagtatgaaagagcttcagggtgacaacatactttcaaatgattcagttaataaaggtcttctactctacttacaaggaactattctgttttaaaacaaaataaaatgcacacagtattctaactaccacactaactcttaactcttgctattattaacattattgcagttgtcagtctaggagagagaaagtatagtccctgtaaatgcctcaagtttatgactgctcctgaacataatgatagtaacatataagcctcaacactgctgcaaaactacacttctaggaagaggaagaggagaagggagaaaaggatgagaagaggtgggagaaaagcggacagcctgcaggagatttagccgggcatggtggcccctgcctgtaatcccagcactttgggaggctgaggagggcagatcacgaggtcaagagatggagaccatcctggccaacatggtgaaaccccctctctactaaaaatacaaaaattagctgggagtggtggcgggtgcctgtagtcccagctacttgggaggctgaggcaggagaattgcttgaacccgggaggtggaggttgcagtgagccgagatcacaccactgcactccagcctggcgatagagcgagactccatctcaaaaaaaaaaaaaaaaatcagatatttttcaatcttgtctctaaaagaaaatttgtaattacttctgcaattcccaagaagaaacaaaaaatctgacagtttacagaagttttctgcagggtagctttcatcatccccatcttactgatggagaaacagagtccagaaagtgcatgctttacccatggacacgaggattaagtagcagcacgggactagaacccaggccacccagatccaagaggtgagatcttaccagatggctggaaggatcaagccgtcagattaaatggctagaaggtgttagacaaatgaaaaaagcaactaaggacagtaaagagaggcatataaccacgtccctatggtcatctctttttgtaagctaagaccaatctattttatattttagtttaaccaccgacgctggtgttttagccaaatgcacctaaggcctcctaactggctttatttatgaagacctctgagctgaaatttattgactttattaagtttcttggcagactctggatcagacccttcaaacaaacagagaacacaatgacattacttgcagagtatgctcaccacagaagtaaatctggatgaatcttgttcacatgtacaaaactgaacactccctgagtgcagaaatgtcaaaaacaaactccaaaagcaaagcccaattacctcagggttcaaagtcaggtcaacattagatttaaggctctctcatttttcacaatctcttagtagtttgtattctacttgggcaaaaaattatgccccctaaatttttgcccaattaagttttgttcccgctgagtggagcggctcatacctgtactcccagcactttgggaagctgaggagggaggatcgctgaagcccaggatttagagaccagcctggggaacatagtgagacctcaactagacaaaaaatttaaaaaatgagccagggatgatggcgcacacctgcagtcccagctacttgggaggatgaggcaggaggatcacctgagccaggtaagttgaggctgtggtgagccctgatcacgccactacactccagctgaggcaatagagtgtgaccctgtctcaaaacaaacaaaaaaataagttttgttacttaaatttcatggctagcactaatacagagtcataatcccttatctaaaatccttaggatgagaggtttaccagaattcagaatttttattttagcactacagcaaatatatcacagcatgtaacaccccagcagtgttcatgtaataatccatattccatcatattagtatttttagagtaaaacttacacaaactcacacaaagtgaactgaattaagaatataaatagcctcctatcagttcaggttaggttcagccatcaaatacattttggcaccaaccttggcataaaatttgttagatcttcagaactttcatatttcagaatttaagataagagagtatggatctatattactatagatgctttatcagtattaataagtattctagattaaaaagaatgaaatataagtttatacctaataataacaaagtaattccatgccaattaccaagaaatccattcttcccaaatgttaaaggcaacaaattctagagtacagaacagtcagtcagtttcccactatcacacattattagttcaataagtggtaatccatcaggaacaaaaaaaatcagatccctgacaagatacaacattcagaaatataatgaccaggttagagaaaaaaataaaatgaagctgtacactgaaatttaaaaaggatctatgcaaataaatgtgaaaaaaattccaaaatttcagtgctgttcaatatgctaacaaagtatggaaaattacataaatcaacgtataactacttttggaaaatcagctctgagaaataaacagttccatcttaaggttcactttcaactgctcacttaaagttcctgcattatttaaggagacaacagtcatgaaagtctgcagtcatggaatcactattccttaaatttccagtggactttcctatatgcagtattgcccaggaccattacacaatcagaagaactttgacatttcctttctacattaacttacatacttacctaaataactcagggcactaagagtcagcatacagtacactatgtagccacgactacttactagtcctactcattaaaactgggggaaaactatataggaaaccagcttatcatacagcctcctccctcacaaacgtgaaacaaagacagaaacagaggtaaattctgcaagggtatgcaccctgggaattctaagaactgggctgtgcacagccagtttttctacactctgttaaattagatgcatttttggatcatttgagcagctgtgggaactatagccctaaccccaaacttcagagatataaggaaatgttcgggataacaccagcaagccaaggcagtaggctgcattagctccactgctgcaaatgtctacaacggcctttacacttcaactgtgagaagtttgagatttgcctcaaagtttacttataaatgggcacttaagtatttgttcagttcaagtcatccaacactactcaagcacttaaaacacacaaagcagaaggtggacatagggaacacaagtgtagaagaaaatcagtggtgactagaaaggtcactaagggaagtgattcaggatgcagatcctgtaagtgtgctgctatcatcatgtctctgtgttccttattgcatccatattttaaaacaaacccgatgggatgtattgccctgaaagactgtcagcagcacacaatgaaaaataagaaaagaacttgagtgagtgcctggtttacaaaggtaagttacatattacttttaataagcattcagcaaaacatgtataactaacatttgtaaaaaataattttggttagttgttacaaacctgagagttgaagagttaaaagacaaaagctactttagttaattaatataacttgtgcaacaggaaaactatcaagtgattaaataagcacaatatcactaaaataacatccaattcctttgtatctagagagaaatccaagttcaagcattttacaatttacctgggcaacaggaagacatgagaaggtagccaataaatgcatatgtaaaataaacatttcaaaatatcagatgcttaagaaatattaccactgaccagcttctttatcattggaacacggcatacttttgaaaaaacaaacaaacaaactcaaccatcatagttttctttcttttccttttttttttctttttttctcgagatggagtcttgctctgttgcccaggctgaagtgcagtggggcaatctcggcttactgcaacctccgcctcccgggttaaagcaattctcctgcctcagcctccagagaagctgggattaaaggtgtgtgccaccatgcccagctaatttttgtatttttagtagaaatagggtttcaccacgttggccaggctggtcttaaactcctgacctcacgatccgcccgccttggcctccaaagtgctgggattacaggcgtgacccacctacacctggccaagcatcacagttttctaaaggagaaaaggtactctttgatgagcattatattactatccatacatcaagcactatctagaatctagcttctgatgctgtctagaaaatagcatccaatattgagaggaagagagggagacagacagacagatacactaatgcgagccccaagagagctgtgggcagcttcataaaaccacaacaaaaaacacgttcccttctacccctacgttgactactcaacaacattctaagttttacatacggtttctgaaagtcctctagaaaaatgttctcaataaaatgatacccattttgcctttacacttaatgtagttcttttgctaacttctttgagccaagtattatttattatttatttatttatttattttttattcttttaaaagacagggtgtccctctgtcgcccaggctggagagtgcagtggtgccaacgcagctcactacagccttgacttcccaggctcaagcaatcctcctgcctcagcttcctgagtacctgggaccacaggtgcagcccaccacgtccagttaatttttattttatattttgttgagagaagaggtctcaccattttgcctagctaggctggtctcaaactcctgggctcaagcgctcaagcaatcctcccactgtggcctcctaaggttctaggattacaggcatgagccactgcacctggccggggatgttttatttccttctaaatcttcacatgtataaacatgtcttgggtgtccagagcatatattacttgatcagtggctaacatcctgtttttaaaatccttaataaaatatgcagtcacatgatcaatacagggcaagtatgaatatatacactcataaaaattcttccacgtgctacattaaagtagcatctatgacagacataaaaattgttaaattactctgaccctattgcttctcattttaaaaaaatagtaattcaaactgttacatagatcttaccaagatgttttgagaacttgatgtgtctgactcatactagtagtcttactaaagatatttcagtgtgtgttcctggagttttattaccaagagtgaacaaaacaaatgagtaaccaacaaactttccaaaattacttagtctttttcaatatggtattatggaaggcttgacagaatgtgaatcagggaaataatctaccaattcttaatacttaattcaaaatacagataaactaaaagtatatctttatcccaccttctttcaacccaaattttctcatttttctttttctgaataaaagtaaagagcaaacaaaaagccactttagatgtcaaagacattaattacaactcctcccaaagaagtttactgaaggactctggagtcattttttttaagtatgttactagtgtatgtccagaagcataaactacacacacacacacatacacacacacacaaatgagaaaaggaaaagagttctcaatgaatggacacaagtgactcacttaccttgtctcagggttatatcctaatatgtagaaaaatgaatccactcgggctttaaactctctagcagcaaatatgtcagaaaaatgggagatgttacacttccctctgggaaaaagagaaaaaaataattagtaataccctcaactgcttttgctaaccaaaactggagggggaagggtggaggaagcactgaactaagtccatgtgcatggagaatcggctacaaacaccacactttatttcacctattcagctgtttcatgactgcttcactgtacacctgtgtaatctgactgcttttatatcaccattttactaataaagtaaaattaattaaaacaacaaagataaactggagacaggactatgagaaagaatattaaacaaagtagaaatggagaaaaattaaaaccattgtgaatataagaaaaactcagtttaaagcctttctaaatcataaaaaaaaatgagcctttcttcctactatattatgataggcagaaagtttaactgtttaaagctaaaatgtggaatatttgacatgtctttggaatacagcttctggccaataaacatttttcttctcctgcaatgtgcaacaaataaagttacttggaaattaaaacctagagaaattttaacttttttgcataaacatgggccccaatatacaaggagttttcaaattttggggtaactttaaatggctataaggttagaaatcactttcccatagaaatactaaaataaagtggagtaaagttttcaggttcatttaccacctaaagttaaaccaacctgtagttgaaaaccctacaatacttactccaaaacggcttaagcaatgtttccatgcaccaagtatcaacgtaaatgccagaagcattatatcacgtggtgaggcctaacttccaaatccaaacacacacacgcacacatacactcactccaggattcccaaagaggcaggggaggcttaagaactctaactccctcctggtcactttaatgccaagtggaagccaaaggctacagtgaggttagatggaaatggaggaccaaaagttcccatttcatatcaaaagccgtgcagcatacttccaggacgtggcctcccactgcttgagcaggctatctgttgtgataagaactccatgagtatgcacggtaacaacatacacaccagctaatggccacagtgttaggaagagaagctggctgaggggttatcagcgtgggttcattcattcacttcctaccaagaaattaaaaagcaaggttcttctttaccttaagggcttaagtacctgtaaccaaagcagggtcagccaggcacagtgacttcacacctgtaatcccagcactttgggaggctacgacaggaggattatttgaggccaggaattcaagaaaaacttgggcaacattagttgagaccccatctcaccacacctggttaattttaaaattttttgtagatgggagtctcactaggttgcccaggctggtctcaaactcctggcttcaagtgatcctcctgccctggcctcccaaagcactgggattataggtgtgaaccactgcacccagcccccatctccattttttaaattaaataacaatgctgttgatataaagtccctttggcaactatagattagaaagtatctatagttctatagaatagaagctacagaatagaaagtattccagggttactgagcacttcaaacaacactgataaaactgagaactgaatttaaaattttatttgatcttaacaaataaattatttgatcttatgtaaatctaaatagctacgtatggctactagctaccatagtgaacaacacagatttataagacatttccatcacagcagaaagttctattagaagtgctatagtattcatacctactatttgtagatagtaagatccaattcaaggaaaaatacagactaagcatcaacttcccaggcccagaactgcctcttctagtatttaactagaactaaaataagcttctgggaaagaaaatgcaggtatgatcttttttacaaatgaacaactagctcactttgaaaccactcatccatacaaggtgatttaatccccgaaagccagaagaaataggttcctttagcagtaaaatagagataacacctactgcacttataaagacaaagcctacaaaactctactacacaatgctatgtaaagtaagttattcctattattgtacattactaaaggaaattgattcttcttttattattgttcgttatttcactcttaaactggagtaattaatgtatcaattaaaggtaaagaaaacccttaactctaaacacaaccactagaaatcaggtatgtttagggcagggtttatcaatcttggcactaatgacagtttgtactaaataattatttattgtcagaggctgtcctgtacattgtaggatatttaagagcatccttggcctctacctagaagcacccatacacatttcttcctcacaacaaaaaatgtctcaagacttgccaaatgtctcctgtgagggaagaaactactggcttacagaaagccaaaagcaacaggaatagaagcatttcatctgataaatgattatgaagttgtcgtaaatgggatttttctctaccatcaagccctttctctatttgattctgtttgtatatgtgaaaggtactgacatttaaacatttcacttttttatcctttcttatgcttctaattgcactgtacctctaatacaatgtggaaagagtgaacatccttggctagttcctgatgtcagtggaaatgtctctcatgtgttcctattaaatatgacactagctttacagacaatcaaaccataatcatagtattggaaataattgactggtttcctcctttagagttaatagtttgatatatgctatcaatagagtgaaaacctgaaccaaccttgcattcctggaataaatcccagctggtcataatgtattttttaaacaaggtattaaatttttaaaaaacaaaaagaatttggttaactacatctaagttttcttcctcccaaatttgtttttatctttattatttccttctttgtacatttttattgttgctattattcatgaaaggtttattcataatagcctaggaacaacccaaatgtgcagcaacagggaaataaacaaatcgtatatatgtacaataaaatactacacaaagatctagtgatacataaaataccatggacaaatctcaaaaattaaatgttgagtataagaagccagacacaaaaacagtatacactgcatgattccacttatatgagctttagaagaggaaaaaataatttatagtgagagaaacctgaacagttggtgattttgggtgggaagtttttagagggaaggatcttgagggaacttcctgagatgaggggaatatgccaggtcttgtttagggtcaaacacatttctgaaaatgtacacttaaaatctacattgtactgtatattaaaaaactactagaggaaagtaaaacaatgagaatcattaccatatagctgtagccatatggtaatgattcataatcttgccagttagccagccctcaaacactgagtattgagcagagctgaagaaagggtttccataaccaggtaaggccaccaggattggctctgactgggtggcacccatttgaagtattttacaaatcaactcgtgatgaacagtgtttacctttaaaaatgtgtgtatatgtgtgcagaagtatgggtatgattttaagtattcagtgttttttatcagagcactcttctcaccatgatctctgtcaaaagtaggacattatttgacattgtttacagaatagatgaggagggaccgttaagagaaaattgccatcacatccaccttgctgaaataaccagttccagagcctcctaaagtcttgtatactctgtatctaaagcaatgcttcactgttaacagaaatatgactaaagacagggaagccccatgtgttagcatcctttcattcaacagtaaaaaaggcgtcccggaaatgactcatttcagtaatccttccgagtggggcgggccccagagagttttacacctggggcatcatccgaagggtcttctggctaccaagaggaggtggctatatgaaaaggatgaagaagagacaagagagcccctcttaagtaaggagacaatacaaatgaaaactgtggcctagaaattcactctcttaaaattaccaataactgggaaggtcttcccgtatccccaggcatgcgcaaactccaaagactcaggacaacgtgcacgagcacacacagaatgtttacagtagcaaatctgttgaaagctattattatcattattaagatggagtcttaagaataaaaaattattaataataaaaaataaattattaataaaaaattcttttttttttttttttgagacagagtctcactctgacacccagactggagtgcaatggcgtgatctcgactcactgcaacctccgcctcccgggttcaagcaattctcctgcttcagcctcccgagtagctgggattacagacgcgtgccaccacacccggctaactttttatatttttagtagagacgaggtttcactgtgttggccaggattgtcttgatctcctgacctcgtgatctgcctgcctcagcctcccaaagtgctgggattacaggtgcaagctaccatacccagtctttttttttttttttttttttttttgagatagggtctccctctgtcacttgggctgaagtgcagcggtttgatctcagctcactgaagactcaacttcccaggctcacgtgattcttccagctcagccttcccggtagctgggactacaggtgcgtgccaccacacccaacaattttttgtagagctggggtttcaccatactgcccaggctggtctcagactcctgggctcaagcaatctgcccagcttggcctctcaaaatgttgggactacaggtgtgggccaccatgcctggacaaaaataaataaataaaaataaaaataaataaaaatatatatatataattttagtttgtacttccccttttgcccaggagttgcttaacaggaagttttaaatttccaggtgaaagggtcttctgttctttgttttccttagtaaactacaattttattgcattttaatcggaatgattttttttctgtgatctaatatatgaccaatttttgagaaggtggcaagatacacaaatcaatgtgtattctttattattacaggatagagttcaaagtatgtctgtaggccaggtgtggtggcttacacctgtaattccagcactttgggaggtcgaggtgggcagatcacaagaggtcaggagttcaagaccagcctggccaacatagtgaaaccttgtctctactaaaaatacaaagattagctgtgcatggtggtgggcgtctgtaatgccagctactttggaggctgaggcaggagaatcgtttgaacctgggaagcagaggttgcagtgagccaagatggcgccactacaaggatgggcgacagagcaagacttcgtctcaaaacaaaacaaaaaaaaaaaacaaaaaaaattaagattattagcttagggggaaaaagtccaaaactgtacaaaatctgtaacaaggaagatttttaaacactcctgaaagacaaaaaaggggatatgaacaatggtaaaacatccatgttcttagataggaaaactcaaactggcatttctccacagattaattaataaatccaatacaatcccagtacaaataccaacaagctttttttttaaaaaaaaaaaaacaaaatattaagcttcacatggaaaaacaaataactaaaaaagaggggaacatatattaaaacatactataaagcctctgtaattcagagtgtagtgctgacacatagacaatagaacaacaaaacaaaaaagcaagtacaaaatacatatggaaagcaagacaatggtgacatctcaaaccactacaatcaacataggtattttaataagtaatcctagaacaactgggtagaattattttttaaatatggtgtagggaaaggctttctaactatgactcaaaatccagaggcaataaaagactgataaatttgattagataaaaatacattttacacaataaaaaatacaacaaataaaattaaatgaaaactgacaaaagtgggagaaaaatatttgcaacaattgccatgtaccacggttgtataaagcactttttaaaagtaaaacaaaaagaaaacccaatagaaaatacataaacagacaatttacaaaaaagagacaaaaatatccttcaaacatatgaaaaaatgttcaaactcattgttagtgaaataaaataaaaacatggagataacacttctcacctatcagacttgtaaaaatttaaaaagacaaaacattctattaggaaaacaggctgcttcatacttatcagaaggaacacaaattggtacatgccagctgaagggaaatttggtaatatgtaacaaaccgcataggcataaacctttcaacccagcaatcccactattataaatgcaccctgacgttcccaatgataagaaaatatatatgcacaaagatattcattgcagcatcatttataattgcaaaatcctaggaacaacgtaaatgctcatgcacaagagagcagttatatcaactacagtatatcaacataaggaagtaaaagagaatgagaaagtcctctatgaactgataagagcaattcccacaatatactgtcatcaagtgaaaagagcaaagtacaaaagaccatctacagtattctacccttcatataagaaagacggggttttaagaaaagaggcatgtatctgctgatttgtgaaaagaaaatgctggaaggatgatccagcaagtaaaatgatcagtaacctagagcagcaaggtgggagcgaagagggaaagaagtagaggatgggaacatggtggcagggttgaagagtatcttcttataaccctgactcttagaaccacagcaatagtccacatgctctcacacacccataaaataaacagtccaggtcaacaaggagaaaccaaaaataggatgtaaacagcaacaaatgaacctaaatgtattacaaataaacaaatgcacataaggaggtaagaaagaacagaactgacctaagtaagaggaaaagcagtatttggcactataagaccgaaaacaaaaagagtcaataaacgggtttctcaccaagacgtgggttacaaattctgaaactaagttgtatgcatttgagaattaaacaaaaacaagtaagtatattttagacaatgagaactgagtttcttctgtgttggagaaagcagttataaataacggaaagtgaagaataaaatcttcaggccaggcccagtggctcacgcctgtaatcccagcacctcgggaggctgaggcgggtggatccggaggtcaggagctcaagaccaacctggccaagatggtgaaaccccatctctactaaaaatacaaaaaaattggccaggtgtgggggtgggtgcctgtaatctcagccactcgggaggctgaagcagagaattgcatgaacccaggaggcagaggttgcagtgagctgagatcacgccactgcactccagcctgggcaacagagcaagactctgtctcaaaaaaaataaaataaaatcttctagtgttggactggaattgaaattaatataaccttacaagtctggagttaggggaagttaataggcacaggctggtatacatacacatcctagctctgcctgctaactggatctagaaacaatgatatccagtagtaacacacatgcctaatacccagatcttggtttctaaacactgctctccactaaagggaaccccggttcctcacagaatggctaattccagcgctggaagttagaaaataaaaaacgagcctgagaacatcttgtggagctagaaataagaaagtgctcaaaaaaatacagaagtttgctgataaagtgcaggggccaatctgaagtagctcctaatggccaaagctgggcaataaaacaaaaaataataaattataacaaaacaaaataaatatccgtaagttcatgctgatgtaaatactcaaatagatttatgggataaaagggagatttctttactacagtggaattccaattaataagtgtagaagaaaagaaaaaaaaatgaaaaaccaccataggcaagcttcacaaaagtaacttttacaggtgaaatccactgataggtgcttaaaatcactgggtgaaaatttaaggagataaatgatttgcagagtgtcaaagtatctcccaggttaattaagcacaggggaaaatctgctttacagtgaagaaacctggcagaagccacattcatcaagtggacaaggtcaatgtcaccagtaattagacattatcaacctcatgaagcccatgataagatgcactcagaaacatgtaatttctgtggttcttgcccaaaatgcctaacttcagaaaagccaaattgagggacatttgacaaaacaattgatcaataatatttacaataccaaggaaggtcatgaatggtaaggaaagactggagaaccattacacactgcaggagactaaggagaaataattaaatgcaatgtgggatcccatataagatcctagaacaacaacgaggacattgctgaaaatcaaagagaatctttagtctaatgctattgtatcaatgttaattccctggttctgataactgtactatagttgtagaagaagttcacattgtgggaggttaggggagggatatattgaacctgagtacttgtaactttgctgtgtgtctaaaaatagctccaaataaaagaaagtttttcaaatactatgaagtactcaagggcagacggaatatcttactgggtaggttcccatcaccaaatatagagcccttcatctactagtagattaataaaaagtgttaaatgatgaatgaataaataaagcaattgacaggttatgatgtctaatgaagtactaagcatgtatagacaaaacaataaaaatgctgtaggtcaaagttatttcacatataaaaacaactgtagattaaagccagataaggattcttaaactgcaaaactaagagctctgagacaccatgaaactccttacagaacttgcaggagctaaagggtgttttttgttgttgttgttgttgttgttttttgttttttttgagacagagtctcgctctgtcacccaggctggagtgcagtggcacgatcttggctcactgcaacctctgcctcccaggttaaagcgattctcctgcctcagtctccctagtacctgggactacaggcaccagccaccacactcggctaattttttgtatttttagtagagacggggttttgccatgttggccaggctggtcttgaactcctgacctcaggtgatctgcccaccttggcctcccaaagtgctgggattacaggcgtgagccaccgtgcccggccactaaaggatttttaaatgttttaaggaatggttgggaaactgtccacagatgtgactaatctgtttcaagccctaaacatatacatgaacctagttgctcataacaaagtagggagataaattaatttataatgaaaagaaacagactggaagcctcaaacagctaatttagggctccttggccctggtcttccagaaaattcatcctaaagcatcttcctataataggagcccctgggtaaaatgacagcctataacctgacctgcagtaggatatttctttccccaagtgactcctccaaataggaagcaggtaatcagaaagctggaaaacagtcctcagtcagcaagacacttacgatctcctgtgctgccctccacaatcaatactggagaatgcactgatgcgagtacacaataaacccaagaatgttccccaggtcacatgtcctcagtccaatcacaaagcaatcactccagatccttggatccttaataaaacattatccttaggggagaaaaagtagcacagaaaacaaattacaagttacaagtttatctgctcgttcttggagtgtgttgagatagctccctaagctgaactcttctccatatacctgaaggaatctaaatatctaatccctcctccgccaacaggccacagagaaatagtaaaataagtgtatgctgagtgattacaccatcattaactcagtacaaaattacacttaatttcactttttcttttcttccacttatacttttaagaactcagcagaaattcaatgagctatggagtgtactacacatgttactagggcctgagatgctctttgagggactttcacactccttaccatactggatgtggaaccagatgtgtgtgtttggttcaggattctgtcattagtcatgtgaccttgaacaagtttgtcaaaggttagctcaaacgttaaaaaacgtgacactggccacaaggctacagcagagccaggactcaaacacaagtcctctaacttcagtctattataccacaatgccagccaaaaattcttacccgggaataaacagaactcaaaaaatattcaaaatgctaactttactctatggtggttatggataaagtgtgatgaaataagatcagcagctgtagaaacttaccttgaaaggtagagataagggatagctaaggtcaagaattcaaaactaacagcaatgcagtaatgctgaacttcaacacacatttctacaactgcgaagggctcagattttcttataggaagaaactctggtaggaaaaagctataatctcacaatttacaaagaaactacagggcattttgttttccttttgattcaccatggctaaaggataaagctctctctcctcctttataacccaactctagcaccagcttgaaagcaaaccttatacatcagtttcctcctgagtgaatggaatggcaagagccccctcagagttactgtgaccggatgaaaccacacaaccgagccctttgatcttcaagaagaatggtgctaagcactaacatgatcagtctttttcttttttcttttttgttccccatggtttttttcattacatttgtttgatcccttttcatgtgcccacagactattttatttgtatctctctcaaaattgaatttatttttagtagtactggtttataactatggagaaagaataaattatttctgtgaataaactatgagaagaaaattggaaaaaaaaggtaaagcttaactttaaccatcccccaccaaatacaccccaaacattttttaagctaatctaccttcgtgaagagaaagagaacaaacagagactgctggggggcactgccatcccattctgttttatgggagtaatgggacaggcaaagcttctttcacagtgagcgctgctgccaagagcgaggccggatcactaagtgacagcaacgcgaccctgcaccattagggaagtgcgtccacacacacgtgtgaccctgcaccactgggccagcacgtccacacacacacaaaactgcaccactaggccagtgcgttcacacacacgtgacaccacaccactaggccagcaagtccacaaacactcatgacaccacaccagtaggccagctcgtccacacacatgtgtgcaacactgcaccactaggccagcatgtccacacacacgtgacacaccagtaggccagtgtgtccacatatacgcgtgcaacacagcaccactaggccagtacatccacaaacaatcgtgacaccacacaagtaggccagtgcatccacacatgcgtgtgcgacacaccactaggccagtgcgtccacacacacgtgcaaaattgcaccattaggccagcatgtccacatgcatatgagacactgcaccattaagccagtgcgtccacacacacgtgacactacactactaggccggcacgtccacacactcatgcaaaattgcaccactaggccagcacatccacacacacacgtaaaattgcaccattaggccagcgcgtccacatgcacgagacactgcaccacaaagccagcgtgtccacacacacgtgacactgcaccactggatcagcacatccacacactcacgcgacactgcaccattaggccagcttgttcagtgaccaaacaaccacctgtcatctgatgtctttgaaaaaaatccaagtcacaaaaggatgttgtatttgacacttacaaaatcaaattcaaggtaaaagttttataaagcagctaccactttttatgaccactttaaagaaaacaccacaggagaaaaaaaaactaattaatgaggattataattatatacccagtgaaaagaagataaagtattaccactgtagcactccagctgtggtggccagtgaaaggacagtgacttacacatttacacatctccaagaaacatctgattgtaaacttagctacagtaaattcatggaaatcagatggaattatttaggataacttgttcttctaaaaatgctaaagataaaaatgggccagacgtggtggctcatgcctgtaatcccagcactttgggaggctgaggtgggtgatcacttgaggtcaggagttcaagaccagcctggccaagatggtgaaaccctgtctctactaaaaatacaaaaattagctgggcatcgtggcacatgcctgtagtcccagctactcgggagactgaggtaggagaatgaatcacttgaacccaggaggcggaggttgcagtaaagtgagccaagatcaagccactgagctccagcctgggtgacagagcaacaccccgtctcagaaaaaaagattctacaaatctcaataccaatgataagtactcaaatatgttgattttaagcatttatgtcaaaacatgttgaatacagttacatatctcacatatttgttcaactgaaactctaaatcgattaaaatcttttccctcaacccgtgagacaagacggaaacaggaaggaaagagtatgcaaaccagtgtaagaagtattccaggatttggctgagtgcggtggttcacacttgcaatcccagcactttgggaggtcaaagtgggtggattgcttaagtttaggagttcaagaccagcctgggcaagatggtaaaagctcatctctatgaaaaatacaaaaattagccaggtgtggtggtgcacacctgtagtcccagctacttggggaggtaggattgcctgagcccaggagtttgaggctgcagtgagccataatctcaccactgcactccaggctggacaacagagcgagatcctgtctcaaaaaaaaaaaaaaaaaaaagacaagaaatattccaggattaagtcatcggtcccagctaacaatattccaggattaagtcaccggtcccaggtaacaatattccaggattaagtcaccggtcccagctaacaatattccaggattaagtcaccagtcccagctaacaatattccaggattaagtcactggtcccagctaacaatattccaggattaagtcactggtcccaggtaacaatttaactgttccatcaatataatcaaccctgcattaacttcctttgttcagcaagtgagcttaagcttggaaagccaatcttaaaagtcacacaaagcttgtggaagttcacaagaagtttataaaacactgagaaactctctaaattcatctaaattcctgtaagaagtcaaacctaactacatccatgccataccccacagcagagttggcaaactatggccagaaaagccatatctggcacaccgcctgcttcctgtggcctgagagaagagttttcccatttttaaatggctgaaaaagaaagcaaaagaagaatatttcctgacacatgaaaattaaatgaaactcaaatttcaatatccatcaagttttactgcagcccagccacttcatttatttccatgttgtctattgcttttatgccacaatggctgagctgagtcactgcaacagataccatgtgaaacatcagctgacccgaaaagcttgccaaagcctgccctaaagttgctactaatttaccttgaaataactgactttagctatgtagctttgcaaaaaagactccaggtggttttcctgaataccatctgagcatcagaatggagaaattattgtaactcattgtagttttaagataaaagctaccaaaatcctagtattttgttaaaaccatattacagtacttaacaaaaaaaaagtagtctttcaccactttatttccagtgaggaaagggttttaagaatatcagtagtcttacttcctataccacttaaaaggcacaaagtcagccatacacacacaaaatgagccattatgggcatccttttcttgaaagagacagaaaatacccaaagatgcaaatgtcatggtcatttttttgacataatttctgaagacattatgactggctggaatgttaccttctgcctcagaatgaaatcttcaatatctttctacccatctcctccccctgccaatgaagctgtatagtaggaaatttttcagacatacagaaaatggaagaatagttcaatgaaaatctctataaattttgcctgggttctcaagtaattacacgctgccatatctgcttcatccatttctctgtcttttctagtggcaggaattaaatctttagaaagtaaactgcagaccatcagaacactttttcccacctcagcttcccaaaatgccaggattacagatgtgagccaccacacctggcccatcggaacatttcacccacatacttcagcaaacaataccaggataataatttccaaggaaatgaagatacaataatatagaaacagcattaaaaagtaaattatcaaaaaaaaaaaagagagagagaagtaaagctagattagtgaagacacggagaacctctgcaatctcaacaatccagagcggacactggcatgttcactgaggccaaaagaggagtctgattaatacagtgactactaaaagatcaggagaaattactctccacctcctgcactcagtgactcctccttcacatggaagagcacgtctccagtacttacctaagggcagcagcatggtaagtgtcaacgtaatcagaaatgaagagctctcggttcttgataactgggtctgtaatgacaagttctcttccagagtctgtcaaaaaattaattaagacgacattaaaactgagtttcccaaaacaagtaaaaaaaatttgtaaaacttttctttcacgtttaccacccactaaataaccgggcctggttagcatcgttaagtatgcaaaatagagaagaggaatcataaattgcaagaataacaataacagaatgtacagtttttgtcaacaaagtatcttcttggctatgttttataccccttagtaagaccctatattttgccaaaatggattaagcacaaatggaaaaagaagaaaaacaactatcttatcctagcacctccttcaactaccaaaatacttagtgatcctgtcttatttttcttgctaaatattacaaaatggagtgaacttacacagtttccattgataagaatatttttaacaaggaactataatttacacgctttaacagaggtttttttatagtttcaaagaaggaaaaaaaaaaaacagaaagataaaaaaagaacatcattcttccaagctgtttttcattggtttgttgactgtgagaaaagtggagcaggatcagggccaggcaaagtttgatgccagcgccagcactgccacttagacaatgcatggccccagcaacgtccttagcatctctcaacctcagtttcctcatctggaactagagagggacagacccacctcacgtgactaactggtagccaatgtgaatcatcaagcataaggcctaccaacactccaaaatccatttttcaaaaagttatcttcatttaatgaaatgtctttagaaagaactttgcccaaagctaagaaacacacaaatcaaaccacaaggacatatttaccattttcattatgtcgatcctgaaccaaatgctgatacacagaatctggaacctcagattgacggtagtaccatttgacgttcatgaggagatggtccctcttactctgaaaaggaaaatctaacagcattaggaacaggatttcaggtggccacaagtgcatatcatacccatgaccaaaagcccctgtaaacgggtggacacgtagatagggagagacacaattaccatcaggaccacaacaatacataagtcagttatgaggtcaagttttgttttttaaaaacacccatcaatagatccctctcaccttacccctctaaactgcttatttcaggaaacaaaaggagaccagtcttgaatctgtttatctccccagtttaactaatccattcaaaattacatttttatttaacattaactatacaatactacattaatatatccttctattttaatctttaatcattttggtaaatatttagagtcagtgttagctgactgtcaaggctcattaagggcaataaggctagaaagaacttaccccacaaggcctggcacaaaataatctcttctccaaggtttgcctattacccagactaaatcagattctccttccactgtttagccacagttattgttaagtgccaaatgaatatagcgaagaatgggtggtgatgaaggtactatgagtccagagacctcatctcatttatttccgaatctccagataatagaacatcttgtataaaattatttgtgaataatgaagaattttatgattatcacataaatgatcctgtaaatgtttgtaggacactgcactatgttatccctaaaagttaattttgttcccagtttgttcagagaataaaggatcaaatattgcccttccattagcaagttatggggctgcagcttgcaaaagatcatctctgtggctggtcaagaaatagctcaacagggagtgcactgaggttccctgcggcctcctaaaatacttttccaacccatgtgcggccttaacaggcttctccaaggtgaatgcagtatcatgcctttcagcagcctctacgttctcatcacaggcccgttggtcagtaatgaatgagagctaaaattcaagaaatgcctcatgtttataaaggggatgcctaaatcctaaaatatgataaaagagccctcattaatgaaggaagatgcttcctgctttaacgagcaagtcacaaatatagccaacactaaaacaccaggaaggttccaaaaaacctttgctaaaaaacacttaaaagccatttaaagaatcagaaagatgacaattgccacaagtttcaacagaactcaaatgtgaagatgtgttatttcttttttttttccttttcttttttttttttttgagaaggagcctcactgtgtcgcccaggctggagtgcagtggcgtgatctcggctcactgcaacctccacctcctaggttcaaacgattctcctgcctcagcctcccaagtagctgggattataggtgtgtgccaccatgcccagctattttttgtatttttagtagagacatgttttgacaatgttggccagactggtcaggaactcctgacctcaggtgatccatccacccacctcggcctcccaatctgctgggatttcaagcatgagccaccacgccggccgaaaatgtgctgttttaaagtaaatacaaaaattagccgggtatggtggggcatgcctataatcccagctactcaggaggctgaggcaggagaattgcttgaacctgggaggcggaagttgaggtgagccaagatcgtgccattgcactccagcctgggcaacaagagcaaaactccagctcaaaaaaaaaaaaaaaaaaaaaaaacagaacaaaacaaaacaaaaaaccaaagtaaataacataaataccaagattctttttttgcatttaactgtgccaaatacacatgcctacaaaaatacggcatcatcactggtttaattacactttatacatagaataatcctacatgatgagtactctttaatatttatgcattttatgcctttatattaaaatttctgatggcaaaaaaaactttctacactgtttatgcttcagatgggaaaaagaggacataccagtatgttaaataaatagaataaatgttacatgtagcagtttagagaaataattactttcagcaggggattatggatgtgctaacatctgacttgagaaaaaatgggagagatttcaatgaattttttcattgaaataaagatagacaaactactgaacatatccagaccccacagtccatctgcatgcatcaacgaagccattctggggaaatatggagaagaacctgagtcctgactctgtctggcctttagtgagcttacaggacaactggagttttctaactctattgctgaccaaatacacaggcagcaagggacaaatcgccaggacatgggagagcagctagaaagtgtaggagatcaggatataccacctcaaaatatgctctctggcacaaggattatttagccaagaacttaagaggggtagaggaaaaattatattttgtctccaagaaaacttagtttcttccctcggcaggataataaaaagcaggaccaggataagattactcattatagaaaaaatatatataaaccaggggaagaagcagcacctgtttggcagtgcttggggatgcattcagttaaaatacgctgtctataataaggacttgctcaacctcagcactactgacatttgggccagaggattctttgttgtggggatctgcctgtgcactgttagatgcttatgacatccccggcttctaaccactaattgccagtagcacccatcgtccagttctgacaaccaaaactgtctctaaacattgctaaatctcccctgtggggacaaaattgtccctagttgagaaatcactggtctagtaattcattttgttttgttttttaaggaaaacaaaatcagaatggcaaaaataaaacctggttcgagcactacagggtagggaagatggcctactggaaagaagatgggaaggcctgtggccccctccaatctcaattccatgacttcccatgtatgtgacttggggcacattaccgagattctcccaatctccccttttctgtaaaaaggagatactgaaatctacctaaaataattactgaaagaatagaaaagacagaaagcatctagaactgagtaggtgctcaatgaatattgtttcctctattggtaggtgattgtaaccaatagttcacagaaaaatctgaagaactgtgccgagaagtgtgggagttacttcttcaccagaacttggtttcctacaagggatgatagtgatctctagtcactgagctactaatacatgcttcagtgctcacagaaatgtattacttcactgagcatacaggagtccagatctactagcactcctaacaacaatcttttaaaatctaccatctatgtatttctgcaacacatttaagacatctgaaaacctgaagggcaacagaaataccttttagatacagtaactcaaatttgtacaatgtctatctttcagaaccaagccagggatactggtgatcttctgaagtacaatatctatgttatcttatggtgtaggaatacctactgattacacacacaaataaattaactgctttggtttatttgtacctagatgtatgactcctaatattatactttacaatggcagtgaaggaactattggattccccaatgcagtactatgcaataaccagggagtggcagcattgtgctgaaaagacttcacaatcaattccacagataaaacacacaaaggtagactggaagtaaacaacaatttgaaacaaatttaagtagctgtaatatccacaatctttctaaataggccggtaacttaattaaaaatgaaaagtccataaagggaggcagtgtgtggtttcagcagtactagattacaattaggtaatctaggattacagttcagtctgcaactgctagttgcaacctgagtggagtcccccaaccctatgaaaagtgaaggggtggaacaaaattgtttctatgctctctttccattcttacatgtttatatctagatttcctcctcaaacaaaaccaagtagataaaatgatgctgtgggagaatctctaattttttctctgtatctgtgcaatggcactggctaacggtgccatcctaaaggtttacaaattaaaatgtcaccttcagtggaagctggccactgctataatactgagggaagaagagagcatcccctccctgagtaagtgttcccagagctacctcagacacaaaagtattgctagaaagttagacacaggtaattatgtaattcctactactcactagttgaagaattttgttcaaaatcacagaaaattaaagccagacgtgaatttagagatcatgcgattcaagcaaaactgtctaagtttgaatcctggctctgcaacttactaagctatgtgactttgggcaagtaacttctccaagcctcaatgctctcatatacaaaatgggagaaaaccaagtttctaccttatttggttgtgaggattaaataaattaatataaagcaagtggatgagctcaaaaaatgtcagatattactatcattgttttacagaaaaagagagcagcaaagatagagagaaaagaggtcccttaaagtttttgcttttctaagattcaaaattatgttagtaatagtgtcatacagcaaattaagaggaaaatgtcttcatttttccaacaattctagaagcttgtcaagaatttctcaacaaataagcctcattttttactaccaatataatttaacaatggcataaatgtcaaaatgtttataaataatatatttcaaacagaatgcagaataaagagggaagtgaagcttcctgtgtgaaagcaccctagggtgtacttctgaatagtaagaggagaccactgggaagtaaataacttctcaccagtttgtttgtttgtttgtttgtttgtttagagacaaggtctcactctgttacccaggctggagtgcaatggcaccatcatggctcactgcagcctcgacctcccaggctcaagtgatcctcccgcctcagcctcctgagtaagtaggaacacaggcacccagctaatttttaaaatttttttgtagaggtggacatcttgctatgttttaagccactaaacaggagcacatccaatctgcttaacaataaagtttcaggactctgggcaaaaaaaaggggagggggagttgtttctgggctaaattatagaccctggctggatttctcttgaaatgaagaacatatgtcgatttaaggagattaatagaggacaaaatccatcccccaaatctgggcttagaaaaaagatccttatggtagctatctgggagcagaatagcaaagatttctacacatctttgaataacagacaatagtctgttgagatttaacaaatttaaaataactgaaatgaaacactcagaactagataactgacaagcggtagactaggggaaaaggaaggcaatggaaacaggcaaggccaagaaaaagttgctgttgaagggcaactgtgttgtcatcagcaacacacaacacagtctgcccaaacacagacacagggtctaacgttgagatggaaacttcctttcctagagatctttcatgattattaatttagtgttttatcaatttaaatagcctgagtctttcctagaaacagtcttaatatcagcctcagggcaatgtttttccacaacataaaaatagtaataataatcgagggggtatctggatagttcataaataccaataggactagggcagagagagagagagagtccttcacacagaggtggcctgcaagccagacagaacaactgtaaattcacctacgatacagaggaaagagcttctttgtcccactgatcaccagctgatgatacctgccaccagctcacagcagggattatcaggtccccaaagcctccaaaacagaccactcctgtccctctgtgttatcaaatgtgacagagatatcaaggccaaagacagcctcaacagagtacaaagatggatattagcaaataaataactttgccaagtcaaaacaatctgctggagagaagaggagtaacctcctgcatatatttaactgcttagtcatgggggctcttgattcagaaccaagtgaaatcagatcaaaattcttactctataagccaatatagccaaccaagtttctccagaaatttgggatgaagtggctaacatgtgtatactgtatggcttaaaaagatactttctgaagaaacttttcatgcatttccacaacatggtgataataaggttaagagttgtctgaacattagaggtttactgtataattcagaaatgtatacataaaacttttaattggtagtcagacactaattaagcatacagaggggggaacaccgtctcccagagacatcactatctcccttcaagtgtgctcaccaaccagtttaaagaggcattaactctgccagttgagcccacctccacttacaggacaatgactgttagacgtgtcaccttagctaagaccttggggacacagtcataatggctttgatcattcctgacttcaagggagaagggtagggacagacaatggggtcaaagatcactattcttcaaagatcaaagctaactccagatacagactgagtaacctcttatccaaaatacctgggaccagaggtgtttctgatttcagaattttctagattttggaatctttgggtatacataatgagatatcttggggatgggacccaagtctaaacacaaaatttatttatgtttcatataaacctcatacacatagcctgagggtaattatataaaacattttaataatatatgcagcctgtcacaaaggtcagatgtggaattttctacttactgcatcatgtcagcactcaaaaagttatggattttcaaattagagatgcccaacctgtatttatttacacaggtaaatcaaaactaaagataagctttctgtaccagtcatagttacccaacttcatggataaatatctgaaattaaatttaattcaattaaaatgaaattagatccaggaatcccacttctgtgaatttaccaaaatatttaaaatcagtttgtcaaagagaagcctgcactcccaagtttatcacagtactattcacaataaacaagttagggaatcaacctcagtgcctatcaacaatgaatggagacagaaaatgtggtgtgtgtgtatgtatgtgtgtgtatatgtgtatgtgtgtgtgtgtgtgtgtgtgtgtgtgtgtgtgtgtgtatatatatatataaaactactattcagtctttaaaaagaagactcctgtcatctgcaacaacatgaattgaactggagaatattatgctaagttaaataagccaggaattgaaagacaaataccacatgtgcttattacatgtggactcaaacaacccaactcacagaagtgaagagaagtggttacagaggctgggcagtggggggaatggggagctaatgctcaaagggtacaaaatctcagtaaagaagaataactgggttttttaaatgatcgactgcacaacatgattaatatagttaataacagtgtattgtacatttcaaaattggtaagagagtaaatttcaaatgttgccatcataaaaaatgataattagcttgaattattctacattgtattaatgaatcatacatcattttgtactccatacatatatacaattataagttgtcagcttacaacaaaatgaaattttaaaaatgaaattagataggaaatatcttgtaatatttcaagcctctaccctatttaacataagactctaagaatgcccgggcaccgtggcgcatgcctggaatcccagcactttgggaggcagaggcaggtggatcacctgaggtcaggagttcatgaccagcctggccaacatggtgaaaccctgtctctactaaaaatacaaaaattagttgggtgtggtggtgggtgcctataatcccagctactcgggaggctgagtgaggcagtagaatggcttgaacccagaaggtggaggttgcagtgagcggagatcgtgccactgcactccagcctgggcaacaagagcgcaactctgtctcaaaaccaaacaaacaaaaaggatctaagaattttacatatctatatatattatccatataactttacagccattacagctcaaaacgccaggaaagaggtatagaaaaacctaaagcagagtataccaccaggcctcaggccatcaaggttcatgtatcccagggttctgctctgacatggggaccagtgggtaaggggaaaaactgaaatactgactccacagactcttctcaggagaaagaaaggactgaatatactttataattacaccatcctatacacatctcccaaatgcactgagtcattaaacattttgtttcattttgagagggcagagtgaggcctcgcaagtaaatttcttattgccattgataaagtatccactcttgtttgatcctggaacaccttctcccaaccttggtgtattttagtgtagcgctggaactgaacagacctaaaaatccacagggtcgtcttctgcatccactctcagtggggcctgaatccacctatggaaggaccacggctgtggcacagctcccctcaggtggccacacaactcccatttctaaaataccttaaaacaaggggcaggtagaggaaaaataaaacaaaataaaatacctgggctgggtgtggtggctcacacctgtaatcccagcactttgggaggccaaggcaggtggatcacaagttcaggagttcaagaccagcctggccaagatgatgaaaccccgtctctactaaaaatacaaaaattagccgggtgtggtggcgaccgcctgtaatcccagctacttgggaggctgaggcagagaattgcttgaacccaggaggcggaagttgcagtgaactgagatggcaccactgcactccagcctgggcaacagagcaagactctgtctccaaaacaaaaaacaaacaaaaaaaaacctgaaaacaaaaattaaatgggacacagaatcctgttggtggtaacatcacatttattagcatttccaaatgggtatacctggaactactggtacatccaatatatagcagacttctggagggatctgctcacaactggaatagtaattttttttttttttttgagacggagtctcactctgtcacccaggttggagtgcagtggtgcgatctcggctcactgcaacctccgcctccagggttccagcaattctcctgccttagcattctgagtagctgggactacagcatgtgccaccacacccagctaattttttgtatttttagtagaaatggggtttcatcgtgttagccaggatggtcttgatctccagacctcgtgatccgcctgactcggcctcccaaagtgctgggatttctggtgtgaggcaccgcacccggccagaactagcataatgaatttttaaagagaagttaagtagatgaaagaaatagaagaccatggccacatccatctgactaggctgcttactgcttgtaggcactaggatcaaggttagaggctcattttcaaaacctatgagtggtattcaattcaaaagactgttgtcaagagataacatcagcatctgggtctgtgtgaaaggatttaaatcaccttctatcagatgttgaagcatgaagggggaatggtaggaaggcagatgactattcacagtgtttacaatcaagatatacaaataactggctacatacaaacactcagaaagatgatgtaactatgaatgtactgaagcacaggctcagatgatgggcaataatttcaaaaccactgtttcttgatgatgccttgtttgttaaacttctgccgctgttaaattatttttacactttaatatggagaaaaatcaaccaatattttggtaggaactaaaacagtgcatgaaaactaaatcatctctgaaatgctagctaaggagtcaaaactcattaaggattttctacttaggattatattgtgtatgaacactgaaattttcagacaattcattcttgtatttgtttgtagcagagaggccaaaactaagcacaggtaaaaccttgggaatatttgtacttcttgccctcatctgtaaactacaaggctgggtaactagatgacctctgttgtccttaatatcacacacacacagagataaactgtacgtcaaggggacttagcagatagggacagacatagcaaactaaagagcacttctgtagctccccaaaagtatcccacaatgtacttcaacctgactgtggggttaatatcaggtgtctgaactggattaagggacatctagatagttggtaaagcattatttctgggtgtgtctgtacaggtgttcctagaggagactggtgtgtcagatggtagcctgtgtgggaagatctgccctcaatgtaggtgggacagcatctaatcggctggggtccagaacagaacaaaaaaaagcagggaaaaggagactttgctctctctccaagagctaagacacctttcttctcctacctttggacatcagaactctaggtcctccagcctttggactgaggactcacaccagcggccccccaggctctctggccttcagcctcagacagagttgtactataggttcctttggttctgaggcttttgaacttgaactgagccatactatcagcttccccgcatctccagcttgcagatggcctgcgatggtctaaatgtttgtcaccctcagaaactcattctgaaacttaatccccaatgtaacagtattaacaagtgaggcctttaagaggtgattagatcacaaggagcctgataactcattaattcattgatgcattcatgggttaacgacttatcacaagagtgagtctcttataaaaaccaggttggctctctcttgtgagccctactgtcctggatgccttctaccacattatggcacagcacaaagccctccccagaggccaaccagatgcagccccttgacctgggacttcacagcctccagaactataataaatttattttctttataaattacccagtctcaggtattcagaaaaaaagactaagacatggctatcatgggacttagcttctatgatggagtgagatttattattcccttaataaatcccctctcatctgtctgtctatccatctgtctatctttctatccagccagccagccagccaattggttctgtctctctggagaaccctgactaatacactgacaaatactaaatgtcagattcagctttaaaagttcagttttgaagggtcaatttggcaagacgaaatttcgcagataaattaaaatcctacccttggacctccaaaatctgctgaccaaacacaaaaatgaatcccattctaaacagtattctcccagcagctctggttttatcagatcaacattctgaagcacaaattttctctttggtccaaaggatttctcccataaaggaagaaaaaaatagctattcgtagagagtgtaataagaaattgtcaaattcccccttaatccctactaaagctttaaacagtccattaaatttctttaaaagcaaaaaaaaaaaaaaaagagtacaaatatcacaaaatttgacatttttgtaataatactttggttgttgtttggtgacggcggtgatggcagtgatattattcatttggagggaattaatgacttcttacacatgacatagccagaaaagttacagagctcaaccacacatcaatggtggggtcagactttgcggtaatgagcaggatgtcaaagaaagggtggggaatttctcacattatttaacatcacattattttataagtaagacttaccaacttatgattaaagatacatggcagagattttacaattaaaaaccgatgatgagctaccatgataatatttccttgaggttgggcacagtggctcacatctgtaattccagcactttggaaggcagaggcatgaagaccgcttgagcccagtagtttgagactaacttggacaacaaagtcagactctgcctttacaaaaaatttaaacattagacaggcatggtgtcatgctcttgtagtcccagttattctggagactgaggcggtaggatctcctgagcccaacagctaaaggctgcaataagctatgatggcactgccacactccagcctgggtgacagagctagaccctgtcttaaaaaaaaagaaaatattttattgactcaatacactttttacagaaggacctctcaaacatcttaagcttcaagattccttagattcttaaaaattattaaagagtcaaagaacatgggttatagcttatcagtacttactgtatttaaaaataaaaaaatttctggctgggtgcggtggctcatgcctgtaatcccagcactttgggagactgaggcgggcggatcacgaggtcaagagatcgagaccatcctggccaacatggtgaaaccccgtctctactaaaaatacaaaaattagctgggcatggtggctcgtgcctgtagtcccagctactcaggaggctgaggcaggagaattgcttgaaccggggaagtggaggtgaaagtgaaattgcgccactgcactccagcctggcgacagagtgagactccatctcaaaaaataataataataaaaataaaaaaataaatttttttgtaatttatgaattcattaataacagtaataaacccactacatgctcgtgttaacataaataattataacaaataactataatttttagaacgaacataatgtaggaaatgagtaacacttttatttctgcaaatctcttttacttctggcttaataagaaaacagattcccatatctacttctgcttctgtattcaatctgttgagctatatcacacatcatttagccttttgtggaatgcactgtacactcctgagagaatgacagtgaaaaaaagcaaatgacgtcttggtatcattatgaaaacagttcaaccctacagacccctggaccatagttaagaatggctggtctctgagatgaagtcgacaagctgcacagatggctccaggtgccctctcttttagacacaatcatttaaataaaaagtatgctcccgaaacagcacaatgactagagattttaaggcacaaattcatttagatgtcagatactattaaaaaagatttcattattatttatacaaccaaacactccagacattccagtagagagcagaagttacacaagaagaaaaatctaaataggaagctctcattgtcaaatttaaggtatctttccaaaaactgagctcaggatataaaagaaatatttaaagcttgattcaaacaagtatttgtctacattaaaaaggtatactactttaaaacaacggtgaacccttgaagctgaaagcatgcagaaaataataacctagataatttccgctattccaggcaactttctggccatttcaaaaatgatactgcttcctacctgagaaaactggcatcattaaacaaaacctttaagaaaaagaaagatattagcttacaatgttaactgaatcatatcttttataatgactaatatacctaatttatgtgaatctagcaatattccgccctctcctggtgatatgctttttgtaccactgctgtctgaattaaaccctgagtgtagagttggtaacacagtaaagtaatttttagcaacacaaatatttgcacttttaagaagcactagagacacagttttagaaattactgactcaaaagttggcctgcataataggaatccaagtacagccagcaacttaccaataaacaaattcaaatagttggataagaaaagggaaaatcagcaggaacactaaaaaattatattttcctggtttacgtaaatcagtctgtcttatcttaaatatcttaattatttcttctcttcctttaacttaaaccaaaacaaagacggtaacctttaatactagttagtctatttataaccgttccatctacaaacatttttctaatacaaacatgccctgatagcttatcttggtgcacatgccagacaacaaaggcccactggcctgctggagaggagaaatggaaagcaggaaatgagaagccttagttaatctccaaataatcgatcagtgtattcagtcaagtgtgagctgagctgggaaaatgctgctttaaaaaagaaagaaagaaaatcaaagagcatgtgactggagccacaattcattttaaaatagggtaatttttgtcaaaaagattctgcatcacgttcaagcaccaacaacaacatacggaaatgttcatatcttctgcagtaagaccccttcctttaaaatctcttgtcatcttttttcaaaaacaagttccaacttttgggctttgtttcttatttcagtttatcttaattattgaggtataatttacatacacacaataaaattaacttattttgtttctactagttttgacaaatgtatagagttgtgtaacctccaccaaaatcaagataggcaacattcccattaccacaaaaagaccaacttccattacagaatcaacatttgctgtgatgaaaaggctttgggtgccagtgttgccagaaaagcaacattctaatctaacttccttcctccattttagcacacagagaagttaatatggagaaaaacaattcagagtctgctgtgactcttctatctattgctagagaatactacagacaggaatcccatgatctttaaatcaagtaatcggctagataaaacttctgggctaagaggtaatatggtctcaggaaattcctagaacatacaacagttttagcgacaagtgatataaaaataaacaaaaataatttcaaattagatctgagatatactttcctcaaactatataaggaatatttattgggcatctgctaggcaccagacactgttctggagatggttgctgagtatatagaagtgggaaaaacaggaagtcccagtcctggtagaacttccattccaatggaggagaagaccccttaccaattcccccaaccctctcctctaaaatgtccaataacggttaagtgcttttagaaagttatgatgaatgaaatctgccacttagtaaccataaatcctaggcaagtaacatttatttacactgttatttaatctctttggatattattttccttaaaattagtggtcttctcaaaagtacttcaggatagcaggaaaaactgtattgtgacctgatatgtcatatacagagacaggtttaaataaccctaatgattccatacaccagtttctctacctacaggacctaggaggaaacctaaatgtcttgcttgcttgctatcctgagcgtgttcatgaaaactcccaaaggtggctctactttcttgctttatctttcttatttttctttttaaagttttattatgaaatatttgacaggcagaaaggtataaaaataacagaaccatctgtaccaaacatacctaaagcaacaaaaacattatcgaacctaaagaagctgcctgtggaacctgcctacagcccagaggtaaccaccaccttgaattcactgatcattcccatccagtacttcatgcttttacttaatatatatatataactaaaaatacataaggtattattttgcatgtttttatactgtacataaatgacactagactctttgagttcttctataatatgctttgttctttcagcattacacttacatgatccatccacgccctagttcacttattttaagtgacatgtattaccttcatatacagcacatcacaatgtgttcatacattttcctgatagtagacatttgggtcatttccagttttccaccattacaaccttggttgtaataagtattcctatatatgttttcacacataaaacttttctattcaaattatttcgattactctgaatgtttggtatcacagctaagtgttcaaattttggtattggtaaaatgttgttcacagtgtcttactaagtaatttaaatatatattaaaggctaaaaaagtttatgtctaagcatggttttagataaagccattaactgtgatgtgttgccttttatttctggagacagtctcactctcacccaggctgcagtgcagtggcccaatcacaggtcactgcagccttgacctcctgggctcaagctctcctcctacctcagcctcctgagtagctgggactccaagcaaatgccaccacgcccagctaatttttgtactttttatagagatggggtttcaccatgttgcccaggctggtcttaaactcctgggctcaagcaatcctccctcctcagcctcccaaagtgctgggattatagacatgagccaccgtgcccaaccaatgtgttgtatttccattaataattcactgcaaaatattttctaatttccactgtgatttcttatttgacccacagactatttagaagaatctgggttccttctacacatctgtgtatttcccaggtactccttttggtcttgattcctagcttagtagcactatggtcacagaacatgttctgtatgatttcaatgctctgaaatatgttaagactatgatctatatatagtcttttttttttttttttttttttgagacgcagtctcgctctgtcgcccagactggagtgcagtggcacgatctcggctcactgcaagctccgcctctcgggttcatgccattctcctgcctcagcctcccgagtagctgggactacaggcgcccgccaccacgcccggctaatatatttttgtatttttagtagagatagggtttcatcatgttagccaggacggtctcaatctcctgacctcatgatccacctgcaatattatatagaaatgaaaatactgcaacttacaaaaacatgaatttcacaaacatgctaagccaaaaaaatcagacacgaacaaatatatattgcatttcattcccttcatatacgaagtacgaagacagacataactaatctgtgatggcagagctcacagcagtagttacgcagttagtggctaggagagggcacgagggtaacctctggagtgcacacattttatttcttgataccagaagttagacagatgtgttcactatatgaaaattcactgagctttctatttagaatgttctttcatgaatatatattagacttcaattaagtctaatttatgaaattaaaaattaacatctttctaaaattaaaagtctaattcgcaaatgctaaaatttacatacacatatacacattaacacgtatgcacatgaagtatctctggaaagatacaagaagctggcaacaattgttgcctctgaggaggagaaccctaaaacaacttataccaaaaagtaagaaagtgctcaaagaatgtgaaagacacgcgaaactcagcctgaaaggacagacctgctggactagttctgctagaacaacttgagaatcaacacataatgttagtaatagagtagaaactacaaagaaaaccagaaatcgtgcatccttgctgatataggtaaatgaataaagtgaatagttgctaaataaccggacactttcagagtcacagggcacctttccataaaatattaactgataacaaaggatgaaaaaagtaacctttttttttttttttttaaagacactgttttgctgttgtccaggctggagtgcactggtgcaatcacagttcactgcagcctcaacatcccactctcagactcccaagtagctaggactacaggcctgtgccaccacacctggctaatttaatatatatatatatatatatatatatattttttttttttttggcagagacagtgtctcactatgttgcccaggctggtcgctaactgctggctcaagcaatcccccaacctcggcctccaaaagtgctgggattagacttgggccattgtgcccacctcaaagaaataactttataattaacttttgggccttgtaaacccaatcttaagtgatcaaagtgaatgccagtaacagaaggaaccaaaattgtgccctacttggcagggtacaaggaaaagatcccaaacctgaatctaataatgaagaaatacgatacaaatgaaaactgagaaacattctacaatgtaactgaactgcaatattcaaaagtgtcaaggtcatgaaaatcaggggaagactgaagaactgttctaaaatgaagaggattaaagaaacataactaagtatataacctataattctgattagatccattccctacacagggcattgaaacaaaagccaaaatgtgtacagggtctgaggattagacagtaataatgttattaatgttaatttttaggtttgattgttgacttgagggctacatcagaaaatgtccttgtaagaaacacacatccattatgtatcagtgtgtaaaggggtatttatttggcaacttattctccagtggttctagggaaaaaaaaaaaaagttctctgtgttgtacctgcaccttttctataggcatggggtgggttagataaaagactggagaaataaattttagtgccaattataaaaatatgtaaccataggcagtggtcactaaaagccattttgacaaacaatcagagttaaaactcagtaaataagaagaaagttacatgtaactgtaaggataaaagcatgttaatgccagccagttaaaaattagtttcaggaatttagtccataataaagattaaattacagaatagcagggaaagatgaactatttaatgagtttgtagagattcctagaaagtcatctaaaaaaaattaagttgtatctatacctcatactgtatgattcaaaatgatctgaaatgagtctaaatgggtcaaagattgaaatgtaaagaataaaaccataataaaaaaatgcaaattaaacttatatgaagaatatattgctcatactggcaaatatccaagttgataacactctgctggccaggttatgggaaaagggttgtcattatgttttacagaaacataagctggcacaattgtgttatagaaagagtaactgggcaacatctaccaaaattacaaacatattcatctgtttctccagcacttattgaaatttattctaaagatacatttgtgctgggcacggtggctcatgcctgtaatcccagcactgtgggaggccgaggcaggcagatcacaaggtcaggagatggagaccatcctggctaacacggtgaaaccccgtctctactaaaaatacaaaaaaattagctgggcgtggtggcggcgcctgtagtcccagctacttgggaggctgaggcaggagaatggcgtgaacccgggaggcggaggttgcagtgagccaagatggcgccactgcactccagcctgggcgacagagagagactcaaaaaaaaaaaaagatgaaagaaagaaatttcatatgacttttgaatttttttgtttttttaaattatataaatgtattacctattcaaaaactatttttaaaaactcacagggtgtttgtttatgtcataggcctttgctctctctctctcccctctctttctatcctagtatattgctgctctttcttttttatgtagctagccttccagtggatagatggtgtctgaccaacagaattggaacctgcatcagccatatactgttaagagaataaaacggaacagaaacaagcctgtataattacagttggtcatgccaacagtctggtgaccaatcttttacacttaaaacttaaagaagttacacgttttcaactgcctgtagaagaaaatcacatactccttggccccccatactcatcatgctgacacagatcacttgagcttaaaaatgctcacaatgtttctgaaagtgaataggcacagagccttcaaatatgagatctagagtatctcactgaatataagatattccactcaatgctaccttataaaacaagccctagaatcaaaatagcttatcactacatcttattcattgtgagatataccgctgaggctggacatgcactttaaaagggaaagaggagccgggtgcagtggctcatgcctttaatcccagcacttgggaggccgagatgggcgatcacctgacgtcaggagtttgaaaccagcctggccaacatggcaaaaccctgtctctaccaaaaatacaaaaaagccaggtgcggtggcgggcgcctgtagtcccagctgctcaggaagctgaggcaggagaatggcttgaacctgggaggcagaggttgcagtgagccgagtttgcgccattgcactccagcctggatgacagagcaggactccatccgggaaagaaaaaaaaaagggcgggggggagaggaaatcattaataaggtgtaactgaaacctgtcctgaaagaaagcaatgagcacctctttttatcataacatattttgtctatgtttcgtatttccacaaactcctctttgattacagattatgtctttccaagaagactatttggcagcaaagtgctgacaaagtattgatggcagacctccttacacaaagcctattagcatttctattgctgcactgcacactctggtattataaatcacacacactcagcatcatgcccaataatcaaacagttacctaacaactaagggtattacaaacgcattgaactaatctttgaatatatgctgataattaaattccattatggtttctaactttaaacctaaaggcaggcaacactgaaatcaagtgtcatccactgtgccctcacatatgccatgaaatgtcatttatattatatagttcacttccaattactgaatacaccagccagagcatctatcactaatattaaaacaagcagaacccagcagtagagcagtggaaggcatcacatggtttaaatggatttctcacctttcaagtgtcaaggggtctttccaagaacatctcacttagggggttgttggccttttaacaaaggaagctgctccagttgaaagaaacattcaaaagacaagacatgctgtaaagcacagctcagagctagagacatctgccccttgtgttaaaacacaaaacagtaaaagatcctttatatgaaaaataaatacatgtaaaaattgagcttttgtcaaggttactaacaaagaagttatgttaatatctaaggagcccttgtttaggcacatgccccacagaaattagggagccctcctgtccagaagatctattaatttcccagtttttaagaccaaagaaatgtttcttgaaatccttgcttggagccccaaagttaaagcagccatcaagcacaaagctatgccccactgtgttccgctgtctgtgtccatgtctgttactcacgcagaaccaccacgattagcacaagttaaatttcatggctacgtagaaatgcacattccagctctctgcctactaccatcacatgatgatctttaaaacaagaatcaagaaaacgttcctaatcctctgtgttcagaaaagcttttactgtcaaaagaaaactttaatagctgactcttggtaattaacacataatagagccaccactaacctattaacaatattaccgtattctataattggagggtaaaaattagctatagagggaattgtaggaaatcattttctagctctaccatcaatgttatgtcagataggctaacaagaaaaactgttagagttctaaatggcagtaaataattattggaacataaaatgaaacaacgcccaagaaaattcaatctgaccacacagaagaaaagatagtggaaccaggcctagggaatttatagagactactgcctctgcattaataaagaaatcattatctggtaactataactcaaatcaggctctagaacaatggttcttaacttttgctacaactaccccatctgaaatctgcatgccatgcaaactactgcctaaggcggggcacagtggctcacgcctgtaatcccaacactctgggaggccaaggcaggtggctcaccggaggtcaggagttcgagaccggcctggccaacatggtaaaaccccgtctctactaaaaatacaaaaattagttgggcgtggtggcgcatgcctgtaatcccagctacatgggaggctgagacaggagaactgcttgaccctgggaggtggaggttgcagtgaactgagatcgcgtctgggatccagcctgggagagagagagcaagactccatctcaaaaaagacaaaaagaaaaaacacaagataaaggatgcttaaaacctaaccaagtatcaacagtaaaatcgaaggacacttagaaaattaactgacattatagacaacgtcaagtaatttgacatcatctcttctttgaaattcaccatcccatcatgtgagcctatgtatacagctcctagtagcggataaagtaggcaaacttacatgaagaaagaattccattactataagctatcattaaacaacttaaatatctagagaaaattcatgaataataactgaggtgattcagagtccacagcataaccagtttaattgcatttaccacataactggtccatatacactggaactctgaacgtgctagacgagtgaaagcaaatgtgaaagcttttatttcagttctaatgtactgcataataaaatttaaaaacacacacaactaaaatgtggattaaatccaaaaactataatttcattaaattgcattataagattttcacttactaaaatacagaaaatgttttctaatatgcattggacttttttagttatactttacatgtgaaatgcagagatttttagatacactatttagtttttataaaggctcaactcaaaacagttctatcactccagaaagttctctcaagcactttcccagtcaatcctcaccctacccatagaaaacctcgatctagctagctagctagctatttttggagacagggtctcactgtgtcgctcagactggagtacagtgtggtgtgatctcggctcactgcaagctccacctcccaggctcaagtgatcctcccacttgagttgtgtgccaccatgctcagctaatttttttatttttgtttttgtagagaagaggtgtcatttcactatgttgccaagactgatctcgaattcctgggctcaagggatcctcctcccatctcaggctcccaaagtgctgggattacaggtgtgagcaaccagatcctgctactactctgatttccatcacagattaatcatagggcagattcatatttaactttttaagaaattgtcaaactattcaagtggttgtaccatcttcattgccaccaacaatgtatgagaacttgcattcctgacaaccttgctaacattcagggttatccatctcttcaatttagccattctagaggctgttttggggatcttattgtgacttaatttgcatttccctgatgaccaataatgatgggcactttttcatgggcttatctgccattaatgtgtctctgtttaagactctgtcaattttaaaacactgatttggtcttatcctataagagtgttgtttgttggaaggtatttttttaaatgtattctgcatccaattgctttctcagacatatgagtgacaaatattttcttacagtctgaagctgccctattttcataacaatgtcttttgatgaattccaatttttttcatttgtggttagtactttctatcccctcattaagaaatcattgcctaaatgaaagtaaacacactctcctgatttcttctacaagtttttataggtttgagattatatttagatcaatgatccatctcaaattaatgtatggtatgaggttgggttatatcctgtttttcacatagggattatccagttgttccagcccatttattgaaaagatttttttcccactgaaaataatttgatcatatatgtgtggattcatttaattttgcattcaagagatataaagcacatctcagtccacaggatcactggcattttaatcttactttgtatagtattaccaatattggaaagcatcatttcctaatattaatatacctcatatttacatgaaacaaaatattggtgtaataggtacatagagattttttttccatttgagttatgcaattacacttcttaaatatattattatttaatatgtatgcatatacactggaactgttgtgacacttttaatggctaatgttcatgtttataaaatatgtaaattttcagctattaatataattgcttgctggtatataatatcagataaaatgtatataacaaaaataatcatataaaataacaccgtttcctcaaatctccaacctcagctaccacacagttgctcctctggttcaatgtaaaattttcctcaaaagttaatatattttaagttattattttaaagagagagggtcttgctgtgttacccaggctgcagcgcagtggctatccacagggctgatcacagcacacaatagccttaaactcctgggttcaagcaatcctaccgcctcagcctcccaagtattaatgactgggactataggtgtgtatcactgtgcctgcttttttttttttctctctctttctttaaaaactttttttctttttttttttttggggggtagagacagggtctcactgtgtcacccaggctggtctcaaactcctggcctctacctcccaaaatactgggattacaggcatgctccaccacacttggctattatattttaagggttactttctaaaccataggaaaattagctgggtgtggtggtgggcacctgtaatgccagctactggggaggctgaagcaggagaattgttgaacctgggaggcagaggttgcagtgagctgagactgtgccactgcactccagcctgggaaacaagagtgaaactccatctcaaaaacaaacaaacaaaacacacacacatacaccctgaaatctctaacactgataccgggcaggggtagtggtcacggtatagagaacagcatattctcaccatcaaaggtgaaatttcacaggccaattagggtactgatttaagatgataggaccagggtctcttttacatagatctgagcctggcctaggaaaaatcctagaaaaaacttacatgcttgtacctctgacacagactagatcatatcaatgggggttggggacaaaagccaactagcaaaggataaaacgattcctctgtctgatcttgtcttcagtatctatttctccctcatggtttatacaggaatggtggcagccatgagagataatgggttaagatttaagaactcaagtgtctgcggtcctggggcttagtaaaactctggttcaataaaaactaacatactagaagtactagaaggatggtagcattggcagcatagtttacaaatgtcccttaatccccacacaaaaacagattagagagtcaaagcaaattcctgctgacacacaacaaaattcagaaataaggcatctctacaaaccgcaaaatataagcaggttggaagggataaactaccatcagccataagatctctggatatgagcatctgcacgagagaaaacagaatcaatcaatgagatatgggatacagctaagatcaggaggaccgtaaaatagctaccaggcaatgaggaaggccaatgtgtgaagagcagctgaagcctggtggggttgcccatgccgacagcaggtcagaacccccagagaccttgcagggctaaaggggctgaagtcatctagacacttttgaactcttcaaaactggcccaccatagctccctgccggcacaaggagccaaggcaggggagaaactaccagtaatggaatataaattctgcaaaaaatacaaaataatttaaattaattaaataatttaaataaattaaagaaaaaagaagatccaaatgaaagtgaaggagaggaacagagtcagaaaatcacagcaagctgccatttttttaacactgcataaaaacaacagaagggggagctccgtaaagttaaaaattcaggaaaattaaattcgcataaaaacaagcaaaagcaaagtacattatacaaacctcatataatgttactattttaaaaagagaatacagaacagaataacacccctacagacaaggacagtacaacaactgggctcataaaaaacaaaaaactataatgtactacttcaaaacatgctaaagatattattaaataaattataccagatattagacagtaacaaaaatcagaaacaagaaaattcagaaatgaagtgacagacataaataatttcaaaaattaagactaaacccgaagcaatataaaagtgagtgaacacagctggcaatgtcttaagaaaaagagaagtcagaaagaaataaacatttaaaagtcaaaagaaataaaaaatatgaaaaggactaaggagaaagtaacaaatattaaaaataggcactgggcatggtgacttacacctgtaatcccaatgctttgggaggctcaggcaggaggacaggagttcgagaccagccttggcagcagagcaagaccctatctcaacgaaaaataaaaaaaaattatctgggcatgatggtgtaggcctgtagtcccagctactagggagtatgaggcaggaaaatcacataagcacaggaatttgaggttacagtgagctatgatcctgccacggtattccagcctgggtgacagaatgagaaaccctgtctcaaaggaatccattagagaacaaacttcagaccacaaacaaaaatgactacagagacagctacataaggactagtggtgaagatgaagtatatagtgacttgaagaactaagactaaatgagggttaaaaagactatagtgtgtaatctaaaaatgcagacattctattatcatttaacacacagaaggagaaaagggagagtgcaaacaaaaattttttattttactgtttccagaaatcataattggtggtgtcagtactagtattgttactctgaaactactgtataggtagatgagataaagaagtaattatgagtccaggcccagtggctcacccttgtaatcccagcacttaaggaggccaaggcgggtggatcactttagtcaggagtccaagaccagcttggccaacgtggtgaaaccccgtctctactcaaagtacaaaaaaattagccaggtgtggtggcatatgcctgtggtcccagctactgggaggctgaggtaggaggatcacttgaaccagggaggcaaggttgcagtgagccaagatcatgccactgcactccagcctgggcaacggagcaagactccatctcaaaaaaaaaaaaaaagaagtaattacgggatagtctaattctgtcaccccttgtgtccttgagaaccagaaatctgtctgaaagaaaagagatagagatggaaatagctgacgttaaataaaaactctgtaatcctggatttaaatgagacagcgtgttgtatcagtataaattgtaagacatcatatataatatttcccagctctgtccactccaattatagatattttaacatcattagtatataaatcaagaggcccagaaataataaacagcccagcagcaatgagactcaaatgttctagattatgctcttgcgataacatctctcactaaaagaaaccagggatttgagaagagatgctaattatgtgtctgctgcaagacatgtacaagatgaggatggaacaccttggcatagagatagtaaggaaactatcaaagattcccaggatcatgtcagaaggactcaggagccaataagaggttcctactaaccaaaaatgggacaatctggcttcaataaggattaggaattgcaattagctgaaatccatcaaataggtttaagaatactccaatgtattatttgaaaactgggtaaataaacggaagcaaccaaacctttattctgtctttcctatataaattgtgcaactgggtaacaagacagtagatgacagacaacactaccatataaaattattctagctaataaatgaaactgaaatcatataattaaaatcttacaattttgaaaatctcaaggaattaatggatacaggctaacaaaaatcagacattatacacttcctgataaaaatatcctacaccacctgtaatcttgcccaaatggaacagacctgagtctcatcaaacctctggatccagctactaatacacaagaaatgcaggggtcagaggcacatctttaactgtactacacaatcaataaaatccagattgcagtagattatctaggtcaaatgacttggaatcaacaacaaacaaaatttaggaaagtaaagcaacgcagcgagagatctgcagagtattttataatagattcagaagacatatcatatgcataactaaactatagtgtacagacatctacacctgggtgacaaaactataatggaatataattactgtatatcaagatagtgatgaattccttagggaaagaaggaattgtcattgcagaggacctcgaagatggctggccacgtcctgtttcttgacctgggaggtaattacacattataattcattaagctatacatatgttttgtgtggctgtatgtatctgtgttttattctacaatcaaaaggattttaaaaagaaaacactaatagcacagctcacctgtattctgcttagaaaaatgcatcaactaaagctatggcaaccacagaaagaaactcaggagaagggaagcgaatctaaaagacaagtcccatcaggataaaggtgaacttcctgactcagacagacttcagctggagaccagatgccacagatgcactatatgagcagataaaagatggattttaaccaatgctcacaaacttaaacattccataattatgtggtttctagctgaaagacaaaatagcatccaaaccaaaagaactaaattagaaaatgtatgttaagaaaatagaaacacaatatgagaaagcagctggaattgtcacaggatcccacaaaaggaagaatagctgcttaacacataatagataatcccttcccagtctggagtgatcagaatgacatccttggattaagaatgcagcccaggaaactaaaatttaagaataattcggaaatataaaaagcaaaaaacatttatgggagaacttgcattaactcataataaatgccacagacataaagcttctgatagaacaagccccttcccagcctctaggtctgaaaagccttaaaggagtcctcatttccctcctctttcacacatcaaacagcaagtcgaaaaccaggaagtcttcaattgtcctctatagaaaattacataggaaaagtttaagcacaggctttaaaattatggagacttgggttcgaaatctggctctcatactatgtgacattaggaaaattactgaacatctctgagcctctattcccaatctgcaaaaccagaatcatttccattgacccttacaagggaacactacaaggagttccttccagccccagtgcatctaataattacctcaaattattccactgaattctaactgttccctatctacaatacaaatcactgacagcaaagacacatttttgttgcaaagcagataaacactgcttgttaacttcacatccctcccctccaccactaactctaacagcattctgggtcagacccctcatacagttcatgtgaactgtctcagtagcttcccaatttgctctatctctaatctttcttaaagaggaattctgatcacatactcatctgctaaaacacgatcttggctccccagtgaccaacaaataaaatctagtttctcagctttcagagctcagcacacctttccagttctatcccccaccactctctttaccaaaccaagctggactccaacattcaacaaaaatattctgcctctattctttgtctaaaaagtttttctattctccagtcaaattctttccaaccttgtgagtcccaccttaaaagctcgtactttgactaagtccttccctcagaaaccactctcacacttccccaagctctgttctctgcagggtatgttgggaccctgaaagacatgtttcattagtgttactcgctttgaaacactctgcgtgcagatgccgtatcttactcatattcttacattcaacaaacacacattaagttcccactatgtgccatgcactgtaaagcctgaagccacagcagtaaacaaaacaagcagatgtctctcccttcatggagctggccattcttgataggcagactaattcatttcttttccctcctgcgcaatggactgttcttcatgcagtatttatttaataaatgctggctgaatttaataaaaacatttcaaaagaccaattaacacaatggggaaatttaaagtaaatcattgaaaactctcatttatattctaatctgcaaatttaacatattctagcaggccttctctttttcagaaacacgtctgactttttaaattcatcaaaagtccctcaaagtgcctgggctggagaagtcccaaggcctacccttcccaaacccctcatcgaagggtcgtcgcctcgtccagtctctctgggtggccatgcttggttttatgtaactctggcctagggcatcccactgactctatgaggagtgaccccctgacccaaaaggcagccaaatcttgagcagacaaaaacacatacattacaggataaaaagataagctggcccaaattctgtcagtaacttgaaataatggtaactaagtaatatcaggaaagaagaaataaggatgcaagatgccaaacaaaatctttatgaaatacttttgatcatgaacttatctgctaaatcatccctcaagtagaaacaggagcccagagcttctctcacagaacctccctttggacatcttccatagtgatcccccaaaatgtaccaccttaaaacatggcttaagaaactactgactgaggctgggcacagtggctcatgcctgtaatcccagcacttcaggaagccaaggcaggcagatcacttgaggtgaggagttcaagaccagcctggccaacatggtgaaaccccatctctactaaaaatacaaacatcagctgggtgtggtggcaggcacctgtaatcccagctacttgggaggatgaggcaggagaatcacttcaactggggaggcggaggttgcagtgagctgagatggtgccactacactccagcctgggcaactgagcaggactctgtcccaaaaaacaaacaaacaaacaaaaactactgacaaggccaggcgtggtggctcacacctgtaatctcagaactttggaaggctgaggtgggcagatcacctgaggtcaggagttctagaccagcctggccaacatggtgaaacctggtctctactaaaaataaaaaatgtattcaggtatggtggtgcatgcctgtaatcccagctacttgggaggctgaggcagaagaatcagttgaatctgggaggtggaggttgcagtgagtcaagatcaagccactgcactccagcatgggaaactgagtgagaccctgtctcaaaaacaaacaaacaaacactactgaccaagtaatagataaaaaccaaataatcagcttgctaaattccaagtatttactcacatttttatttattttttatgcattcatttggcgccctatttattgaatatctaactaagtgctaggtcctgtgatagtcacagaataagacagattaggtcttgctctcaaatttattttattggagaaaggcaaacaagagtttgccccctagttcctcccactttctttctttgtgctgagaaacacagggtgccttcacagttctgtgacctggacagctgcaagttttgccttgaaggcttgagcccaagctgagggcttagccattcccaggcactgctgaaatactgcaagaccaaatgtggcaaaactcacagaaactggttccgaccacgaatcgaattcctcaaaccctcatataaactctataacctgacccctcctcatagacacatctaggtagaacatctcttgtctcaatgtctatcgcaagtgtggtacagccctctgtgtgtaagttcccctaataaatgctttttttgccctgctgtttagtgcttctttctttggaatcctaatcagcaccacctcaggactaagtcagtcccttgcaggaacactcctaccaccattgcttttggggtaaatccatctgagagctggccagacagaacaagtaaacaaaccaacaaggtaatttcagatgataatcagtgccataaaaacaataaagatatgaaaactgagcagtatcttagaaaatgactaagaaggaaaaggggtggggcctgaataaaatggtaagaaaaacctcccagaataggtgccattcgaacacctgacaaaaaatgagtcaaccactcagggatacagcacaaagccatcaaatcaaaaagagtccacaatccacactcaacagtactatggaccacagagaatgtcagaaatgtttaaaactgttttctccctcaagaggcttaaattccatttggggaggtaaattaactcaggaaacaaattttatgaaactgcagagacttcagctgaaggccagagatgccctgggaacaaatggaaatgcagtgcggcccaccggtcatgttccctcaaaggccaagttagtgcctctggtattctcattctggtacctatgctgctggaaatagtatacaaactatgcctttaagctttccaaattggaacctgaaattttaaaaatcttaattagtccacacttacgaaatacgaaggcttccaggcacactgtctgtttgctgttctggaaaatctagtccttgaattgcatttccttcacttacctgtgaggttccttgacttcttcccactcttgcagccttctcagccacgctgattcacagctgctgcttccctctgagggaccacacgcctgctctcacccagaatcctctagcagtttctttttctagaaacagctgaagaactgctgagtagaaagagtctgcaaactatcccgactgcactgtattattccatcagtgtgtggagcaactgaaaagttacttggctatatcagatgttaagaactgagcacaagcttcccaaatgtgtgttcactataaagaggaaagccagcagacctcttccaactgagactctgaagagaaggctgcaagagatttctgtggcgctgacatcagatctactacatcatgtcccagcctccacggggcaacaagaaagtaaagatcaaaccacctgagctgccagataaggaacgcctttctctataaataacttactgatgtgaagaggcttttctgggataaaacaagtagaaaagttatatattgtacaaaaagaatggtcaagagaaagatggtgtaaaagcaagaaaaatcttgaccctcccagaagccactggctgtttttgaccacccattgacagtgaattgcaaatggccatcagcactctttttgctttaaaaaaaaaaaaaagaaaagaaaagccaatttatgccattagatgaaaatccaagtatcatcacctattttcaatgcaaaatgcaaactgtctatatagccacctaatgaaccctgccctaacatgttcccacaatccaaatccagttagtgactggaaattatccacaggacgacaactccaggaagcagttgcctcctggctaaaccaagaagacttaggagtactagtttctacacctagaatccacttttctctccttttcaaacctgtctaagccaactccaaattcactccaaattctcctccttagcattatcaactgacaggttccatcacgcatgcttccttcgcagttcacacttactatgccaaatgcactgctttcttgtgaaacacatctaacgtatgtcctgcccttcccacagaaatctgcacatgctgagggaaagaactcagatcctgtcttaaagatgctgctaccattcatttaatcccttcctctaaaggtgcctactataaaatgatacgtaaggtgagggtttaataaactttggcttaacacactgaaaggaaacaaagatttttatagaaggaaaaaacactgtaatgctaatgtgaagtagtaccttcacagtaaagacattttacagtacttccctcctcaatgaaaaggaacaaagaaatacaactgaaaacatcaacaatttaactaaatcacaggccatttcatgtttagcaacttgtctttaaaaccctccctactacacttccaccctaaatgcatttacatgcaagacataacaggctcctgcccttccaaaccagcaaaaggtactttttttttcttttttaaagacaccgtctctgtctgtcacccaggctggatggagtgcgatgctgtaatcttggctcactgcagtctcgacctccccaggctcaagcaatcctcctacctcttcctcccaagtatctgggactacaggtgcataccaccatgcccggctaatttttgtacttttttgtagagatcgggtttcaccacgttgcccaggcttatcttaaactcctgggctctagtgatccacccgcttcggcctcccaaagtgctgggattacaggcatgagccactgcatccagcctaaaaaaaaatcttttaaaagccatctttggctggtgcagtggttcacgccagtaattccagcactttgggaggcctaagtgagaagaatgcttgtggccaggaattcaagactagcctgggaaacatagtgagatcccatctcaaaagaaaaaagtcatctttgcgcagagttctacttttacaccctatcctaggagaatcaaacttaatcatatttgcgtggagataatccatgtttgtttaagaaaatgaacagaaattcaattcataaatttagttctaaatcattaaaatacaaatacatgtaaaacgtgttgaaactgttcttacctacaatcgccatgtaatctcttctatcattctactctgttttggtattcttcacatgtttttccatctgagatatgcaatagttctcctaatcccaagaaatggctacaaccttggggtcattactactcaggaactgggctgtttgtggatctcattctgtgctgaatggtgcgactggtttcagacatgtccaactgtggcagagagtgcttgttccccattcaacgtccattctccccattttccataataacagagcacctacgttactggagcacagtaaaccaaagttgttaggcacggctactggaaaagctctggaatgggcctaaaatagcttttgctgtgtgcccctctgataagggtcagctgtgtccccacccaaatctcatcttgaattgtagctcccataattcccatgtgttgtgggaaagagccagtgggaggtgactgaatcatgggggtgggtctttcgtgtgctgttcttgtgatagtgaatacgtctcatgagatctgattgttttataaaggggagttcccctgcacacgttctcttgcctgccaccatgtaaaacatgactttgctccttatttgcctccttatttgccatgattgtgaggcctccccagccatgtgcaactgtgagccaattaaacctctttcctttataaatgacccagtctcaggtatggctttattagcagcatgagaacagactaatacaccctccttcagctgcctggctgggatggaggaccagtgtcccccaatccactgcagagcagtgatttttacaatgttaaacggctagaaaagtttctaaacagatactttcagcttctctattcatctcctggtggactggtagcaaacagtcctattggtgagccaccatttgaatagcactggtctagagcatggactttaggggctgtggctccagccaccatctgggaccatggcgagaccttgagaagaaaaccatgcaccggggcagacaggaggagactagatacctgaggtttaggtcactctaccaacccggggcagcacaccctgaaaacacctcattttatatgagaacatagatgtttatcttaaacaactacgatttggggttatataataaacagccaatccgaacaacaactgacgctcccattttgcagaccactacaaaaatgtcacagcactacattatcgctttttattctcacatgagaataaccctatgaagcatgtagcatgggtattattttggtttgacagctatggaaactaatgtcctaaaaggttaaatagcttgtctaaagtaacacagccagcaagtatagacccgcaaacaaaagccagctaggtaccctttccaaaacaactcacctctccatgaagtgaaatcatctcatcacgactgtacataaaatacgctgtaaatgatcagaggtgtgtacttacaacaaactacataaaatgtgtatgccactgggtagaaagatacaacaaaaatgtcacagtcaactagttaatataaaatcagatttaatggctacagtgagaatgtactgcattttacagtggtaacaaagcatctgtgaaagtagacagaggcgcagaaaccacagacaatttttataataatttagccagcaatatagcaagtgaactatgagcaaatactacaatatagtctcaacatttgagcctctacatataacatatagtctcaactaatactagatgtaaatacaatatattaataaataataatgtttaagacagtttgaataataatgtcatggttaatagtaacatattatcctttagcataaataagacttctgagaatcactggcaatcagatgcgctctgaaccattcttttgatggtaaagaaggttggcagagagccatccccactcacttccaggaggccctgatgagcaaaagcatattattaaaaagctgcgggggccaggcacagtggctcacacctgttaatcccagtgccttgggaggccaaggcaggaggatcatttgaggccaggagcctgataccagcctgggcaacatagtgagacttcatctctacaaaacattacaaaattagccaggtgtggtggcatgtgcttgtgtggtcccagctactcaaaaggctgaggcaggaggatcgcttgagcccaggagcttaaggctgcagtgctctatgatcacaccactcattccagcctaggtgacagagcaagaccgtgtccaaaaaaaaaaaaaaaaagctgctggtttggatctaccatgttatctgtgactgtggactaacttttctttgggtaaaatttctttgcctatgtgggtatcaaccattttatttcatctgaaaaaaaaaatgctaaagcatttgtccatatccatacttaactgttaaatattaaacagaaaagttatatttatcattaaataccaataaaaacttttctgttgtcctgaatattttgttacaacattaaaaaaagtacacacacacaagaaaaattcagacaaactttaatgtattttattattaatgttttatttttatgtattattttaatgtatttatttttatgtatttatgtattttatgtatttattttaatgtattattttaattgtattttattatgtacatattttcctgtcatattttcccttcagaaacaaactgccaaagaaaaaagatgaaaaagcatgtttaagcaatatttaattgctcctagcatttaaacatgttataaaaatccttaaagatcattagtaaaaatgagttcttacaatacctatccactagtacactatacaaaaaacaattaatggaaggaggagtggttagagggatgtattggtagagatatagatatattttaaaaaaggatgcatcaactcaaataatataggaaagaagaaatgcaattcccactaactctgcaaatgaccctcaaaccttacacaggcacaaggctacaatgaagaaagcaagtaagttttggagtgactccttcagggcactaatccccaaaagtttataccagctcaggcttcagcaaactacaggcccacaggccatgtccagacaccacctggactctactgatccactagaaataaagtgattcagtaaaataaagtttcactgaaacacggctacacagtcatgctcatttgtttacaaattgtctatggctaagttgagtagttgccatacagaaaataaaactgaaaaaactatctggcccctaataggaaaagcttgctgtccctgagtacaaaaataaccaatagtaagaatgttcagaatcagctggctgagcagcagcaaaaaacaggatagctctcctctagaaactggtaggagcaagctttctgcctcataaacactttgctgtgtatacacatgtagtcttaattcatgagacataagatttgtcttttaaaaagctgacccaaatacaaaccatctccaatcagtttctcagacacaagtcagaatatgacattaaaatccagtgaattgcactgatattttctcttacagacaaacctagtctgtaggaaaataaattactctttctctctctcttttaatttaactaagggtcttgctctgttacccaggctggggtatagtagtacaatcataagctcactataacctggacctcctatgctcaagcaattctcttgtctgtggcctcccaagtagttgggactatagccacaagctaccatgtctggcttttttttttttttttctggtagagacaaggtcttgctaagttgccagggctggtctcaaactcctggcctcaagtgatcctcccatctccaactccccaaagtgctgggattataggtgtgagctaacacacctggccagaaaacaattttctctaatgaattaactgaaaagatttaccacacagcgtgtctatctttggaaacagcgctgccacaaggtacctggtggtgttcaagtacaaatccccctgacctgcaagaaatttcacctttaataatctttaagaaaggtcaaaagcattaacatgacagatgcccagggcacgagccaataaaaggaaaagttaactgggttatctctctcatatgtagttaaaacagcaaatgcttaatcatttaatttgtactgatgctgatttttttttttttttgagacagggacttcctttgtcacccaggccagagcgcagtggcgtgatcgtggctcactgcagcctcagcatcccaggttcaactgatccctctggcctcagcctcctaagcagctgggactagaggtgtgtgccaccatgcccagctaatttttatattatttatagtgacggggttttgccatgttgcccaggctggtctcgaactcctgaactcaagcaatccacccgctgcctcagcctcccaaagtgccaggattacaggtgtgagccactgtgcccagcccctgatgctaatttttaaatggacatttgaattctcaaagaaatttgtgttgcctcttgtcaaaccaggtcactgaaatgataacccacacaataagccaatgagaaggaaaaaatatatgggattggaaaacagaatgaaaatcaacattaaaattccataattaaaacacgcagatagaaaagaatttatctgacaacgtgctaagaaccccctgtcctgtgtttgctgtcatggggagggaagaatgtctgcagcacaggctttcccagtctgattcacagccctgttatatatgaatgtgcacactcgaaacaagatctgatctggacaatagtcaagtctctaaaagcaagggagttcaattaattttttaaataaacatttcactggattttttttttttaatgatcaatcctgttgacagttttcccgtccatcttccagaagaactcactactcaaccaactgcctggtattcagctgtgactgtgaggatggataactatatttccttaagaaatagcaggaaggtatctcatccaagcagaaaataagaccaacagttgtccaggtctcagtggttctgcatttcttcctaaaagagaaatatgtctctaaacatctctttcccgcctcatggggttgggggaagcaatatgctcagaaaaattttaactactccaggcagctgaataaaacaagctgaaaaccctagatgtgttctccacattactgtgacagaatgcaagtgtgtattcgaaagatttcctcgctggaattataaagcgtacagcaagccagcctgctgtactgccacctcgctcttgctcccagactccctcccatggactaagcaggaacgaacatacgagctgtgaatctggtaggggaaacaggaaacatccaaccaggaacacactggagagaagagaaaacagttaaccacctatgagaagatggcgctgattccagcaggtgacaggtgggacgtgaagggcattcccggccctccagcagaagcaacgtcacggagctgggtgctgggtgggttgcaccgttctgaggcagcacggttctctccaatgactctcacacaggaaccagacctgactctgtttcttccaggacggtcctccctcactccacagcctctcatggcagctggacacccaccagggctggattccacacacagaaaccacatccaatgctctgttactagaagtcgaccatctggatttcaaagacctctgtctctttctgtcctttgttaatcagtctcccttcccactcaaccctctcccctccatgccagagaaaaggatttttaaatctgatgagtttttcagggaagcagaaatgtgagattacactgttctttagcctcacctcatggttttgctacagagatcaacgtcttctaacacagctttgcccatactcttcctgaggctgaaccaaaaaatctttcatgaacagtactgtctccaccagcagaatgtaaatataccacagcactgacttcaaaacactgaagtagagagtcttaactctccttagacagaaggcagaaggctgcaaacatcccccagcagactgcaattgtgctgttccaactgacaagcccagtaagcactgcccatgacaggacctcctgcagaacttctcccagcctggcggacagcggggcaggggtcaccctcagaggctcgccttctctttgctccctagccatcacactacactgggatgagacacaacaagcacccaaatgacacagtgaccatttcttttggtcactgaggttcacgagatgggctgtttttctttttcaatcgaggagctgaaatcctaccagccacctaacaattaacaaccccaaccctgtccacggttaaaatcaacgaaaaaagcaaggccaacttcttgtataacttccttcatacgggaaaaacatcaagttcaacgtgtgttaatcaagtgtcaggtcaatgtaccacgcaaatatatttgatgttttttgctaaggccaatactaaactgttaaacacagagaatatgaggaaaaacaaggttaaaaaaagtgtatagatgtccaaccctcttttaataattccaaaaaaacacaaagctacttaggcaaaaataaatcacaaatctattcaggagcactgtaaaacggaagagaattatctaaagggattcaccggctactgactaattttaatatgaaatgcctcacaaatctccctgtgccaccaacaaatcaccagctgaggcaaatcccagataatgaaacattgtaagaagggctctttttaatagtttagcccatcaaggagtgagtattgattcttattttcagcagaaggagacagtcttatctccagccttacagctcagtgacaacatcagagaatttaatcacagagccttttctgccatgcaatccttaaactgtcacctaggattctgtgccattcctcatccatttgtagagaaactcctggtctcacagatgtgtctgcctacttaaaccacagtaaccatattatatggttggctgtgtcccacccaaatctgactttgaactgtaataatgcccacgtgccaaggacgggggctgggtggagataaatggatcacggcggcggtttccctcacactgttctcatggtagagaatacgtctcacaacatctgatggtttcataaatgggagtttccctgcacaaactctcttgtctgccaccatttaagatgtgcctttgcttctcctttgccttccaccatgattgtgaggcctacccagccacatggaactgtgagagtccattaaacctctttcctttataaaaatcacccagtctccgtatgtcttaattagtggcctgagaacagactaatacaccatagcagcacttcaagtcctacagattaaacacatctatctatcaattaccatttgccagctgtttttctttaagaattttttaacaattcatcagatatctttgtgcatttccaacttgtttgttaagaaatctgctcagtatcttaagagcagattgaaaatcataataatagctgtgccaattctctggacatctgtggatatttgtaatatatccaagacaatgccagtaacaaaagaaaaagccagggggaagtgatagcgaaatcagtcattatttccttatcctgacataggaagatcagaaagtcccccaccttccagagaaaattaaccaaatactaaagttagcagtaatattaattcaaaagtgtccctgcatctttaaatactaaaaaagtactcaaaacacagaaaaaattacactgaaaacaagccaatacttttttttttttttttttttttgagacagaatcttgctgtgtcacccaggctggagtgcagtggtgcaatctcggctcactgcaagctccgcctccagggttcacaccattctcctgcctcagcctcccgagtagctgggactacaggtgcccgccaccatgcccggctaattttttgtatttttagtagagacggggtttcaccgtgttagccaagatggtctctatctcctgaccttgtgatccgcctgcctcggtctcccaaacttttttttttttttttttttgagacagagtcttgctatgtcagccaggttggagtgcagtggtgtgatcttggcttgctgcaacctccaccttctgggttcaagcagttctcctgcctcagcctcccaagttgctgggattactagcgtgcgccaccatgcccggctgttttgtatttttagtagagatggggtttcaccatgtgggccaggctggtttccaactcctgacctccagtgacccaccctcctcagcctcccaaagtgctgggattacagggatgagccaccatgcctggccaagccaatactttttaattcaagtacaaatcaaactacatcactgagaggaatgttccccaatccagttacactaccctactatccattatcactgttgctgtgaataattagtacccccttccagggagtggggggtacagaccacgtgacagtgggtgtcactgtggtgacaagactgtttgagagtgggaggtgggagcaatcatttatgctggtaatttgccttaagatgttattcccaaacatccttccatgatcctttggattgagataccttaatcccaactgccttcatgtccaaggtcaccacacacacacacacacacacacacacacacacacacacacacacatcttccttccatgatcctttggattgagataccttaatcccaactgccatcatgtccaaggtcaacacacacacacacacacacacacacacacacacacacacaaacacacacacagacacacatcttctattagagagaaccgaaggcatttgacagctgcctttttaggtccttctgcctttccatccaaactatccatcgttaacaaggccctatggcagtgcagcagcgctctccattctaatcaggcatcgaagagaaacttcactgtctgtaggctgcaaccaagggcagcagcctcacaacaaaagtgcaccctttgtgtggcaatcatttacctgttgtaaaagcacagtacccttctctctaataaaaattcgaaaggccaaaaatcagcattacataatggccaaacataaagaaatgaaaagcagtctgggtgcggtggctcatgcctgtaatcccaacactttgggaggccgaagtgggtggattacaaggtcaagcgatcgagaccatcctggccaacatggtgaaaccccgtctctactaaaaatacaaaaaaatcagccaggcgtggtggcgggcgcctgtagtcccagctactcgggaggctgaggcaggagaatcacttgaacctgggaggtgaacgctgcagtgagctgagactgcgccactgcactccagcctggtgacaagagttagactccatctcaaaaaaaaaaaaaggaaaagaaaacataataaaacagcctcacgctatgttcactggaaaatttatatgcatgtatatgttttataagttatagaagcccataagaattccaatagttcaggggaaaaaaaaagaaaaaaaaaaaactaaacttgagctatataccgatgtctacccactaaaattactaaaactatagccaggaatacttgtttggtttcgtgcccctctcctttacaagggaggtagaaagcaaggtggagagacacccaacagtcacttccgttttaaaaaacaaaaacaaaaccaaaaaacttacacacagcagatttttctggctagtattggccaatctttctcttgacagtattaagtgctatcctttgtgttaacagtcccatgcatttaatttattggtttaaaagaaatatttcttcatctgattaaaaaaaaaatcaatctgacttttctgtcttgtaattaaaacaaactatcaatacaatggatagggggcaatttctctgaaccaggagctgttccagacactggggacaaaaaggtgaatgaaacacagccccttctcttaatctagctaagaggacagacacgtacagaggcatgatgtgagaatgatgctggctgacagtgcctctcaggcagaagcgagagatgactggaagtgggaggtggagaggagaggctcacttttatttttcatttcaatgtataccttaatatttttaacatccatttttggaattacatgttttacaacttcattaatagagttcagaggcacaagattttggctctaagtttacatataactaagtagtactaccataattatcacaagctggtaaataaacaagatggcctcaatgtgccaagggcacatttatgccaaacaaaggcaaagtcacttcatggcaagctgtatttacactgatggtttctgagtggcaataactgaaagaaaagcaacaggaaaaccgagtcattacaaggaatccagccgtctacacaaaccaggcaccatcccagcatccaagaacatgggccataaggaagcagtaacagttacatcacaagcggctacttatttcacaacatcatcgcccagtctattaaattaatgttggtagtcagaactttattggttttgtagtttggtttgaaattaatttataaactgccttttatagctgcattagggatataagcacacaaattatacctaatttgtgtattggggaagggaggaaattaagtaatatagaagaacacaaaaactatttttgaagtaaacatactcaagtttcaaaaacatgaaagaccctggaactgcatcagaagttccacatcctcaacgtaagcaacataaggaggagaccctgtctttacaaaaaattttaaaattagcagggcatggtggcccgtgcctgtagtcccagctactcaggaggttgagacagagaggccgaggctgtagtgagccctgaacatgccactgtactctaggtgggtgacaaagcgagaccctgtctcaaaaaaaaaaaaagaaaagaaaaaagaagaagttccacatgctgcaaaggacaagatcagatctacttttacactagttactggagttggggacaagccttcatttgctaatgctggccatccatcagaatctcctgagaagtgcttcaaaggagtatggattcctgggtttgactctggaacaaatgaatcagtattctcatcttacatgtgaagacagtgggactctgaaagattaagtcacctgatcgtacaactagtcaatgggtaaccaacatgattcaaaccgatactatgattttaacagtaaaaacgtgaggttttttaactacctccatgatctgggggaagggtatactgcagttccctgaactactctttcaacttctctgtaagtctgaaattattttcaaatagaaagttaaaaacaaaaactaaaaagaatagacagcaggctgagacgtgttaagaggtagaggtgggataggaaatggaaaaggatgaggcagaggcctctgaaaggagggcagaggcagagctccatctccacacagaggaggtcggctggttttcagttttgttttgttgtgggggaagaggaggtaccagtcaatagcaagctgaggagtttaaaaaaagaaggaaggaaggaaggaaggaagggagggagggagggagggagggaggaaggaaggaaggaaggaaggaaggaaggaaggaaggaaggaaggaaggaagtccacatatctgtaaggtgggcaataaaggaacgatctttctgtatttctctacattacaaattcaaactagcatttacgaacttgccaaaaaaaaacctgtttatgtttatagagaaatgcattctgaagtccaaacaactgaccacacaacaatttctaaacccttccactactacataaaacatctgcttctgtgctaaacttttgtaaggcacagtttctgcttcaagaaaatctgtgatgcttggaattgaggtttatcttactgaagaaaaatctgaagaaaagtgtttgccacccatacagctgataattttttgtaatcctaatggatcagtgggaaattgtaccacgaaatctcttgtcagtcaatataacaatgtctctaactaatttcagtaaagtgaaatctacagttattcccttgaaaaacaggacaaatcaactctttcccaacttttttcttttttttcccgcaagacggagtctcgctctgtcgcccaggttggggtgcgatggcatgatctcactgcaacctccacctccctgattcaagcaattctcctgcttcagcctcccaagtagctgggactacaggcacatgccaccatgccctgctaattttttgtatttttagtagagatgaggtttcatcgtgttatccagtatggtctcaatctcctgaccttgtgatccacctgcctcagcctcccaaagtgctgggattacagatgtgagccactgagcctggccttcccaacttactttaagaggtaactaaaggacgggtgcggtggctcacccctgtaatcccagggtgattggattgggaggctgaggcgggtggatcacctgaggtcaggacttcgagaccaccctggccaatgtggtaaaaccccatctctacaaaaaatacaaaaattagccaggtgtggtggcacgtgactgtaatctcagctacttgggaagctgaggcaggagaatcacctgaatccgggaggcaggtgatcatgccaaaatcatgccattgcactccatcctgggcaacagagcaagaccccatctccaaaaaaaaaaaaaaaaaaaaaaaaaacccctaaaaaaagtgataatagattatctccattactggcagcagaaaacaaatttaagtgttaaataccaaactttttttttttttttttgagacagcgtctcactctgtcacccaggctggaatacagtggcatgattatagcacactgcagcctcagcctcctgggctcaaacaatcctcccacctcagccctaaaagtagcagataacttttgaattttttgtagaaacaaggtctttctttgttgcccaggctggtctcaaacccctaggttcaagcaatcctccagtcttggccgcccaaagtgttgagattacaggcatgggttaccacacccagccaataccaaagttttacattacataggtgaagctagtatccaactattttccaccaattaccatgtaatatggttgaaattacacgacctttcaaacttccagatacaggtgacaaagaacatttttaatataatttctattttcaagatttaaaaattctatctacttttaatgtctacctagctgtcacctcaaaaaattcaagacagattctaaattttaaaaattttccaatttatgttccaggaaatttaagtgaaagggaggaaagctataactaaaatttactaatggctagtagtactaatatacatactttaaaaaaaaattaccaaggaataaatatttaggatgctccagagaaaaattatatctgtaagcagtttcaatctcctcattttatgaatgttttggttacttcagctattaagttttaatcaagctaaaaaataggcctttttccttccatcttaagaatgtcaatgggatgaggagggaaaagccaaaaggtgggaggaatagagtaacaaacttttaatcagctagcatgatttaaaggacacacacttctgtcctttaacacagcatgtttcttgaaaataggttactagttcctaaaaaagaacacaaaagctatttacaggctgaaaatctaagattttctattctcaaattttcatttagagaatacattttgggacaagagggaaaaactacattcattttaaggggataggaaaagtacctgatacgatctaatcgtaaaacatgagatcaaagataagaactgaaaatgcaacttccaggcaccaggcataataatttatatagactctaaaaaaggattaactttaagtgtattacttcaacttcactccagtccttagaaacatttaatatccttgggaaagagtaccatctcttcttccattgaaggccttgatatttatagaagatattgccggccagacgcagtggctcacaattgtaaccctaaccctttcagagactgaggcaggtgaattctttgagcccaagagttcgagaccagcctgggcaatgtggcaaagccccgtctctaaaaaaatttaaaaattagctgggtatggtggcaggcgcctgtattcccggctactcaggaggctgaggtaggaggatcatctgcgactgggaggttgaggctgcagtgagccattatcaggccactgcactccagcctgggtgacacagggagataccctgtctccaaaaaaaaaaaaaaaagatattcccatcaaaaaatactacgatatcctaaaaacaaagttagaataagtaaaaccacaagcttacttccatggcctgaaatgtctttggcaattctattgctaaaaataaagcctaggagaagccccgcatatttgtttttatatatatttctttttttttttttttttttttttttttttgagacggagtctcgctctgtcgtcgaggctgcagtgcagtggtgtgatcttggctcactgtaaccttgaacttctgagttcaagtaatcctcctgcctcagcctcccaagtagctggtactagagcctggtactatcacagccacacaacaccatatctggcttttttttttttttttttgagatggagtctggctctgttgcccaggcttgagtgcagtggtgtgatctcggctcactggaacctcttcctcctgagttcaagcgattctcctgcctcaacttcctaagtagctgagattacaggcgcccgccaccacgcctggctaatttttgtatttttagtagagacaaggttttgccatgttggccaggttggcctcgaactcctgacttcaagtgatccacccacctcggcctcccaaagcgctgggattataggtgtgagccaccacacccagcctaacgtttttgtttttgttttttttactttctgtagagacagggtctggtcagagactggtctgaccagttcaacctggtcttgaactcctggcctcaagcactcctctctcctcagcctcccaaggtgctgggattataggcatgagccaccacacccagctgttcagatattttttcaatcaactagtacggaacaagggctgtgccaagtggctttgtaatcttagcactttggggtactgacacaggaggatcccttgagtccaggagttcaagaccagcctgggcaacatagggagaccctgtctctacaaaaatttaaaaaatttttaaattttaggtagcatacacctatagtcctagctacatgagaagctgagaaaggagaatcacctgagcccaggaggttggggctgcagtgagccagaatggtgccactacacccctgcctgggtgacagagtgagaccctgtctgtaaaatcaacaaaaaaaccccaaaacatgaaacaccccaagaaaggcagggctgaaagtcctaacagtgcctgtaagtaataaagagcaatgcactatccctgaaagaacaagaagctcaataaaacttgcaaaggatcattaaatctaatatatgcctatggaaacaaaaaggcatttaaatcgtaggcagttataaaagcataggtttattgatatttgtgatctaaaaatgcggcttgatgccccttttggaaaaaagatgatgaatatgatgaaaagacagtcttaagaataaattgactgggcacagtggctcacgcctgtaatcccaacactttgggaacccaaggcgggaagatcacttgaggtcagtttgagaccagcctggccaacatggtgaaaccctgtctctactaaaaatacaaaaattaggccaggcatggtggctcattcctgtaatcccagcactttgggaggccgaggcaggagatcacctgaggtcaggagttcaagatcagcctggccaacatggtgaaaccctatctctactaaaaatacaaaaattagccaggtgtggtggcacacgcctgtaatctcagctactcaggaggctgaggcaagagaactgcttgaacccgggaggcggaggctgcagtgagttgagactgcaccactgctctccagcctgggcaaaagagcaagaccctgtctcccaaaaaaaaaaaaaaaggaataaattaactgacaattagcttttatggggacaactgctccaggtgaaaggaacagagctgaaagcaggcccagccgggttctctgatgccagtagcagtcagccttggcattataggtcagctgggtgctttcagaactttcttaatttgttacattataagtcgacagctagtaatcatctttcatttagggtagctggattaatcccaacatttgtattagcaattcttctgaaaatccagccatcttaatatctttcactaaaatcaaatataaaaagcaatctctcatgatctttatcgatggttatttttggcatacttaatggggagtatgccaaagcagggaagccacagtaaataatgaaaaagcaatatagcctctctaaacttctgcaccactaaaaaagcaaccagattggagttctttctaagcaacaagtaggtaacaaacgtaatacaatcagcatttccaaaagagcattttataataaattttcttttttaattcttaaatggtactatggtatcaagcatggaaagcactaatgttagaagtgatacttactaatggtaagtgccttacttcagcaaaaataactctattaacaccggtttgactgagttcaatcgagcctcccacctcagcctcctgagtagctgcaactgcagacacatgccaccacacccagataatttttcattttttcgcagagatgggatttcaccatgttgtccaggccagtcttgaactcctgagctcaagtgaccgaaccgccccagcctcccaaactgctggggattacaggcgtgagccatcatgcccgggctgatttgaggttttaaatgacaaacagcagaaccttcgctgtttttaatcttaacttttaaattattttcaacacctaagcaatctactgattagcatccatagtcaaaaagtaaagatcctctttccagaaaaatgtacatatatagaagattttgccagcagtttcaggatgttcacagaccctctaaaactttcaagagactttatggatttcagattaagaatgacgagaatttgggccgggcacagtggctcacgcctgtaatcccagcactttgggaggccgaggcgggcagatcacaaggtcagcagttcgagaccagcctggccaacatagtgaaaccctatctctactaaaaatacaaaacttagccaggcatggtggtggacgcctgtaatcccagctactccagaggctgaggcaggagaatcgcttgaacccgggaggcagaggtgcaatgagccaagaccgcaccattgcactccagacgttgctctgggcgacagagcaagactccatctcaaaaaacaaataaataaaaaaagaatgaccagaatttgtataattcaagtcttacaggataatagacaatgcttattgtatgcttgctatatgctaagtatggtgctaagaaatttaatgaattattttatttaatttttgcaacaaccctttgtcatagatagtattattattatacccatactacaagtgagaaaactaagagttagaaaggttaattaacatatcctatgttaccaagaaacatgtcaaaagaaaaaaagttccctaatggaaaatgcaaaacaaaaataatgatttaaaaaaaaaaaaaccatacaccgggcacggtggctcacatgtgtaatcccagcactttgggaggcctaggtggggggatcatgaggtcaggcagtcaagatcataccggctaacacagtgaaaccccatctctactaaaaatacaaaaaaaattgccaggtgtggtggaatgcacctgtagtcccagctactcgggaagctgaggcaggagaattgcttgaacccgggaggcggaggttgcagtgagctgagatcatgccactgcactccagcctgggtgacggagcaagactctgtctcaaaaaacaacaacaacaaaacatacacagccaggtacagtggctcacacctgtaatcccaacactttgggaagccaagatgagaggatcacttgaggtcaggagttcaagaccagcctggccaataaggcaaaaaacactgtctactaaaagtacaacaactagccaggtgtggtagcccacacctgtaaccccagctactcaggaggctgaggcaggagaatcgcttaaacccaagaggtggaggttgcagtgagccgagatcatgccactgcactccagcctgcatgacagggtgagactctgtctcaaaacaaaaacaacaacaacaaaaaaacactactcaaataaaacagttcaaaccacccctacaatactgtcctactatgtgtgttaaccactcaaaagaggtcaaacacacaaaaagacatggctaaaagaattaaaatgctaactaactaatatcctcactagtccttgatcttctagtgaggaagaggatgggtgcagccaacatgagtcctctgctgcagagccacacccttgacaatggagataaatgtgcacgtatgtccccttgaaaggttgcacctttcctgctttggctagagcctctgtcatggtgccacgtggtttctatgtaaatcagctggcgggtagaatcatttctgaccagtttagggaggttctgggcaatgttatctttgccttcctacctccctcactactccctccccaccactgaacacagtactttttactagaaaacatccaagctaacagattctcagtacaagtaaaaatgttgcctctccagcagatagaaaaatgaacagataagttaaaacttacaaaattaaatctgatgtttattccatcattagtgtagaaacacagatcacatatacctgaatatgcaaagaaagttaaattatgatgcaatcaatgctatcctataaaaactaaattaacaaaaatagtctattagggaagacatctggtgtatcatggcaagaaatgttaatgatattgtctgcaaccctgtaatcaattttttctcccagcagctctctcattacactgtattagatctgtgtgccttgcaggatttatgagaactccacatatggggaagctttgccaactggatctgattcagatccagctcaaatgactttggcagcacaaagcatcattaaagaacaatcaatacagttagctttatgtagcatcatcttgactgaaagaagatttatcctttcactacagaatctcttacacctacatataatgtacccaagtgctccaccagtcatgaacttatttaaatcatcagtagacacaaatatttttattgctaaaaaataaatactaatcattaattctaatataaaaagtttacaaaaaaattaatgttattatggggaagacttaaaatccattcagcaattcctgttgagtattacagtaaataaaagtattaataatagcatccacattgattaagaaaatatcagcctgaaagtaaaacctactttttagatatatgtggaaataagacatatcggtaaataagacatattggtaattgctaaaggctgaagctttagaagtaggtagtcacattgggaatctactaatttgtcccgtaagatgtcagtctttctctgggaattaaaattagacttttatctatactacactgggttctgtcttccactgtaagacagagaattccaaggtttccataatgtgaaacccccatccctttttttggtatgacccttgagtaattacatcagcaaatatgtaaacgtgttatgctgttgcaacaattactcctgatttggttacaattatcaatatatcatctctactgtcttggtcctcttcatcttacccatgaatggcggccctagccttctacttggaattttcaccatctttccccgttccacactgcaaactgctacagtcaatcttcttaagcagtggcctgcaagatggcttgcctagagtaaaaaagcttacacaggctctctactgcctattacacaaaatcttaactttgctaactttgaagatcctctataatctagccccatttatatctccacatctgcctcccaaaatccactaacctgtgctcttcagtgacgtcctgcgggtcatcttctcacaactcccagactcgtcagcctcactgcctgcgttgcttataaggacaggctgccatgtacacctggaaggctcctacactctgcctatccacttcttattgatgtatgaaaaacatacccagctcctcaaaacctacccaccctcacagaacttccccaagtgccacagcccatctggagcactttcttttctacgacccaagatattaatattctacactgcagctgaacaactcaccatatattgacagtatcttgcattgtgtgtgtctaagtgtgagagagcttgctatcctcttgtattatttgctaattcagtatgaactggggcaccacagtcacttctttacactgacgtcaatgtaactgcaactacacttctttcatattaacccactagtcattcagaataataaatactcgactttcagaaaacactaccattaaatcctccattaagtcctaccattacaggaaaaaaaaggaagacaagtgtgaactttcctaaaaaaagggagatgtactaaacgataataacccctatgatcacccacatgggtccctgtgttttaagggataaagcactacagatacttcatcctgctgcctcttacacatccctcaggaccaccactagtaacagaggaataaccaagggatagccgttaagaagtatagctacagcccgacccaagcctcttgaagggcatattctgcatctagcactggagaaaagcctcgctatttctgagcaataccctacaaaatgtcacccgagaggacaacacccaaaatagtttagattggtgggccatgagtcccaatgagcctggggaaacgcacattccacacttgagctcaaacttacccccttttttccccatttcagttgccaacatccatactcgctgctgattgccagctcctgctccttgcagcagcccagcatgctctctgctggtgccaaaatacccttccaccaaaccccgctaacttctggaactgtcctagaggggtaaggcaagtcccgtattttgcttcctctgtgcatgtacttgttactcctttaaaaacacatataatacagcacattttaaaaggggctctggggagggaggtaatattcctattttataccctatgggatataaaatactgatagcttttaaaaacgggattctccttacccctacaggccctctcccggcttcagaaagatgctgtggtggctgtgatgccaccggcagagagcatgctggggggtcacacaaagcaggagttggagatctgcaacaggcctgggagttgtggacctaaaaaagaaaacagttttaagttaacgtgcccaacgccccatcatgccctggttattaggggcacgcagcacacaagtcggtatctgcaaaaactctttagcagatgacctctgaaacctcagataatttgttctaccactaaagttaacctttttgcattaatcaaagctgttaccttatttcagtgtgaacaaacgtatgacccttctggctccacactttaatccaggtcctatcataaagcagtatggtgtgtgcccctcaaaataaccaagttaagatgtgagatagtgccaaagcacagttaacagcaacatgctatgcttataataaaaacagaaatgcaatggtgtcagatacaaccgtaaaatgaatcacaagtggacaaactgagctttcagaagagtttctaatgacagaagctagagacataagacatgtacttaataaggaaatagggcatttgggtggccaaagaaaggccctgccattttctcaaagttcaagtttaactgtataaagctgaaggcaaagtaaatagacaaaggccccaaaacagagggaaaaagacaatattcacatgagttataattttctccaaacgcccacaaggtgagtataatgaataggcacagagcataaagttccagaaagacattacttatttttataggcaaaactagtttagtatgtatcacgtgtctttttaaaattaactttgaaaacatttaaaaaccaggaaaaaaaagactatagagcaacttctgaaagctagcacagtatacctcagataacagtttgagtatgttccttttcaaatattttagacagcacataacatttttaaaccaatttcatgtggttttgaatgaactaaaaaaaatccataaaatcccaatacttatataagaacctgtcttacggttgtctaaaaattacagatgaacaaccttttaatattagatcattattagggtgtcctgttacacataattccctttgaaaagcaaagagcaattaacaactttctgtaaacaaagattttaatatatttcattatctatttttgtaagtctcttaagctccctacacatagacacacacacacacacacaaaacaaaacaaataccaggaaaataagctaatgttcagaatgttttatcatgatcattttcttttctttttctaaagatgaccatctagagtacatcctgggatctacactaaaatttctgtgcagtcagtctctgattctcatggcctcagtgatagtatagctgacagagtgtcagtagccacaaccttctcaccacacaccttctccccaccatcaccaacactgcaaactccaaattaaagattcaattgtgcacttgaatgtacagcatattcaatattttttgccagaagcatcaaaataaaaatggacttctggataatctcttccactaggaatatgactgcccaaaccactcaaatccttacattcaaattaagggttttaaatcaaaaacacctggtaaagcatttccagacactttggcattattttaaacatgcaaatagttcaagtaattattaaaacattttatatattttaaagaggcattttttcaaaacaagtcattgttctcacatacgaaatgagaaaactttgacagtatctgtttccctaatttttttttagtacttctaacaggtttttcttggactattgagttggttcttaatgcaagcatccatatatacatacaaattacaaatttccaattgaaaagaattaagtttgaacaagactttaccaatattcttgcacagtagatggctgcaaatatcagattgtctcaacctttcttaagctcctttaaaattagaatacctagagttttctgcattgaaaaaaatttcacatatagataacaattttagtaaataacattttcagaaatatattttatggaaatatatataattaaacaaaactttttcaatagtttcttagagtcccttgacccaagtaaattagaagaaaatgaattacccaacctcacagtagtagttaaacactaaaacttaaaatcccaagtgcccaaccctgactggcagccacgagtgaagacaaattgctggcaagctcagaaaatggggccagcaaaatgctgggattatttattcccaaggcctcattttgatttccacttatgttaataccactctgtccactagaggttgacatcagtatcatgcaaaaaggatgtggtcgttcaaaaaactttcaacaccattactccataattgtggcgggaggggagtatagatatacaacctcctctgactcagtacaccaaactcagggctaaagaattccatcttgcttgatgcggtggttcatgcctgtaatcccaacactttgggaggccgaggcgggcggatcacaaggtcaggagttcaagaccagcctggccaatgtagtgaaaccccgtctctactaagaatacaaaaacatagccgggggtggtggcaggtgtctgtaattccagctacttgggaggctgaggcaggagaatcgcttgaacccagaggcggaggctggaaagagctgagatcgtgccattgcactccagcctgggtgacaagagtgaaactctgtctcaaaaaaaaaaaaaagaattccatcctacctcttaactcttaaagaattaaacaaaattagaaatcacaaatttgtatgtgaaaaggccacttggtccttggatataatagctgaaaatacttgataacgaactttaatgtaaagtttttacttcattatccaacactacacaacaagtcacaaaggtgtaactgggtgatactgacctttttatatggtacaagccaagaaagtaaagagaagaaggagctatagaaagaaatactcaattttgcaggcctaccttgaaggactgtcaaaaacaaaaacagaaacaactgatgtgtcacacaggaacaaatcatcatagcgtaaggcatttttcataacacatggccttttctgggaggttcacacgtatactaggccctcatttatctttgctgaaagtcagtcatatggaaaactcaaaacaatataatgatgcctaaaaaatgttatgactttggctacattcattcaaattcgtgaagaaaacaagaaactgaattttcttcaagtattttaaaagaaataaagttttattatttctatacattacacactgcaggctaaccaaaggtaattgagtagacttctttggcttgtttaagagaatgttaatttgtgttgatgtatgcactgtatcaaacaactactactaaagttttttaaaaatacttatccagtgaatttattccagttaaatgttacttcattcagtattcaataaatacttactgtggacattacagccagccaatgtgctaagcacacaatatatacatcagtgaataaaaagcataaacctaaggtaccaactaaacatcaacatcacaatcagtgtcattctatggggcactggacactttgtaagtctgaccttttaatctaaaaacaatctacttggcaaggtaggtactttatatcccaacttcacaggtaactaaagaaagttaagaggcttaagtgtatttcctaaggtcaggaaagatggcaactgatggatggagtatgtgaactcagacaacctgatgtcaaagtccgcgctctgaacctgggcaatctaccatccctcatctcaatcccagaataacagatcctaaattctgaattagccatgttcaaattatgtgcaccttcctgcccaccccccaaccaaaaaagggctctaatgcaagatttacctccttttaaacgaatgcccattccgtgaatgtccatacactacaccttctgtgctaagtggtaacagccaagctgggactaaagaaatgcagtcgataatgcgtaagtctgataattaagtcactgtgtgtacacttgaatgtgtgcacaaagagtatgtgtaattaagtcgctacctgatgatatctcccagcatcatctatggtcctaataagacataattactcatcctcagtaagtttttattacaaaggaggagaaatagcttcttgttacttttaatccatttttaagaaaataaatttggtggagggcgggcaatctcaatggcaagtggaacctaagatgaagttaatttctctgcagcccttctgctgttgtactgtcagggaaggcatgaataaagggtagtgagtagcaaacaacttatgagtacagaccaggcataagagagaaattccaagtgtttttcctccaactgctcacatttgacaatgaaacaacgagagggatatggtattaaacgataaataacttggcccccacattcacagcaataatggaaatgtgcattctccaaggtaactagtagtatgcatccttagctattccacattcagaaccagcatttagaaagtaggctgttagggacacaaatgatacagcggcattctcatctatgtggagccgtaacaatatgtcgagcccagctaaccatcacctgagacactttaacatccctaactatcacccccaactctaaggaatctctgtatctggcttaactttaaggacaattttccaagttttaataaaacagttaaggaaccaaaatgaatcaatatcattaacccaaaatagtacttatagctacatatactacctagaaactcatttggtataagtaacagctgaaacacctatgtaactttaggaaaccaaaagcatgttttcctctactgtatgaatgacagcaatgcaagaatccacactgaatttccatggagactattacaggactgagtttgcttacttatctgtgaataaagaaaggtagtaactgctacaaggaactacttactatacaaggaactcctcagtgctatactgaatgaaaattagtgtctccatgaccttgttagcattctcggactccatgattacttccagatggcaaattatttgtattatacttcttaatgcctgggtttctataaaaatatgattttattgtttttcgtaaacaaacaaatcatttcttttagaactaaagtgaatgcccttcttgtcaatcctattcagaatgttctccaaagaagactgacatccaataatgccacaagttgtctgtccacttagaatctaagatcactgagggaatgaacaatattttatacttcttcagtctccctttaggtgctgagttccataaagaacacaaagcaggtattcagtaaatgcctgtggaagtccctgattatagctcaaaacatttctatttgcactctgtgatataatgctcctcaatgatattgactcattcagaacaaaaccctaaaagtaagtaagtcacatggtgacctataaaagctatgggagggcagcagaagggttggagatattaatctaggctctttccattgcaattcatgaagagccactcaagctagccaggtgagagctctttactcagagcgaacaggataatctaagaatcctgtgggaagaacatcagtgcagtgggacccaggagagtcaaggaagagacggctgtgcacacacttcccttggcagtctgctgctcttcccacagcttgcctgtcctctgcttttcccagtttcctaccctagcaagtgagcttgcctatgccagccctaaccttgctcttgtcattcaggtaattcttttatttttaatttttacagatatattaggggtaattcttgaattatctattcacctttcccctctactaactgcctcagtctctcagtttctcaactctaaattctaaaaatgaaatttggctcaattaatcttttcatgccaggccacaaggatcacagactgtcattccgtattactagtccttcaaaaagctaaataaagactttgccagctattttactatttagttcagaaatctacagtgcgaagcgacctttttaatcaacaatacttctttctcctgcttctaagtacgtgctgtccctaattctaccctgcctcttctgcttgcctgagctcctgcttttgactacttcttccataaatactttggtcagcgcattcaaacaaaatcagacctctccatttgtaaataagcccaatcaaatgaatacttcctaagagaatgaaagcttcctaatagaatacataattcctacctttaaaacctcagctcagttaggaacttaattgcttgatactatcatagcctccacctaccctgtggaagtgtgggctcgaaatacacctaccagtgtaggacggtggtgtccctatgtgttttgatggttgaatattaataaagcagaagccatggatcttatccccataggcaagataaccacacaacctatcatccacactcaagacatttttgagagtgaaaggggaggctgtttaatagtctggcaggacaacagacagggatcaggacatagaggcagctgtgttctataccacagactcgattctaagggaatgcagcagcagagtagagaagacaacccaggtccccacataaaatacaaagacccttctccttatctcataaagagctatttcatgaaatgtgacccaaggcccttggttcaataaactgccattattctagcctcggtgactggcggtagatgtctcctcctccccacgcctcacctcattagcttttgttatctttaacatcgtaatcgtacctactaatgtgtatcataacgggcattcacccagttacttttacagtgcccaaacatcctttatacacaaaatttcaccacggcaaagggattctcatttatagtataaacaatgaaacacatctctcagttataaccccaaaccaactttttattttatgattattaaaaagataaaatacctaattactcaacatttcaaagccatcgggtttttgtttctttcattgctccactagtcatgttatttgctgggagcaaaatcaaattcaatttcttcttcttcttaaaatcttgcagagaaacaaagcttatttccttctgctcatcttttacccttatagcttcagtaaactgaaggagaaaaaaatcttgatcattctcatctgattatcttttaataagtacagagaagtaagaaaataagaaagtggaaataactatatttattcccagagcaaatatttcatcatctgttgttcttacacaacaactatgaggatgtgctgaatacagaacctcaaacaaaaacatgagaaacagcagtgtgtgatttagaaaaaggtatctaaacatactgcaccctacttcccacactgtttttgtagacagctttaatgtgttgtattagaccaatactgacaacagaagctttagcttttattgctgttaataccctgagcaattaccgtaactcagcaggaacctctgcccagaacagcaactatcacattgtaatcagcatttcataagagatgctgttcaaacaggaaggcacctgctaatgtgcaaaaactgtacaaagggggctcaagatctaataggtaaaataaaaatatttacaattttatttcacagctatatatttttcacggtgcactgatgtttggtttagtaaaaatcacacaaaaagacaatgggcaggaaaagggcagtagcagcagccactaccaaaacaaaactcttcaggaataaggctacacccgtatttcaggtgtcagtgctgtatctgtttaaaaaaaaaaaaaaaaaaaaaaaaacacactttggaaggaaagatataataagtagcaaagacctctaaaaatggtttttaaaaattcatatagacataaaaactggatagaaagcatttgatttacaagattaaactgcaaggccaccttgcaatgcaaccaggaaagttaaaagccgcttatcaagaatagatccatcttagaagtaaatagcacatttgacttcatcttaaaacagtaagcatgcaataacttaagcaataactttttaacaaagaaaaataaaatgtgattttttttttttcttactgaatatactactttggtacttgggccattaaaaatgataaaaaacaaaggagatgcagagaaagatcttttcaaactacatttctttagactgaaatatcacatacaacatatgtcagaacacaaatattgtcaaattacaaagggtgttggaaataagagcattcacagatagtgatacacatctctacaaagctaaggaattacgaattctctaggcctaagagcacagacagtggttcacaatcttcaaagtactaggatcccttgtaagatcaaaatgtttcaaaagattcccaaatgatactacttcagtagtatttcaaataccaattgtttgaggaaaataacaaacaaacagtggttcccggctggcatggtagctcacgtttgtaatcccagcactttgggaggccaaagcaggcaaatcacttgaggtcagaagttggagaccagcctggccaacatggtgaaaccctgttctctgctaaaaatacaaaaaaaatcagccggttgtactggcacgcacctgtaatcccagctactcgggaggctgaggcaggagaatcacttgtttccgggaggcagaggctgcggtgagccaagactgcaccactgcactccagcctgggtgacagagcaagactctgtttcaaacaacaacaatgacaaatagtggttcttaactgtgtattgcttttaaataagtgaaatttttaaaaatcataaaagcatactgaaaacaggctgaaaaatcgttgtccagacgtgtgagatcaatttatttacatcaagcttagcatgtttatttgcagacctctgccaaatctctgcagacatccagggatccaaagcctaaagtgtgagaaccactggccctaaaaaagcgatttcataatgaggaacatcaacacttatatattcaggaagaatttttaatgagaaagtacagtagctatgtccttacttctgcaacacatgcactaaaactggaaagaaagtataacaactttaccacgcccaagccagacttctttcaaccgctaccccgggaaacccccacaacaatttcaacatcatatactccacacctgccgaaatattgaaggaagtgacaggtttccactggaaactattctctgacccgtttatattatttcccctactcatcaatttactgaatttactttacttcaggctcttaacaatggctgagaagaaacaagctacttcagaaattcaagggactatctgaaattgtcaaaagttactaaagggataaaaacttcagaaatattgtttacaatataagcattatgagagtaagtgttacaaagctgaaaagatggaactagtaaccctcatttcagtgctactgccacgaggcagttagcactcaaaaggtgaactggtaaccacgtcaacagcgatggaggaacaataagagatagccaatggaactggaaaaagagagaatacagagcagagtgaacagcacattaaaaacgcttaccagtttgaagtcttgaatgctacagatgaaatacggtgtgtttggcctccgactctcgatatacacacagtctttaaaagaaaaagaaattttaaaacaatggcatttacctttaaggaacaaagacagggcccataaagccactgcataaataaataaatgacaaagcacatatcttttattgtaaattttttccaaaagatgatattaaattgcaaatatctttaggctaaaggaaaactgccctttggttctttctgattatttttctaataatttaaagaatctgatgaagcctaaattattttcttcagagtccctgaagaagaaggggaggagtccaagggattatccatattcagatgaagacatttagataaaagaaaccgcttgctcaagatcacacatcaagatgaaatcttgagtatcttattcagatacatgttcacatgtcttcgaaaaagagaaacggctttgccacgtgctactatatttgtaataaatattttgtgaggaaataaatgaaatacgcaaagatgactagcttgaacatgctattacaatgaccttttcaactaatcaaaaagagaaagaaaactaatctcttacagacaatttgccattacattgtaccctaaacacattttattttctaactgtaaacaaaaacaatgccactaatcagagatggaataaagtaaaccaaattgcattttcttcagggaagaagggtgctttcttaaattacatttgacatggcagtggttggaaaataatttttgatgctctcaatgactggagtgtaaagcgttgcttttgtttgtttgtttgtttgttttgttttgttttgttttggctggtctcctctccaactcctgggctcaagcaatcctcccacctcagccacccgaagtgtcaggattacaggcatgagccaccacgcttggccaaggttgctttttaaaatgccatgttaagacacttaaataaaaagcaatgattttaaggaaagcagtggctatagagagagttaacctcctcctacccccatatcacaacctaagatcatcataaagcttaggtcaggaaagtctacgtattatttactgaaaagtaaaggcacagtcaatgaaatctaggaatagtgaccacaatgcctcattcattcattcattttgcatagacagggcctcactatgttgcccaggctagtctcaaactcttgggctgaagctatccccctgcctcggcctcccaaagtgctgtgattacatgcataaaccaccatggccagcccataatgccattcattttatacttcctctggacccttcagaatgagtgtatcttacaataattcagatgcttgacaacactggcaacttcctctattgtctcatttgtcttatgtgttgagagcgaagaaaaagcacagaagtagcaattgggagtcatcacaaaccccaacagaccaactaagatgatcaggaagaaagtcctcacaaatgagtacattccaagaaactttctgcagaacatcaggatctttgtacctacccaaaaggcactctagaaaaagaagaaatctcaatgccaactatttaggcattcagaattccccaactgatttctctactcaaagatggactcaacagagatttaatccctgaatccacgtaaaacagtagctcaggaatgaactgttgactaagctttccctatcttgttccaaggtcccagatgctaaataactgtgcttcagcattcaggcaacatcaacttaacatgctaatcatcttaagggacaagcaagagaattcttcccaccacagtagatcattctttcatactcctaccttggtattcaagtaaaaacagaagaaactcaattccctagataaaaactgtagctccaaattacacaattttggaacaacccaaagttcttagtttcctgtgtttcagtccctgttatacccactgccagcatttcagatctctagttatcaattatttactcaccttactcaactcaacatgccctctcctttctgttgcttcctacataccacatttcatgacattaacaccatcatagcctagctactgacagagcaggagcatcaccatcttggacaagcaccaccattttcaagttccccttgatcaaaaactgcctaaatccaacccaaagggcatcagcctaatggctaatgacatcatgaccataaaccacaaatgacatctccaaccacaaacattccaatcctaagataaacccctctctgaccacagacatgccagcccagagataacgtcccctctggctggagagatgtcagccccaaaacattccaaccccacaataaacttctcctccacacagaaacattccaagcctgtgataagctctcctgccctaaatccttaagtaatactcttggtctgtaatagacagtgctcctgaccaaaatcagccagaagcccctctccggtttattctccaaaatgagcctgtctttgactgttaagccacttttcgcatttctttcctcattctttaactcttacagctactactcactggcttcagaactaataggtccctttctaattaattgcttctaccttcttaaggctcaagtgacaaacttactgcattcaatggtctggtctcactccacaccccatcttcccctaggctgcattcactacaagaaaccccaactctgctcccagtctgcaaaactcttcttctctccttctactagcccctgatcacaccaaccttagaattagttatcagttccatatggagtaactcctcatggctcctctgtaactaaatggcaacacctcccttcttttacataacattaacaatttacattccttgtcaagttatttggcagtaaggtggtctgcactgtccactaacaattactatcaatcttgtaggctcagagaaatgtactcaattctaccttccccgtactcaccaaggactaatgtctgccattagtgtgggggttaaaaaaaataaaaaataaaaaataaggccaagtcaggtggatcacctgaggtcagttcaagaccagcctgaccaacatggtgaaaccccaactacactaaaaatacaaaaattagctgggtgtggtggcacacacctgtaatcccagctactcaggacttagaggcaggaggattgcttgaacccaggaggcggagatagcagtgagccgagatcacgccactgcactccagcctgggtgacagtgaaactgtctcaaaaaaaaaaaaaaacctgaaataaatgggagacacttggaaagcaaagactacgcatgtttttctttttacacaaagaaaagctttatttatatatactttaaataatccataggatcattactacacaccatcttactgtgagatataaagctaacttacatacaaaaaagctttccagaaaaaggaaaaagaacctatgttctttcatttcccgctgcaaagttacattcaagaaaagtgcctgtaaatacactaggatatagctctgttagagaaggaaggaaaggaacatgccggtatgtcaagagcagccaagcacatctgtttgcctaaacacttctcagcagttgtactggagctgcctcacacacctggcctgagaaatgctgccatgagggataagcatgagagagatcctcaaccggacatacggaatgaccactgttacttttccttagattaaaagccacctctttttgtttaaaaaacgaccatggcaactcaaactgatccaaagctatgaattcatatcagacagtccaatacacaaggttaataatctgtaaaatgggtgagtgcatcaagtgagctctatcagtactttgaaacacatatatgaaaaagttagagaagctcactgcaaaattaagtgacaaaacttacagttttgtaagccactggagggtggctgttaaaaaaaaaaactttacatacatagtcatgaaacacagaatggctaagactggagtaataagaactaaaaatgtttcacactatgtaaaacttgccataggaatggggaaaaaaatacactgctttgacctgatttgtctaattcatttttaaaatcaaagcatgacgaactattgtacagtcaaacttttctttataaccctctgacaaatattaggatgacccaacaaaaaataaacacaatttagaattcaagtctcacagaaaaaaattctactttatattactcttaaaaatattcaaaacaaggttcaattaaagccaaattctcatataaaaagcatttccccttggctcattaatcaagcagctatttaagaaaataatttatataaatgtttatagcacaaaaataaagtgctttatttgaaaagggaaagataagaacgtagtcaagagcaatgttaaaatctcagttggaatatatgcccagtaatcttttaaagccaaaatgatttggcaagattttcatgcaatttatgagtgcatgggatgtctgaagctggttataaaattggttttagtcagtaggatcaatgattctcaatctgaaaatctcccacggcccccaagcactgcatatacttctttttttattagaaagctagcagttctgaaagaactgcacaaagctgatgtgatccaccaaatgcataatgcacatcttcagaatcacccatgtaaaaacacgtatttaccagaattgagcaaacggttttggcagggcaagtatatatattttttaaatcttcaaatcagcatgcctgtaatgggccagaaaaatgagtgaggctattaccatcaatatcaattagtccaaacaacacatgataactaatgtgtctttactagggatgtctagaaatgaaaccatgggtctaggttgagacctactctcttaacacctaacctctgtctgggaatggatcacaggattaagtgacctcaaatccttgtgaacagggagcaacaaaatccgtaatttgggcaatgatactgaacagaggtatttctggctgtttctcacaacctcagcatagcttcatgtccaaagatctattgtgccatctgtaaacaacagagcatttgctaagctggggaaggaagtcagccaaaacgtgaaggcagattctcaaggcaaagaaggccctctctgctttttcaaccctcagcaaatcagcaggtttatgtaaatatagcaaaagcacagtcccctcaagggtaaaaatctcagtctgaagcattaggcagtgtgtcattatgaaacacaaagaacctgtcagcatcttttctgacagcctcctacagagcagagtggacacttacctcacccactaatttagcaagcagtgccacacacgccagtactaaaactgtggtcacaacatatataggcaatgctcagccactgctccacctcataaagaattttcctttccatcaatgtgtctccgcctattaatctttgaaataccttctcatccctttgcaaagcatggcagtgccactctgatataatttccaatagaaaaccccattgtaaaaagcacgcatgaacaaagactttctcacaaagagatttctcagagaccaagctgggtggcacagcggtgaaatgggaagttgactctcaggactgcaccgctcttctgctttctgtttctcctctacatgactcctccaccctcaatgcttggaggtaacagtcaatgaggtacagtatgttggtctaatattgcagaataaaaaatccacaagtatctctctacagttaaaacagatgtcctccattttccaagacacacaaagagtgtatatgttatgtgtgtgtgcatgctggaaacaacgctgaaatcccggtacccaaattccaatccagagtctctggcatactgcatgtcctccaacaaaccctcccagttctagtctcccaaaccataaaacagccaaacccatcaccattcctcaactctataaacaatgcactgttcttcatagtaaacactcaaaaattatatgaggaacaaacaaactaaacagagacatggtttaaaaaaaaaagaagagagagatcctagcaagaaagttgctacgctctatcaatatgaacaaaacaaatgctgtattctaatacttctttaggaaataactcgattgccaggtaacctactttagtttcctgccagaatcttttgctgtgaggggtactcatattgactgtaacactggagaatttaaaagggaaaaggactgctgctcaggaagctcaggtgacagcatcactggagccctggagttcaaagctgcagtgagctatgatccagccactgtactccaatctaggtgacagagtgagaccctgtcactcagtcatacatacatacgtacatatatacacacatacatacatggaaaaggaaacaaaaattgggaaaagtgcacctccataaatgaagccttcccagtccttacccttactctgtttatcaactgttatcaaaatcagctgcatcatcttaaggattctaaacttggtgggaaaagatcccagataacatatatctttgttcccctcttttttaaacataataattacattccatgtattgaaatgtctatagattcccaagtagtgctacaaagaaagcctcactaaacacagaacactaaatatttctagcaaacattcatctgtctttatcctcattgctaacaaggacagttaaataatgagaacaaacaagttgaggggaacaggtcataataaactaaaagggattttgttgaaaattcctacatttctcttttctcctttaaaagtcaggaaatctcccaatgtattgaaaacttaaaaactgatctcagataattatcttcccaactttaaaaaataatgctgggccaggcatggtggcacatgcctgtaattccagcactttgggaggccgaggcagaggactgcctgtgccctggagtttgaggttacaatgagctatgactgtaccaccactacactccagcctgggtgacagcatgaaaccttgtctcttaaaaaaataaaaaataacagtgatgtggatgttttggactaactgctgcagcatgaagcatgacccccgcttcccaaatcaatcatatgctatacaaacttgcgaactctgtggaacaagaaaaagcaaaattatcctgccagtagcagaaatcttattagttatactgatatgctaaatattagccatggttggacacttatattacccaagcaaagaacactgtaagcactctcatctccttattttactctgaaaacgttccttaaatagcaccccttgtcagctgtgttggttgagtccctatcatgaaagtgagtttagccaatgtaacatccaagttccagttaactgatgtggatctctatactagtataaaacttgtgttcatatacagcttatgtgctgtaagagaataaaagtaatccaaggggggaaatctattttaaaattcagtgacagccatctacctattgaagtagtgcttgtggcaccacagacacaaaggaagagaacttccaggcttcactcactctttctgtccccttgatacttcagagtatctaatttcctaaagcttaaaaatgcaggtgacaattctatcctcaatttaacgactcatcccctcccccaaaaaaactatgctctgaaccctattaagtagaggatgattactaatggaaatgctgacagatccttaacttaatgatgagaactgatatatggctgaaataatgtacattcaagaaatcaatgcaaagagtccaaacacttctagaacattgtgcccagtatttataggaaaacatcatcagtgacaggtaggctgggtgaaaattcttctctccccgtatggctgacaacaaacaaattgctcgtctgatcttctggtgtcacatcctgcagcgcagatttcaagcaacactgcttgctccttttcagaaaacaatgcactaggagcctgggctttacaataaatgattcaaccaatttacagggctcactggaaatacacaggacaattcacaatgcgtgtgttataattcttatttggcaaatgattttattataaactagtaatccattttctttacaggttttctgctactgtttaatagactgtcagtataatttagatttcatctatttaaactcattcaagcctggctcctgattgtacagtaaatggaacatatttctattcaaagaaattaatgacagttaactgtagtctgcagttctcagttttgtaaatgcaactgttccacagtccaagcatcaagctacaaaatttcccacaccaattattttcctgtacttcacaggcatcttctatttcttggaagccttccttgttaagactaatgtacatattcatttaatattctttcccattcaaatatttacctccaactttctagaaagttaggacttaaatacaaccaaaatgtcagaaaataaaagtttaattgccattctggaaagatgttctactaatacggatttttttaagttagcaaaattcaagattaaaagacatttttaaaaacatactcttggatgattttcttatatatttcaaatcagttacaatgtcaacattaagtgaaatttattaaaagtaggctaaatatcctatatggatttaaatatacaaacaaggcacatggcatatattaatatatactgaattgcttctgagattgatattctgtttaagagaaatttacttatggccaagcttagtggctcacacttataatcccaacacattgggaggtggaggcaggaggatcacttcaggtcagaagttcgagaccagcctgagcaacatagcaagactccatctctacaaaaaaaatttttttaaatagctgggcacggtggcaggcacctgcagtcccagctgcttaggaggttgaggtgggaggatcacttaagcccaggaggttgaggctgcagtgagctataatagcaccactgcgtgccagcctggggaacaaagcaagatcctgtctcttaaacacgcacgtgcgcacgcacacacacagacacacacacacacacacacacaaaaatgtacttctgagtgttagttactagaaatcacaacaatcccgtgagtgatttttcttcttgagtgattactctttcatggaagaggaaacatccacacagctgtgtaagacatgcttaaagcagaaaaaagcatgcaaagatgcaccttaaaagaaacttattggctgcgcacggtggctcaggcctgtaatcccagcactttgggaagccgaggcaggtggatcgtgtgagcccaggagttcgagaccaacctgggcaacgtggcaaaactctgtctctacaaaaagaaaaaaaaaattacccaggtgtgatggcgtgcacctgtggtcccagctactgaggaggctgaggtgggaggattgcttgaccacaggaggcagaagctacagtgaacagagatggtgccactgcactccagcctgagcaacagagtgagactctgtcaaagaaagaaaagaggaagagaaatgaacttatcaaatcaacacccaaacagtaataaggtaaggacccagaatttgctgccccaaactataaccaccagggtcacacaatgacagatgagaagtaaaggaaaaacagagacacccttttcattcagcaagcaaagtctgctcacctggctttgtttctcctctcctatagacacattcaatcaagaccaagccatgcccatcctcacgctgctgctactacaaccgctcttcccaaccaggtcctatcacaatcctgctcaaccttcaggacccaaatgccaccaacttacaacctgttctattcagttatctgcccactcaatgcctattactaacgtatcacttccctaaatgagagcaatttctccccacaaaatgaaggatcaagggctaaaatcctttctactttttttatcttgcagtaccataccactataaaacatcttctacaaagttgcaggcacagaagactgtgctcttgttttattggctgattgttaaaatgctactaatactatagctgacatctaatacacttcattaaattctaccagcttacttgaaatctattacagtgtcagcaggcttcaaatttaattgtttgctttagtttatataaacttgaaagggcaaatgaaacctgttccctgactctcgaaatctacccatacctactccttctctcccttaaatcgttgttgttttcattcgggtttttgttgtcattgctgttgtttgggcaggtcttacttcttctaattgaagtcaaagaataaagatttacttatttatttagagacggagtcttgctctgtcacccaggctggagtgcagtggcgcgatctcggttcactgcaagctccgcctcccaggttcaagccattctcctacctcagcctcatgagtagctgggactacaggtgcccaccaccacgcccggctaattttttgtatttttagtagagatgaggtttcactgtgttagccaggatggtcttgatctcccgacctcgtgatccgcctgcctcagcctctcaaagtgctgggattagaggcgtgagccaccgcgcctggcctgaataaagatactttaagaataatttaaaacatcaagacactttcctatgacaataaatattgagacctcatttttcctttaaagatcttcagcccactgtgaattacaaatgtcattttacaactattcaacaggtattttgaaaaaacaattccacctacacagtaatttccaatcatctatctccttatgattgcaatcatccatctccttatgatacagtgattttgctttctgaaatatacaatatactcaggataaaaagaattctagggttgtaagggattttgtctggtaatctgctgtccacctgtcactttcataatcaaaattagcacagatttcagcaaggtcatagtatttaaagtatctaaatgcttcttgattcctaaaatgagacgagagcttctgtttattgttcaagccctaagaggctctggatgctttctatatgaaaccgtattcacaacagacttcgttcaacaaatgagtgcagctgctctaggccaatataacacttaatgagagtgttgctttagcatgctccttttgtaatctgtaccttggaaaaattacgttttgaacatctgcgaagacaaaatgtatgagaactttgggaggaaaaattaagacttccccattctaaacaaagtatatgaaagaccctttgtcttataggcaagtcttgtcaaggttacattaaaaataaagaatatgaaggattctataaggaaaagaatcataatctcataaaaacattcacacacaaactgactgggcaccactaatgtgccacgtaagtgctggagatgctaaggcgaaaaaaacactgtccttcccttgacaagttcacaatctaatataagaggtagacatggaaacaactgtatgtcttcaattattattttattttatcttatcttatcttatcttatcttatcttattttattttattttattttatttttaagactgagtttcactcttgttgcccaggctggagtgcaatggcgcgatctcagctcaccgcaacctccgcctcccaggttcaagtgattctcgtgcctcagtctcccaagtagctgggaatgcaggcatgcaccacaacacccggctaattttgtatttttagtagagacagggtttcaccttgttggtcaggcaggtcttgaactcccaacctcaggtgatctacccacctcggcctcccaaagtgctgggattacaggcgtaagccaccgcacccggccatcttcaataattttaatggttacttattttttttgtctctgaaacagggactgctagctgggcccaatatttattctccccttcttccttattaagaaggctgggcatggtggcacatgcttgtagtcccacatactcaggaggctgaggtgggaggatctcttgagcccaggagtatgagcctgcagtgaactatgatgaccactgcactccagcctgggcaacagtgtgaatcctcatctcagaaacaaagaagcaataataataataacaataataatattaaataaaatataaaaaaataaaaaacatctggtacacagttggacacatggcctctcagaataaagacacttcccagcctctctaacagctaactcggtcatgcaacaaagtcctagccataaaatataagcagacctataatatttcaacttctggaaactgaatcctgaaaagtggaagccttgctcttcttactcttcctagtagtctgaaggcaaatgtgtgggctggaggtggagcaggagatagagcatgggagaacaaagagaatggaggccacatacaatggagtaacagaagctttgcctgtagctcaagaaccaagccgagaatccacacctcctgattcacagttcagtattttcggccactttactcaaatatttttataaattatttttaaatcggcaaaatatttaaatttcatccattaaatttaaatttctagatgccctagtggcatccagaacacatattttggggaaaatattctaatttttttaaacagaaaaagctaggaacagatgatgcattaaaaagtagaacacagagctcttaatttagaatgatcaaaataggttgattcaactattaccttctcctaggattatgaatcaacccctagcagcagacaaagtcacaacttcctcccctaagagactttacagtgaagtcaagttcctagcacgactctactataaggttgcacaagtaggaataagtgatgttaacctctcctgcagactgcctggcattctttgtgagggcaggtggatggtgtctgctggcactactcagtctcccctctttcatactccacttctgtacaggtttgatcaggacttgagagagaatacatgactgttcttccacaaaaatatagggactaccgacaaacaaattttctagaacattgtattatttataagagttaaagctgaccaaaatcatactatcctaaattctcagattataatctatattttacttcatattagaaggacgatatcctctgtgataccacagctctacctcctttccacacccttaacccggggaccaaaagaagagcacaaaaatatgtctgatccactcatggtggcaaagatttacccttcaaagattatacaaagtctcctgttctattgacacaacatttctccaatttctcttttttgttgacattaaagttacataaggacatttcttcaatttcaaaactacaaattcagtcacttttataggccaaagccctacgatacactagggctggttagaaagaagtgtgaaacctttaaatgtccagacatactaactcagtaattccattccttaggaaagtgagctgaaataaatttatcgatattcatcactgctgtttagaacggagaatatttggaaaacatcaagtccaacaacacagaactagttaaactgtggcatatagccattagcgtgtgagcatgtcatatttttttgtgccatggatgactttagcattctatatacctgttcttaaataaattttttaatgtacgaaagcaacatatattgaaatacttatcataatataaaaaacttgtaatatagtaatatgtgtacttttttgttgattcattaaataacaggatttactagaggtcactccctgaataacctccatactttcaaagtaatgtggaatataaacattattttgagatgttttttccatgtgatgtgataggagaatacctataatttatactgatgtcataggcactgccagtattgctgtgcttatcacctagcttcataaatgaagtgaatgctgaatgtcatttgacatttgatgaactggtaaaaataaagatgcaattttttcctcacccaagttcacaatcccttaaatttgccttggttggccatataccccaggttatgaatctcagcatgaatggcatacaaagcagccagaacagttcagatttacaagtggtggcatggaaataaattcaggacatgttaagaaccacatcacaaaactgcgaatagcttaactccatatacgttcactaagaaaactgaccatacaacaaatgttaacagtggttaagtagcttctattttaacttttacttgtccacatttttcaattttattccttgaaaatgtattatttgttcaccaaaaagggaaaatgcagaaggaaactcatagacgaaaaaaaatttttttttttttttttttttttttgagatggagtctcgctgtcgcctaggctggagtgcagtggcgcgaagctccgcctcccgtgttcatgccattctcttgcctcagccttctgagtagctgggactacaggcacccgccaacacgcccggctaattgtttgcatttttagtagagacagggtttcaccatgttggccaggatggtctcgatctcctgatctcattatcctcccatctcggcctcccaaagtgctgggattacaggcgtgagccaccgcgcccagccaagaaaaatttttgaagtctatagccaaatattataaatgtactcaaagggcaaaagaagaagcagtaagtaaattcaggggagagaacataaaaatggaccacgcttaatcattacagaagctaagttagagaaacaacactgaaaagggtgctggaaatccgtacgttcatgtatcagatgccacagcacttagaatcctgacaactgggagataatagaagtaaaacatatgacaaaactgatggtctctacaacagccagcctccaccaatcctgacctaaatgccaactgcaatctttaaaaagcttgcgctccatgatgccaaatatctattttggggatagctgctgcagacttcaaaatcattctggtttataaccctgaaagatagctccgagtttttctccaaccaaatatcttccagccagtccagagaataaactggaaatcaagtctccattgtctagttagaaactgagttatataactccttgcaaggaagaaatatcatctccccaagtctgagtgctaacagagtaattaccagatgcaaacttcaaaaccttatgtgtatttctatgctgtgaaatagtggtaattaaactactacttttcagttaaactgttcctaaggatgtaaaaatacagcataccaggtgagacctttttgtgacatttcctttccctctactaaaaaggaaaaattataattatacacagtattactaacattgccacaatcaatttggtaactgcacagtagctatgttttataataccagcacaatgggatggccaggacaagtaaagtctaaaaactaaatactgtctaataataatgatagcctgctttagagccaagttatacagagctttacaaatagagcccaaattaaaatgttaatgaaaaaattaagaataaaaagcacagctaggcatggtgatatgcacctgtgatcccagctacttgagaggctgaagtggggaggactgcttgagcctgggaggtggagggtacagtgagccagagattgcaccattgcactccaacctgggtgacagagtaagaccctgtctcagaaaaaaaaagaataaaaaacaacatattgaaattatgctaaaaatctgtatcataaactcactccactttccctttctaaaagagaggtataactataatcaaagctcccctcccaacttttttttttaaactatatgaatctctattgatcagtctacagtgagacactaacactccatctgtcaagtatcaacatctgtccaacacaaagaaagccagaacaatgcctgcagccttcaaagggatataaaactgtacctttgccttttaaagtttggtttatcattttacacattacactatcactctgtacataactgaaaaggcattccttgcaaacataactgaatagggaaatctagagatgtaagtcagaaaacacatttaggggttaaatgagtgaacagtggtggagtatctttcatatgtaacatatactatgatgcctaattagcttgagtacatttttaatggtgaaataatgaaaaagacttaaaggtactggatatttaatgcatatataatgacaaatagtcattatgtatgaattcaatggacttggtaaagtgactagaaatttacccatttccaggcatttaagcattcacttaaaagaatgaagtgactaacttaccttctcccatctatctctggtacttacaatacgcattataaaactcagactaatactaaggaaggagtaaaatagtgaagcatttatcctcactttttctagtatttagggtattcacatagctccaaagtaaaattcatgcacagccatctattctgcagtatttaaaactttttaaaacaacaaatcactcttgtccacatacattttaaagtaatttaacaaacaaaatacactgctccatcttcatagacagtatttttaattttggaaagtctggttttctcagctggtgaagctgtcagaataaatagaaggcaatatctggaaagatgacaaacacatgggtcaatgtcaaatacaagccaatctctgtcaagaaaaagagccaaattcctgcatttccatttaaattacgttatccaactcaaataccaccatgccacttcaaatgaaaatagtttccctttaaacagagctttttacaaaactgatagagtataacagattaaacaactctttcagcaattttcttagctactacaaagtaaggcatctatgtataattataataaggggaacatttaacaattaattgagccagctaaagctaaatctccagagcttaggagttcaaatgcttgctcactaagaaaaaaggacagaggattttaatataactgcaggaaatctcagtccaattagattctaggtaaatataaatcttgttgcactgtgattggaactctgtcacagtcctccggactgattttagcatctggcttggagagtcaaaccaaagaactccttgccccactgtttctctccacacactactgaattaatcaagtacctccaggttctgtgctgaacaaagaaggtcttctgaaggctgtcagcttgcttttacaaccaaccaataagactcacagaacatatcatacaactgtgaggcagtaacatctctgaaaatattcatgatttaccctagtttatcatggcgacaccttaagtaattcactgtctttcctcattcagaattagatcacgtgaggccaggagccatccccttttggagttttgataatggagacttagcaactatctttcaaaccaaggaggattaaaaattaagtaatcaaattaactagggtggcagttcacttccttaacttaatatacatcttttatctctgtgaagatctagaaaagtgcagaaggatttaacagaatcaaaagtatcgtattaacattttgggggtcaaaaaatcaggatatattttatattttaaataattttatagttgaaagaatttggtctgttagaaactggccttgtaaccccaatctaaaaccccaatctaaaacagtaacacttaacaaggattttaatataggactggccctttctgagttccgcacctatgtgcttgtgtatatacttatttaatccccatcacaattctggaggtaggtactcttatccccattttattgatgaaaagacaaaggcacagaggctgtcctctactccacgttaacccaccagcagtggggtactagattatgctgtcctttctccctctgtgtaactgattcagatttgtggtcaagatgaaacctaaggaagtttatgcacaacactgaaacatctaagagaattttttagggctgtttcacttgtaagtctaattaacttataagaagagttaagtacttgaggtttgtgttaatagactttttaaaaatagaaaccaaatattaaattagtaaaggcaagcttaaatgttgaagatattaacgagtttataaacaagactaatttgtaattcaaaatcccttaaaagtgattaaaatgtttaatttataaatgagatttataagctgaattttttaaaaagtgtaacagtgtccttcaatttgcaactttaacaaattgaatatcaatttttttaaacctaggtaaaccttctggacagtcatttctgcatataaatatcaatcttaaggactcttcccaaaaagtcctcccatcaactgctctgtgcacatgtctcctactcaactgctaaaggaagaacagctgagacaatgctacccaagagaggcacctagggctaagcactcacatctagcagctaactctgcctgcgctaataggtatctagggaatgagtaagtgcctagaatgtgctagacacttttccaagtacctgggatacatcggggaaaaagatccctgtcctgctggaaccaaccagcatggaaaaagacacacaacagaaatggaaatggaagatgccatgggtgtgagtgactgtgaaaggtggggggatccaagaattgaaaatcctagtgggctcaaacaatttctggatcaattggccccaggaaggtggaaagttaagaggtagaagagtggaatccatgagtaggtcatcaccaggctgcattcctgaatctgatcattaattgctcataaaaataccttcaaagattgacctttcaacatgtttttgctcattattgagcccaatttttaaacagccacctaaagaacatttctgtttcctctggaacacagtttttgaacacactgtggttcactgcttcttatgtagatatttctgctataacacaatatatgttactgggaagaccacatattcagcaaaaatgttcactaaaaatgaaaggacttacgtaaaatacagggtaaaaagcagactactcaaaccctatgcaactctgaaatcagatggctattttgttaaaaatcaatacttaagaaataagaaacccaggcagttacccaagagtggctgcacgctgccaaaggtgatactgagaatacatgaaaacaacagatgctggcttgaaggcaccaaaacaatgcagtaatctgggggtttttgtgaaggtgagcacagcagacagggcaacctgccacagagcataatgttagcgtgtgcctctctggggagggaaccccaggggacaggtgttcatttttcatttcattttcaatagaaatgagaaagctcctgctgatgcaacagccagagtgaaagtttaaattctcacctatttttttcctttcctgctaaaatacaatcccacattataccattaaagtatatattataattctattccatctggtcacactcctcttgcctagcaaaagttgcacatgaaccagcataaagtgcacattctattgacctcactgttctatttacttacctatcacacacaaagcaaaacaaactattgctaaatatccatatgcaataacaaggtctcatggccagcccacatctatttcccctaccaaactgcttcccaagctcattgtggggaataactttagccccatcatgtgcaggcttgggaaagcaatcaatccaggtttctgtctttttttatacaagacatgtgcatgcaattcaaggtagacatactatatttactcttttggaactgtgaatcttgagctgagtgacagcaaggacaggaagatcctgaagggccctattccagttatagcatgtggttggaacggtcagtagttcccgccaaccaagtacctgaacgctctcgttccaagtaggttttggaggcttttttccagcttcccaaccattatgggggaagcctgtaattatgtgagccactctaacaacacattgccctttgtgttatgtgatcaatgtacaccaccttgcatcaaaaaacttttcatgcatacaacatgcttgctttttattagatcatagaaaaatgtgtatttctctttcagttacttagggttcaaaatccagtaatcaccattagcctatgtattcttgaacaatttactactcaccttctcagcttacttcccatagtttccttatggactatgttgcccaggctagcctcaaacttctgggctcaagtgatcctgccaactcagtctcctgaggagctgggactacagatgctcaccactgtgcctgactagacatacaatttttggcaacaggagagctataaataattttaggagtaaaaggagaaaagagaaaaagagcaaagtaattatatcacttgcattttcgaagaaatcagtctatctcttcttttttcttccacacaggttatttgttttttgtattctcttcagggttttatgcaaatgtccgttcattcttggctttaaccagttctcacaggcccataccattttacaaaccagctgtgtgactttggcctccatgtctttgtttcctcatctgtacagcagggaaacaatgtctaggttgtataggaattttctaaggactagaaattacacactcaaagcaaatccagtagatagaaggtgctttaaaactggttgtcacccatgttgtagctcccttactatttacagccaagttcacagtgccctttgcaatcaggcactttagaagatgcaaattattcccaataatttggccagaatgtaattctgcagccacctctgttcttcttgaactgcatgcatcatattttaacgtcaaaatctcaagccatgaaatcacatattttttctctaatttttgatctgcctaatttgtagtctgccacaggtaagtgacaagcatgctgggtactaatcctctcacctcatgcaatggactcattttatatctgcgttagcttgaaaaagactgggaagcactaatgagtgattagtgactctcaaatctaaacgtgtgtttaaatcacctggacatcttattatataaaacatggattttgattcagcagattgggggcggaatctgagattctgcatttctaaccaactcccatgggatgccaatctgtggccaatgcttggtgcagagaacaactacagtacaggtttcatgatacttaatgatcctttccctataaaatcaaaaaagatatgattaatttgtctcaaatatcacttcccatttctctaattagaataactttagtattttctctttcctctatcctcacgaagtaataagtttttatgtgctaaagaattgtctttcacatacgtggaatttgaataacttcctaatatacatgaaaaggcaatcaactaaaagatgaaataaaatttcaaaagaaacagaagaaattaaaagttaactaatgtaatccataactaaaagttcactataatgtgactgaaaataagaactacattttcccaactgttccaaagacatacaactaagagaactgaggagatgtcactcaaatgtgaaacacctgaacctgagtctacctaacaacaaagctctcaaatgtgaaacacctgaacctgagtctacctaacaacaaagctcttcctgcctgttacaggatgagtttgtccttcccaaaattcgtatgttgaagtctttactcccaatagctcagaatgtgaccttattaaagaacaggtaaggccaggcacagtggctcatgcccgtaatctcaacactttgagatgctgaggcaagactcctggcttgagtccaggagttcaagaccagcctagacaacaaaacaagatcccttctctaaaaaaaaattagaaactagctgggcacagtgccgtgcacctgtagttccagctacttgagaggctgaggcaggaggaccacttgagctcgggagttcaaggcttcagtaagccgtgttcatgtcactgcactgttgtctggacaacagagtgagacccttccccgccactcaaaaaaaaacaaacaaacaaaaaaaaaacagggtcatcattgccaatgtaactaaaataaggacacatgaaaatataattacactgtaggtgtgattagttaacattaagtaaggtgagccctaatccaatatgactggcatccttacaaaaaggaaaaatgtagatagacacagagatatgtacacaaagagaatgctatgaaagatcaccactacgctgccacaaagcagcaaactactgtaagcaaggacagaggcttgaaacagatccttccctggtgccttcagaggtaacatgaggctgggtggagtggctcatgcctgaaatcccagcactttgggaggccaaggtgggcggatagtgtgagccaaggagttcaagatcagcctgggcaacatggcaaaaccttgtctctacaaaaaatacaattagccaggcatggtaatgcatgcctatagtccctgctactcaggagattgaggctgcagtgagcaatgatcatgccatagcacaccatcctgggcgaccctgtctcaaaaagaaatgaaaaagaggtaacacgaccctgccaacaccttgctgttggatgtgtggcctccagaactgtaagacaacatacctctgttgtttaagccactccatttgttatacagccacagcatccctaacatactaacacacagccacattgtgtttcctcccaaataagattaacgttgattaaataacattaaagatgattgtgcagataggcaactaggtcacagagggtctacagtgccaggttctgggaacaaacctgctggtgaacagggaatacactgaaaagctttaagcagattaataataggtctaataagtgcaactgaatttgtcacatgtcggaaaaaaaacattaagctctgcctaaagatgcctttatgctatgttacacaaaaatattcttgccattatcaataaaactaccccaccacaaaatatgaatgtttcaagaagacaccttcatttgcatgtcacatctattaatacctaaaattcttctaaatattgagatgtagataaaaagttacagatcaaatgagcttctatttaaaatatgtatgtgtgtgtgtgtgtgtgtgtgtgtgtgtgtgtgtgtcccctggaacaccaaataccacatcttggttttgttttattttgggaaggaaatgtttgtctgagtaattaattgccttacagaagctttcgatgattcagagaactaaggatgtgacaccacttgcagcctccacagacctcagtgaagacgcagtagctaaatgttaggaccatttgttaaaatatcggggactccctccccactttaaacagtaacttgattgaatggaaattttccatttagaaaatagttgcatgttatctttactttttcttttaaggcaaacttttactgaagtgtaatacatatacagagaagtgcaaaatgcagtaaattttcacagaacaagtccatgtaaccagtaccataaaacgtaacatggccagaacctgggggtccccttaatgttctgttccctgtacccatagggcaatctctctcctgacttcaaacaccaaagattagttgtggctgttttaaaattttctataaaaggaattatacagtattatgctcttctgtgtccactcaacatcatgtttcatgttgaaatcatttacctgtttttgcgatggggtctcactctgtaacccaggctgcagtgcagtggtgcaatcactgctcactgcagcctcaaccttccatgcttaagggatcctcccacctcagcctcccaagtagctgggactacaggagcacaccaccaagcccggctaacttttgtattttgagtagagacaaggtttcgccatgttgcccaagctggtcttgaactcctgggctcaatctacctacctacctccacctcccaaagttctggaattacagacgtgagccactgcacctgacctatagtcatttactttaaataggttttagaaataacgtatattccatttttattcaaactagatcctcaggtttcattttgcctagtttgaattttttccagcttaaattccatttgcatcaaaagaaaataacacttaagtgatcaaagtaaacaattctagtttccagggcatttttcctcaaaattgtcaaataaaatggtcaaatattttgcatcacctaagatttcacaaaccacaaacttatatacataaatacatgttttgcactatgttcatgaaagtagaaggaacacatattctaggactatagggtaaataggacaatcaaacaaaattatcagttaatatgacaaaatgttaaaaaattaatacatacttttgaaaaaaaaaatacatttcattatccaaatagcaagcaataccaatatgccaaaataaaaaaaaaaatctcacaataatatgaagttagttttttaaccagttctacctacaccagaaataaaggaatcaaatttcctagaacctaactgaaaacagtagaaagaaattaatatgccacctacagcaaactccagaaatcaatatcctatgctaaagaagcccagaaggaaaatctggctgcacacagctgtgtaataaatcaatttgttaccgtgacagtcatctcaaaacaggagtaatggctgacagacaacaaagaagttagatctgactcaaggacaatatacaatagagccccacaaggtttttgttttggttttatttttaaacaagtctgttaaatcattcattgggaagtaatacaaaacagacttccagaagtcttattctaattttaacatcatcaatgagtcaataattttttttaatgtttctagaaatttctttattcaacaaatattatggaatacaggctgggcgcggtggctctcacctgtaatcccagcagtttgggaggccgaggtgggcagatcacttgaggtcaggagttcgagaccagcctggccaacatggtgaaaccctgactctactaaaaacacaaaaattagccgggcgtggtgtcacacgcctgtaatcccagctactctcgaagatgaggcaggagaatcacttgaacccaggaggcggaggttgcagtgagctgagattgcaccactgcactccagcctgcatgacagggcaagactccgtctcaaaaaaaaaaaaaaaaatgtatatatattatggaatacacactatgtgtacactattgtcagtagatggcaggaattcaatgatgagtgggggaaaataagaattgctgtttttttggagaagggagacttattaatcctaataaaattattactgttctaagtgctagaagaaaagatacaaaaaaggctataacagtatttattaaggaaatgtatttgactaacctgggagaaaggcagtgacactggggtggcagagcttaagaaaagataagaattaagtgtgttaccgagacgagaagagcaagtgcaaaggccccgaggcaggcgggaacatgggcagtgtaagtaacaaaatctattatgctgagctcctaaggacaaaattaaggtaatcccagagtttagcagcaaaggtgaaaaagacctggttgtgacaacgcatgagattaaaccgtagtgataaattctaaataatatttaatttctccataagatcacatgcttctaaacactaaacaatttaaatatagcttgggacagaaaagtatgattatatgaaagcctacctttatcctcaaagtatccctgctatgctcattctcagtgacatttcgagaggtccctataatttatacttattctgagtagtaaaaccaattcagagatgtagaaagcaataaatatttgaaaaatcttaatttgtgctttatatcccatagaaataaatgagtattaaagatctattcacttggaagcggtggttcacgtctgtaatcccagcactttgggaggccaaggtgggtggatcacctgaggtcaggagttcgagaccagcctagccaatgtggtaaaaccctgtctctacaaaaaatacaaaaattaggccaggagcagtggctcacgcctgtaatcccagcactttaggaggccggggcgggcagatcacaaagtcaggagatcgagaccatcctagccaacatggtgaaaccccgtctctactaaaaacacaaaaattagctgggcatggtggcacgcgcctgtaatcccagctacttatgaggctgaggcaggagaatcgcttgaacccaggaggcggaggttgcagtgagccgagatcgcaccactgccctccagcctggcgacagagtgagactccatctcaaaaaaaaataaaaattaaattaaattaaataaataaataaataaaaataaattagctgggtgtagtgccacgtgcctgtaatcccagctactcaggaggctgaggcaggagaattgcttgaacccaggaggcagaggttgcagtgagttgagatctcacaactgcatcaagcctgggcaacaggctgagactacgtctcaaaaaaaaaaatctaccatttaaaaactagtaatttggccagatgcagtggctcatacctataaccccaagactttgggagatggaggcaggaggatcacttgaggccaggagttcaagaccagcctgaataacatagcaagaccccatctctacaaaaaaattgttaataggccaggtgtaagcacacctgtagtcctagctactcaagaggctgaggcaggagaagcaattgagcccaggagttcgaggatgtggttaactatgatcacgccactaccctccagtctgagcgacagagtgagactctctgtttttttttaagctagtaatccattgaagatatcctttacaacattctccacagatcctaagcttttaagatacaactaagcacacaggatctctgcaagtgggtgaggataatggtttttcatcactaacaaaggatgttattgtagtagtttatatcaagaaagtaaaagaccaggtgcagtggcttaggcctataatcccagcactttgggaagccaaggcaggaggatgacttgagcctgggaggtcaaggctgcagtgagctgtgatcataccactgacagcctggatgacagagcaataccctgtctcaaaagaaaaaaaaaaaaaatcaggaaacaaaacaaaggaaagaaaaaactcaacccccatctgggaatctaatcacagtactctgctggtttttttggttttgttttttgttttttaagagacagtcttgctctgtcacccaggctgtaatataatggcatgtagttcactgcagccttaaactcctggcctcaagtgatcctcccacctgagactctcaaagtgctgggattacaggtgtgagccaccttgcccagcccagcaccctacttctgattcttcagtttaagtaaccctaaagaacagacaatatttaacaaatactcatttagagaaaaagctgtttggagaaggcagctaactcagcttcaaatccatcaccaaaacgaaaggaaaccactgagaaggtcaaagacagtctccttaccaaatagacatccactggacctggcaggatgcaaaggcacagcccccactcaagcaaaagggtgcctcacatggagctgtcttgctctgggtgccacggaaatcttccaaaccatgtgtggcctttatagatccttcataatacacttagctttcagagacagcatacctttctcacatgtcacaaaggttttcagattcactgaaacactaccagcctccacaaatacatagttcttgcccaagcactttaagaaccattctgtaaataagtccttagcaatctcccttcacatattcttccagactcaagaagggaggtgtattagtccattctcacgctgctataaagaactgcctcagactgggttatttataaaggacagaggtttaattgatccacaattccacagggctggggaggccttaggaagcttacaattatggtggaaagagaaacaaacacatccttctcatatgacagtaagagagagaagggctgagcaaaggtggaaaggccccttataaaaccatcatatcctgtgagaactcactcactatcataagaacatgatggcggaaactgcccccatgattcatttatctccacctagtcccgaccttgacacgtggggattattacaattcaaggtgacatttgggtgaggacacacagccaaatcattatcaggaggacttcctataatcatagttcaccacgcccagctaatttgtaaaaatttcactacaatcatagagcactgcaaccttgacctcctgtgctcaagagatcctcccacttcagtctcacaagtagccgagactaaaagcacacgccactgtgcccagatccaagactgtttgtggtttgttggtttatttctatttttagggagatactcagcagaaacagggtgccacagtcccataaatgggaaaaatagccggtgtttttcatgttaaagaggtttccttaactgtcgggcttcttggagtcactaattctgactctctcatgagggagactgtacaggcagcattttccacacatatttgactactatttttggtgaaatgtccccactgacaccagaataacgttccatattataaatgctgagaaaggttagcattcaatactgcacaaggcagcttgccttttgacagtgatccaaactgtattaccacattaaattgttatcaagagaaaggataataaaaaagtaaatctttccttatactgaagttatcataatgtaatctatatctaaaagagttggccaggcgcgatggctcacgcctgtaatcccagcactttgggaggccgaggcgggtagatcacgaggtcaggagatcgagaccacggtgaaaccccgtctctactaaaaatacaaaatattagctgggcgcagtggtgggcgcctgtagtcccagctactggggaggctgaggcaggagaatggcgtgaacccgggaggcggagcttgcagtgagccaagatcgcgccactgcactccagcctaagcaacagagcgagactccacctcaaaaaaaaaaaaaaaaaaaaaagggttaacatgttttgttcctttcccatgatttagatgtgcgtacgccctaaacaagcaatctgtggtaactctgagagattcttcagtcactaagaaattcttactgcccaatagctgagtctacatcaaagataaatacagacagtactgtaacctacacacatcatttaatcgttacagcagatttctaactgctctaaaacctccactctgatcaatttatatcacacaaataccttctcagttaatctccaaccaagaaattgtagctgtgaatgcaaatttgtctgtattaagttctagcactgactttttttttttttgcgggggggaggggtggagacagggttttgctctgctgcacaggctgcagtgctatgatgtgaacggggcttactgcagccttgccctcctgagctcaagggattcttctacctcagcctcctgagtagctgggactgcagtctcatcacactcccagctaattttttactgttttgcagagatacggtctcactatgttgcccaggctggtctccacactactcaagcaatcctcccgccgcctcagcctctcaaagtgctgggattacagtcatgagccaccgtgcccagccccactgacatcttttgaaatttaaaaaactcctgtgtgggagaatgaaaatctggaacttgacgtgaagttcataacagtaacagcattcctcagtaaaatgattgttccagattatggacataacacagtgaagtattttaatctccttctcagaaaaacataaaaatgggcagctttaatctgctaattacatctcatacaaaattcatgtcactcttcaacagtaaaagtaactcaaacaaaatgatttcacctaggttttactggcttctgtaagaaaggatcttgttttgtttttttttgtttttttttttgagacagggtcttgctctgttgcccaggctagaaagcagtggtgcaatcatgcttcactacagcctcgacctcccagactcaagtgatgctcctgcctcagcctcctgaatagctgggactacaggtgtgtgccaccaggcccagctaatttgtaaaaattttttgtaaagatgggggtctcactacgttgcccaggctggtcttgaactcctgagctcaagcaatccttctgtctccgcctcccaaagtgctgggattacactgtgcccagcctaaaaaaggtgtcttaatacacacaatacatcaaatgaaaaggaaaggctttgctagtgttcaacaggttttgactcacttgtttccctgatctcatctaaaagttgagtctgtctttttttgagcaatgctataagccacaatatactggtgtgaccataatacattttctggaaaaccaagcaggttagatgactacttctattattgttgattagagagcctgaagctcaaatttttggaaaaggaagttagcaggagcaatacatctctgatcttcagggcttttttttttttctgagacggagactcgctctgttgcccaggctggagtgcagtggtgtgatctcggctgactgcaacctccacctcctgggttcaagcaattctcccgtctcagcctcccaagtagctgggattagaggtgcacaccaccgagcccagctaatttttgtatttttagtagagacagggtttcatcatgttggtcaggctggtctcgaactcctgacctcaggtcaccacccgcctcagcctcccaaagtgctagaattgcaggcgtgagccaccatgcctggcctaaaggccatttttaaaaagtacctctctagagtctggtcgatcctgtcccaaggtaaaatttcctgtttccaagaatcttaaggtttacttgtctccaccaagcagtcaattctgcagggtcaccacagtctcatttatgattgaagattaaaaagcaagcatgaattcaaaagacaaaaaaatactaagcagatggtccagttagagaacaagcagcacaggaaaataagaaaagaactcatgaatgcataaaccaggacacaagagcaaattaaggcagacacaagcaagaagtgggtgaacctaactgaccaaaagtgggtcacatgtttaccaaattaagtttcctactcttctagattccaagccttccttaaagtgtacaaagcgtatttatttcaccataatgccaagatcattcccccactgtaaacattggcaagacccaaacgtaaggctccttacctcctggtctgtagaccacatcatcttcagtgatgtaggatgttatctcaccggtatctgtcctttcataacgagacttttttttcggtggtttcttcttattcttcttcgtggactcctctgcggtggcactattgttgtcattgtcctcgtcttcactgtgatcactctcagcataatttttggctcctccttccaaggtacagctccggcgtggccttgaattctcactctctcttgctttgtctcttttctctctctctcggtcccggtctcggtcccggtccttctctttgtctttgtctttgtctttgtccgctgtcatgattcgccacgtgccttcttctgtcctctcacggctaggcctccgtgaaaggtagacagtaagcctgggcttcagtcttctgaatttctcactcaattccagggaaaatccaaccactccaacaaccccaacgtttcaaaaatgctaggagagaaaaaagaatggttttaacgctttttcatatttgtttcctaaaataatgttttgttaaatgaatctcttacttattcatgctttacacctaaaaacttcgcacaagccacaggagaaaaattaagtgttaaaatttaaaaactacagtttttggtctcagcaaatggtttggggttttttatgacaccaataataaaaactgtctgaatgcctaagagtaaactacacttcctccaccttacatgttttctcctttttaaagaaaaagcaaaccaataccctggtagacaacatataatgggtattattatacaaaaggagcttcataactcataatattaatttaaagaggaaagaatctgtagtaaaaattatttccaggccaggcactgcggctcatgccttgtaatcccagcattttgagaggccaagccagaaggaccacttgaagccaggagttcaagaccaaccctggcaacaaagcgagatcccatctccaacataaaataaaatatttctacctgaaaaaatagtaatagtttgcagcactgtcaaaaatgtctcaggataggccgggcgcggtggctcacgcctgtaatcccagcgctttgggaggccgaggaagatggatcacggggtcaggagatcaagatcatccttgctaatgtggtaaaaccctgtctctactaaaaaatacaacaaaaattagctgggtgtggtggcgggcgcctgtagtcccggctactcaggagtctgaggcaggagaatggcgtgaacccaggagacggagcttgtagtgagccgagattgtgccactgcacttcagcctgggcgacagagcgagagactccgtctcaaaaaaaaaaaaaaaagaagaagaaaagaaaaaaaagtctcaggatatcgcatagagcactatattctaaagatattttctggctacttctacaaactcccagaacttccttcaagaataaaaataatatttaactcaaacgaaagtgagagcttcagagcaagatttttccaccttcagttacattttacacatcttttcatcctaccattttcagttatgttccaaggaaaatgatctctctaaagatgtattactggccaggcgtggtggctcacacctgtaatcacagcactttgggaggccaaggcagggggatcacgtgaggtcagaagttcgagaccagcctggccaacgtggtgaaactctgtctctactaaacacacaaaaagtagctgggcacagtggcacacgcctatagtcccagctacttgggaggctgaggcaggagaatcgcttgaacctaggaggcagaggttacagtgagccgagatcacaccactgcactccagtctgggcaaaagactccatctcaataaagaaaagaaaatgtattgtctctgccttaacaaaacataacagcttccagaaacaagcttccatctttcgggaatattaagtggtttttacagtcttccagatttctactataaatggtatccctaataaagtactccccaaaaagaaacccaacaagaaaagtcttgaggtttttaagcgtctgcaatgggaaaagtgaatcccaaactccaagctaacacagttcttacagatattttatagcaggaaaaaattttgtctttctaagtcagttttggaatagacctaacaataaatttataaataaataatttatcttttgtttttcttatgatcttccccaataccctatctcacttattcaacaaatctttactaaatactatgtgccaagtgttagaactaaaaccacaatggaggagaaaactcatggtccttgttctcaatgctcaaatgcaacaaaaggaggcaaccgatcaatctaagaagcttctgtttctcatgcaactagggtgagaaaggaaacagtgcatataaacaaacaaaagattggtcctctttacttgacaaccacaaacaaatcagtttgcagttacatgcttcagatgcagagaaaattctctttggtcagccaggcatggtggctcatacctgtaatcccagcactttgggaggccgaggtgggcagatcacgaggtcaggaggtcgagaccatcctggctaacacggtgaaaccccatctctactaaaaatacaaaaaattagccgagcgtggtggtggacacctgtagtcccagctactcgggaggctgagttaggagaaccgcttgaacccaggtggcagaggttgcagtgagctgagatcgtgccactgcactccagcctgggcaacgagagagactccatctcaaaaaaaaaaaagaaagaaagaaagaaagaaaaaagaaaattctctttggtcatgctaaaaccataacaattaccatatattctctgcagcgctcttaggtcaaacctcttaccagaaaagacctcctcataagcatctcaaatatccttagacattcagcaaaatagaaagtatttagtctttggaagataggtgatgaaggagcaatcatgcatcataagctacattagaagaaggaacgcatgtagcacaaaactagattacttccttctatgtaagaaacatgctgtttcaaacaggatttccattttctaaacatatttcaagaaaaggaaaaattatcactgcctacaaaagttttgcccagatgaaccgtctgctaaacagatagtcataaactcccaagtcctggtaggctactagtgctagcaactgaaaatacagagacctactacttcctcgacaagtcttaagtttagagcatgaacgagccaatcatgaaagaaagaaaactatcaggccaggggcggtggctcatgcctgtcatcccagcactttgggaggctgaagcgggcggatcacctgaggtcaggcgttcgaagccatcctggccaagatggcgaaaccctgtctctactaaaaatacaaaaattagctgggtgcagtgatgggtgcctgtaatcccacctactcgggaggctgaggcaggagaatcgtatgaacccaggaagcggaggttgcaatgagccaagattgtgccatggcactccagcctgggagacaaagcgagactccgtctcaaaataaaaaacaaacaaaaaacgatcagctaacaccattgttaaaatgttcctctttgaccctgaaaactcatcagtgtctactaggagtccaaaaagaatgaaaagcttgggctgaaaacctctccactgcaactgcagtttcagacagaaacacttctgataactttaagaaaaaaaatcattctccctggggttaacaagataactgctccagaaaactgtgtagaaaacattttttcagcactcaaagagaaaaaatagtaagtccaaattgtacattcaacactactcactacaaaatcatacactgtttctatttacaaagaaaatagagttgtttctgccaaaagtgagcaagaaagttaaaaattcaagaaacaataaagatgtctataaaacaaaatccagtatatgtgtatatttataaaatcaatgttctgatttatctgaaagttggctctatttatatattacataatctgcatgttatattaatatattaaattatatgaataattaataccatatcatttatatattaatgacatatttatataaccaactttcagataagtatgaacattaataatctaagcaaaagtcaatccaattaccatttacatttggctctaaaatacagctcaatgggaatatatttttttcctctatgtttagcatatgaattataattcttctgcgccttagtgtacagtgatcaacacataccaatgatgtgacagataaagaaagggacccagagaggaaccagatggcactgagaaggagagttgtcacttcaatttgctagaaatgatctacaaagtagacgatacaacaacagcatctttattatagcaccatgaggtttacagagcaagtccctcatttgattcttccaactcatgaagtgaactggacagaagttgtcatcctcgctttacagtctacagaactcagaagagatcatctgcacaaggccacgcagccaatgggcacgaagtaggattccagtgcagctgtctcagagctcaaccctatctggcttgcacaggaactcctgctgcctgtgctgccaggatctccagctcttcacaggcaccaacttctcctacattcatccatgctgatgattcacgcagacagatttaagaaacacactcactctgcccccaaagctatttttctccagtcggaaagccaaaaacattgaaaatatctgtgtcaatcactacccaacccagtgaaacaggaaacacattataacatgctttaaataagaaaaggaagaaaatctaatgtagaatacatttcagatttacaacaagcttcagctactcagtgaacaaatgtcaagtgaatgcctattatgtgctatttacagctccaggtgttggtaaacagcagaaaactcaacataaaacccctgcccttatcttgagcttatgtgctcagcagtggagagagaccaccaacaaaaggcaccatacctaatgagaagatcttacatgggaaatctaagggggacacagtgttgcaggactgcaattttaaacaagatgttcagggaaggcctctctgagggggctttgaccctgagtaggagcattagagagaaagccaaggacacatgaagggaggtgattcctgaagaggggaaaaagtgcaaggtccagaagcaggaatgagccaggcccactcaagacacaggagaccagaggggcaggaatagcacaaaaagggggagagaggtcagagatgagttcagaggttgaaggggcagggggaggaggacctggatcctggcaggcctcatgggccagggaaaggactctggcttttactcaagtgaaatgaagttactcgaatgacactttagcagggatgtgagtagcaaagaaaggcatgatctgacttctgtttaccggagatcactctggccgctgataaaacctcaaggagcgcagtggggcacgatcaccccgggaagacaagcagcagctgggaagggctggggtagtagcaacagagaatggggaaagtctcatgtttgtatgttttaaaggtaagagtcaaataaataggatgtgctgataaacttgagaggtgagagagagagggaaaaaagaaaaaggacatctggcctggatggatgaagctgctgtttgagtttcatggggagaccaggaatttggctttgaatgtgttaagcttgatcaagaagcctagaaaatcacagagtcgaagttggcagaggtccaggctggagataataatttagtttttaaagccatgagactgaatgagatcacccaggaagtgagtacaactttttgacaaaacttttaaaactcatgagaacatttattgctcacgcttgagtgcagaggatattcaaaatagacttatgagttacacatttccaaaggcagtacccttaggactccttttaagtatattcctctcaatcatttcctgattagaagattatacatcatcatttcatcttaagtaagaatatgtgggcagttgccaaagctcaaaaaatggcagcttcacctatttagctgaaggccagattcctcacagttttttgatcctattagattccccacttaatctaggggaaagaatcaaagctttcagcagagccaatatacagaattactcttcattttaggttacttcagcctctacaaacaccatcttacctcttcaaaatgaagccaacaccacccccaaacatctcacactacttctcaaaaccaattcagacaaagcacaaaaatttcagtcatactcatggtccaaatctcatttaagagaaccacttcctggctggatacagcggctcatgcctataatcccagcactgtgggataacaaagtggagaaatcatttgaggcaaggaggcaatcatttgagaccaacctgggaaacacagcaagaccccatctttacaaaagaaaaataaatttaaaaattagctatgcgtggtggtgcagacctgtagtcctagctacttgggaggctgaggtgggaggtgggaggattgtttgaggccaagagttcaaggctacaatgggctgtgatcaccaccactgcactccagcctagggaacagagtgagaccctgtctcttaaaaaacaaaaaaagaaaaccacttcctgtcagtacttaagcttaaggaaggggcccaggacagaactggggatactggactgagaagccaagatccaagttcttagcactgccgcttgctgcactgccttgggcaaatcactctacctgtctgagtcgcagtttcattgctgtaaaaggggacaagacctacctatttcacaatgctgctgttgagaattacacaagtatactatatgtaaattgtacttatagattgcaaagtgctttacaaatgtaaaatatcaataatatgtatttatttcagtcatgatttacatctactatggtagataataagctatggaagatataaaggtagccaaaacacccctatcctcaagaaacttaactatttgggcgggggtaaaatctatccagttccatgattaagaaacaaatcatggagaattaactacaaatgaagaaaaaaattaaaaatatttcctcttgggtcatgtaaaattcacttatccatggaaatctgcccctccctcctgagttcccaatcctcaagctctactcatctccattgctcaagccaggctatttgttaggatgtttgacttttgactaaatacagtgagcgaagtcctccagttaattcttcctcactcaaccacagtaagacatacttatatttttcaaatgcctgaccatactctaggcatttttgcttagcacttagtctaccagacacatcctgaacacctctgtaatggacccactgctccaactgaatcttagcttacctacttcaagccatcatcatccctcatgcagatgaatacaactgctttctaacagatctttgtgactacaaaacattgtttgccttagccttcctcccatctgtcctccagtgcagccagccagccagcatatctgacgtcccaccactttttttcataatagctcaattcagatataattcacgttccatatgaatcaccatttaaagcatacaattcatttaaagcatacaatgcccactattccttttcaaagattatggggctgccccttcacctctccagcctcacctctcccctactgcttccacctccacccctcctgcatgctcctcctgctgcctcaagacactccttcagtccctagaacccaactgctgggaatactgttccccgcccctttgtctgtgtaccttctactgaccctcagagtctccagtgtttctgctctccaattccaggaggcctcccagacctacccagagtccagccttctctttgccccccaatcctgcctgtaaaatggccctcattgatcccactagtgttatcagttgttaacttacatcacttccccactaactgcaaagtccacaaaggcaaggaccatgtctaccatgtcatattccgtgaagcaactcccactcaagcaatttcctctctgcagcaaattcaggagagcattttcctcatcattatttgattattcagtagcagctgacaggggctggccacacaccctcctggaaggcctcttttcctttcactttctagacacgatcctctccagggcctatctaactgctccctccacttcttatactaggccaaccagtgtagaagttctgttggggcactccctcttttctcatcctctactttctacctggccaatctcatatataatgcgttcatcaccaatcagataccaggacacacaggaggatccacacaagtacatgtctaccagatctccccttcagcttcagacacatgtgaaaactgttcacctggggtctcttcttggatatctcaaaggtacctcaacatgcccaaaccaaaggcatactctgcgtgcaccaccatgcctggctaatttttaaaattttttgtagagacagggtctcattttgttgcccaggctagtcttgaactcctgggctcaagcaatcctcctgtctcctctctttaatccctacatcccatcatcaacaaattatctcattgttaccttataaatttctctcaaacttatacctccaaacacctccaacatcacaaatcttagttcaatctactagtatggctttcctggaccacttgaatcaggttcttgattagtctcttcaaatccactcctctgaactcctacaattattttactgtactgcagccagggtgttcctttaaaaaggctaatgacattatgtcaatccccactttacaatacgtcagtgactcttcactttggtacattaaaaatccaaatccttatcatgatctgcaaggtgcttatccttttttcgcttcatctctcagcactgtctttcagtctacacccagccacactatccctccctcagttcccagaacacaccacactccttcctacccagagtcctttgctaaggttcttcctaccctttgtaatgctcttcgtctggcctaggtgcctcctacccttccttcaagtcatagctcaacagcaacgtcctgaggatagctttcttgttcaaaacaggttaaattcccttcatagcattttccacaactgtaactttacatttacttgtgtgatttggttagcttctatctccacctcccagctagaagttccttgagggactgacccttgactgttttttgccctttgctgtatttccaattccttaactcactgcctggcacagaaagaggaataataaattatttcttcttccttcccaccctctcacacatacgttggatcagtaaagagggcattatgatgagacttgtgttggggaaagaaaatatttcatgaataaataactgaagaggtacttgatttggttcataaaccatgagtaggataaggagacgcaaagagaaggcgaaagacagtccaggtgggaggaacttcacttaagagagtgttcagttaaatagcagctacaggggaaaaagagcagtacaaagtaaatttaagtagagcaggtggaagggataatggaatgcccccaaaataataaagcagccaacactcactgggcacttaatatgcactaagcactttacacatgttaactcatttaatcttcactataacaaaggtgacaatgtaatttatgatccaaactggatacatctgagagagaaaaaagacacaacaaataaccatgcaggaaaaacatatgaaagccaggtcatatatcctagctatacccttattcagtcagtactactgttatgtatatcttatcaatgcaaaagtaagcactgagaggctgagcaagttgaccaaactcacacaactatgtgtgagacctaggatatgaacccaagcagctgactccagagcctatatgcttaaccacaaagccatcctgccttaaatgacatggccttaaaagccgagttatccaatacagtaggttaagtgaaaaaggtgctgccaggctactgagatgaaaagagcagtctaggaacattcatcttatctggcagtaggagatgttttccaccaagagttgttagtgtcggccaaacaaacttactttcaaatccatattctctgagagcctaagtaaggaaccgaggtacctcaagtacttttgcctgtgccatttctgcatttattgtgtatccaaaaaatgtgttagcatcctcctttaggaacacaaggcaaggagacagtccacgtgtggaagacctacatgaacatcttactctgctagccctgcctccaagagaagcagctgcagccagcatgcagcagaaaaccaaacaggcaccctacagctgggcgacttgcttccaaagggaaatcaattttcctttcctgttgcctttcatatcaacatgcctgggaaagaagacgtaatggcttttgctctggaaagggaaatgtcactctaacacttgtattcactgaataagaagtaaggcattctcataaacagtaacctgatgtagagaatacttcaaaatatgccagagaattgcagatgaagctgcaagatatcactgaaatatgaagtcagcagatctgcaaactcagacagaaataaaacagctttttatctgaaagttatgtggtattgagagtttttccatgttttaaagttcttccacctgacccaaaccaaccacataagcaaagagctacatatacccctgcacgattctctacctctgaggttaatgagtaaactcaatcaatcctgctaagagtttatatactcattctcagaatatacggcttatttaaggaacctaaataactgcaatgggatgcccaggtcaaattcaaagagcagcctttgtggtatcagagcagaaggcagcaaaaaataaaccctttaatgaggactgggtttaatgctgatagtagcacttcctcatctcctttgagctttggggaaacaactgagagaactaagattaaaagactctaataaataaggcttctcaatttcttccaaaaagacatactaataacaaaacacaagaccactgcagagggtgcaaaagtacccaaaacagcaaaactcaaggctacaattaacaacccaattaaaaccaagtaagaaacgatatataatctttattatttgaagcaaaaattcccaaagatgaggtgccccaggaggtttccaataaaaatttaaaatcctgtctttctttaaaaaacacacaaactcggctaggtgtggtggctcatgcctgtaatcccagcatgttcggggggccgaggcaggaggatcacctgaggtcaagaatttgagacgagcctggcccacatggcgaaatcccatctctactaaaaatacaaaaaattagctgggcatggtggcacgtgcctgtaattccagctacttgggaggctgaggcaggagaattgcttgaacctgagaggcagaggttgcagtgagccaagatggcgccactgcactccagcctgggcaacagagcaagactccgtctcaaaaaacaacaacaacaacaacaaaacccacacaaactcattcatacaaataactgctttcatatacttttaaatgtgaagcttttccaattatatacagttagcttgtacactgccaacagttgtgtctcttctactcagcaggttaagggaaatacactgctcactctaaacagggcttctcaactgaactacaattaacatttggggacagataattttttgttgtggggggctatcctgtgcattgtaggatatttcgcagcattcctggcctcaacccatacagattctaacaacgcaacccactgctccagtgagaactacaaaaatatctccagatactgccacatatcccctggggagcaaatatgcccacagttgagaactactgctttaaacaaattatttgcctattgcagagatttcaaagggttaagcatctgtgttgcttcatgcaaaattatgcttcactaatatgcaatccataaaacaccattacgaaaactatagtctgccatgttctttgttctctgaaataaactagacaaattcaaagtattgcttgaaacagtaattccacagatgtttgagggtgaattaggagaacataatcaaatatcctgaaaattctgttgtttactggcaagtcctgaagcttgctaggaacagaattactcataggtgacctgctctggtcatggggtcaagtggaagcttccgctgtcacacaactaaagagaaaacctggtgtccacaaatgccaagggcaagggaagccaaatgccgatgaaaccaaatccctgatcttgaaaggggaaaagaatccctaaactcactttcccaaagcatggctgtaaacagaaaaccaagtggaaaagataaatgcaaaacacaagcagatgggtaaataaagtgtagtatacatacacacaataaaatatccagcaataagaaatgaggtacagatatatgttacaacatgggtgaaccttgaaaacattatgctaaatgaaaagagccagtcacaaaagattagatactatatgattccacttgtaataaatgtacagaaaagacagatccatagggacagagagcagattacttgttgcctagggttgcaagggtaaatacagagtaactgctatggttatggggctgcttctgggaatgatgaaaatgccctaaaattgattgtggtgatagttgccagtatctgtgaatattctaaaatgcactaaactctgtgtgtgtgtgtgtgtgtgtgtgtgtgtgtgtgtgtgttgtgtttttaagacagggtctcactctgtcttctgtgaatattctaaaatgcactcaactctgtgtgtgtgtgtgtgtgtgtgtgtgtgtgtgtgtgtgtgtgtgtgtgtgtgttgtgtttttaagacagggtctcactctgtcacccaggctggagtgcagtggcatgcgtgatcacggctcactgcagccttgacctaccgggctcaagcaataccccccccaactcggcctctccagtagctgggattataggtgtatgccaccacacccggctaatttttttgtattctgcaaagatggggtttcactgtgttgcccaggctggtttcaaattcctgggctcaagcaatctgcttgccttgccctccagcaatccgcccgccttggcctccaaaatgctgggattacaggcataagccaccatgcccagccaattgtacactttaaataggtaaattatatgacatgtgaattatatctcaacaaagctgttttaaaaacaaacacacagcagcagcagcaactgaattacaaactaacaagaaaaagctcaggcttcactacagccaaacaaaggtgcatctggctacgaaattcacaaggatgagctttacctctgcaactgagaaaaaccaccttttaaagctgtaaaaacacagtcaattaaactagtagagttttatttcacgtaatgctgagaatgaaagagagccttctttggaccacggtaatctttaatatacaggaattcttggtcaggcttactatctctgtatagcatgttcaaaagtagattaagttggacagggtttctttcagtttgcaaagctctaagattcaaagtaatttgcaaccatggcacataagctctcagcgtgtgatgaaaggaaatgacagggtgaattttatatttaacttaatacaattacacttcacacctatagaaaaaaatcaaaagcattcaaaatgcacttctaatccacaggtacaaattatatcaaaggaaaaatggaaccacaaaactcatcggagcagctcttttaaacacttagaatctctaagtctaagataaaaggcaaactggctctgactaaaaacacaagtctcagtcaaaattcaatttgctgttttctatgtctgagccattctaactgggtgtgattctaggttgaccaaatgtattaaccctgctctctctgttaacctgatgtcattcaaaaagaaaagcagaagagccactagaacaactcaattaagatgccagcaactagtaactaaccagggagggcaggagaagtcccaggacctagaacataacacttaaatgtagttataacactgatcatcaaataaacatcaatctccagaggagattctgtcagttcccccattatttcagcaaatgtttactgagttcatactaggtggcctaggagctatgtccagaacacacacaatctctaacctcagagagattacaatctagtgggggagagagcagacaataaacaaacaagtagattactacagacacagtctgtaagttggccataagatgtgctatagaaaaaaaataaagctgggcaatggccatggagaggtcatcaatttaaggtaatcactggcaagggatcactggacctaaacgaagcaaggtgcaagttacatggttaaagtgggggaaagcattctgggcagagagaaaagcaagcacaaagttctgactcaggcagaagcatgcctggcatgtccaggcaacagcaaagggacatggtggctgaagcagtgagcgcaagaagaattggagatggagagatagctcagtacttactcaaataagggaaaagccatggtggagttttgcatagagaagtaacaatccgaggtacattttaacagactccctctggctccttaggaaacaactcaggcaaggtcgtagcagtgaaggtgttaagcagtggtcagattctagccctcagaagtggctaacagagcgcacgtggtgtgagaaaaaaggaggccaaggaagacaataaggtttaaatccaagcaactacagtcatttactgacatgcaaagagaacaaaaactgggaattctgttggaatgtattaagatgtatgtgttgagtggtcagaaagctctgggctagacctaaatctaggagtcctcagtgcacaagtactaataaccatggggctggatggtatcaaaacaaactactagggatgaaatattcaagatggcaaagaatgctttgcaatgaatattatggacaggccaaaaacgttctgtaaactgccaatgaagttgaaatggtagaatgatggaaagactacatgacgatgctctgaaaagaatacacttttttattcacagagaagccgtctacataggaaacgggtgcctatggacaacttctgtattaatgatgttaccaaatactgcatttaataaaatccaaaccgctgaagtccttcctggctgatttccacgctagaagacacataggatggaaacacctccccctgctgtttcacagggaaatacaccagctgtccaaatgacttttgccaggtccttctgggctaacgaattaaggaaggaaaaactatttgaaagattcttgccttgtaaattaattctaaaaagagttgtcagatttaaaaattagctttgttaacatttctgagggcctaaattaaaatttttaatgtccatgtgaaaagagaaaaagaaaacatgtagtgactaattatatgaatttaaaacaaagttcaactctagaaaaaatgaaatttaatgggttcgctagtgatatttagctggtaccacaatttgaatccgaaataattcaaatagagcaacatttatatgtctcaggaaggcacactgttttaaagtaagtgatatgaaaaggtaaaactggatccaaaatctgtgagcattatcatgagaaatatatgattacatctgtaagagaaaggggaaagctgctagatttagaaaaaacatctcagccgggcgtggtggctcatccctaaaattctatctagcactttgggaggctgaggcaggaggatcatcactacaggccaggagtttgagaccagcgtgggcaacatagcaagctcccatatctccacaaaaaataaataataatttttaaaaagaaaaaaagaataatctcactccggaaatatattttttgtttgtttttttgagtcagcgtctccctctgtcacccaggctgcgatgccaaggcatgatcatggctcactgcagcctccatgtcctaggctcaagcaatcctcccacctttacctccagagtagctgggactacaggtacgtatcaccacacctggctaagtttccttaatttctgtagagaagggatcttgctaggtttcccaggctagtctcaaactcctgagctcaagcagtcctcacaccatggcctcccaaaatcctgggctacaggtgtgagccaccatgctcagcctggaaatctaatttaaagagatcaaattatcaaattctggctaatgacagggaagatgtttccagcaacgagagaaaatgcagtattattccatcactttctatctactcctgtgcaaacacatttcttcactgcaagtggaaaaaggaaactatgaaaaagcaaagaatggcgcataccttcaaaaatgtcacttaaaattactactgcaggtgtcaacaataacctttatggttattcagcctcagatatacttggcttctggactcaatcaatatgtcaatcttattgtaacttcacactttacagtgtctccatgcagcaacagcaacaacaaaaaaaaactcaagaatatgccagcatccttgtatcagatgtttactaccaaacaaacaaacaaaatctttaatactatttgctcagggtaaaataccaattctatctgcaaaacaaacaaacaaagctctttaaatatttaatcagcagtaattagaatcggaggacagaatgactagaatcagatggagggaagaaaaggttttcatttctaccctcctgataaggaaaacagccatacattcaagaataaaataacttttatcatttagaggagcctaattcatttatttatttatttattttgagacagagtttcactctcgtcacccaggcagttcaatggcacgatctcagctcactgcaacctccacctcccaggttaaagcaattctcctgcctcagcctatcaagtagctgggattacaggtgcccgccaccacacccggctaatttttgtatttttagtacagacagggtttcaccacgttggccaggctggtctcgaactcctgacctcaggtgatccacctgcctcggcctcccaaagtgctgggattacaggcgtgagccactgtgcccagccaggagcttaatttattacaacaagctctcaaggatgatataatgaccccatatcacagacaatacactccagtcctgtttaccatgtaacatattctctaataaaaattcataccccctgacaatgcctacctgggaataaaaaagagaatgtcttcaagtctatgtcatgggttttcaacataaatatgattcccctctaaagcaagcatctgtcaagatcttggaaagaaggtcattactgagaaaagcatttatttgtgaaataaacaaagggctccaaaacagaagtgccaaaataagaaaaagtcaagtatcatgtttctgtaaaaaatggagtgaaaaagcttaaggctataatattttttggctggcgcagtggctcatgcctgtaatcgcagcactttgggagccaaggcaggtagatcactcgagcccaggagtttgagatcatggccaaatcccatctctacaaaaactacacaaattagctgggcacctggtggcaaaggcttataatcccagctactctagaggctgaggtgggtggctcacttgagcctgggaggttgaggcaacagtgagccataattgcaccactgcactccagcctgggcaacagaataagacctatctcaaaaataaatattttcatattaaaaatattcaaattattaaaattgtaatatttattctttggtattatttagctcccatttataacaaaacatacccaaattaaatctatagcaaatgtaaaatgcaagctttcattaaataatatgtgcaaagttgcagctttttccatagatcaatggcctaagagaggcctcatcttgacatttataaattattaacacaggcctgttaaatatcacaaggctaaaagagagcctttgatttatggacctggacattatcatcagaaggaaagtaatacatacttctttttcaggattaaaaaaacaaaaaaacagctacgtcttcagaggtttaccaaataagttttcttaaatatgaaaataactgaataggatcacacatacaaacaataactgtgataacaccaagcaggactgaaggaggcagagactccatttcttccgcaagccagcggatctcccaacaacacttgtactggtcttgtgttggcaaggcttaatcaataccacacagctatttctttctaagcttccatctcatatagtgtaaaataaagacagtagagcaactgctagattaaataaggtctgtattccaactgtttaaagtcaagtgccccaatgttgacttgacaaacttcctcaattttgttgtcaaggaaaaatacgcatttcatactccattttacatactcatacttcattttacaagcaaagtaatcatttcatactccacaaccacaaaaatatcagaagctcagtttggtgcccaacgtaagcatatactgaagaactctagtctctagtgacccttcagctcacctggaaaaaaggcaatatacactaccagagaacataaatcccaaaagcaactgacaaatgcaacctgggaggctgaaatgtaaatggagcacacagttaaaacagcattctccagagaaatcccctttctcacttcagcaaacagaggtcttctcaaaagctttcagtggaaaaactgccacttctgattaaagttaatttgatcaaatccatggggccctgggggaatgcacagatccctcttttctctcctccctgctttaccttgcacattctaaagtgactaacaatatgactaactgcctagagacgtgccattttcagcaactggtaaattacagtgtttttttaaatcagctggttatgatatgtgctgctttcttccctatatataggcctgtcactttcgatatagttttaaataaacaaatgacatgatatgatacagataaaaagcatttttagaatatcagagagtatcagaattgtgcagaaaaggcccagaatggtggctcatgcctgtaatcccaaacactttgggaggccaaagttggcagattgcttaagcccaggagttcaagaccaacctgggcaacgtcgcaaaaccccatctctacaaaaaaaaaaaaaaaaaaaaatacaaaaattagacaggcgtggtggcaagcacctgtggttccagctactcgggaggattagccaggtgtgttggtgggcacctgtaatcccagctacttgggaagctgaggaaggagaatcacttgaacttgggaggcagaggttgcagcgaactgagatcacaccactgcactccagcctgggcgacaagagcgaaactccgactcaaaatacatacatatatacatacatacatacatacatacatacatacatacatacatacatacaggttgagtatcccttatttgaaatgcttgggaccagagcagtttcaaattttaggtattttcagattttggaatacttgtattatacttactggttgagcatctcaaatcagaaaatctgaaatggtccaatgagcatttcttttgagcatcatcttagcacccaaaaagttttgaattttgaagcatttcagatatcgtatttttggatttgagatcctcaacttggactcttaaggtttacactatatattaccatataaagggtctatgaagtctatatgtaagaaaactgttcaacaagttagtaatcaacaaaattaaatacccacagtaaatttcccagtgtaattcatctccacattacaaaacttataaatgatcaatgccaagtctcttccttagaatagaatgtgagtcacagattagaataacacaaatcttacaatttaactgcacttaactatcttaggagttctcagtgggaatctgacatctgtcacatcaatatgtgccttatctactgatggggtttcagaaaagtaatccaaaaaagcccaactgacctttcttttcaccttagagactcagctcacatgaagaaccatgtaaagaatgattctgtcacaaaacattcttaaatggcaagctgaaggactaaagtaagtcacatatttttttacactaaaaaaaaaagaagaacctgacagcaatgagagaggtgtcacctcccaagtgtgacattaaatcaaaatgttcataaactaaactaccaagaaggaataccagaaactcaaggaaaaagagactcttaatgcctaaaaccaccttagggtcccaaggcaaaagtatctctgccctcaatgagccctcatcacaacccaggctccaaactagggacaaaggcagaatccctctgtggtccccagggagttccaaccacccacagggatgagtaccaaatagggcagttattgctggtcactaacttgaactggaggaaaacgtctgaggcagttctgtgaatctttttctccattcaaagcgccctcatttgtcctagacctcagttcctgctctctgcaaatgccacctacatttgtctcagtttttaatatcttcattcaaaaacttacaaagaaaaatcatgtcaggcccaatttcctccttcaagaaaccactcctccagtcctccctaaacagcctcccccttgactctccaatacaagccttctctacagatcccctgtgcttgagctcaccctttcacctttgctcatgcgtccttgccactagcccaagaggggtttttgataaatgcacaccattcacatccacttcaagtgtcagaaaagtaatttggctgggcatggtggctcccatctgtaatcccagcactatgggaggccaaggcaggtggatcccctgagatcaggagttcgagaccagcctggccaacatggtaaaaccctgtctctattaaaaatacaaaattagccaggcgtggtggcacgtgcctgtaatcccagctacttgggaggctgaggcagaactgcttaaacccgggaggcagaggttgcagtgagccgagatcacgccactgcactccagcctgggcgacagagtgagtctccgtctcaaaaaaaaaaaaaaagaaagaaagaaaagaaaaaaaaaaaaaaagaaattgttgatgcttccaacccatgccatgccattccttaattccttttgtaatcacacggtcagtatttcacaggttagcgttctaacataagaataacgtaaaaaccttattattcactaattcatatgtttcatgtaccatctcccctcacccttctctgtagggctccactgacagaacatacccttgtccttgctagttttgtaaacatgagctagtcaatttctctgtctagacttcagtttcttcactgacaaaatgaagataataatatgacgtatctcatggagttgtgaggaataagcaaaataatccatgcaaacttaccaatccacacaatgctagcagatacaagatgctcaataaacctcaacactgctgatgacaaaccatgttattcacatctttagaattccacagcacagaggcaagcaataaacattttgcagaaaacagtatctaaaacacatcaatctggtcccagaaaaactatttgtttgtattgcttaacaggaagagttgtttgttctactcaagaagcctgccttgactcctcatatccctccaaagggcctgcagccctccggaagcctggtttcccaagccaacccttctcaggctgcagaagcatggtctcctggttgctgttcagatccacgagaacaggaactgtgccacatttacctctgaaagtaatgaaatatttggtcatgaataaaatcaatttattagatttcatttttcattattcactaacaagctttcctcttttataatcaaagggcacagattcttaagtaaaaacaatatggttttcattaacgtttttcttaaatacttaaaaaaaacaggcgacttttgggtcttttgttttaaaaattaaattatggggccagacacagtagctcacgcctataatcctagcattttgggaggccaaggcgggcaatcccgaggtcaggagatcaaaaccatcctggctaacatggtgaaaccccatctctactaaaaatacaaaaaaaaaaaaaattagccaggcatggtggcacgcgcctgtagtccctactcgggaagctgaggcaggagaatcaggaaccgaatcgattgaacctgggaggcggaggttgcagggaggcggaggttgcagggaggcggaggttgcagtgagccgagatcgtaccactgcactctagcctgggcgacagagcgagactccatctccaaaaaaataaaaataaaaatacaaaaagtaaattataactctccaactcacatgctaatagtctttacattcccctttccattccaactttctctaaagaaaaaatgtagaaataatcatgtgtccacaaaaccacaaaatgtctagacataagagaatgctctcagatattattcctcttacagccatatgacccacttaagaactttaatctagggccatgctgtccagtatagtagtcactatctacatggctatttaaataaatttcaattaaataaaatttttaaaatgtactttctaggtcacactagccacatttcaggtgcttactagctacatgtggctagcagctaccacactggacagcacagacacagaacatttccattgccactgaaagttctattccacagtgctgatctaaagctaaatgtatggtaagtacaaatattaagattctcatttcctcaataagccactctcttttaatcaactctaatagcctcaagtacaagaatatgcataaacatgaacccaggggactttatctttgactctcacaaaggcaacagattacaattcttcttaggaaagacagtgagacagtcccatagcaatctaaggctttattcttccatttcttcagcaatttacacaacgtgacccgaggaaaaaagagcaagaaaccatttttttccactacctttatctatcatagtcacatctgccaagttttagaatcacaggttccattatcttacaccgtcagcactcttcctttataaattcccctctccacactgatcttctctgactcactcaacatattataccatcactctgaaatcagggcctagagtctctggcagacaggctatatgtaatgacagcctgggtacaatcttaagtctaccctccctcagaggatttcccaaccctatgcaattgtcatgtgggtaggcagaaggctgcacatttttcttcataataaaaacaaagcttcaatttctgtaaaatcaataaattacctccgtatttataatacaggatgatggcagagttctgttttctacaaaactagagcttttaggagcacatgttttcaatcacttatttttcaagaatgattgaaatatctccaagcgctccctgagaacttcactggtgtgatctgccactcaagttaattatcacaggctgcttatacacaggaagagaggaagcgggaaagaactcatgaccttgcacagggatgttttataaaattctctaaaatttaaactacacacgtttttccataatgcaacactatggtactgccttcaaaataatcatcatggaatagctgttttcttagtgatgtatggggaaggtggtagcgggtaggggtgcaagagattctgtacacataagaaaggcagtcacgtgacaccaatgtccttttcctatacacctggtggaaaatggagaaagccagaaaaacctgttcagtgattatcattctgattttttggttattacttcactaaaagaaaaaaaaatacatctgagtatatgcataagttgcatttctctggagtacttccttctgccctctgagtccaggtaccaatgatctctgaggggaaaggtcagccatctgccatgagaagaggccaaaatgtgggcaactattcctttctaaccaaagcacttctgaatctgagaaagcaagcaaacgtagtgtggtgtataaagcaaattctcgcccggaattctagcttgaatggagaggattccatagaaaatgtttccagaaggactctgacaacagaaagaagcaattcaagaacaaggacgtaatgccatatggatgggggaaagaaaggaaaagaaggaagacagaggaggagtctgagaaaatcttagttcttaagcatgagaatcagaactgtgggcttcagggtaaaaaggaaagagagactgaaaagtaacatctatgtttaaatgggtcctttagagaaaagaaagcactcagctaggattaaaggaaaagaattgtacctcctcaactccgtttcagagtataataaaccttaccaatttagaagctacacaccctttcacagttcacattcagctcagactgggagtcggaaattgaaaaacactatagcccgggagaaagagacaggtaaacatacaaaggactgagacaactgcttaccactaatatgggtcaatctcgcaggaatacttgcaaaaataaaaattaccaagtgccctctacgaatgctaaatacaggtcaaaatttccaatggctcaaccacctgagtggagagccggagaatgggagtcagaaagcatgtaaaaccatcgaggtcccgggaaacaaatttcctaggcttttaaaaccattcgtcttttctaacttacagaaaacgcaaactgaaaccattcagaaataaaacaaacggggcagggggcaggagagaaacggccaacaataagctactattctcctaccactttctcactggtgcaggcatctccaaaccaaaccactcagaaattttatatacaaggaataaatcataaggatctcatataggactattcatatactaaattatgtataataaccggggagtctttctcttaatatttttgtcaggagctctgaaaatgaggttttagaagccacagcatacctattcatcttaaaaggtaagatggcttgctttcagtttagctaagctttcatttctatcgtaaatatttgactttagaacactgaacaccatggcaaaaggcaaatatttacttagcttaattattccatatatactgttctacttcccctgtaaatacaaaatatgagttgaaacctcaaatcattaatacctaaatttggccacagattaaagtgtgctattaaacatctcaacaaattgagattaggtaacactttaagttctatatcacaagtcttaaactaaatcaaaaaaagtaaatgaaatttatctataatactagagatcaacaaagaaattaaactgaaataggtactaacgcaatcaccacagatttccacagatcccagtagaaataaagaagtttaatctttagttgaaattttaagagtagccattaaataagtaggacaggaatggaaggcgaaattgattcttttatatcctaatattcatattgagagatctgggcaaatatagtaagtcaacttggttctgggtttgagaaataagcacttaagtacaataaactccacaccagaaatatttttgtatattctactctcatttcaacataaccatgcaaagccctaatcagactaagggcttattttgatcataatctcctttactctgaaccctacctaccctgttttggctaagtgacagattttggccttcctctacccaggcttaccacccccaacctgtactgaagctctgtcgtatcatgagatgaagtctgcttagtaataggtgaaatgggacttgttcccttctttatattataggctgtctataacaaagtcaggctctatattcttcataatttcatgactaataatttcaactaaatcctatctcatttctttccatgatacaataaattcttcacatttcaatataaatctctttatcaataccacagcctttgaatttgcttaagccacacaaccaattcctgttctgaggtactatgaaaatattatgtggcttgttttattgtttaaatggaactttcctgtgggcactgttgttgttgtatgacattaattatctgtccagttcagttttacccaccataaactttctcaaaatgattgggaccatgtcttgttttatgagtgtatttcttgatttctttgacatttcagtgtccactagggactggtaataagccttccaatgtataggtggtaaaaattgttacctacacaataaaaataactatactaattcacgaacttctctatacctagaaatgtgaagcatgtaataatgtttaacaagaaatgccggctctagtactataatgcagaataaaaattaggcaagtgatgactcatacttcacaggtatgccagcctcaatcaggttttcaacccagtctttattagaaatgacaagtgattctttcgcatgccttaatttaatccaaagagcaatcaaggatctgagtgtgaaggtaacagattcaatgatgggaaatacaactactactcaatgctatacttcggtaaaataaacactggtatagcccaaagaccccaatcagaagttagactccataatttaccaactctgcctcactgtctttaccaaaaaaaaaaaaaaaaaaaaaaaagaatggaactcaaaaattctattagtataatcatcaagcttcaaaaaccaaatataacaaatgttacaaattatccatattttagatgccaaatgcctgaagaattaataacatcaaaaatggaatattcaaaggggagaggatgcaggcccagcctcacgccaagccatcctcctaggaatcctacaagtctataccacacatgtaccttcacccttttgttttccttttaatcccactcctccctccagacttgttccttcatcttttccccaattctctgcttgagaatggcataaaagggcaccacttagtagaatctaatcattctacttaaagactaaagaaatgaaatggctggaccctgctaaagagaaaagacggggagggatgggacacctttccaaaaacctcttcagagacacacagaaattctacaacccatccactgtagactgtctaagggaaaactgttccccacagttactggtgctgcttttaacagaataccaataaaggtataaaacacagaaaatattcatttatggcagagattaaaaacaaaatatatgcatttatatgactttatttttaaaaaataaattgaccaggcgcagtggctcaggtctgtaaacccagcactttgggaggccaaggcgggcggatcacctgaggtcaggagtttgaaaccaatctcaccaacatggcaaaaccccatctctactaaaaatacaaaataagccgggcagggtggggcatgcctgtaatctcagctactcaggagactgaggcaggagaattgcttgaacctgggaggtggaggttgcactgagccaaaatggcaccactgcactccagcccaggcaacaagggagaaactccatctcaaatcaatcaatcaatcaatcaagcacagctaccaactccttggggatattacaacctaatcttaattaaaaaataaattcacatcacaggttttccttcaaagccaggttaacaatactacttcacaggttaaatgccagtttttttggtttttaccactggccttaaatgattgcattaaaacacaccaaaaggatcttagtaattaaagatagatactaaacaaaatttccacttaaagtcatgctaaagcaggacaaatttttcatggttcaaggtgtgcaaaaagccttcattttaaagaatgcttcaatgaccaaatacattttcaatgaatcaatgtaccaaataataattaggtatattaaaatatccactttaattacaggaaattttgttagaaaagctagtatcatgaagccactgtcataaaagaagaaataatttatcattaaaaaaaatcctgggcataaacaaaaaaccccgccctcctctcatatgatggaatcaatgctgaaacacggaagcttataaaatcattttaccaactgttacagaagcactaagtatcagacacaggaaaagggggcttaaaaccaacatatttcaactagagatttaaaaacaaacaagaatgattaattaagcaataatcaagttcaaaagtatttggtgaaatagtaagtatagctcctacaaaggataatcaaacccaagcacaatctgatgcctgttaatccacctctccctatgagctgttaacccacctctccctatgagaagccttcctgtcaccaccatctttgcctcctgcaattgcaataaacaggaaacactaattggtcacctccagaagctaaataccagcaatgggtgggaaatccctttactcattcatccattcattcattcattcattcattccattcatttgagacaggatctcactctgtgatccaggctggagtgcagtgcacgatcatggctcactacagcctcaacctcctgggctcaagcaatcctcctgcttcagtcttccaagtaactgggaccacagacacgtgccaccacagccagctaatttttcaattttttgtagagacaaggtctcactatgttactcagggtggtctcaaactcctgggctcaagcaatcctctcttctaggctgcccaaagcactgggattataggagtgacataccacacccagcccaaatttggattttaaagaactaatttgatgcttccatagagaggaacttttaaactacacatttcctgattcaacagtttacctactacacacagaaaggctttccaggaagcattttatatttgctaaataacggtaagtaaaatattttaaagtcatccaagtttcaataacaattatcattacttccttactttgaaagctacaaccatatttccaagtattaaaacaacaaaatacaaataatcctaagaaatccacaataaagatttatctattaaggccgggcgcggtggctcacgcctgtaatcccagcactttaggaggccgaggtgggtggatcgcgaggtcaggagatctagaccatcctggctaacacggtgaaaccctgtctctactaaaaacacacacacaaaaaaacaaaaaaaatcagccgggtgtggtggcacgcccctgtagtcccagctactctactgtttagaatcgttttcaatgtccaaaaatgtgactgctttagagatgccaaataagactaatttaaataacctaagattgctccaattaccgctggtttttcaggtggtacaatgtataaaccaaagaaaagaagctggtgcataaaactcagctggctgaagaagttaaaaataaaactccacaatgatatgtggtttggggaaaaacatcagagttccatttagacatgttaagtgttaggtgcttactggacatgtgagtggagctatatcttctgagtggagatacaaggaaggcagctaagtaggtctggactaaagataacattttaaactctttaggtaatttttttttttttttttggaaacaaggtctcacatccatcacccaggctggagagcagtagcacgatctcagctcactgcagcctcgacttcccaagctcaggcaatcctcccacctcagactcccaagtagctgggactacagatgcacatcaccatgcctggctaatttattgtatttttagtagagacggggttttgccatgttgcccaggatggtcttgaactcctgggatcaagcaatccgctcgtcttggcctctcacggtgctaggattacaggtgtaagccactgtgtctagcctgcatttaggtaatttttaaagccatgcatcctagggaattacgtagaaattcaacaaatatttatcagacacctattatgtgctggagatagagcagtaaaccaaagagtcaaaattctctgtcattcaggactttacattctggtggaagaaacaagacaataagcaataaaaataaagatgtagccgggcacggtggctcatgcctgtaatcccagcactttgggaggccaaggcgggtggatcacctgaggtcaggagttcaagaccagcctggccaacatggtgaaaccccatctccactaaaaatacaaaaattagctgggtgtggtggtgggtgcctgtaatctcagctacttgggaggctgaggcagcaggatcacttgaacccgggaggtggcggttgcagtaaactgagattacgccattgtactgcagcctaggcgacaagagcgaaactcagtctcaaaaaaaaaataaaggtgtagtttgtgatgaagacaagtactctaggggaaaacagagcagagtaaggacaaagtagagccgagactgagggtcaaggtaggcctctcactgagactcgaaagcgggacggtgagctacagatatttggagaaacatatcccaggcagaaggaacagtcagtgcagaggccttagtgatcatcacaagggcagtttccctggagcaacaacggatggatttaagaggaaaggagaactggagatctgggtacagaaaactcttgttgagaagtttttctgcaaaggaagcagagaaatcagcaatagctggcagagtaagtgggatccaaatacgggagtttgtatctgttttaagattggagaaaagcggcatgtttgtatgctgctgggaaagatccagcagagaatgaaacatcaacattatgagagacaggaaattactatgtgagagggcacgggtggcgcctcagagagttccctgaacagctggtctatacacaagcagtggggaaagcacaggatgccctggaaggtggcaagatgtggtaggagtctgcagaagggctcttaagactgttctgattttctcatgcaagtaggaagcccaccatgaggccaaggaggaagtataaaaggacaatgtatgaaacaggcatctaagaaactgcataagtgaatggacttgcccaggagccttaaagctccatttgacgtttattaaccaattgggaattaacactgagaaactcaccaaatctgagacataaaggctgactctgactttctactataaataaaaaattctctaacaaactgctgaaaatggtcagtgtctaacatatttgaatatacaatacttggggagagtcgtaatttctccaaataatgtgttgaaagagattacatcccattttcacaccatattcataattgcttcgtcatacataacttgaagggagtcatcagtcattgaaggatttaataaccttaagctgaagttaactcccttatgtcagaccacagtaaacaaaagcagggttttaatgccttaagccaattatatattgcaaagtaaaacatcttatattcttattcacagaagtacaaatttagttttagtttagttatattcttattcacagaagtacaaatttacacaaaaagattatctaacagcattcaattaatcaccaagaactgccatataaaaatctatttctaataatatggtcctggttgcacaactctatgaacacagatggtccccaacttaagagggtctaacatacgattttttcaaattaacaacagtccaaaagtgatacgcattcagtggaaaacatactctaggtaaccacacaactattccatttttcactttcagttcagggcacagcgactaacgcctataatctcaacactttggaaggccaagtcaggaggatcgcttgaaccaacgagtttgagaggagcctggagaacatgagacccctatctctacaaaaaatttaaggccaggcatggtggctcatgcctgtaatcccaacactttgggaggcaaaggcggatgacctgaactcaggagtcgaagaccagcctgggtaacatggtgaaaccccgtctctactaaaaatacaaaaatcagctgggcgcagcacctgctattgtaatcctagctacttgggaggctgaggcagaagaatcccttgaacccaggaggtggaggttgcagtgagccaaaattgtaccactgcactccagcctgggcaaaagagtaagactccatctcaaaaaaaaaaaaattaaaattaaaattaaaaaattagccaggcatagtggcacacacctgtagcctcccagctactccagaagctaaggtgggaggataacttgagcatgggagctatgatcgtgccactgggcaaaacatctatctgtctgtccatttgtccatccattcatccactcatacatatataccatgagatatccaacactttcttatataataggatttatgttagatgattttgcccaactgtaggctaatgcaagtgttctgagcatgtgtaacatcggctaagctaagctatggattttggtagattaggtgaattaaattcattttcgacatgtattttcaacttaggatgggtttcctgggacacaactccatcttaagtcaaggaacagctatatactggaaaccattgatttgtatactttttaaatgagtgagctatctcgtataggaattttctctcaataaagcttttttaaaaatctattccaagcttttaatctaaagaaatagttttatcaagtaaaaatttgattttttttttagtttctttgttgaaatttcaatggaaaatggagcaaattaagtatgttctgacagcttatgaatataaactttgtagagactcagaattctttcagaatgaagggcagaattaaggatggagtttttggcctttggtttggttgtttttcttctttagttgactaaagtttatagtttctggcattcctgctttatccctttgatgaagacatactcaaatcactttgactaaaataaacagcaattttctggttgtagatagccacaaataactcctctatcctattacagacattcatcagcaagactgagtaacaaaccaatacctgtataaaaatgaaaggatacaatatcacaagtactaattcaggtaatatcacatttcttagagttatgacacttcaaagaaattttatacttcaaatctaaacagcaggccaaggaattcatattttttccctgagacaggaaagataattcaataatttccccactgaagtttcagttcccatgccagaatgtgagaagtgagagagttcttcaccttgaaaatcaaatcaccacagggactaaaaataaaggttatattcttctaagcaaagcgattataagactgacaaattaaggtgcccatcgaaggagcaatggatacaggaaaaaaaaaaaaaaaactactaacaggcttagttagccacttccaaaatgtaaactgtaaatgtgggaaactcaatgaactgccctacacttgcatctcattttgtgtaacctgagaggctaacatctgttctgcctccttcagaaggcagctgtaaggatggaactagaggccagtaaaggctgttcagtaggtctaaagtcttctgccaagagaagtataatcctcatttcgttctcaaaaagctcagtctctgtagtaacatactgatcatcttctgcaggtataaaatttatgctctgtattagtccgccataacagaataccacagactgggtggcttaaacagcaaaaatttatcgcttgcagtttcggagtctcagaagtccaagatcaaggtgccagcagattcactttctcaatgagggctctcttcctagcttgcaaatggccaccttctggggctgtgtccttacatgtcagagtgagcactggtcatctctggtctctcttcctcttcttataaggacactaatcacatcatgaggagccccaccctcaggatctcatctaaacctaactgccttccaaaggctccacctccaaatactatagcacttggggaacggaaagctaaggcttgaacataggaattttgaggcaatacaattcagtccacggcactcgcctacacaatttctttactgattgtctctaggcagaaattaaatctttgtatcgagagagaaagatagtttgaaaggatggctttaaagggggctgaaggtagcttactgagatttagacaatgtaaaataaaatttaagaacagatgagggtatttggtggagaataatagctaagaagtattaagtatttacctttgtggatagtttccttaggtcacacacctagtttcacgggtcacacaggctacaaagcctttacttttaattatacaatatttgcttctcttttccttggaacaaaggaaaaaatagaagaggaggagaatctaaaagatgaaaccatgaatgagctgctacataaaagtatgtattcatgttcattttgtaccttttgttagatgtggccaaaattttagtttattttttatttttatttatttatttatttatttttgagacggtgtctcgctctgtcaccaggctggaatgcagtggtgcaatctcggcttattgcaacctctgcctcccaggttcaagcagttctcctgcctcagcctcctgagtagctgggactataggcgcgcaccaccacgcccagctaatctttgtatttttagtacagacggggttttaccatgttggccaggatggtctcgatctcttgaccttgtgatctgcccgcctccacctcccaaagtgctgggattacaggcatgagccaccgtgcccggccggccaaaattttacaagcaaatggctcaaaggaaacttgatgagttacaggattctaaatctgtaagttagaaaacaaaccacatgctcagaaggtctggttttttttggtactaagagctaagaaaagtttatctctatgtcctcataaagaaagcagtttaatacggtcaacagcagccttgggaacccctttataaaccattcagtacacacaaacactgttccacaagtgttcgcacaagtcaatggcctcaaatcaatataagtaaagcaaacctgccaaaaataagaaatgcaaagccttcctagtcattcaaacatagatctagggctcaccagaataggagttcttaatgagagggttcatggataggcttcaaaggctacataaaccatctgcaatttatgtactcaaacagtcacaaattatgttctgggagaaagatcatatattacaccaatactcaaagaagtccctgataaaaataaagttaaggacctgtaacaagaattaatgaactacataaccatcaggagagcctatccaaatcatcttaacaaccaaggcactgggtacttatatgccacaattaggctgatgttaaattccaacaagtagctagtactggataaatgcagagtcaaacgctctaacttagcttaccctggaagtagttctaacctcctctaagaagtgcacagtacctgttgcatagtaagcccctgaatatgcactgctgcaattattactggatatattacaagctccaaggacaggaccaaatcttctgcatttctgagttccttgatcattaaaataaatggtcctcaataaagaaagaaaataatacaaacatttaactctacatagatctagcaaataaggaccttagcagaatgggtttatttctaaaaactgaaaagcatccctttgttttataaaatgaaatgttttggaaaacgaagaacacagggaaactgaggggaaataacacttacatggaaccactaacaaattcatactacggtcatccctcggtatccaaggggaactggttccagaacctccacagataccaatatccagacactcgtatataaaacggtatagtatctgcatataacctactcacattctcccatatactttttttttttctttttttttgagatggagtctcactgtgtcacccaggctggagtgcagtggtgtgatctcagctcactgcaacttctgcctcccatttcaagcgattcttccgccccagactcccgagtagctgcgactagaggcgcctaccaccacatctggctaatatttttgtatttttagtagagacagggtttcactataatggccaggctggtctctaactcctgatctcaagtgatctgcccgtctaggcctcccaaagtgctgggattacaggcatgagccaccgtattcggcccggtatactttaaaaagaatctctagattacgtataatacctaatataatataaacgctatattttttaatttgtgcttttttctaaacatttttgccccacagttgattaaatccgtggacacagaagccaagaatacaaagggcttagtgtagcatattttacatgaaccctaacctatcactctaccagaattatgcccatttaaaaatctaattagattgtattattcctttttacatctaaagtttatgctttccgcttacaagacagagtatgaggcacatgtaatgcataagatttatggtcctcgtttctcctgctccatgacaaatagtagagaaaaataaaaactgtaacagagctggcatcggaaatgagcagttatatgaaaaaaaaaatttaataactaagaagggctaaaatccactacactgacaacaccaaatggtagcaagtatgtggagcaacagaaactctcattcattgcttgtgggaatgcaaaatgctagagacacctcgcaagacagcatggccgtttcttacaaaactaaacatactcttaccatgggacacagaaatcacacaccttcatatttactcaaaggagctgaaaacttatctcaccacaaaaaactgcacacagatgcttaaagcagctttattcatcattgccaaaacctggaagcaatccagatgtccttcggtaggtaagcagataaataaacttcagcacagctacatgatggaatattatcagtgataaaaagtagtgagctatcatgctcacagagacatggagaaaccttaagtacattttgctaagagaaataaaccaatctgaaaagactacatactgtatgagtccagttatatgacatctggaaagcaaacctatggagatattaaaaaagatcagtggtggccaggggcttgggggcagagagggagggatgaatagggagaacatagggcatgtttagagcagtaaagactcttctatatgatattgtaatggtagatgcatgttatgaaacatttcaaaacccatggaatgtataacaccaagagtgaaccttaacatacactatagactttagttataaataatgtatcaatattggctcatcaacaataacaatgtaccaaactaattcaagatgttaataggggaaactgggagttaggggggatgcgggaactctgtactttctactcaatttatctgcaaacccaaaaccattctaaaaactagtctactgatttaatgttttaaaattttttaatgttttaatctaccatataaaataaaatgctacttatctaaatgcttaaatgttaggcctgttagcaaaactgaacaacaccaattttctttcccaaaaaaaaaaaaaaaaaaggccagattgctttaatccttacattttccgcacttttagttctccttttccattcaaagagccaggaagtgctagccagagcaatcaggcaacagaaagaaataaaaggcatccaaacaggaaaagaagaagtcaagctactgctctttgctggcaatatgattctatacctagaaaaccctgaagacgccatcaaaagactcctggtacaataaacaacttcagtaaaagtttcaggatacaaagtcaatgtacaaaactcagcagtatgtctatacaccaataatgttgaagctgagagccaatccagaatgcaatcctatttataatagccataaagaaagaaaataactaggaatacacctaaccaaggagggggaaaatctctgcaaagagaactaaaacacactgctagaagaaatgacaggtgggctgggcggggtggctcacgcttgtaatccaagcactttgggaggttgaggcgggcagatcacaaggtcaggaattcaagaccagcctgatcaatatggtgaaaccccatctctactaaaaatacaaaaattagccgggcgtggtggcacatgcctgtagttccagctactcgggagactgaggcaggagaatcatttaaacccgggaggcagaggttgaaatgagccaagatcatacctctgcattcacggctgggtgacaaagcgagactctatctcaaaaaaaaaagaaatgacagatgacacaaatggaaaaacatttgatgctcatagattggaagaatcattaaaatgaccacactttcctaagcaatctacagatttaatgctattcctatcaaactactaatgtcatttttcacagaattaaacaaagtaattctaaaattcatatgaaaccaaaaaaagtacccaaagagccaaagaaatcctaaggggggggggggaatgctggcagcatcacattatccaacttcaagctatactataaggctacggtaatcaaaacaggagggtacaggtacaaaaacagacacatagaccaatgaaacagaatagagaacctacaaataaagtcataaacctacagccatctgatctttgacaatgctgacaaaaacaagcaatgggtaaaggactgcctattcaaaaaatggtgctgggatagctagctagccatatgcagaactggaccgctaccttttcccatatataaacatcaactcaaggtggattaaatatttaaatgcaagaccacaaactgtaaaaatcccagaagaaaacctaaaaaacaccattccgacccttggctttaggaaataatttatgactaagtcctcaaaagcaactgcaacaaaaacaaaaattgacaactgggacctaattaaactaaagagcttctgcacagcaaaagaaactatcaacaaagggccaggcatggtagctcatgcctataatcccagcattttgggaggcccaggggggcggatcacctgaggtcagcagtttgagatctgcctgaacaacatggtgaagctccatttctactaaaaaaaaaaaaaaaaaaaaaaaaaaagccaggcatggtagtgagcgcctgtaatcccagctacttgggaggctgaggcagagaatcacttgaacctgggaggtggaggttgcagcgagctgagatcacgccactgcactccagtctgggtaacagggtgagactccaactcaaaaaaacaaaactgtcaacaaagtaaacagacaacctacaaaatagcagaaaatatttaaatatcatgcatctgacaaaggtctaatacccagaatctataaggaactttaacaatacaacaagcagaaaacaaataaccccattacaaactaagcaaaaggcattaacagacattcctcaaaagaagacatacaagtggccaacaaatatgataaaatgtttaacatcattcatcatcagagagatgcaaatcaaaaccacaatgaaatatcgtctcacgccagtcagaatggctattattaaaaagccaaaaaacaacagacactggtgaggctgtggataaaagggaacagttatacactgttggtgggaacataaattggttcagccactgtggaaagcagtttggagatttcccattaccaggtatacatgcaaaagaaattaaatcgttctaccaaaaatacacatgcactcgtatgttcatcacagcgctatacacaataccaaagacatggaatcaacctaggaacccaccaatgatggactgataaagaaaatgtggtacaggctgggtacggtagctcgcgtctgtaatcccagcactatgggaggcagaggtgagcagatcacccgagctcaagagttgggagactagccagggcaacatggtaaaaccccatctctactaaaaagataaaaattagccaggtgtggtggcacacatctgtagtcccagctactcaggaggctgaggcaaaagaatcgcttgcacccgcaaggtggaggttgcaatgagctgagattgtgccactgaactcctgcctaggcaacagagtgagacactctcacaaataaacgaacaaggctgggcgcggtggttcacgcctgtaatcccagcactttgggaggctgaggcgagtggattacctgaggtcaggagttcgagaccagcctggccaacacggtgaaaccccatctctactaaaaatacaaaaattagcagggcatggtggcaggcgcctgtagtcccagctactcaggaggctgaggcaggagtatagcttgaacccaggaggcagagattatagagagctgagattgcgccactgcactccagcctcggcaacagagcaagactccatctcaaaaataaaaaataaaataaaaacagttgaaattatcaaaaaaaaaaagtaaataaaatgtaatggaggtactagtgaaaaaaataataagatccaaactcaaattgctcctgcacccaacacacttaagagtaaatactgttaagagtcctttccatgaacatctaacatattgagaaaggtgaatatttcattactgaacatttactctaacctatgttaagaattatgatctgtggaaagagcacaggctaaggaagctgcctaggtaaatagccaaaaaacatacacataagatgaaaacttgtctgcgtcattttcctaccactcaaaaaagaaggtaacagtaagaaataaacagcaaaaacaaaaagaaaaaattgttcaaatgttcaatctagatataggtttttctgtataatttaatcaattaataaataaatacacatgtatctttcttcccccaaccacaccccccccacacaacttttttttttttttgagacggagtctcactctgtcccccaggctggagtgcagtggcgtgatctcagctcactgcaagctccgcctcccaggttcacgtcattctcctgcctccgcctaccgagtagctgggactacaggcacccgccaacacacccggctaattttttgtatttttacaaaatgtttttcaccatgttagccaggacggtctcgatctcctgacctcgtgatccgccgcctcggcctcccaaagtgctgggattacaggcgcgagccaccacacccaacctaccacacacaactttctaaagttcctggataatgttctaaactctttttctatgttttacatgtaacttatgcaagccattcactttactaagcaaatgaacagtagtgtctgtggccaaaaataataagacttaaaattttgagtccttccaaaagaacttgtattaaatctttggaatagaaaaaaaaagttcatattagggagtagatctgggtattgaaaggcctgtctttttttgttggtaatgccaaagaatgtcatcacacaagactcaccttataatattatttatgtataagttatcaattacatatatttaacattttaagtgaaagcaagtttattaagaaagcaaaggaataaagaacggctattccttaggcagagtagcctatatttaacattttttaaatgtttaaaattataaagctggtgagtaaaacaaaaacatctttgagtgatacagatcggcagaatttccccagcctcattcctgagagaccaccacataaaaataacttggttatctgcttctgtatgtaaactcaggttgtttgtgcaaaacataaactgccccaactaagaaatcctgaagaacatgcaaaaggaggtactttcactgtcattttattaaaaggcacacaagtcactactgctgaatataccactgtttctacccagctattttaaaattattggtagataatgtggtgagctactggtaaatacagctgtgaacacagcagcacacaccatctggaggcttttgacttaagcgatttttcaaatgcacagtatatttacactcttttgttcctttgaagcccaccagtcacatataaatggaccctttcttaaaactacaactacaaaagctcattcatcttgtggaaaacaagatatgagaaacaaatctaattgttcagctttagaacaagtgattatttcaaatcattaacagcataaatactttactttttctatttttattttttttaatagatagagacagggtctcgctatgttgccaaggctagtcttgaacttctggactccagagatcgagatcttcccaatagggcctctcaaaatgctaggattacagacgtgagccactgcacctggccccaacactttacttttataatgatctcccatacttacccattatattcttattatcttaacaagaagcttctgattaatactctaaaattaaatgttttcttcttttttgtttttcaatgagacagggtcttgccctgtcactctggctggagtgcagtggtgcaatcatggctcactaacctgctcagaaattatgtttgtaagtttcacgaatcatcatgctcatttttatttgttttgtcctcctccactggaaaataaatgctatgagaacagagacttcatcttttttgtatcttcagcaactaaaacagtacctagtacataattagtgctcactatgttaactattcactgttttcccatgctaagcatggtcctaaagcatttcgtaaaccctctaggtagactcattattttctggtatgagaaaacagtcacagaggttaaataacttaccccaggtatcacagtgagtaagtggtaaactaagaatagaactcaaactcagacagcctaactatttaccactacgctgtactgaataaattaatgaattacaccagagttcaatgataacattaaaaattgagtaaaattatgctaattttcctattgactaagcatcaacattattctgttttattacaaatatttaagtatgtcaactatttcatggattaattagattttagagggaaagtctaagaccccaatcatcattaatatgtggaattggataacaacctggaaaaagacttacaaatgaacttgtgatataacctgtttgaattggatgtaggatacctacttccctccattattccttggattcagcagtctgttgccaatctgaatgttttaacttcttttaattagagaaaacattttctatataagttacaatgaaattatcacgttttctagaaaatactgcactctactgcttcattccaggttgtctgaagatggaccaatttctccaatgaattaaaaagtatcttagtctaagacaagctctctttctacccagccacccccacgagatcccactccgccccaacaaccctcagcccccatcttctatcagcaaactgggcctctgacacaaaggtaccacatttataatatcagctttagtcataaacagatttcaatcaagtttgtttctacgacttttgctcctttttaaaaatgcaatggatagcccaggcgcagtggctcatgcctgtaataccagcactttgggaggccgaggcgagtggatcacaaggtcaggagttcgagaccaacctcgccaacatagtgaaaccccatctctactaaaaatacaaaaattagccaggcgtggtggcacacgcttgtagtcccagctactcaggaggctgaggctggagaatcacttgaacccgggagacggaggctgcagtgagccgagaccatgccattgcactccagcctgggtgacagagtgagactccaactcaaaaaaaataaaaataaaaataaatgcagtagataataacagctctggacagtagtatctactcaacaggaaagcagacagtaaagagaccagaccactgagaacccatgtcagtcacattacaatctatgttacagcctgaaaagcctgaaaagactcaaatctactcataaatactttctaataacttgaaacaataacactataaaatatcaagttggccacacatgcccctgagcagacacgtctaaaagcttctatgtgccacccagcccatggccaaactgctgttggtcaatgggttgctcaagtccttttgtacaatgtaacgagaggtaagagacaagggggaaacattctagccaccttatctccaatgatgccaacatttatttctgcttgagttttacaaactaatcctagactagttaacaaagaacccatttttcattgttgatttttacacaaaatattggcttcctatgtcattataaaatggatggctccatcggcttctcagcctacacaatagcaagcaaaaccctttggccttggaaaagcatggtaaatataatacctactaataagttacatggtttaccaatttcctcaaaatcaaaaataaatctctcacaagtcaactattaaataagtaaacaaaagcttgtcttgttctatcacttgcttaaaagcaagcacggtggcatgggagagggattaagaaacacaaccagtcaagtccataaaaccttcagtgtaagataaaactaccctgtaggagcagccaatgcattctgacctaacagctgtacacagttgcactagttaaaatgaaaagctagtctgcatcacacacaggcaattcactgagccttactgatacgttgatggggtttaccatcacagtcttccctcccctaacctacaatgtaaaaaatgaattgccatatagctgaaggcaccgggatgggggtgaggggaatacacacacacacacacacacacacacacacacacacgcacacactccctccctccctctctcaggcatttcaaaaataatcacaaccatgtagattgtaacatatcctatacgctataaaaacacacacacaaaggaagtggtacagctacattacgtcagctcttgcctcaattcataaatgcaaaaaccacaaaacaagacaaaaatctaaacggcctttttctggaaatcttagagtgaatgaatgtgggttaagtctttaaatatgttattgaacacttctcgcagatgcattgctttcatcagccacggggagggaaaaagtgtaatcttggtcaattctatcatgcaaccagatcaaataacatttcaagtgcagcctgccaagcgccagcgcctgccggagtacaatgagcgctcaactgctctggactgaaaaaccatctttcactggtcccagggatctttataaaatagtttaaacactactaaattacagagttagaaaaaaaaaatacaagctcaactctgctgcccccacactattgtgaagctgctgttaagcatctaaaaatctgccttgtgtaatttactaggcaatgtaaatattcagaaaggcaactgcctctcagagcccaagtctaacacatgcataaaaatgtagagttggttgtgcttctggaaataattgcccacagatcaacgtgcttacatgggatattgttcccatctgtaaggtttcaaatcatgtctactttaaatttggagtttccagaaagaggaaaaaaaaaaaaaagccagaactcaaaacagtaattttggcacagaattgtgaggactttgttaaatctgttctcaacttttactcagtgtctcaatcttaaaacacagaggcacaaagggaaaatggaatttctctgtagacacccgtgttcattcacagaccattttttagattttccgtgtggctgagaggcctccagccaaacaatgcccacagagcgcggggcacatgtgcgccagggacgcttaagggctgcaagtaaaacaaagtaacctattacaggagtttccttctcagcaaacaaaaagtggtcaagcaggtctccctacagtttcagaaaacaagagttgagtaaacaagagaggagaaacaaggaagacagcatcccacactaaaaaattcttttaacaatttaaacgtaaaacaatcgtcaagagtacctccgcattttagctactctggcaaaataacagtagttcggtccaagaagaaaatttcatttgtcacttaagtagcctcaaatcaagtccatcaaattcattttatttttaaacttgtttattccacagtaaagcaatgaagtttctgatcaaagagcgacttctgcattatactcggcttcaaaagcactttcctttcagaagaaaaaaataaaaatatatacatatacatgtatttttaaatagtgttttctctcccccctcaaaaaaatgttttctgttcgatttaattaactgagatttcaagagtttggggctacttaaaaactagtgagcccaacagaaatgcaatgggacacggcaaatactgactccccgttcctggaaagccatcatcattcttaggaacacccgagttccatctttctagggtcggctggaacactccgtgcacccaccccgagccccccgcccgcacttgtccaactttctggcccgagattcgcgtccccctcgacgcacgaggccgccggccacttgcctgcggcccgctggcggcgagagctgagcccgcgggcctggtcctcctcctccggcgcagggccccgccaactccggacccgcggaaaggggcggcgcaggcgggcaggtgggggcccggggagtgaagtgcacttgctaaaacaaaaggaggcctgagcggccgcagggcaccgcggcgcgggcgcaggtcccggcggcttggcggctccgggaggcggtggccgcgcggggccccgcccgcggctagggaggcggccgccctggcccgagcctgctgcccacggccgcggcactcagctcgcactccttcagcccgggaggccgggccagcactgccacatgccggtgacccagacgccgggagagaaagagcagactccccgcgacggcggcggccggcaaaacccgggctggagcccagcccgctccgcgcgcacccctgctggccgccgccgcgggcgcgcgcacacacaatgccagctgcaattttatctccttcgttgcttggccagcctccacccgctccaatcctccctcccctccgacagccggaactgggagcctgcgtgattgatggcagctcttaatagcgtggtcagctagaaaatgcatctgcaagcaagatattaaagaggcagcgcatccctgtgagtgatcagcatttcacacatcctagagctgcctctgcttctgccaggaatattaatgccaaccacctctgacgtctaataaatgcagatgaaacaaccaacaatcacagacaagctaaacatttatttcaaagatgcaccgggagaaagcagcattgtttcgtgtcaaagaacacttctgaccccagttttccttacacattaagaattctctgcaagccatttgtttaaaaatctcaccaatcccttttccacaagtaaataaagatccatctgttagacaagacatagcttaaattgtgcatgattgaaattcatctaataaggaagcaaaataagtgcacattccttaccatgtggctttaaataaacatataacctaccagctaccagattccaaactccctcattaattcaatttttatgtgaatcttaacagattaccaactgttaatttcaaactaatttcttacccacccacaattaattctggtaaaaaatatatatatcaacttgctaaattttattaaaattaaagtacatttaaagcatgtattctctagtggtgatagccaagatcattttgtcctcccaaagacattgtataggaattttttaaatgtattcctataaaatacaaattctaactattaagttcactcagtgtcaacccaaattagaaaggtacaagctgaaaatttaaatgattacttctggtatcttcactattacacctttccccttccaggcaagtttcatggaactctcaaatagcttcataaatgttaattagactttccaaggccctataaagtggctgcattatcaggtactctctttccaataaacagagaaatttagacagattaaagtgatttgcctatagtctctcaacaagatgggggtggggccaggctgaatagaacccaggggtcctgctttgttgccacagacagccaaacagacatgcacatgcatgtttgctatttaaagataactctgctggtctctctttaaagacaaatcaagttattctacaggacatagaaatatctgtctcaaactcctaacacagcacatgtactgagagcaagagctgatgaggcataatgtctttgcccccctgaaaggtggctgtgatcaatacaaatcagagatggtctgtagtgcaaatctagctctgctataagctccactaaacaccattcctcagtgaaaccatcctgagggggacctgtgacttgaaaatctgcttcatatccaagtggctatgagattactccatatatgtcagagatgaaattgatcctaaagccttgctacaaagctactcctgtacttggacacacttccaattttctaaccagctatatccagacacatggcacaggctgaaaagaatttcttttttcttttctacagaccattttaaaagtgccagtttatagtgagttggaaaaggctggtgagaagaagcaaaccgctctattctgaattcatactgtacctagtctctcagggattctaaatgctttgacagcattttatgccactcaaattcttttgtgctcatcttgcacctgctgctaatccaacctgcacccagccccccactttgcagttacaccagtttttccacttcccccaggtatagggatttctaccacaggccagcaggcttcttcccaccagagcaggaataatctccttgcagccccaaacagccactcacagaccgtttaaagcctccttcagatctcaggtcaaacatcactttttcagagaagcttcccctgagatcccattctaggtcaagttcctttgttataagttctcatagaactgtgttcctccttcacagcattgatctccgtttgtaagtcatgggtgtgattttttttaacactcatagccccttctaaacagttccatagagttctatagagaaggttctatatgtttgctcatcatgtagatttatgtcaggtacacaaatctgttgaatgaataaatgaactgaggtcaacaacactgctttactcactccatatattctctgcacatttcttggcacaaagaagcctatctcaaataagtaacatctatgcaaataagaatatcttctattggccggatgcggtggctcacgcctataatcccagcactttgggaggccgaggtgggcagatcatgaggtcaggagatcgagaccatcctggctaacatggtgaaaccctgtctttactaaaaatacaaaaaattagccgggcgtggtggcggccacctgtagtcccagctactagggaggctaaggcaggagaatggtgtgaacccaggaggtggagcttgccgtgagctgatattgccatgcactccaggctgggtgacagagcaagactccgtctccaaaaaaaaaaaaaaaaaaaaaaaaagaatgtcttctattaacctttaaaagcctagtaagccaagagtggtggttcacgcctgtagtcccagccgctcaggaggctgagacaggaggatcctttgagcctaggagtttgagtccagcaacataacaagactcagtctctaaaaaaaaatttagaaaaataaaaagtctagtaaaaaggaggatttttatccccattttatgaagatataaaataattgtgcctggggttactcaaaaacacagagatcctaactagtgtcctatttccaagctacactttttaagagttaatgaagtatagaagccatcgctagtttattcaagccaagttcttcctattacccagcccttaagggatatgcaaacagccacaggtaaactggacagaggactaaatcttgtatacacacagagcaatataaacagaatataaaacttagaaagtactttgtacactagtttgtcttcaaagcttctcagaatgcaaaagcactaccaaattctgctgtgaatgaggggagttcattcttacctcccttttacactgaacttactttattttcaggtttttttctctaagtaacagacctgacatggaagccttcgaaagagctctttccacctaggaactcaatggtgggtgtactcctcaaagtgaaacatttgttttaaccctcattagtatgagtttgtaaattactttgtgaagaggaaaaatcaaagttattacaacaaaaactataatttttcaggtgttttgcacatgaccacatgaaaaagtaataggaagaataattatgtaagataaatgaaaaatattagatataccacatccctcccaaattaatactcattatgactgtcagcattccacaagggattccttggttcccatgttatctccctggcctggtctgcaccattgcttctttttgtcctaagctccattccacacaaattccagctctccgtttccataacacccgtcatttatcaaaacaaccctgtcaagttgagtaccattaacagataatgagaggagacaacagatgtggctggaagcaaagcactctatattctacaggcctcagcatgcagccaagtgagctgacatctgactttatcctaacagttataattaaatcgaaagtctagttaaactaacattaaagctatgaccagaaacatcacacaggggaaatgtgaaggggaaccttagcaatagctgaacaggacccacattattccagacccttaacctggagcaaccaccctgcatggactctctccaccactccgctctgtcacagcaaaggaagaatcataaccatatcttctgaagatggcaactttgggccactttccaagaccaccgaggcagcaaggaaactgcatttttacatgaaagtttaaacagtagcactcatttaataacactaataagtgtcaaaattctaactatcaagttacctgagacaatcaacattctttcctatagcattatccagtacaaccattcagaccaagtaatttagctcacccatgtcaaaatgtcaaaagtacaccccaacgtcatccagcaaacagtgactgaatccaggattgtattagtaccagttagctatgtccgcataggatgctagggtggagaggatttgatttgtaacacagtactccacttttatccacagtttcgctttccaaggcttcagttaccctgagtcaactacagttcaaaaataggtgactaaggtacagtaagatactttgagaggccacattcatataattttcattacaatgtattgttataattgttcttattattgataatttaatttcccttataaatcaaattttatcataggtaggtatgtgtaggaaaatagtaaaaacagggttcagtattatccagtttcaggaacccacgggggccttggaacacattcccaagggtaagaggaaactactgtcctatacagaatacggagggatatggtttggctctttgtccgcatccaaatctcatcttgtagctcccataattcccacatgttgtgggaaggacccggttggagataactgaatcatgggggcaggtctttcccatgctgttttcgtcatagtggataagtctcacaacatctgatggttgcttttttgtttttgtttttgtttttgttttgaggcggagtctcactctgacccccaggctggagtgcagtggcatgatctcagctcaccgcaacctctgctcaccacaacctccacctcccaggttcaagcaatgctcctgtctcagcctcccaagtagctggggactacaggtgtgtgccaccacacccagttaattttctatttttagtagagatagggtttcaccatgttggccagctggtctggaactcctgacctcactgaatccacccacctcagtctccgaaagtgctggaattacaggcatgaaccactgaacccggccaatctgacggttttaaaaatgggagtctccctgcacaacctctccatctctttgcctgctgtcatccatagaagatgtgacttgctcttctttgccttccgcctccccagccacgtggaactgtgagtccactaaacctcttttcttcccagtctctggtatgtctttatcagcagcatgaaaatatactaatacatggagttacaattttaagcaaactatctacttcttttgcttttccaactcaccaaaatgtcactagacaacaaaaactctggagtttttttttttttttttttttttttgagacagagtctcactctgtcgcccaggttggagtgcagtggtgcaatctcggctcactgcaagctccatctcctgggttcacgccattcttctgcctcagcctcccgagtagctggaactacaggtgcccgccaccacacccagctaatttattttttttgtatttttttagtagagacggcgtttcaccgtgttagccaggatggtctcgatctcctgacctcatgatctgcccgccttggcttcccaaagtgctgggattacaggcgtgagccaccgtgcccggcaactctagagtttttaaaagaaaaaagaaaaatataaaattcttgaagctcttttagattttttaatttttttttttcttatattgagacagggtctcagtatgttgcccacgttggtcatgaactcctgagctcaagcaatccacccacctcggcctcccaaagtgctaagattacgggtgagccacggcacccagctcccttgtagattttttttagagtatatggtcctacggaaaatccaagcaattccacttaacaggctgaaggtttaccaggctcttctctagaacataggtacaaaagcatgcacatatacataaaaacatatgtattcatttgtctgagggttcacttgttgattttttgtcacaaagatgaaatcccactatttatgttatacagcaagtcacttctctcactttacagaagaccattaacatcccattcttgtttattactgcaaagaactgaacagtgtgggagtcccataattattatataacaagccccttattgagtctttttcacattttttactcttataaacagtgctacaacaaacttctttgtgcatacatgtatttctacactgaaggaatccctagttcaatgaatatacactctttcagagagagtcaaacagccatccaaaagctgtacaacttatactcttaccagcagtgggtcctggtcctgttcccatactcttattctggtttttgttggtttggttttggattaggcactctcttggatctcctacctttctggcgattctctctttctttccatgactcctcctaaatacaagtagtccctgtcaagcctccttttatcacattcggccatctcacatcagtgaaaagatccactctcaagctgtttctgtgtttgtgattccaaaatttgatttttccagctgagcttgcttcttagcaagaggcccacatatgcaaatgccctatgggttccaccataatggcattccacagacactctcaatcccaaaccaaatcaaaatgttcttccccctaagtcctggggggactgttgcaatctacgtaatatactcttgaatatactgttgcagtctacgtaatatactcttgaaaaataactagaaataacatcagattataaaaagaaaacaaaaagcccaagacagactggcctttagtaaaactctgaatagcacactttaaagtgaaataacataggtacaacattaaggttgggcattagttacaaccttccttcatgttttactttccaacatagtcccaaacatagatatttgtttgtttgtttgttttttgagacggagtctcgctgtgtcacccaggctgatgtgcagtagcatgatctcggctcattgcaagctccgcctcccaggttgatgccattctcctgcctcagcctccctagtagctgggactacaggtgcccaccacgcccggctaattttttgtatttttagtagagacggggtttcaccgtgttagccaggacggtctcaatctcctgacctcttgatccgcctgcctcagcctcccaaagtgctgggattacaggcgtgagccaccgtgcctggccatagtcccaaacatatttaagagtgataggccaggcggagtagcttacacctgtaaactactgggattacagtagcaaagtgctgtaatcccagcactttgggaggccaaggcgggtggatcacttaaggccaggagttcaaaaccagcctgaccaacatggcaacaccccatctccattaaaattacaaaaattagctgggcatggtggcgcatgcctataatcccagctactcgggaggctgaggcaggagaatcacttgaacctgggaggcggaggctgctgtgagcccagatcgagccactgcactccagcctgggtgacagagtgtgactctgtctccaaaaaaaaaaaaaaaaaaaaaaaaaaaaaagggagtgataaactgctaataagtatttaaagtattatatcatgaaatacattatcagcattataaaaatatactccagaaaacaaaaaatacaactttccactaggctcccgggggcatcacagcaaactgttatgacattagtcatcaatcgaaggtcaggcctggaggttttagtttttggaagtgtgcagccgtctcatggatgtagccctaaaccaacttcagacagagagcaagacctcttagatagcacatgctttaaatatgtttaaggacattttcatttttatttcaaaactcactagagatctcagactgtgcagatcaaattattaaattccaatagagcgatacgttgaaaagccaaagcagggttaagaagagaaatttctcgtttggaaaagggttttacagatttaaaaacaaacagttttgtggaagaaagagctcagggatgcagggcctcaatgggatgtttaaaatgaggcccctcgtgtattttgaactgatgatatatgataaaatcagtgtggagatccagccaaatgtactggaagtaatcttaaggataactcaaaaccacaactgaaatcaatatcctaagaattcaaaatattaaccagacagataattgtatgacttattaaaataatgtacacaaattcaaaatataattttgccctttattattattaggacatgttttctctagtattatgccgccaataaatgaaaatactttaaaataaaattacacacgtgtatttcagaaaaaaatacatacatttaaatgtttcaaaaaattaaatgagtaccatttgccagtctcagcatcagaggtagcattacagatccaggaactgcctgcctaaaagccaataactgctctctagaaaatgccagaagactccagttaaaaatatacactcaaacattatataatacattggctaaaacaaaaatcaaaagccacagattcgagaatgtttgatctgcacaacacagggtggtttcttgtgttttcttctgaagggattagaagtgagtgagactgtcataaagacaaatgctgaacatacattctggagtttaattttaactaaaagagcaaatacttgggctgcaggaaacaacaactgagtgagtacaaaggaaggcatgggctaacttctaacgtttacatcatctgattaattccaacaataaaatctaaacactgatcatcccctccaatcttcagagcaagctgactctacagtgaagaatacgagagccctatcagctgactctggtatgtttaaacgattataatgtaaagcatgttcattctcttaagtgaaaggaaatgactgccaaatgcttccttcacaatctctccagaatagggcaggtcctttaatgtgagattttcctgacattccaattgtagcagacattgaacaaacagagacgcattaaaagccgacctggttctattatcttttattgaaggcctagcaaagatcagacatgagccctgtgctatttacattttttggtgcattaatcacttttatactcaagggctttagaaaaattcaatggatttttttttttaatgaaaaacaaaataaaaaaaaaacacaggatgtaaccacagctatattggtctttttctcaggaaggtcagaaaagctttaaaaacaggaagtctgtgctataaggttgagaaatgtttgttttaacagcctaaggcgtcatggttgcagtttgcagtcagctgctatggaggactatagtttattcttcccagccaaggattaatgtccctagggaaaaggccaaaaaggtactcatataactagaaaagcacattatcctaaaataagacttgttataaaatctgaatcataaatcttacaagatacctttcaacattaaataggaactaatttagtaactggaggaggaacagtttgtcttttgtggtaatttataaaggctaaggaaaaaccatagtaaccaatgctaagacaacctcctagaaacaattagcagtgggttaagaattggtgcttgccatttgatacaagttttctattgattacctctattttaatcattatactaatattaattattaaaatcaaatgtaaaaatgacactcttgcttgaatgcaaattcttgcaaaaaaggcagattaactttaaaaatgttttatccctaacaaaatggttggtctctgcttttaagaaaaaaattttttttaattaaaaactttggccaggcacagtggctcacatctataatcctagcactttgggaggctgaggtgggcggatcacctgaggtcaggagttcaagaccagcctcgccaacacggtgaaaccccatctctactaaaaatacaaaaattagctgggcgtgatggcaggcacctgtagtcccagctacttgggaggctgaggcagaagaaccacttgaacccgggaggcagagcctgtagggagccgagattgtaccactgcactccagcctgggcaacaagagcaaaactccatctcaaaaataatgatgatgataataataataatagtaattgcaaacttcaactacagtgctaaacagtcttaacatacctaacattaaaggtattttatttcaaaaattacaattttctgattccattctttatacttagcttacacaggcaatcaaaatgaggctttttcatggtggactccattttaaatggaattaaacgttatattatgaaaactttaagccaaaaatatccaaatattaatattaaaatacacatagcacatgaatttaaaattcatttggcttttaaagggtagtgattggaaaaatcctatcatgataaagtgctttaaaatacaaacataaatggctaataccacaaagtttgccattcaccccaagaagtaattttctatttgatagttatagctatctttaaatttttaaatatttatttctacaatatctctagagaggattgaactactgccatttaacagatgggagtaaaatgaaattctctcaactttatcttttcccttatggttcagaagacatcactctaataactttatctttccaaggggcatcattcaagtaacaactcatcctaaaaggcccatactggctttcagttgagtgtattctgtattatgctctggcgtctttcctgaaaattggaagacaatagagtaacgccttcaaatttttgaggaaaatagtctccaacctacagttctatacccggccaaactgtgagataatcaaggatgagcataaaataaagacattttcagacacacacagcctcaaaacatttacttcccatgtacccttctcaggaaaatacttcacaaacaacagagggaaccccaaccaagaagccatgaaaaatgatctgagagtcatatgaaagggaagtcttcttccaacaactcagtggcagatctagacaccaaaatgaggcaatgggttccaggaggatagcaccaaggctgatctatagattaatattttccattacactgattttccaatagttctgttggaaaatttaagggtgatttagagacggggcatacaaaacaaaacaaagaatcaaaagagagacaattattaattccaggaaagaagttgtacaagaaatgtaattcaatcataccacaatttttttttttaagacggagtctcactctgtcgccaagccggaatgcagtggagcgatcctggctcactgcaacctccgcctcctgggttcaagtgattctcctgcctcagcctcccgaatagctgggactacaggcgtgcgctaccacgcctggctaatttttgtatttttagtagggatggggtttcaccatgttcgccaggatgctctcaatctcttgaccttatgatctgcccgtcctggcctcccaaagtgccgggattacagtcgtgagccaccacgcccagcccacaatatttgttttaagctataacaatatatacatgcctataataatataaacattcggctgggtgcggtggctcacacctgtaatcccagcactttgggaggccgaggcgggcagatcacctgaggtcaggagttcgagaccagcctgaccaacatggtgaaaccccgtctctactaaaaacacaaaattagccaggcgtggtggcaggcgcctgtaatccgtgctactggggaggctgaggcaggagaatcgcttgaacccaggaggcggaggttttggtaagccgagattgcaccattgcattccagcctgggcaacaagagcgaaactccgtcttaataataataataatataaacattcaatactgatttaaccacaaatggtgatattaccacaatgagaaggaagaggaagaggagaaagtagaagatatataaaaggtgacgggctggcaaggaggctcacatctgtaatcctagcactttgggaggccacagcaggcagattgcttgagctcaagagttcaggaccagtctggaaaacatgacaaaaccttgtctctacaaaaaatacaaaaattagccaggtgtagtggtgcgtgcctataatcccagctactcaggagactaaggcaggaggattgttgagcccagaaagtagaagttgcagtgagccatgatcatgccactggattccagcctggatgacagagcaagaccctgtctggggcgggacgggcggggaagagatttaaatggctaaatttaaattactcattgggtaaactcagcaagtgatgtctaaaatagaaaataaaaacaggtcaggcacagtggctcacacctgtggtctcagctacttgggagactgaggcgggaggatcccttcagccatggagggcgaagctgcagtgaacagtgatcaagccactgcactccttcctgggcaacaaagtaaggccccatctcgagggaaaaaaaaaagacaaaaagaaaagataaagaagccaggcatggtggctcatgcctataattctaacactttgagaggccaaggtggcaggatcacttgagctcaggagttcaagtccggcctaggcaacactgcaagatctcatctctacaaaaaaaaaaaaaaaaaaattaaaaaattagccaagtgttagggcacacacctgtggtcccagctatttgagagcctgaaggatcacttgagcctgggaggtcaaggctgcagtgacccaagactgcaccactgcactccagcctgggcaacagagcaagactctgtctcaaaaaataaaaataaaacataaaacataagcatgtcctttagcaatattgagataagtgacaaaataaatggttttaaaagttcaaacagtttgcctctgagaagtgaaactcaaggatgggaggaactactaaaataaacaaacaaaaaaaaataaacagtacaccaccacttgattaagtacgtgcacatatattacctagaaaaaaaaatcatatgaaattaaaaattaacacaaatgttcccagaagatctttgctacctttttttaaaaaaaattcactaacccatgtgctttgatcacctggtgaagaaagtaataaaatttcagaatggaaaaaaagaaaaggaataaaaaaaaacctagccaaagaagcaatcaatctttttaagacgtaggcatcggactgaaatttatttttcttcagagggcaggctgtactacattttgcaacctgctagtaagactcctgaaatttggcccctcgataataataatcttataccaaaaagaaaggaaaaagacacaatcacaattttaaaaaataaatgatataacaactcaatcactataattttagtatgtataaatgagaaatacatcactaactaaagtaacagcttttaaaagaagcagtaggtgaaagtacaaatagatcatccagcttcaaaaaacttaatgaatttttaaaatcatttttagcattttacccatttgtttattcacaattatgttccatagtcagctaatggtttttgaaaaagagagtaagaataagatggataagggaaaggaaaatcaagcatgttctaaattgcaagttaatcattaggtcaacagtggtagttttcagtatttctcaaacacaataacgccttgtcatcgattgagaatactgaattttaatgccattgttttgtcaataaaaagtgcttatgtacacttcacgagttcattaataatcctctaagaagacctaaattaaagcttggcaagcagtttctcatgaaacaaaatttgctttagttctggtttgttagaactaaatgcaccaagtggcaaattaagatgtagaaacataccttaaaggttatgctttgaaagtattcaatgactcaaacagaggcatcattaggcagtagcaaaataaatactaagattcctatttcatttgcaatctgttaagtttcagacagataattttacaatgaccaccaatagctatcaggataaacttcgaaaggagatagacatacattccctaaatttcatcagaggactggaaggtaaccaggatagatcccattttcagcattaaaagtgatcaaaagagtccaataattcacatagaagatgccattgtgctgtctatactgtgtgtatttaatgtccatgggaatgctgacatgtgcactccaagtggtgattgaagagtcaactaagtagggggaaagggcttggagcaaaaatttcaactaaaaataatccagttacaggagaatagtaccaggcaagctggaaaaactataatcaaagtctgtatttccagtttcaatagtaaacacagttgttaagagtggttaacacacaagaccataagtgcatgcaatttcaagtcagaaacatctgttttaccaatagtatccctgttatgtcctccatttctttactaaagcagaatgtgagagtaagaacaagagcaagcacaatgtatgaaagaaagtaagcagtcaatttaccttagaaaacattaggactttcatataagttcctaaaatcataaattctaaagccgttagatttctagaacttgacaagatttctttaaaaaacagggtcagataagaattttgcctttcctcctattagtttttagtccccaccagctgaagcagggtgcccgtttctacaccaaagagcggcaaaatgaagaaaatcaagcaaattacacagcaaaggcagaaatgccttctatttcatgagaaaagagaaatggtgcaagccaatggatcaccaacctcaatgcactgaacagctgaatttttttgtttagttctgagaataaagctgtggtttaatttcatcaatagtgaagtttagtcctacctattttgctgggtgattttaaatggtaggtgactctcttcatctggtactctaagagcaggcagcaacatttcatccttagttctgactgagcttcccagtcttcagcaaatttagcctagtggtaaaggtctctagctctggagtcagatggccagggttctcctaatctaagattttctaactgcataaccttgggaaagtctccatatgcccatctatacaatgtggttaataacagtacccactgcacaaggttatcatggagatgaaatgaaataattcaagcaaggccttggatggagtgcacagcacacaggaaatgctcagtgaatgccagacaccattaaccgtgtcatcttggactctgtcatcgacttattgtaaaaacctgattaaaacaattaaaggagggcctaaatcaccccaacagtgagggtggtaattcattatttgtctgtgaagtacatcaccccactaaaaaaaagaaacaggcagggggcagcaaaatcagcattttgcttttcatccttgttactatcactgctacattatttatgtgaactgggaaggagtgtgtccggacagatgctcagctgggttctgcaagcagagcatccatcacaaaaggtagtgcctgtctcaggagcaagcccctttcctgcctcctctctccccttcatcagtcaccactagggagagcacagtggagccacacagcagctgggcaatgtcaaaacattattgtccaagcactctgttcaatgattttgatgaaataaagtaatccacccctaaatgactcattttgtcccaaattagcatccttaaggtaattattaaatatccaaaaggatccagggtgtattagaaacaaaggagggggtgaggaacattgatatactaccaacaggcaccctactataaatttactaaaacaggaatcatgaaatgattgaaatgacaccaaattatacaacataaacatagaggaacaaatgacagagatttgccctctgcttaattcagcttacatagatgtctatcaaagacaagtttctacagagtcacaagcacactgtattcaaataatcttcatttccattttctctggacaagcgaaagtaagcctaccacaacagttaatgggttaaaaactgtcacattttcaaaacatttacattatttaaatgcttatgtgtctaccaccacccccagagaattaatcacctccttattactgtcacctctctaccctccatataattctactgctgcgtttctcacagacttaaaattattttcatataaattggtctttgctgctatatgaagcaactcagggcatggagcacgtttgattcatttttgtattcccaaatcttcctgaataatttactcactcattaatggaacttacaagccctaatatgtgccagatgctttggggcggctgaggcgggcaaatcatgatttcaagagatcgagaccatcctggccaacatggtgaaaccctgcctctactaaaaatacaaaaaaaaaaaaatttagctgggcatggtggtgcacgcctgtagtgccagctactcaggaggctgaggcaggagaatcgcttgaacccaggaggcagaggttgcaatgagccgagatcgcgccacagcactccagcctggcggcagcaagactccatctcaaaaaaaaaaaaaacagcacaagcacttagaatacatctatgaacaaagtagaaagacactcctgacctcaaggggtttacattctgcagggagaaacaaacaataaccaacagatttttttgtattctataaatttcacacaatattcaaaggcagtaagtgctaagaaaaaaaagtagagcaagaaggattaaacatatgcagagggtaggtaccagctggagagagaagagagacagacagacagagtcagagagagagcaagagagagagagagaacaagaacgagcaagagagagcaagcgagccggcaggactagaacacaactgagggtggagggtgccggcaacggacgagtcgagtccaaggtcagggtaggcctcataggccactgtaggggagttcttataattgtataaccccaagagtagacaagaagcacacatcccaaaatacgttacttgtacatgaaacatccaggctccattaaaattaaaaatctagccgggcacagtggctcacgcctgtaatcccaacactttgggaggctgaagagggcggattacttgaggtcaggagtttgagaccagcctgaccaacacggtgcaaccccgtctctactaaaattacaaaaattagccagacatggtgatgcacacctgcaatcccagttactcaggaggctgaggcaagagaactgcttgaacccaggaggcggaggttgcagtgagccgagatcaccaccacacaccagcctgggtgacagagcgagactctatctcaaaaaaaaaagttgttttagtatttctcaggtacccgataggtcatcttagaaggagcccaccttgaagacactgccctaggctggtaaaacttggacagttaacactgcattcctcagacaactgggagcactgcagaggtctgcttccccaagcccctgaacgacagcctgggacttccctgcaggcctgaacacaagatctcaggaaatggaagagttgaaccgaaagagtttttgtatttttccactcaagacttttttattattatttttttagaaggagtctcgctctgttgcccaggctggagtgcagtggcccaacctcggctcactgtaacctccgtctcctaggttcaagcagttctcctgcctcagcctcccgagtagctgagactgaaggtgcccactaccacacccagctaatttttttctatttttaatagagagagggtttcaccatgttggccaggccattctcaaactcctgacctcaggggatctgcctgcctcagcctcccaaaatgccgggattacagatgtgagccaccgtgcctggcaagagattcttaaaacctcttctggtgagaagtgaggcacctgaccaggaccaatgggatttggtgacttggtctcacacctgctttctctctgttggaagggttgctggcctctattagaaattttaattactatctggcaaaaatatgttctcctttctgactgcttaaatatgtaagatgggtccctcagtgctagctaacctcaaaactcaaaactaaatcatcttaataacataaacccttatctctgtcttgacagcagtaacacggagctgaacagtcagctaccagcatatctcatttcattgcatttgctttgctgcgctttgcagatactactttttctcacctagcaaactgaaggctttggcaaccctacatcagggaagtctactggtgctttttgttctttgtttctgctttcttcagccctttttctgtctatgaagccaacctcctctactgcactcattggaatgcttacatttattctacttcataaggtattgcccaattctagaaccacaaataaagccaactgaaatctttaaacgatatttgttgtaattgtgtcttctgacagaaacacaactcaatccacgcacaggtcttcctgcctcaacctttgctaacctagcacccatctaccttccccttggctatcaaaccaatgtttctgaaactcaattctggtaacatcccttttctacttaaaactcccattagctttttcatccaaactataatgacagcgatactaatatttattgagtgctaactgtacaccaggtactgctgtaagtattatacatatatgacaatattcctacaggataggcactattattacctcctcttttataagtgagcaaaccaagagacaaaggtgttaagtaacatctgttcaataaagccacagacttggccttcatatccctgggttccacatctgtggtttcaaccaaccacggactgaaaatatttggaggaacaaaaaaaggatggttgcttctgtactaaacatgtatagaattttttaagtctttattccataaacaatacagtataataactatttacatggcctttacattgcactgaatactataagtaatctggagacgatgtaaagtataagggaggatatggtctaaagtatgttggaggatgtgcataggttacatgcaaatacgacaccatgttatttaaagaacttgaatgtgtgtggattttggtacccaccgatggtcctggaaccaatcccccacgaatactgagagaggactatgtagttagtttcagaacctgcatttaaactcaggctctatacctcaaaataaaaagctatttgacatggaaattcaattaatcaacagagttgtctttgaccctctacctatcaaaaactactgacagcacaaacgattcagaactttcaacagagaaaagagaaggtgtccagaaaggaatgctgagtctctcttaacacagctatcaaatcctgaatgcctcacaaacatcagatcagccatccatcaccaaaatgggagggggaggtaggaatcgaaactgcagaatgacaacaaagaagaataaaatctaacaactcagcaacaatataccctcaggttagagataaggaagaataaacaattcagtctgaaaggacttctaccaagaagagattagtaattagactgaatggctgtggttcaatataaagtatagaaatgcaatttttttccctctaaacagaacataggcacaaccccagaagttactcaagagggctttaaaaaagaaaacaaactctaaaacaaagagtatctttaaacactaatcattgtttttttttctaaaatcactattagaacactacctgacaaggtctttaaagggttcactgttgattaagccattttcatggcctagtaagtttgagttctattaattcagactgtgctatgtacactgaaattttgtcttaggcaggctcaacagaacagttcttcaaattaagcaagtgcttaatgttaggtagaaaaaatatgtcgctgtgaaatatatactgtccaagtactatttggtgccaacaaaagctaacaaacaggctgtgtttttaagtctaagcagaagaaaagtaaccactacctgtacagaatacagttcggctctttcagtatttcagataaaaagaaggactgaaaccagaaacaacctactttctagctctgaattaccatcatcacattgtataaatcattaggtggggacagaatacaccaaaatagaaatcacaagctgaaagagccttgaattccttcccttaaatgaagctcttatatcaaatgaatctatatagtctctgtgtgttccagcattttgtcaacttgtaaatcaaagattttgttccatagcccttctcaattttctacatttaacatctgacaaaaaccagcttttatctttaccaaagatattctatccctagaaagtcactatttaaaatgatgtcatttatatcatgtaacatattaagaaatacatttattttatttttggtagtaacaaaacaaccctggatatttgcataaattaaagctgtcaataagaaaccacttctatatgtatccttctttgggtttctggctcaggggttggcaaaaatgggttatacatttaaataatatttcaatcttaggttaaggaaaatttctcctgtatatttcaagatacagagagactctgccgatttacattcaaataaaacaaaacgtgagtaatactgtctatatcaatgttctgtcacttgccagaataaagaaaacatttagtaagttagttaatttcaagtctgagaattaagcaaatatcccaaatcctttgtaaactcaaagatttagttactttctctacatattacacagctgctttaaaattttaccttctggccgggcgcggtggctcacgcttgtaatcccagcacttcgggaggctgaggtgggcagatcacgagctcaggagttcaagaccagcgaccccgtcgctactaaaaatacaaaaattagctgggtgtggtggcgagcacctgtaatcccagctactcaggaggctgaggcaggagaatcccttgaacccgggaggtggacactgcagtgagctgagattgcaccactgcactccagcctgggcgacagagctagactccatctcaaaacaaaagaaaaaaaaaatttaccttttatttctagatactttgtaaaaaaaaaaaaaaacaactcaaccttctttcctagaaactttctaattaactttctacttttttcgttaagaaaactcctttagtttacacaccaattctgtataaattaaaaacacacaatttcaggtgaaagttctaatgagtagtgtatattttgaaaacacgaatgcttattttacattactctgtgattagaatgaaaaaaacatagatgcacaagtggtgacagaagtaaacctaatactcaataacaataatcaaaggcaatacatgatactcgttcctgtctcactagtgcacattagttttaacattactgaaagatgtgggaaactcagtattttctaaaactcctgatttatttccaaaggaaaaatagttgtaactacgtcaaaataactattttggccggatgcggtggctcacgcctgtaatcccagcactttgggaggccaaggtgggcggatctcttgaggtcaggagtttgagaccaacctgaccaacatggtaaagccccgtttctacttaaaatacaaaaattatccgggcatggtggtgggcgcctgtagtcccagctactcaggaggctgaggcaggagaattgcttgaacccgggaggcagaggttgcagtaagccgacatcgtgccactgcactccagcctgagcaacagagtgaaattttgtctcaaaaaacaaaaattgcaattaatagtttaaaatattaaatctaaatttataggagattcattagtttgcccttggtaatccccactttctgccttgtaaagcctaagaccctaagaagctctacaaactagagcttcttaggcttcaaaacagttctttccaaaccatatttgatgaattatatgtaagatgagtcaataacataaggattagatttccctgaaaatgcatagaaggttaaaaattagaagaaaaagtgataggcataataggctctgggttttgcttaatgcaaacgttctgaaaggttcaacattaacacagacattcacaaatgaggcatctaattttaactttgttttaaaaagttgtttaaaaaaaaagtcaaaataagtcaaactcttcccatttgtttgaatagagggtacatttacttcctacccaacaagatttgaaaacaaaagacatattagctataaagatatattcctttcacttaatgctccacaaatgtctgaaaagcaaactcaactcaatttagttgagtcaataagggaattccagttttccttttttcttttctttttttttttttttttttttttttgagacggagtcttgctctatcgcccaggctggagtgcagcagcgtaatttcggctcactgcaagctccacctcccgagttcaagcagttctgcctcagcctcctgagtagctgggattacaagcacacgccaccacgctcggttaatttttatatttttagtagagatggggtttcatcaccatgttggtcaggctggtctcgaactcctgacctcgtgatccacccgcctcggcctcccaaagtgctggggttacaggcgtgagccaacgcgcccggccaggcaattccagtttttctaagacagtattgtaaaccaagcagagatattccctagggccatataattctgatacattagctaatctttgtaagccaaatcagagcacttctttccaaaactcacatttctaccaaaccgggacaccgtgtggtggggaaagagttcagaacacctggtatatttttccaaagcaaaatttaactttccattgccaggagaagcatgaacatgttgacttatactgccctctagagtctccttctaatattttttagcctgaaataattaattctaatcataagactcttctaattactcaagctttcagtattctaatattgtaaactgacgtttatttatttatttattgagaagaagtctccctctattgcctaggctggagtgcagtggcacgacctcagctcactgcaacctccacctcctgagttcaagcaattcccctacctcagcctccagagtagctgggatcacagccatgcaccaccacacccagctcatttttgtactcttagtagagacgggttttcaccatgttggccaggctggtctcaaactcctgacctcaggtgatccacccgcctttggctcccaaagtgctgggattacagcatgagccactgggcccagccaactgaccttttttcagtggattagtagtcttttttttggagggcgcggggtggggggaaaggagtctcgctctgtagcccaggctggagtgcagtggcgcgatctcggctcactacaacctccgcctccagggttcaagcgattctcctgcctcagcctcgtgagtagctgggattacaggcatgcgccaccatgcgcagctaattttgtatttttcatagagacagaatttctccatgttggtcaggctggtcttgaactgccgacctcaggtgatccgcccgcctcagcctcttaaagggctgggattacagatgtgagccaccgcatctggctagtagtcattattaaaacatacaatatttcaattacccactgttttttatttttttgttgtttgtttgttttggacagcgtctcgctctgtcgccaggctgttgtgcagtggcacaatctcagcttactgcaacctctgcctcccgggttcaagcgattctcctgcctccgcctcccaagtaactgggactacaggcacgcgccaccacgtccagctgatttttgtatttttggtagagacggtgtttcaccatgttggccaggatggtcttgatctcttaacctcgtgatccgccagcctcggcctctcaaagtgctgggattacaggtgtgagccactgagcccggccaattacccactattcttaaaggtcagcagtacttccccaaaggacaggaatgcaccccaaacagaatcttctaatttgcttatttaaaaaaagttttaaatagctcaaactgcaaagacttctaaaacaaagaccacttgtagcatatattaattaatccatgtagcccagagttttgtctagcaaaacccaagttcacacatttgaccacatgcacacgaacctcagccaacgcagccaacgctccccagaggctacttctgcagctaagcatctgtcctttcagctcctggcagttcctgccttttctcttgccaggcaaccagagctctaaagggatcttaatgcactaatgagaagccatgacaaccaagacctgcggtagctgcaaagcacaaacaccagtatccacttttactgagcacgcatgcaataagcaatgtgctaaggaatccaagtaaattaaaatcattcctctaacctaataactccataggcacctataacacaccataacttgaaactttctatcattctttatatttaagaacttattaaaaggcaggctttaccatgcaccactggtagtatagcttgcctcagctgttatagtaactatagaagtagggttattttcttgtttgtttcaatctagagtcataagagaccatcaaaaaaaaaaaaaccctattgaaaccatgtttagagcgaaaaagtctatattctttttaggggattagtagtcaccattaaaaggtatgatatttcaattacccacagttatttgagatcagcagtatttcctcaaaggacagcacctaaaacggaattttctctaggcacctgtggtataccataacaccaaaaagcatccctcaaaaaagaaactaaaactaagatgctatgctccatacccagatatctgttattacttctgaaaacaatctaagtaatcttggggatcccatccagtagataaaaacgatggcatcctttggggcataaagtgaaggtaagatttccacaggctctgaaacagcagctagcaactagggccaagagactgcacctgtttttgaaaataaacttttatagccaggcgcagtggctcatgcctgtaatcccagcactttgggaggccgaggcaggtgatcatccgaggtcgggagttcaagaccagcctgaccaacatggagaaaccctgtctctactaaaaatacaaaattagctgggcatggtggcgcaagcctgtaatcctagctactcaggaggctgaggcagagaatcgtttgaacccgggaggtggaagctgcggtgagctgagatcgtgccacaccattgcactccagcctgggcaacaagagtgagactccatctcaatcaatcaatcaatcaatcaagttttattagaagtcagctacaccgatttttttttttttttttttttattgagatggagtctcgctctgttgcccaggctggagtgcagtggcacaatctcagctcaccacaacctctgcctccctggtttcaagtgattctcctgcctcagcctcccaagtagctgggactacaggcacgtgccaccatgcctggctaatttttgtatttttagtagagacggggtttcaccacgttggccaggctggtttcgaactcttgaccttgtgatccacccgcctcggcctcccaaagtgctggggttacaggcatgagccactgcacctggccttatttttttatgtgtattttctatggttgtttgtcttcccactacaatggcagagttccatacttgaaacagagaccatacaacctgaaaagactaaatatttactatatctggccctttacagaaaaagactgccaacagcaaacatctccagccttctccagatcacaacttaagaggaatgtcatgtgcatgaggctaaggagtgtgggctggcttgagatggaaaaggggattatgactgctatccaccctatactacatattaagaaaatgaaattatgggaactcatgggaagaaagaatgacagatgcagctgattcctcccatatgatggttcacatcaggcttttccaaagactgaatgaagagctctaaggttttctttcaggtatttaaaaaatcttatgtaagggatggcaggggaaaataaaattttctatataacatactatttcactcacatcaatgttacactgaagctcacacctgagataggctgatatttctttcaaagagaagatttcaagtaagcttccaaatagctatgataatgtgtatgaatagaaccagatcccagaatgaacttgaggtaaataccaaggactgaaatcagtgaaccatcaaaacaaatatacttgtcaaacatacaatacacaagatgaaatataatgaatccctttgaaggtcactatatgtagatacaaaaatacagcttgaagatgatctagtcaagagacccaggttctagtccgggttttgactctccctgtaacttagaaaagtaatttcccccatttgtttttggggttttttttgtttttgtttttgtttttgagacagagtctcgctctgttgcccaggctggagtgcagtggcgcgatctcggctcaccgcgagctccgcctcccgggttcaccccattctcctacctcagcctcccaagtagctgggattacaggcatgcgtccccacacccagctaatttttgtatttttagtagagacagggtttcaccatgttggtcaggctggtcttgaactcctgacctcaggtgatccacctgcctcagcctcccaaagtgttgggattacaggcatgagccactacgcccagtctggttttgttttttgagacagagtcttgttctgtcacccaggctggtgtacagtggtgcaatcacagctcactgcaccatctacctcccaggctcccaaagggctaagattacaggtgtgagccacagtgaccagccagtttcccctttgtactttatctgtgaactgaaggactaacgctgcatgagtggttctcaaccattcacatgcctcagaatcacctggagggatttgttaaagcaaggggtgttgggtgccaggcttcattttcagttcagaagtcatcattcccatcctcacagcaagaaaacagctaaacaaactgaaatcaatggcctttcttagatccattagagaactggggtcacagagcaaacagctaccacaaaatttgaaggaaaaaaatcacaagaaaatacagagaatcacagaaaagatcagattaccagaagcaaaagctacatgaaccagtaagcaatacagtaatcaatacctgaacggtaattttgacgaactgcagaagactgagtgtggactagcttgagagttaaaacttctggaggtccagacttaagagggacctatatagcttttacctccaggagcctgaacaggttcttacaagaacatcaaagaaaaaaatcccctcgtattttaggcagggagaggggaaagtaaccattttgcaattgctcagagcattctccataacaaaggcccacctgctaagaaaaactacttcgcaggagctttgtagacctggggaaaggacaattactcaactccctcttgccttctcacagaaggggtgaggggaggaaagctaataaactcttcggaagatcacagcctaaagacttacgcccactaaaaaactgagatttaatattagattacagaatgcactccttccccaacacctttccaccacatcaacagagctccagtataaaaaaaaaaatgcattacaactgacagagcttcaagacagactctatttaagaaggagttcttagggaaacccaaagaaaccaggggtggaaaaaaacaagaaaactacaggaaacggaagcatctaacccacagcaaacatgaagcacagtatggcattttctgaaaaagctaaacataatgtttttttgtttgtttgtttgtttgtttgttttgttttgtttttttgagaagagtcttgcgctgtcacccaggctggagtgcaatggcacgatctcgactcactgcaagctctgcctcctggtttcatgccattctcctgcctcagcctccccagcagctgggactacaggcacacactgccacgcccggctaatttttttgtatttttagtagagacggggtttcactgtgttagccaggatggtctcgatctcctgacctcgtgatctgcccacctcagcctcccaaagtgctgggattataggcatgagccaccacgcccagcctgaaaaagctaaacataatcttaccatacaatcccacaatcgtgcccctaagcatttgtccaactgacttaaaaacttatgtccatacaaaaatctgcacaaattttagagtagttttattcataatcagagacagaaggcaaccaaggtgtccttcaaccgtacttcatgaatagatatgcgaactgtggtgttcactgagcaataaaaagaaatgagctctaaagaacaagaaagaggaacattaaacacatattgttaagtgaaagaagccaatctgaaagtatacacactatatgattccaaccatagaactttctttaaaaggaacttcaactttctttaaaagacaaaactatagagatagtaaaaggaccagtggttgccaggggctgggcaaagaagggagagatgattacatggagcacagaagttttaatggtggtgaaactattctgcaggatactgtaactgtggataagcacatgacatttacgtttctgtcaaaccccacagaatgtacaacacaaagagtgaatcttaaactgtagacttcagttaataatatattaatactgcttcatcagttgtaacagataagccacactcatgcaagatgttaataatagggggaactctgtgtgtgtgtctgtatatgtgtgtgtgtgggaactacttatactatctgcccaattttcaatttttctttttttttttttttttttttttttttggtttagatggagtcttgctctgtcacccaggctggagtgcagtggcgctatctcagctcactgcaagctccgcctcccgggttcacgccattctcctgcctcagcctcccgagtagctgggactacaggcgcccgccactacgcccggctaattttttgtatttttagtagagacggggtttcaccgtgttagccaggatggtctcaatctcctgacctcgtgatccgcccacctctgcctcccaaagtgctgggattacaggcgtgagccaccacgcccagcccgatttttctataaatctaaaagtgttctaaagtataaagtttatttaaaaaaaaagagagagagagagagtgagtgttgggagtcactcctcgatcctaattcagtaagtcttgggacaggcccaataatttacattttaaccaaattcacaagtgctgctgctggttcaagagccacatcttgaaaccactgggctacggctccttttagttctaaattttattattctattcactaacattttcatgagaactgtggtaaccagcccacaaaatggcccccagtgagctctgcctcctggtattcaaactcttgacaataatgtcttccaaggctacgtcataaaagacattgcagctttcaccttgctcttatatgaatcctttcttctggaaagccaggtgcagtatcatgaagaaactcaggcagccctatgaagaggttccatgtgcaaggaactgaagcttctgccaacagccagcaagaactctgccaaccttgtgaatgcactatgttgcaattggatcctccaggccctatcaagccttcagttgactgcaacctgagaagggacctcaagccactcctaaattcctgacccacaaaaggtgtgtgggataacaaatgctgaatgttgttttaagcagcagtttggaggtattttgttacatatatcatataggagcttaatctaaaatatgtatgtggctgggcacggtggctcacgcctataatcccagcactgaggcaggctggatcacctgaggtcaggagttccaaaccagcctggccaacagggtgaaaccccatctctactaaaagacacaaaaattagccatgcatggtggtgggtgcctgtaatcccagctactctactcgggaggctgatgcaggagaattgcttgaacccagaggtggaggttgcagtcagccgaaatcgtgccactgcactccagtctaggcaaaaaggtgagactccgtctcaaaaattaaaataaaataaaataaaatgcatataatataactgttattgttgacccttcttgcctttactttgatacagctggagaagtcctgaaaatgtgtccaaattcattacaaggtgaagatcaatttaaagaactcctccacatttctcaaagtattatattaataatgaattatatcatttcttcaggacataaaggatttggggtgggaggagaagggaaaggaaggaagtggaaacgagattttcatcatcttccctaagccattgctggtcatcctagagtagaaatctgagagtttcactttattgcttaaaatcctttaatattatagtttcccaaagcttatggaagtgaatccagacactgctcattgtctgcactacatctaccaagcaggctcatgaggcagcacaaggggtgcacacaaacatgggctgactttgcaagaccttggataagttacttaatctccctgcctcggtctgctcaacagtaaaatgaaggtaattatactaccaatatagttactatagggaattaatacattaaaacataaaaaacacttaaaagaggacgttgcctaagtgctcaataaatgtcagctatcatcatcatctgccattgcatctctcataacccagactatttcaagccattatgaactactggaattttcaaactcaccaacactgttttatgcttttgcaccttagaaaagggactttctctgtctggaatggccttccttcacttctctctcaattatccttctcaacttccttatatagccttctctgatttcccttttacttaccgcatccctcatagacacacctacagagaatatttaaattatttattatttgcctctcccacaaaattgtatgcttgataataatacttgatacttattgtgtcaagtactgtgtgccagccactgttttatattaagcactttacttagactatctaacttaaacttcttaataactcataattatcctagttttattgacagtaaaatctataacatatataaataaagaataagaattcaaaccttagctgtttggctgcaatttgttacaatctaaaatctaaggactaggaggtggagatttctgacatgctgaaaatatcaaggaagcaattaaaccttccagcagttagcataagtgcacacagtttaaaaatttataatatatatgcatggtactgtaggtgggctaccccacacccccagtcatatcagcttcttgcttatactttctggagatatttcatgcatatacagcatgcacacacatatatgtacatctctttgttacacaaatagtagtatacttcatatagccttctgagcccatttttacttcctgtatctttgagattgttccgtgtcagtccatacaaagtgcctcattctttttcactgctgcagagaattccaccatattccataataatatggtttggacttgtgtccccacccaaatctcatgtcaaattgtaatccccagtgttggaggtggggcccggtgggaggtgattggatcacggggcggtttctcatgaatggtttagcaccatcccctcggtgcgaagttcccatgagatctggtcgtttaaattgtatagcaccttccgcctctcttcctcctactccagccatgtgaagatgcctgctccagctctgccttccaccgtgagtaaaagctccctgaggcctccccagccttgcttcctgtacagcctgcagtactgtgagctaactaaacctctttcctttataaattgcccagtcttcagtatttatagcaatgcaagaacagactattatatttaccatattcaaccactctcctatattgtttgtagccttttgttgtaatataaaatcctaaagcaaaatccttatacacaaagaaatggatagaggatgattctacagtaaatatggtaaatgtatacgctatagcaaatatagtaaaatgcaactgtagaatctaaacggtgagtgcaggggtgctctcactatcataattcctgcaattgttctgcatttaaaccatcagtttgtttgtttgtttgtttgtttgtttgttttttggagacagagtcttgctctgttgcccaggctggagtgcagtggcacaatcttggctcactgcaaggtccgcctcctgggttcatgccattctcctgcctcagcctcttgagtagctgggactacaggcgcccgccaccacgcctggctaattttttgtattttttagtagagacggggtttcaccgtcttaaccaggatggtctcaatctcctgacctcgtgatccacccacctcggcctcccaaagtgcttggattacaggtgtgagccaccgcgcccggcctatacttgttcttaaagtgagcatcatgtttttctttcaacttctcaataaattgctaatatgaaatattttatcaacttcaaaacaatccccaaatttcaaaaatataataatcttggaatgtttgttacccttggcttatatcatagaagaacagaggaggcaattatcagaagagtcacatttcaacttccatcattttacccaagggacagtcaagtaaagtaaaactgccctaagtgtcttattttcttgggtctctcaacactcttttaggcaaacacttggtcttcaccaagaacaaagagttataggtgtctgttacctctaggagaagcaagggggaaaaaaaaaaaaaaaaaaaaaaaactaaaacctttggagagtcattgtttgacatcttccttctcagcttccttcttatataattcccaggagtcctagccaataaagaatggtttaactcttctttctgaaaaaaacaaatgattatctttctttagaaaatgtattcctctttcctctgaagactcagaagcagacctttcaggagaatttctggattagagtgtgccatttcagccaagggacttcctctaccagggtccaaagataacacattctaatgaatgcttgctggactgtttcctttttttttctgacaatttgaaggtcttcaatgaaagcatgccagtattaccacagacttatcttagggcagtgctttggtaaaccaaattcagaagctttagaaaagactagaaactaataagtcagctatacatccacttagagtttgccagacagagaaaaaggaaaataacattccagtcacaaagaataaatcacagagggctttaaggcttaattgccacgttttccctccaaaagaatcaaaagtttatcacacttgtttcctaaatctccaaaaatgtgagttattgagagaagagtcatacaatttttaggaatttccatttcttccgttgtcgaacctttgaaaaacaattgcaagttgaagagaactcacatgacccagaaactgttctgagctctatcaatgttcaggaagcagaattttttttttttttaactttttaaactctttttgtagagacaggatttccctatgttgcctaggctggtctccaactcctgggctcaagtgatcctcctgccttggcctcccaaagtgctaagataacaggtgtgagccaccacacgtggctggaaaaaaatgttttcatccagagagtaaaactcaatgaagtggcacagcacgcagtacatttcaactttcccctcttaaagatttcagcctacacactccaatttcacactcaatgaaagcttaagcaaaatgttagcataaatcaaagttttaaatcattttagattgttaactagcaaatgtcctgcagaaattttaaaactcactaaataaattataaatctagttatgagaacaaagcacactgtggaatataaggatgcagaataaacagctattcagaaagtgtgtccaatttttgtcccacccctaagtcaagaggcaaaccatgaccccgctgtgggactgggctgtcaagcactctccctcctctgctaacgctgttgcctctgttcagaagaccttccctgccctctcttcacggggcaaacctacacctctcctccaagatccagctgagcctttacctcctctgtggcccctgatcagaatccccaaggcagaagtttttggagctttattcgtgcctttcttttgttgttgttctttttttttatttttttgagatggagtctcgctctgtcactcaggctggagtgcagtggtgtgaacttggctcactgcaacctctgcctccctggttcaagtgattctcctgggctggtctcaaactcctgacctcaaacaatcctcctgcctcagcctcccaaagtgctgggattacaggcatgagccaccacacccagcctattcacgcctttctgacacctaccactcactataacacacttaacaagcctcttcccattccccacccctcaaggcagagcctgcagccctggtcatcctctatccctgacacccaccacattgcccagcagacaacagcacagtcagtagtcccatttactaaggacttacgtgccagacactatgctcagtgctttatataatatcaactcatttcaccttcacaaaaaccatatgaataatataataataaactatagtatccctccaatcagtcttccccagcctccttaggaggttccttttcatgtgaacaggctgtaacctacaggactctatcctgaccatactgtcatcttgttcctcacactcttcctgggcaatctccaatccaggtctttggagctcattccaaacccatataggacaggcacttggatatctgagtgttctgcacttaaaattggtcatgtcccaaactctgtccatctctctccccaaatatgctctctctttatgattctaacagaacactctatgtccagtcatagcctaagtccaatcaggagaaagaaactacatggtaatttgaacaagggaagataaaaaatcattaactataacaaaagattaatgagaagttggcaaataagaccttgaaagaacacagcaatagctgacataaaatatagtagcaaatataatattatgtaacacaacatataattgccaccacccttaaggctgagacagagcacccaagaaagagttcccccaactctagggctgagatccagaccttgctggagggggctcatacctgacagaacttcaggcaatccactctgtgaaatttgccagaaatcagtcctctagaatgccaaggaaagttgtttgtgggagagtgtctcagtggacgtactctgctacctgggcagcaggagagctgctggtcactaagagctgcaaatgcctgagcactgaagaaacaccatgtgccacactggcctctcttggaaccagcaagtaaatctctttcctcctcaatgtctctccagcaccctctactgacaaaactaaacatcgtgccagctggcggaggaaaagcaaaaggcccagattcattttcacagagcaagcaatgaaggacatacttcgaggtgagaagcaataaatcaataactgacacaagcacacaatcatctatcagttgtctaagcccaaaacctagaggcatccttgatttttcctccagtcatcaagtcccacaggtcctaccttctaagtatttattgaatccatctacttcactccatccacttcactccattatgattaatgttaataatactgatatattaattaattatattatataataaataatatattattgttaataatagtgttaatccccccgtccagttttacttgcttgctttttttattctgttttgcctctgggccactgcacatgggtttcctctgcccagaacagccttccttctttcccctattgccatatccactttttggttagctgattcttcatcattcttcagctctcaactctcttgctccaagttacttgcccctgctaagtacacccaaaagaatcctcttcttccccactaagaacacttaccacacattattgtacaatcacatgttgcttaacaatggatatatgttcatccttgtgtgaacatgatagagtgtagttacacaagcctagatgataccctatagcctactgctcctagactacaaaactgtatagcatgttacagcactgaatactgtaaacaactgtaacacaatggtacatctgtctagggcacttaccccatgaatggagctcactggaagttgctctgggtgagtcagtgagtcagtggtgagtaaatgtgaaggcctaggacattactatacaccactgtgaactttataaacactgtgtgcttaggttacactaaattcctcttttaaatattattttttcttcaataacaaatcagccttagtttactgtaacttttttactttataaaccatttttaaaactttttgactcttaacaactcagcttaaaacacaacacgaatacattgtgcagctctacaaagatattttatttgtataatcttattttataagctttattctatttttaaattttttaacttttttaatgtttttgttgaaaactaacacacacacattagcctaggcatacacagggtgaggatcatcactgctgctcttgcaccgccacatgttggaccaatggaaggtctccagggtcaataacatacatggagctgtcatctcctacaataacaatgccttcttctggaatacctcttccagaatagctggaggctattttacagtgaattattttatatgtaagtagaggacgtacactctaaaataatgataaaaagtacactatagtaaatacataaaccagtaaaacaatcatttataatcactatcaagtattacgtactgtccacgattgaatgtgctatatttcatataaccggcagcatattaggtctgcttacaccagcatcaccacacacatgagtaatatactgggctacaaccttataccacatacaatgtaactaagcaacaggaaattttcgcctccattataatctcatggaaccactgtcatatatttggtgtggtccaccattgcccagaatttctttacacagcacatgaccataattccttattaactaactctcatcattcatacttttacctctatgaaggcaagaaaaatttcttcatcactgaatcccaaagagttagcaagatgtctagaacaaagcagacactcagtatcagctcagttaatggatgttgaatgaaggggggtgacatggttaggcattgtgtccccacccaaatctcatcttgaattgtaaaccccataatcctcataatccccacatgtcaagagagagaccaggtggaggtaactgaatcgtggagccggtttctcccatgctgttctcgtgatggtcagtgagttctcataagatccgatctgatggttttataagaagctcttccccacttcgctcagcactcactctgtcctgccaccctgtgaagaagatgccttgctttcccttcaccttccaccatgattgtaagtttcctggggcctccccagcattgtggaactgtgagtcaattaaacctatttcctttataaattacccagtcttagacagttctttatagcagcaagaacagactaatataaggggaagcattttatgaagcaaataacaacttaaaaggagaaaattttggctttgagattatatctgatatgttgatcagtgtacatgcaataaaattattacacatatataactctaaggataaggagacaatgcctttgtctcatgcctaacaattaagatacagtaaaatataaagtctattcctcaaaagaaaaagaactaattcaaccagctggcaatatgaatttatatgatttcagtatattgtatgcagatgaggaaaaagactgttagttttcaaggtgaacagtgccatcccagtgtagtatgtatatatcaaaggattctgtttatttacacccaataatgaaaatcaaatattacaacatgacattccattgcacaccatgcttctatggtagaaaatcaatacatcctatttgttttcagtaacttgtttacccaaccacagttctagagtcattatgcaatgcaaacagtcttctaaagcactctgacccatatgaaataaaaactaggtcctctctgacactcccaaagggaatatctctctggctaactccaggaatttgctcagggatatatggagcaaagattgtagagctgaatcggtatataaagttactctgacactctgggaggaaatttagccaaatccgtaatagtgagtagcaatctcatccactcaatggccaagggaaatatattcaggactagaactcacacaagccaaagcactaaaatacacaaagtacaaccaccagcagtgctggctcacacctgcgatcccagcgctttgggaggccgaggcaggcagatcactcaagcccaggagttcaagaccagcctaggcaacatggcaaaaccctgtctctacaaaacttacaaaaattagccaggcatgaaggctaaaattagccaggcatgatggttaaaaattagccaggcgtgatggggtatccctgtagtcccagctactcaagaggctgaggtgggaggatcacctgaacctgggaggttgaggctacactgagctgtgatcatgccactacattccagcctgggtgacagagtgagatcctgtctcaaaaaaaaaaaaaaaaaaagtataatcttgaagatttaagcttttttgttgttattgcttatttatatcattctcacagtctaaaggggggaaaaacttaggatacaaacagacgttatttcagcaactcaatcattgtttaatcctcgagacatattgtggacaactgtattatagaatttaaaagtgtgtgagtttattacacacttgtttaaaaaaagacataataagtatgcagtctattcgagctgggcacagtggctcacacctataatcccagcactttgggaggctaacatgggaagactgcttgaggccaggagtttgagaccaacctgggcaacaaggcaagaccccatctctacaaaaaaattttaaaaattagccaggtacaggggcgcgtgcctgtagtcctatcttcttttttttgagacaaagtctcactctgtcatccaggctggaatgcagtagtagaatttgggcttactgaaaccactgcctcccaggctcaagcaatcctcccacctcagcctcccgagtagctgggactacaggctaatttttttttttttttttttttagtagagacggggtttcaccatgttggccaggctggtcccaaactcctggccccaaggaatcctcggcctcccaaagtgctgggattacaggcgtgaaccaccgcacccagccacacttggccatttttaaactatttttattccaactgatatatatttcatcttctataacatgtctcagtatagacatgcatagtctgatcaagaaaatcttgtcaataaaatgaaacttaacaagggccttggggatattctctctaccaagactgatctttcctttacttctacagggctcagtccctcacttatttgctaaaatgtcacctttccccagttattctttaggcccaccatgaccacttactccctcagccaaatctcagcttgccatttcccctgtgcctgcttgacttttctccagagcacttttcaccatcaaatctttacttatttgtatattactgtctgttttctcccactagaatattttctccatgaattaaggaatatttgggtttgtttcacttgctgctgcttcctcagcacttagaactgtgtgttgaagcacagtaggtgctcaataaatagtggttgaatgaaagaaaatagacagtcccagaaattaatcttaatactgatgctgtgaaatgaaaagctctcaaagtgggagtggacatacttttaagagatgattccctttcatttaacttaaagcccaaaggacttttcaaaatgaaattgttattccaactacacccaaaaatcattaaggctgcccctgggtgctcacgtacgttttaacaaaaagcaaggaattctatgtcctgctaaagcaatggaaaaccctgatgtagaaaatgtaaactgcttaagttccatatgtgggtagtaacgatttacaccacaccacttataacattatgagggtcacactaaccacagggagaattccgtttcacctttgtttttccacatacatgccctctaataatacaactcttcacaaacactgtattagctgcattcttaaacacgcctactatctaaaacatacacagcaatgtaactgatgggtacattctcaatcaggtaattttgatagaaaaagtataccaaccagtgtgccatttggccattaaaacaataggaaagacagaactgatctaaatagctcataatatggtctaaaagagatgaccttcaaactttagcgataaaataagaaaacacagaaatagaggtgttaatcagttaacagaagtcagtaagctaaaacgtacaaagttctacactgcattttgtggtaagagacaaataaaatatatgttccccatacaaaaagacttcttaaatctattaagatggaataaatagtatgtacaggataatggagacaaatgcccatagtctaaaatggaaaacttcaaaatcacctagacccaagaaaacaaaaatcacatattaggacaatttgattttcccatgacatacgtggcgctgtagatgcagtttatcctacctccagtcaagtgggtccatgaatagaaactctcaggtataaaccactcctctaccacttcaccccagggcattctagtgacttccatggtgatttggtttggctgtatcctcacccaaatctcatcttgaattgtaatcctcataatccccacgtgtctagggagaggcctggcaggaggtgattggatcacagggcagtttcccccatgatgttctagagatggtgagtgctcaggagatctgagggatttataaggggctcttcctcctttgctcctcactcgctcgtgccaccttgtgaaggtgcctgctttgccttttgccatgattgtaagtttcctgaggcctctccagctacatagaattgggagtcaattaaacctcttttctttataaattaaacaggctcaggtatttctttatagcagtgcaaagacagactaatacacatggttacgtttctctcaactactgacacttggcatgtccagctattataatttcatttctatctcccaaatgttttccatctgtcccattccattccagaccaccgttggcctaggttcagctgtcatgatcgcctggctaaactgcaaaaggaggtgcgatgacattatactcctgcttaaaacttctacaggattccacggttcactgaatgaagtctaaactccttaatactctaatatacggattggacctctgtcctcagccccttctcttccaggcttgaacctccatgtcttggcatacatacttttccaccccctaacatatattccctttcttttctgttttaaaacatctttcttactggtcgtgaacggtggctcacaccggtaatactagcactttgggaggctgtggtaggagaatcgcttgagcccaggaattcaagaccagcctaggcaacacaggcagatcttatctttacaaaaattaaaaattagccaagcatggcagcacatgcctgtggtcccagctactcgagaggctgaagcaggattgcttgaacccaggaagttgaggctgcaatgagccatgatcctgccactgcactgcagcctgggctgctgagcaagagcctatctcaaaacaaaaccaaataaaattcctcttacttttgaaaggcccagtttaaatgtaacctctgtgaaaatttctttgatcctcacaatcagaattatttgttgccttcagggtattgccaaagtactctgtttatatctctgttcaaagagattgtatctatgttaacgtaaatcatagtctgatgatagcttttgtctgtttaacaaagcaccctccttactgactttactctagggaactaccacttcatatggggacctaataacatgtagtttgggtggatccagggttgctcaccatactaaatcctcctggccaccatgacttgttcaagaatggacccatgtctcagtaagaaccactgagaaccctccccataacttctgctagaaccaccagaagaagaaaaaaaatacaaagcctattttataataaatttgaatatctcatgtaacttattgaatacagaaagtgaaaaacaaaatggttatatggtactcaaagtatggtttctattgactgtgtatcatttttgcaccatcataaacttacaaaattctaagtcaaagaatcataagtcagagactatactgacatacgagtcatgatcgtggtctgacttacattacaattaattgtactcagggccaaagaaacagttataagaggacacctggcagataagagaaacagcaagaaggcctgtgtggctggggcaagcaagtgtgggagcgtgtatgggggggaagtgagagagaaggagggcaggcaggggagggaggggagagagaagagagatgggggaacaaaaaagagagagagagagagagagagaaagggagagggagagagagacagagccagacagacagacaccccaagatggcattgtgaaaggtcaagctattgcaaagtcccaagcagaagagggacaggatctgacttaactttcttttttgttttttgagacggagtctcgctctgtcgcccaggctggagcgatcttggctcactgcaagctccgcctcccgggtccacgccattctcctgcctcagcctcccgagtagctgggactacaggggcccaccaccacacccagctaattttttgtatttttagtagagacagggtttcaccatgttaacctggatggtctcgatctcctgacctcgtgatctgaccacctcggcctcccaaagtgctgggattacaggcatgagccaccgcgcccagccctgacttaacttttaaaaggatccttaggcttgctgtgttgtgaaaacaaatggcatgggggtgggcatggaagtgggaggtgggcagggagaacaagacctgttaagaacctgctagggtaaccaggccagaggtgatgaaggctcaaagaaagttttgtccaatttttttttttaaacaccctaattttttttgctaccaattacaactttggaaagacagataaatcaacacatgatattcatacttgatttactgagtatctactatatttaagacactctaaatattaccttatctagttacagaactatcttcctaaactcaaagcccatatgcaaacggtgaactggaattctctaactaaatatcccatacacattttacccccaaaacctaatcctcctttactctctaatctcattatctcattaatattatttcctagcctagttgttactaaagataataagagagtaggtatatttgagacagagctttgctctgtcgcccgcgctggagtacaatggcacaatctcagctcactgccgagaactccgcctcccgggttcaagtaattctcctgcctcagcctcccgagtagctaggattacaggtgcatgccaccacacccagctaatttttgtatttattttagtagagatggggtttcaccatgttggctagcctggtctcgaactcctgacctcaagtgatccgcccacctcagcctcccaaagtgctgggattacaagcgtgagccaccacgcccggccataactttctatattacttaagtagttgtatacaactacacataatttcgtctaaagttcaagacaattctgggagagaaacacccttatttacctctaccattttacagataacgaaactaagctcagaaaaatgcagtaacttgccagaagttattatgctggtaaatagtggagctgagactcaaacgtgggattctaactcatccacaatcacttcagtcagaaacgtgggaattatcttagactcttctctcagccccacgccagatgccctctgtcattcactctcacaccatcactatcttagttcagagcttcccatctctaaactcagttaccacaataggctcacaggttacgttgctgtatcttgcataaccctccccttccatccattctccatactattatcagatactctcttcagttccaaacacaagctttgtgctccaacgcaagtatatggttaggaaacctacagatcatggaaacagagccaaaagtgtcaagagctttcttcatcagtatgcatgcattaattccagcaccagcaacttaccaagcaatttttggcagcatcccaacttcaagattctcattaatatcgccaagtacgaaaaacctggtgattgctcaatttctccttttgtctttcttcccagccccaaaggtgtggactttaagcatttcaaggacctcatcagacctagtcccaccttcctaaattactcttttcttatccaatcaaaactgccattcctagaaggcccaaataggtcttaagtgttcataatgaggtatcagaacatacatattttaaaaagaggagctaattaaataagtgggtctctattctggtatttcataggcatgggggacagtgatgatggtaataatggctaacatttatcaagatctcggtaagctgtgtgtcaggtactgttttacttgctttacaagcatttaattatctgttcctttaatcatcagaactactccatgaagtgggtataattattattattatcacaatttttggataaagaattgaagagctggaggagttaagtaacatgtccaaggtcacccaatcagtaagaggtgccagcgctcctaaccacctcatgctaacaacttcactataatggtagactccaatagagatatgtgaaggagatcattgtgagcttattcattcattcttaaaatatttcttgggagtttattatattctgagaattattcctgccactgggaatttaattgtagataatgcttttatggaactcacaagaaaggcaccaaaaaatacataagtaaaaatgaaaacaacacaattttgctctggaaaaaaaaaaaaggataaggtgatgtagagtaatgcgctactttagactggaagccagggagggcctccctaaggaataatattgaaatgcgatctaaattataagatgaagcaaagaaaaaaacctgatggaaccgcactgaggcaattatgatgaatgcaatacacctaggtaagagttagtttgttagttcctaaaacaacagaaaggacaggaggccattgtgactgatgctaagggagcaagtggagagtggtcagagttatatcagagactcagaagtatcaactatgctggcacacagccatggaggaaaaaaaatctgtattttactcccagcagaatgagaatctggagggttttaaggaagagaacgaggtgatctatgtttctgaaaaagcaattccactcctccaactctgtgtaaagaatgaactacaggccaggcgcagtggctcacaccagtaattccagcactttgggaggccaaggcgagtgggtaacttgaggccaagagttcgagaccaagctggcccacacagcgaaacctcatctctactaaaaatacaaaaattaaccaggcgtggtggcgggcacctgtaatctcagctacccgggaggctaagacatgagaatcgcttgaatgcagaggccgaggttacagtgagccaagattatgccactgtactccagcctgggtgacagaacaagcctctgtctcaaaaaaaaaaaaaaaaaaagaatggattatagagtgatgaaagtggaagactggagaggaattaggagactgttacttctagaaccatgcctggcacgtagtcagtagtcaatgtgttcaataaatgaatgcttcaatatcaaggtaacggaagatgagggctaagacttgggtggtaaagtgctacatgtagaaaccattctgcctcattcaacatctgtgagtgtcacaaacccagtagtcttttaaaaaccagtagcctctttttccggctggaaccatggagggtgttgaagagaagaaggtggttcctgctgtgccagaaacccttaagaaaaagcaaaggaatttcacagagctgaagatcaagctcctgagaaagaagtctgcccaaaacatgctttgaaaggcaaggaagaagcttatttatgaaaaagcaaagcactatcacaaggaatataggcagatgtacagaactgaaattcgaatggcaaggatggcaagaaaagctggcaacttctgtgtacctgcagaacccaaattggcctttgtcatcaggaccagaggtatcaatggtgtgagcccagaggtctgaaaggtgttgcagcttcttcgcctttatcaaatcttcagtggaacctttgtgaagctcaacaaggcttcaattaacatgctgaggattgtagagccatatattacatgggggaacccaaatctgaagtcagtaaatgaactaatctacaagcatagttatggcaaaatcaataagcaaattgctttgacagataacgctttgattgctctatctcttggtaaatatggcatcatctgcatggaggatctgattcatgagatctaaactattggaaaatgcttcaaggaagcaaataacttcctgtggcccttcaaattatcttctccatgaggcggaatgaagaaaaccttgactatctacaatataagctgctccaaagtgcttgaaacatctgagcacacttcccaaaacaggtagtgttctgttgcccatcatgacaatctctcaataactctgaaacatacttattcaagcagcccccatttacaaacatccaccaaccctacctctgccagccctgctactggaaaaaacacttaggacatgccagggattatgccaagcactttgcatctagtctctcatttgctccttactacactctatgagtctaatatctccaaataaatagcaatctatagtaacaaaggcaatattcttataagaatcatgtttttaatacctggcacctatgggaaaacctctctgatggaagaatttaagagaagggtggaagggagcaaattccatttcttccagagtgactaaactacaccgaagtcaaacttatgctacccagttagttttgctctgatgatcctctctgcactgacaggtgaaagcacatgcagaacatgcatggcttattattctgaaaagtccaaaatactgcgcttattcctatagcaactcggaggctaaacagagacccagtgttaacttcatacagacgtcctcagagaagcccttcctttgcagttttatgttctttataattataccaaacctttagctcagaatccctttcactttaaaaaaaaaaaaaaaagaacttacattatcatctagttatatatgcaaggcaccaaagaaacaacaacaacaaagtaaatatggaaaaagacttgattctaagaagtcataatagaattttcagcacttgactgtagtacgggaactgtccccaaataactgttttaagattgcaaaaaaaaaaaaaaaagatcaattcaatataataatagttaaaacttaacacagctctttatgtggcaggcactaatctagaataacccatttaaccttcataacggccattcaagggccactattattatccccattttacagacagcaaaaagacacagaggctaagtaacttgccagtgaagtggtagggacaggatttgccttgcgtgtctgtgttcttatacaccacatgctgctactcttcaaatggaaaaaaaaaaattcactatcacccagaaggcgatcatacgatgatgaattttgactttgctttttatttctaatccttcatcataaaagaaacacttcctttgcagtttcatattcttgtactaaagcatagctcaggaacattttcatttaaaaaaagaaaaaaaatactcccagtatcatctagtagttataagagatacggaaggcattaaactacattattcctataatccttacaagagaaattcaggttcagagaagagactatcaaaatgataaacaatagtgaagtggtaattcagaaaagttcatgtttaagtttcatcttaatctttatctcattgagggacatattttaaaagtaagaacactgacaaactgagagataacgtaacttgtactcatcgtaaggctgtagataaaaacaaggtttcttaaaaccttgtgagtttcttttcctatgctacagcagatgtttcaagaaatgaagctattgcctttgtaggaaactgatatgatcaaaagaaattaaaggaaacttaccagagacagtttgtgttggaaataatttgaagtgccaaactttaaaccatttcataatttttaaattttgttttcatagatattacattacaaagaaaaattttccagaaatattttaatcaaagttctatttaaagaaacttttgattagacattattaaattgtgtattgttttaaaacaataataataatctgtcctgagctattagaaagaaatgtatagcatgttattttaataggcctaaatgaggaaggatcaatattattttaatttttaaaggtctgtttatgaaatgcaatcatccttcattaaaaatgcaagctgtgcttcagcaagaggttagcataaatgattcacagagagatctctctccagtataatcttcctctcctgggagtttccttcggatgtttcatcaaaccactcaagctactattaaaaatgcttccctgcgataaaaggagggaataaacaatataaacacacttccccattcccattcaccaatgactcttccatttgagtgatctatacctttttcagtcataggtaaaattaattttttatattccacgcatttttgcaatcgtttcttttctcaagcattttaagttaacgttattttacagtattcaaaatcagaaattcagatttttaaggtaggtttttaatcacttacctattttgacatttcagtgtgagtcttgtctttcattgaaattaaaagaagtttgccttctatttgacggattttaaaagattttaaaatgtcaactcatcaaagtcaagacactccaaatttaaattcaattctcttctatttaaaaatgctaatgaaaatggctgtttcaatgcagcagcatctggctcattataacactcagttttaactaataaatccttaattattaaattctggtgttcaatttctttcagataaataagccaaacacatactgctacaattataaatacctgggataaattacttataccatgaaaaagcatacctcttgattctctggctgctaaataagacccaaagtatgtaaaggacacacatttgaaagacccagcattaaacatttgggctccactgtatgtaggtcccacattcataggctggcaaatctttaactctactgggtcctcatgcataatgcacagggcaatttgtctgtttgtgcaaatgggccagtttttttccatgctttttcagatgtgtcaaatgtgtcaaaactgaacataatcatatacccctaattctggctttacaaagcagaccctaccttcacccagcttgatgtttttattaaggagttactgaatatatttaatcaaggtattactgcacatcatgatgtcttgtaaaggttgaaatccctgagagaatatgtttggttttaagccctaatatgtgttagggagtgtttcatttttctctcccactcccaattcctttttttttttttctccttttttaatcagcagcatcgacagtactgactgaatattttacaatggagttgcagagtatgtgtgttcaatcgtttcagcttcccagaagattcattacagttacattagaaagtcaaatcaggcaattctgcagtctggtgaaagccagcatatgaaagaaggttaatacaaaagaatttcattttagaggacatttaggactttaaaaagcaacattatgataaaattttcaagatatttgttcttgccttagcacatgctttccaggtctaatttcagagctgtctcaatgcttttctaggaaagaatgagggtgtatgggaggaaattgtttgatctacaaggtctgccatcttaatgatcctcatgctaagaacactgcagatgtatgttttgccctcactcatggggaaagaatctatggttctccaattatgctgatgaagtagaagtcaagtaaaagtgaaggtgcgttcatttaaaacataaagattttcagtgactgttaacatctgtctttctgattataaataaaactaactgctgagattttcagatcttaatatgtatttatataacaaaaaccagtaagttaattgttttccatgattagtagcaggtatagaaagatcttcttcagattggtacatgtttaactggcacttgtgtataatatagtaattcccctctttctagaattcaagcctcaataaacccctaactaatcttatgtatttatttccactggtttataggtaagcaaaaataagaatagactatctactgaaaggcaagccttgtcattcagtacagtcgatttacagaatacaaattccaattcaatacaaaggctcacctttgcatgagcaattccaaagcttaaataccatggcaagagggaaacagcagctagcagtggtaacagacataaaaggcggctgactgtcttcagtgctacctttggcagcagtacagatggactttgtaggccactggctatgcttaatttaatatgaagctaaatacagtcaaaacatctggtgcaccactgatggttatcatgataaattaaatctggcatcacacacaaatccattcaatattctgtttatatcccttttacctaaaccacaaaactaaaaatccacatttacttttgtttttcatttcctcttagcagtcctgtattttagaaaaggaacgttttgtagatctgttgtttatacaagttggggggccttctttaagaaaaagaccacgaaaatttgtatacaaaatgtcaagagggccactcaagtgagggtctctttggtttaagcttcatggacaatccacctctggggaggttgaaaggcagtgtaaaaactaaatagtatgccaagtagcacatggaactgggacaaagaatacaaaaatttttaaagcagacaatttaactgacaagctacagaagagcaaacaagactttctaggcaagcaaatcggcaaaaacaaactgtattgtcagaatctgtttttaacatatatttctaaaatgcaaaaccccaaattgggccaggtgcagtggctcacacctataaatccagcactttgggaggccaaggcaagagaatcacttgagcccaggagtttgagaccagcccgggcaatatagtgagactccgtctccacaaaaaataaaaattaaattaaattgaaattttaaaaccccaaatctacagcatactaccacaacaaaagggctattataaaggaaaaaagtcaattaaagaaccaaattatcagtcaagtgtggtggctatagctgtaatcccagcactttgagaggccaatgcagagggattgtttgagcctagaagttcaagaccagcttgggcaacatagcgagaccccatctccactaaacatttttaaaaatttaaaaataaagtaaaaaataatcaaattgtcaattttataataactataggtcaagaaacaagtataattcttacaagcaactaattcacaaaacaattagatcatggctaaccatttgttatttttaaaaagtcagagcaccacttataactaaagtgactactgcctgaactgcaatattcaaattattgcatttttattacattgctttgaaggatattcagtgaagataattattaattctagtgctatataatattagcatcacccacactcttttaaacaaaaaggacctaaaagcctcgactctgcatctgaagggaggagagcatgccatataataaattcagtacaatcaaaatgagaaccatatttctgtttaactttatgcatcttggctcaagagccataaaaaaaaagttattaaaattaatgcatcaaactataattctgtcctttttattactggtaatattctttctaaaatattagtctgctttgctgtactactatatctttttgaaagttttctttgaagatcaggatcactttaactttagaatgaaaacatgcaattatattaatttggcactgaatcttgttagtttcagtgggtttgaaactttgaaaatgatttattcattagaaagccacatgttggccagacatggtggctcacacctgtaatcccagcactttgggaggctgaggtaggtggatcacctgacgtcaggagtttgacaccagcctgaccaacatggtgaaaccctgtctctactaaatacaaaaaattagtcaggcatggtagtgcatgcctgtaatcccagctacttgggaggtgaggcaggagaatcacttgaacccaggaggtggaggtggcattgagccgagattgtgccattgcactccaacctgggcaacaagagcaaaactccatctcaaaaaaaaaaaaaaaaaaaaagcaaaccagttactgcttctgatggcactcataaagatggaagataatgaagctacttgtcattcaacacaaaacacacaaagaaagtgttaacagctggcaaatgtcacaaagtaaacattttcctatttctgttaaataaaattcattcctaataatcactgtcctgtatgaactttccctagcaaattactgccccatttctttcactaaataatcaattttttctaaagttaacacaaaagaaataccctggaaatcctcattctctagtcatgactaaatgaatgaaccacatgggctaccaaaatcaaattctctactgcatcactaatgtaatactaaataggatgctccatcaaaagagacctagaatttacataatttcccataaacttatcagaggaacaaatgtaagacaatgggaagaaaatcaagataagctcactgttgttgctggtttgtgtattcctgtctttctcaactcctcccacagctgatagaacattgtagttaagagagctggtagaaactacttcactaaaattatgtatttgaacatcagccttttttcattctagtcagccttttttcactctaaagtattaaattcaaccaaaaagccaaacattcaaagtctgttcaccaaaaacactcatcataaagatgtttatttactatccatataaggacgcaaaatggtattcctaacagccaatacacagaatcaacctaagtgtccatcaacagatgaatggataaagtcacatacatatgtatacacacacacacacatacatacacacacacacacacacatatatatgcaataggatactatgtgttctaagaaaattctgttacttgcaacaatatggatgaacctggaggatactatgttaagtgaaataagtcagacatagaaagacagatactgtatgatcccacgtatatgcagaatcctaaaacgtcaagttcaatttttttttttttagaaagaatctcgctctgtcacccaggctggagtgcagtggcatgatcccagctcactgcaacctccacctcccaggttcaagcaattctcctgcctgagtctctcgagtagctgggattacaggcctgcgccaccatgcccggcaaattttagtattttttagtagaggtgtttcaccatgttggccaggctggtctcgatctcctgacctcctgatccacccacccagccacccaaagtgctgggaacacacgtgtgagccaccgtgcctggccctcaatctttttttttttttttttttaaagaaacggggtttcactctgttgcccaagctggagtgcagcggcacaatcataactcactgtaacctcaaattcctgggtgcaagcaatcctcctgcctcagcctcctaagtagctgggactacaggtgtgcgccaccacacctagctaactttttatttttattttttgtagtgacgaggtctcgccaagctggtctcgaattcctaggatcaaggggtcctcctgcctcatcaaccttttttttgaagctgaagtagaagcaaagagtagaatggtggttaccaaaggctgagaggaggactggggaaatgtgagtcaaaggacataaaatttcagtgaggaggaataagttcaagagatcagctttataatatagtgactataattaataataatgtattatattactgaaaattgcaaagaagaatttaagtgtcctcaccacaaaaaaaaaaaatgtgaagtaatacatatactcattttagccattccacaatgtatatatatttcaaaccatcatggtatacacaataaatgtgtacaatttttgtcaatttaaaaaatgggattattctctcacctcaacattgaggtactaactaaaaagatatttcccaactactcagatgctgaagccggaggattgcttaagcccaggagttggagaccagcctgggcaacacagtgagactccatcttgaaaaaataaataaaaataaaaagatactgtgattgtcaaagaaaggaaagaggtattaagtcactgaaaggttatatttttcctttagaaaaatgaaaaattcctactttactgtcaactattacctcttctgacacattaactgtagaatccttttatatgagaaaattactaaatcggacactacatctcagaatctgctagaggtcacttggaaaagagcatcatcctttcaaaaggcaaggatgaagaattagaaagaaaaaggccagaagcacacaagtgaaacaagccagtgcacctgaggcctttgttggtccaatcaaactataggtcacaggtatttcaaaaaggggaataaaagacaactgcagttactttagaaaagggttaaattctccaaagtagacgcttcccaaaagaaaaaacagaacgaaaactgcaaaattctttcttctctcctttggagaatacggtttagcacagtttttaaaaaatcaaaatctcaagagatatgggtgccattcccatcccaataactaagtggctctgctaactgcaggttgtgtgaaactgtacacccactacgctcaattgcaaaacagccataaagaacttagaacactacacaagttcaacagacatgaagaaaaacactacaaaattcaaatgtgagggacaattttcctgccaatatacgtataactctaaattcttactctctctatacacacacacacacacacacacacacacacacacacacaatatgtcttgatgatcagagctattacactgtataaatctaattaaggtcagtttcctatatgggaaaaggaagatttatctgagaaataattcaaaataaattctccccaagtaaatagacctaggcctatcattagtttagtttagttttgttttgtttttttgagatggagtttcactcttgttgcccaggctggagtgcagtggcgtaatctcagctcactgcaacctctgcctcccgggttcaagcaattctcctgcctcagcctcctgagtagctgggattacaggtgcccgccaccgcgcccagctaattttttgtattttcagtagagacggggtttcatcatgttggccagactggtcttgaactcctgacctcaggtgatccgcccgcctcggcctcccaaagtgcagggattagaggcgtaagccactgcgcccagcccctaggcctgtaatagttaagacaatcatttatacatcatttatatcaatcaccacagtccacaaaagtcagccttagataagatgccaaaaatcggagatgaattaaaagaaagagtcctgggtcagtagtacagctttgttgcaagtatctgcagggacctggtagaggtgtgagagacacagttccttggtgtgaagggtgagaggtcacagggagggtagcaggaagcccaagaacaggtaactgaatttggacaggcttttgatattttaagcccatttccatggatttttgttgtgttttgaagatagggtctcgctctgtcacccaggatggtttcttaatatatttactataattattcccttggaatactaatattaatactaagttaaattctttgaaaatccagccagtgtcagttatgctaaatgaaaacaaaacactttgtacaattttatatttaaaaagagaagctctacactctaggattagaagcagtggagccagcaagactctcagggcaacattagctaccatttatggagcacttcttatgttccatgtgccaggctaaattattttcatacattatcccactaatgtataaacaaccctatcatttagctattatcagctccattatatagacaaggaaatggaggcacaaagacgttccataactctaacaggattacaggacagagaggtggcagaacaaggattcaaacccaatccttctgttctcaagctcagactcggaaccattatgctttaccgtcttaccaaaatgagaatcaaaatgaaagaacctcaaagagaaataaaaactcaaaggaagaatctgagttctttaaacaacaccagagcaatcctgtcctaaaactggaggattttcaggttttgcaatgtgacaaacttggaaaagatacatctgacactaaatcctttggcaattttattccacctcggggcttcaactaccccattctcagtatctccatcttaaccttgatgacttctcaagatattaaatatttccatctgcctaatgacaaaaatcactcatctcaataaaaagctgtatttattagcatcttcttcctcaaatcagtttgtcctcctgtgttcccaattttttaatggcacaggtgtaatgcaaattacctatgcttcacacctcccccacatgtaagactatatgccttgttctaacagttgccaaatccaactaattctacctctacaacgtctcccatctgtcatacctcttcatttcccctacagttagaaaggttagattctcggccgggcatggtggctcatgcctgtaatcccagcattttgggaggtcgaggcaggcagatcacctaaggtcaggagttcaagaccagcctgaccaacatggagaaactcccccgtctctactaaaaatacaaaaaaatagtcgggcgtggtggtgcatgcctgtaatcccagctactcggaaggctgaggcaggagactcacttaaacccaagaggcggaggttgcagtgagccaagatcacgccattgcactccagactgggcaacaagagtgaaactctgtctcaaaaaaaaggaaaagaaaaaagaaaggttagattctcattactttccacccagtcttcactctcttcctttcatgacatactagaaatagctatcctaaaacacaactctatcatgtcactcctttatcagaacaccttcaaaaaggctccattccccaccaatcaacccttcaagattcagaccaaatgcctccttctccaagcaaccttgtgtaatctccttcccctaaggagaggtcattgcttcctcctctgaacttcagcagtacctcacttgacccttaccaatttcagcctcctatcacaagtacctgtactgacatacaagcatcgtcaccctactggaagacaagcgccttaggagaaggttcaatgtctaattgaactgtgagtctcccacaaattctggtgaaaatatacttgcacacagtaggtacttaaatatttgacaaatgaatgaaaaaattacaaatcagctttctcggttataacacaagcttttcagcacaagaacttgtgcccatttacttaatttttttaaaacatacaaattgtgaagactaatcataatttccatgaaaccagccctttttggttcctagaatacccgagaaaggtgcttattttatttgaagacaaaaaaagtagcatcagttagctaggtcaggcaccatctaactctactattcactgaggccaggaacatttcctagggcctcagctttggtccttctggatgaagcctcagggggactttcctctgataatggactaaacgattcaagatgaccttaatgaccaccctgtttaaaacagcctccttatttctccaatacttcttctccaaacattgatgtttccaccataaggtcagctcctctttttcttccccttatggcaaggcttatggagaaactacaccacataaatgaagactaggagctcaaaattccagaatgacctgggaccatggaaaattagtattttgccttctacagtaaagtcacactcttgagcaaaggaggaaaaaaaaattatcacagtccctcaatcagcaaaaatctaggcatggaagactaaaagaagttagggtccagtaagcttaaaaaagaaaacagtgactcagaaatttcctatctgcaatatatagcaggtttagaggacgaaaatgaaaacagaagattatttctagacagcttgatggagaaagataatatttacctcagtaaagttacaaccataggaacaaatccagattctatttgtttttgtacaactctgcaaaaaatcatagggtgtaattcacttctcagttcagaaataagacgtccttaaaaaaataagtaagaggtacttcttgaaaactaaaagaaaaaaaatctactcccataatcaagagtttccatgcagtattaaaaatgatgtccagctgggcgcagtggctcacacctgtaatcccagcacttcgggagactgaggcgcatggatcatttgaaatcaggagtttgagaccagcctgaccaacataatgaaaccccgtctcaactaaaaacacaaaaaaatcagccagatgtggaggcgcacgcctgtaatcccagccactcaggaggctaaggcaggggaatcacttgaccctgggaggcagaggttgcagtgaggcaagatcgaaccactgcactccaacctgggcgacagagctagactccgtctcaaaaaacaaacaaacaaaaaacaagaccgggcacggtggctcatgcctgtaatcccagcactttgggaggccgaggcaggcggatcacgaggtcaggagatagagaccatcctggccaacatggtgaagccccatctctactaaaagtacaaaaattagccgggtgtggtggcatgcgcacctgtagtcccaactactcgggaggccgaggcaggagaatcacttgaacccagaaagcagaggttgcagtaagccgagatcacgccactgcactccagcctggcaacagatcaagactccgtctaaaaaaaaaaaaaaaaagtccctcctataattcaggaagtgaaggtgctagttgactgttatttattctcactcaaaaagctaactcaaggtcaagaagacctctgccaccagctgcagtgtaccaatcctaggaggctatttctcagaaccccatgcttcttatcaagatggttcccacgctgtcttccctttccctcatcactgcctcctccaggtcaaagaatatccccagggcaagttgcagctgctccttatgcactcagccctggcctcagagtacacatgggttttgcctcatctatgactcttgggggaagcttactatgcagagagcaactgcaatgtgtcgctctctataggatcccagccaggtgccttagtgccatcgggaaaatgagaggaaacaaggaacacacaaaaatcatgaaatactgcttcgggtactaactccaagacagaatttttttcttaagttaaatgtttaaaaacaaaaaaaagctacagtcatctatgtattcagtcatccagtcaatcccatgccaagtataatctctgttaactatgcttagtgtggtcagaaaggaagtctagataaacaatcacaacaacagagtgggctgaatgcaaacagccggggttcaaggaaggctccctgaagaaaattacctgtaaactgaagcaagcaagaggtgaccaggctaagaagaaaagaatgttcaccacacagccattactcagggacgtaattcacccagatttctatttttaaaagatcaaaggctccaaaaaagcaaagggccagtaagcacaagacagaggctcaacctcattagggaaatgcaaatcaaaactgtaagataccacttcacacccatcagaatggctacaatccaaaacccagatagtaagtattagtgctaatgtggaaaaactgcaaggttcatgcattgctagtaaaattgtaacatggtgtagccactttggaaaacagtttgtcagtttctcaaaatgttaaacagaggttccataccccccaaaaatttcactcttaggctttggaagtcaccccaagagaaatgcaaatacacatcctcacagaagtttgtacatgaacgttcacaacagcatttttttaacagccaaaaagtagaaccattcaaagtgtccatcaactagtgaataaataaaatgtggcatagccacacaatggactatgatttggcatttattgggaatgaagtacagatgttatgctaccacatgggtgaaccttgaaaacattatactaagtcaaagcagccagttacaaaagactacatgattcaattaacgtgaaatgtccagaataggcaaatccataaagacagaaagaagattaagggctgcttagggctgggggatgagtagaggaggaaatgaggagtaactgctcatggatacaggatttcttctgggcataattaaatgttctgaaattgcagtgatgattgcacaactctgtgaacacaaaaaacaattgaattgtacaatttaagtaggtaaattatatgatatgtgaattgtatctcaataaagctgttataaaaccaaacaaaaggccggatgcggtggctcatgtctgtaataccagcactttgggaggctgaggtggatggatcacccgaggtcaggagttcaaaaccagccaggtcaacctggtgaaaccccatctctactaaaaatacaaaattatgccaggcgaggtagctcatacctgtaatctcagcactttgggagaccgaggcaggcggatcacaaggtcaggagatcgagaccatcctggccaacatggtgaaaccccgtctctactaaaaatacaaaaattagtaggacatggtggcacgtgcctgcaatcccggctacccgggaggctgaggcaagagaatcgcttgaaccagggagtcggaggttgcagtgagtcaagatcgcaccactgcactccagcctggcgacagagcgagactccgtctcaaaaaaaaaaaaattagccgagtgtgctggtgcatgcctgtaatcctagctacttgggaggctgaggcaggagaatcacttgaacctgggaggcagaggttgcagtgagctgagattgcaacactgcactccagcctgggcaacaatgaaactgcatctcaaaacaacaacaacaaaaagaaaaaacaaacaaaagatcaaaaggactacagcagtgaagaacaaaatttctaattttgttagaaattagaggatttgaacatgccaactggtttggaatctataaagtaattcaagcaagagacagtggccaggtgcagtggctcacgcctataatccccgcacttgggaggccaaggctggcagaccacttgaggtcgggagttcaagaccagcctggccaacatggtgaaaccccatctctactaaaaatcaaaaaattagctggatgtagtggcacgcacctataatcccagctactcaggaggctgacgtgggagaatcacttgaacccaggaggtggaggttgcagtcagccaagagccaagattacaccactgccctccagcctaggcaacacagcaagactccattgcaaaaaaaaaaaaaaaaagaaaagaaaaaaaagagagagagagagacagtggcctgaactagcgtaatggattaggaagagataagagatacaggaaaaagaaacaatacttgattctatatagtggggagaagagaaggaatcaacacagcccagggttacttacttagaaaattgagtagcatttatcaaaacaggaaaacacagaaagacatgtttgggagcaggaaaattcacaatattgtgaaatttaattatatttacaaaagttatataaggacttagagaaggttttaagaaggttttgttttaaggttttgttggaagctttcttgggcatttatctaattttaaaatgcaatttaatgttagttatgtttataagtagaactggatatttaaacagaattcaacttgaattaatcaacatgtatcaaaaactgcattatttttcttttacctttatataaaatgtactgaattaatgaatagactaatatgatttataaactgaactcaaggctcaaggaaaattggactttaaactttttaacaataaattgactattcattttctacaccagaaactgtaagtagttgggtatcactggcatgtagcattactggttgaaaaccgagaagttctaatttgatggcttctattttctctggaaatgaggtcatcaattcaggaaatggaacggaaggatgggtggtatgagaaagtagaccaggaatccaaggtttgatacataattgaaataaaagcaatggaggccaggcacagtggctcatgcctgtaatcccaatactttaggagtctggggcaggacaattgcttgagccagaatttgagaccagcctgggcaacatggtgaaatctcatctctacaaaaagcaagtcaaaattagctgggtgatgtggtgcacatctgtattaatcccagctacttgggaggccaaggcaggaggatcacttgaaccagtaggtggaggctgcagtaaaccaagattgcaccactgcactccaacctgggctgcagagtgaggccttgtctcaaaaaaaaaaaaagagaaagaaaaaaaatgctgcttatcaaaaaggatgggatttctaaataaaaagctttctttattaaaaaaaattaaaaatagcctgtaatcccagcactttgggaggccaaggcaggcggatcacttgaaggtcaggagttcaacaccagcctggccaacatggtgaaacctcatctctactaaaaataaaaacaaaattagccaggcatggtggtgcacgcctgtagtcccagctacttgggaggctgaggcaggagaatcacttgaacctaggaggcggaggttgcagggagcagagatcacaccactgtactccagcctgggtgacagagcgaaactttgtctccaaatataatataataataaaataaaataaaaatgaataaataaaagtgatggagaaaagacgagctacgtggtggacagatacagaaggaccacttgaaatagtcacaggccatttggagtaaaaaggccatgacttcatgaggcatccattagctgaatgatgtctttttctttaaaattacttagtagcataatgactttcttccaaataatgtaaaaagaacgtgtttctggagtcttgattttcagctataccttaaagatagaaataactaagaggaaatttgatgtatgtacttacacaggaatactctgcactctaaatctaaccatggaaaaacattctttccaggaaagttgtataaaccacaatatccatttcagaagataatgaaagtatcattcattcattatactttaatatcatttctatgtcctttttctctaatccttaagtcagaattctagacgagtattgtccaacagaactgttgggaatgatggaaatatactgtatctgtgctggccaacacagcacccactggtcacatgtagccactgaacacttgaaatgcagctagtgtgactgaagaacttaactttaaattttatttaagttaatttaaatagtcatatgagggtagtgcctaccataaagaacagcacagtaaacttttctgttaaagaaaatgaagaaatttacaggccagttaggtgtccaagagtcctgtttacaacacaaaagatgtgaattcactcacttatgaatacatgtaacaacaccgacgcttgtccctgaagagcctttggttctattctcataatacaagagctctaaagtctcaaaaatgtgggtgtggactaggaggacaaaggaaatccatttcacaccccaagttccaagagaaaccgtgtacttagagaaggagttcatcatccttaggggaaaaatgttcatcagacaacttctagaggccagaggtcggcaaacggtggcccacaggccacatctggactgcaacctgtttttacaaataaattttataggaacacagacatactcatttgctgtaaaagcatgtatccatgctttggggctataagggtagaggtgagtagttgtgaccatctggcccacgcagcctaaaatgtttactacctcacatagtaaatcattgatttgagtaaatgttttttacccaatgatttgagtaaaaggagtaaaagactttgttttgaggggtaaactgctgctgtattttattattaggaaaaaagcaatttcaaggaaaaaacaaaaaacaaaaacaatcatatatagaagatttaaaatactgcacttccaatcccaatccacagtattccatcaaaaaatcactgacccaataaatgactgtccaagtacaaagtgataggcagatgcctaattcagaatgacaaccttaagacactgaattccgaaccatttttaaagttgtaaaactccaaaccactataaaggatgtaaaacacatcattttggtttgtttggagacagggtctcaatcgctcacccagggtgaggtgcagtggcacagtcatggctcactccagcttcaacctccaaggctcaagcgatcctcccatgtcagcctcccaagtacctgggactacaggctcatgctatcatgcccagctaactttattattttatttttgtagagatggggtctctgcccaggctggtctcgaactcctggactcaagcgatactcctgcctcagcctcccgaaatgctgggattacagacatgagtcaccacacccaggccacacgatttttttttattttttattttttgagatgaagtctcgctctgttgcccaggctggagtgcagtggcacaatctcagctcaccacaacctccatctcccaggtccaagcaattctcctgcctcagcctcccgagtagctgggattccgggcgcacaccactgcacctggctaattctttgtgtttttagttgagatggggtttcaccatgttggccagattggtcttgaactcccgacctcaggtaatccacccgcttcagcctcccaaagtgctgagataacaggcgtgagccaccgcgcccggccaacaccattaatttttaagtacactaatatattggaaattttctaaaacaaagcttgaaacaactatcaccaaaagttctgtaacacaaagagtcaataccactgaacacagtgttttcacctgtaacggagtaaacattctcatttcagaatattattgaaatagttaaggtattatcatgaggtacagtacctgacacagaatgggtacttatttaaaaaaaaatttttttttaaaaggatgactgtaaggggtcattccccatggattatggataattagggccttaccttctcaataatgcaaaactacattttcaatattgtagcatcactgaatgttttgtccaaaactagatttagagaaaatgtcacctactgattgagagcacagtctcgagaagcagactgcctcagtctacttatagccctactacgtactagctctgtcctcagtttcctcatctgcgaaataactatacttaacaatccatgaagaacaagggaagggtacagtgacgtagaacaacactgtggcaaactgtaagcactcaacaaaatgctgtattttaaaaacctatggctaatgtactgcccaaaattggtacaatcttttttagagggtaacttggcaatttctactaaaatctaaaatatgcctaacttttgaatcagtaactctatttttaggaattcatcctgtaaaaatattcacaggtttatgaaaagatattgacaaggatgttaactgcagcatcgttcataatagcaaataaccggaggcagtctaaacatctatcagttgaaaacaggccaaattataacactaacatgttttcttatggaatacctgtaattattaaaaaataaactatgtgtgcacctatttggggaaatgttcatgatttgtggttaagattaaaaagtgggtctcagtacagtatgtagaataaaatcttatttctattaattaaaaaaagacagaaaataactacagcagtcagaatccactaaggagatgcaacaacccacctgctggggggggaaaatgtaatgaaaaagaaaatgcatatagcataaatgttttttagagaaaaaacatggaactcctctaacagctatcattttggagattagaactattagaaactgggccgggcgtggtggctcacacctaatctcagaattttgggaggccgaggcgggtggatcacttgaggtcaggagttcgagtccagcctggccaacatgacaaaaccccatctctactaaaaatacaaaaaaattagccagacgtgatggcgcacacctgaggtcccagatactccggaggctgaggcaggagaatcgcttgaacccaggaggcagaggttgcagtgagctgagattgcgccactacactccagcctgggtgacagagagaaacttgtttcaaaaaaaaaaaaaaaactattaggaacttctatttgctaaatatttttttgcattatgtaaagtttataattagcatatactaattttacaatcagaaaaaagatgggccgggcatggtggctcacgcctgtaatcccagcactgtgggaggccaaggcaggcagatcacgaggtcaggagatagaggccatcctggctaacaaggtgaagccccgtctctactaaaaatacaaaaaattagccaggcgcggtggcgggtgcctgtagtcccagctactcgggaggcagaggcaggagaatggcatgaacccgggaggcggagcttgcagtgaccggagatcacgccactgcactccagcctgggtgacagagtgagactctgtctcaaaaaaaaaaaaaaaaaaaagaaagaaaaaagaaagataaaataggtttttagagacttgtgagaactctgctgcaaacgctgtttaggaaaacatataaaattttgtatgtatgtactgtcacatgtacatgtacatatgtaatatctatatacccaattttgtaaaataatcccaattttgtaatacatataactagaaaaagagactggaagaaaagacaccaaaatacagacagctgttatctctataaactccatgaaggcaggagcttcaactgttttatattgaaatatatactcaattacaaacatatgcttattttttttaattacgagatataacctgtcactacactggactgaaacttactgctacttgagatatttgttcctgatatataaattctgttttactttatcctcttgaagcatcattctaagtaaaatcttacaaagtaaacttacaaatccagcaaggaaaaaaaattagattacatactgtaccttgctctgataagaactttacaatggctttgaggaactcaacaaggaaaatcagtgtttccaagaagaagaaattcggcaggacttggtggttcacacctgtaatcccagcactttgaaaggccacggcaggtggatcacctgagatcaggagttcaagactagcctagccaacatggtgaaaccccatctcaactaaaaatacaaaataattagttgggcatggtggcgggcacctgtagtcccagcagctactcaggaggctgaggcagaagaatcacttgaacccggaaggtagaggttgcagtaagctgagattggccactgcactccagcctgggcaacagagcaagactcggtctcaaaaaaagaaaagaaaaagaaatttatgggctgggcacagtggctcatgcctgtaatcccagcactttggaaggctgaggcaggtggatcacttgaggccaggagttcaaggccagcctggccaacatagtgaaaccccatctactaaaagtacaaaaattagccaggcttggtggcacatgcatgtaatcccagctacttgggaagctgaggcgcaagaatcgcttgaacccaggaggtgaaggttgcagtgaacagagatcatgccattgtattccagcctgggcaactaagaaatttacttctttaaaaaataaaaataaaaaaataagtgaatatctggtctgtacctttaatacaatatcaactaaacttaaaagaaaaagaattttgttgattgaattaccaaagaaagtttttgagaattttaaggtccaaaaatgttactattatttgtcatcttaacttaaagatctaaaagtcaaaacatctgtctaaatagagatgttcaagaaatatttcatgctttgaaatgctatagcaataatatgaaattatattaaatcataaccagatgatatgtcttcataacaactctcaaccaaagaaagcagatgctgaaagaaggttgctggccgggtacggtggctcacacctgaaatcccagtgctttgggaggccaaggtgcgccaatcacttgagctctgaagttcaagaccagcctgcacaacatggcaaaaccccatgtaaaaaaatacaaaaattagctgggcacggtagctcacgcctgtaatcccagcactttgggaggccagggtgggcgaatcacaaggtgaggagttcgagaccagcctgaccaacacggtgaaaccctgtctctactaaaaacacaaaaattagccgggcgtggtggtgcgcatctataataccagctacttgggaggctgaggcaggagaatcgcttgaacctgggaggcagagactgcagggagctgagatcgcgccactgcactccagcctgggcgacagagcgagactccatctcagaaaaaagttacatctaaagtaagttacaatgctgtacatacatttgacatcaatgacagtcaaagacaatgagaaggggaaatgtcacaaaagaactgccatagaattttaacagaatgatctctaatgatctttcccactcatttactcaagtctttgacatcagctcatagccttccttctcaacaggatcctatcataatccagggtgatggcaacaaaaatgtactcatctaaccaggtaccttgttcctaggtgtcctctctccacgaatccacacacgcagccaaacttgctctacctctaaagccattcattcgaggcatcccattctctagccataatcactagcaatcctgaatattcgagatgcatttgttctccagcctcaactgtacctgtctttctttggtcctcagttttcttcatttcagcatctttcagatttcacttctactttctctggtttatactcactgcttgtaggaatttaatattatctccttcattttggcaaactatttttttttttttttttttttttgctacagagtttcgctcttgttgcccaggctggagtgcaatggcgcgatctcggctcaccccaacctccgcctcctgggttcaagcgattctcctgcctcagcctccctagtagctgggattacaggcatgtgccaccacgcccggctaattttgtatttttagtagaggcagggtttctccatgttgtgtcaggctggtcttgaactcccaacctcagctgatcgacccgcctcggcctcccaaactgctgggactacaggcatgagtcaccacacccggccatcattttggcaaactattaaaacctataagaaatctaacttatttcaatgacctaaaagaatcaaacaagaattaatagtctattatacagaataaaaccatgtttatctaatcttctcaaggacataaacataacaaacatgaacgtgctcattcattggtgggtattttaactcctcaatagtccaaccctcatctgcttttccttaaaattatttcattattccagctgaggagaattaaatcatgtgaaaagccccatatcagcctttcatagtagcatttcttctttctttcttttttttttttttttttttttttttttttgaaacagtctcactctgtcaccaggctggagtgcagtggtgcgatctcaactcactgcaacctccacttcccgggttcaagcgattctcctgcctcagcctcccaagtagctgggattacaggcgcacgccaccacgcccggctaatttttgtatttttagtagagacggggtttcaccatgttggccaggatggtctcgatctcttgaccttgtgatccacctgcctcagcctcccaaagtgctgggattacaggcatgagtcaccacacccagccacatttcttctttcttcataaattttttctgggccgggaacagtggctcacacctataatcccaacactttgggaggccgaagcaggaagacttcttgaagctaggcattcaagaccagcctgggcaagaaagtaagaccctgaccctgtctcagcaaaaaataaaaaaataaaaattagccagatgtggtggcacgcacctgtagtcccagctactcaggaggctgaaatgagaggatctcttgggcccagaaggtagaggctgcagtgagctacaatcacaccactgcactgcagcctgggcaacacagtaagatcttgcctttaaaaactaaacaaataaatcaacttttttaaaaaacaattttttcccttaacggtattttctagcacctaatattaaatacacatggtggttatttcatgttttctaggaaacaagtaactaacataaaaacaaaaaataaataaaatacacatggtgtgtgtttgataaacaatggaatattttacctctttcatcacttaagctttgcatatattaactcatttaactcttttaacaattttatgaggtaggtattactactatctccattttgtatcgaggaagctgaggcccagggaggttaagtaacttcctcattaatataaagcctctatgcagtagagctcagatttaaacccaggcggtcttggattctgcatctgtgctcttagcaatcatgccacactgcctctcaaacccaggctaaacttttgcttaactgagaaatctttccactgaaaacatggttaataattagtttcattatattcaagtaaacaccaaattagtacatcgcttccataccaattgtaataatctctaaattcttcatctgtttatcattcataacacagtaatcattcttcctattttcacaaaccatttcttatataaatttcctaaactttacatttcctttcactttaaatagctcagtaactttctaattttttcatccacctgaagttaccgggttactttcttcactgtctcattcttttcttttttaagacaggggctccctctgtagcccaggctggagtatggtggtgtgatactggctcgttgcaacctctgcttcccaggttcaagcgactctagtgcctcagccttccaagtagctgggactacaggtgcacgccatcatgacccactaattgttgtattttgagtagagacaggctttcgccatgttggccaggctggtcttgaactcctggcttcatgtgatctgcccggcttggcctcccaaagtgcaggactacaggtatgagccacggcacctagccccaaaatattgtttcattctattaagcatgtaatatacaacttaccaaattttgtaactaagttttcctctttccttcttctaaaaaccatcaatgtttcaacttccccttaaattcttttttattttattatcttttttttgaggcagggtgtcactgtcacccaggctggagtgcagtggcaccatcacggctcactgcagcctcgacctccccgggatcaggtgatcctcccacctcagcctccggaatagctgagagtgtaggcatgcgccaccatggccaactaatttttttttttttggtaatttttgtataggtggggtttcaccatattgcccaggctggtctcgaactcctgggctcaagctatccgcctgtctccacctcccaaagtgccaaaatgcaaggattacaggcatgagccaccacaccagacctaaatactttcttttgctgaatgttaaaacagtatcaaagtcaaaaattagaaccacttattctgagtgaagccaataagcacttcacctttgaaggagctctaagtagaacacgaaagaaagttatcaatattttatctgctaacatttacacggcaacctacttaaaaagttatatgggtgcttccacttctggaaagcattgtcttatctaagaagtccagattttctctttgcccttctagaaaacacatactatcaagtgtcatcaaatatttttcttatgttttataccaattaaaatttaataatggaggtgactgtgaagggagaaagaacaaagagaatacccaagcctaggtttaatttttataactttttgaagaaaaatatcaagaaaataggaaaacagaagagaatgaacattatattttctacatgaaattaaaagaagacagtagtttgagacaggtcactctgaaaacaaagtgtcatactttttttttttttttttttgagatgcagtctcgctctgttgcccaggctggagtgcagtggcacaatctcggctcactacaagttccacctcctgggttcacaccattctcctgcctcagcctcctgagtagctgggactacaggtgcccgccaccacacccggctactttttgtatttttttagtagagacgtggtttcaccgcattagccaggatggtctcgatctcctgacctcgtgatccacctgcctcggcctcccaaagtgctgggattacaggcatgagccaccgtgcccggccccaaagtgtcatacttttaataaaagtatatggtataaaaataaaagtatatggttaaaaaaaaaaaaaaacttcaactacccagacctcaatttgaaggccaaatgttgtattactaatagtgataccctgcacaaattaattctctgaatctccatttcctcatctggaaattagtaataccatctaccctgaagaatgggttattagaagtaataagaatacagcagctcaatcattccttttctccaaccatttcttacagtcaccacactaagcaaacagcaagaactgactcacctcaagccattacataaaatttatctattagacagtgagttaaagtatcaaataattctcattgtgatgaccccacatagactgttgtcttaaagtctttctgctgtattcagctctaagaagatgtttcttgatgcgcagttaaatttacaataaattacctgaaaattttctcaggcatgccaaaaatcacaagatctatttatatattttagcaatctagtgaaaacgttctttacttatcaagaactgatgatacttaaacttccttccagaggtctctactcagtttaatttgtgatagcacttgtatgtgagacagcaaacactatacattttaagcaaagaaaaatactatagaagacttcattttttacagagtttaaaggaaagctcattctgatgttcagaaatacagtggctcgggagtggtggctcataactgtaattccagctcttcgggaagccgaggcagaaggatcacttgagcccaggagttcaagaccagcctgggcaacatggcaaaaccccatctctgcaaaaatacaaaagctactcagttgtggtggcatgtgcctgtagtcccagctactcgggaggctgaggagggaggatcacttgagtccacgaggtggacattgcagtgagtcaagatcatgccactgtgaccttgtctcccaaaaaaaaaaaagaaaaagaaaatacagttactaaacagttttgtttttgttttgagacagtcttcctctgtcacccaggctagattgcagtggtacagtcttggctcactgcaacctccatctcttgggttcaagcaattctcctgactcagctcccaagtggctgggattacaggcatgtaccaccatgcctggctaatttttgtatttttagtagagacggggttttgccatgttggccaggctggtctcgaactcctgacctcaagtaatctgcctgcctcagcctcccaaaatgctgggattacaggcatgagccaccacgcccactccagttactaaacagttttatgtgtaacatcacttagactctatcctaaggaaataattgtaaatatgagatgacatttatctgctagaatataagttccatccgggcgcagtggctcacacctgtaatcccagcagtttgggaggccgaggtgggcagatcacgaggtcaggagttcgagaccagcctggccaacatggtgaaaccccattctctactaaaaatacaaaaattaggctgggcacggtggctcacacctgtaatcccagcactttgggaggcaaggtgggtggatcacctgaggtccaggaggtcgagaccagccttaacaacaaggtgaaaccccatttctactaaaaatacaaaaattagccgggcatggtggcaggtgcctgtagtcctagctactcgggaggctgagacaggagaattgcttgaacctgggaggcggaggttgcaatgagccgagatcacgccactgcactccagtccgggcgacaaagcaagactgtctccaaaaaaaaaagaaagaatgtaagctccatgagagcagagatttttttctatttattcattatcatatcctcagtgcctagaacaatgacaatcacttatttactgaatggaaataaaaagatccatagtgttacagcagtaaaaaacagaaaacacttatgatacattatgcattcattacaatgatgatgaaaatttatgattacataaaagtgcttacactcatttatttaaaaaacattaacttagtggccgggagcagcttatgcctgtaatcccagcgctttgggaggtcgaggcgggcagatcacttgaggccaggagttcaagaccagcacggccaacttggtgaaaccccatctccacaaaaaaatacaaaaattagtcaggcatggtgttgtgcacctgtaatcccagctactcaggtggcaagattctgtctcaaaaaaaatgactaagtcactaacttaggcattaagaagactgggttctaatgccaactctgtcactaatttgacctgtaccttggggtaaaggacaacctatttgggctccagcaccctcgtatgtattatttcctccccatttcctggccttggctggtcttaatgagactggctttgggtagacattacagcgagtacatgcctgagttacctcagaaagcaaagactaacacaaacagcagagaaaaaggggatgcaacctggagcagatcaaatgctgcatcccagtggactaggagatcctcagtgacatgctcttcaagccacactgactcagaatcatccatttttaactctaggacctcaaagcatccttgaaccactttacaataaacagcaagtaatttaggtcatctgagtcaagagaacaatgccatccagggtataccaaaatatcaagccctactgtcaaaaggaccagaaaataaagtacaggtggagaggaagtgatttcacccgctggaaatagaaaaagtagatctgtgtgtcagccaacaactatcacacaatggaacaggatgcttacctctctgctggaggaaaagaagctattctcaagtccttagaataaaaactattgtaatcttactatatctattttatgtcatctgagagcaatccatgaggacaatgcttcctctttcagagaatcttccaactgaaaatctcaaagaattcccaagcaccacttgcccttcaacacctacctacacctcacttctctgccccacactcacaaactttattagcatccacaattaaagaaccatgaggccaggcgcggtagctcatgtctgtaatcgcagcactctgggaggccaaggtagaagaatcacttgagcccagagggttgagaccagcctgggcaacatagggagaccttgtctgtacaaaaaaaaaaaattctcggccaggcacggtggctcacacatgcaatcccagcactttcagagcccaaggcaggcggatcacaagctcaagagatcaagaccattctggccaacatggtgaaaccccgtctctactaaaaatacaaaaattagctgggcatggtggcacacacctgttgtcccagctactcaggaggctgaggtaggaaaatcacttgaaccctggagatggaggttgcagtgagccaagatcatgccgctgtactccagagcctggtgacagagcaagactccgtctcaaaaaaaaaaaaacaacttttttttaaattagctgggtgtggtggcacacgcctgtgtcccagaggctgtggtaggagggttgcttaagcctgggaagtcaaggctgcagtgagctatgactgtcccactgcattccagcctgggcaacagggtgagaccctgtcttaaaacaaataaataaaaaacaaaataaaataaaactctgctctgccacttcctagctgagttactttgggaaagttattgaatctctccgtgcctccattttctcacaattataaaacggggataatacctgttacacaggattgtgataaagattaaattcatctagaatgcctgggtaaatacttagcataaaatagatttccaaaaatgtaaggccaatttctaccgaggcctattccttacaaagaaaactgaagacacataggaattctcattccttgtagtgatctaaattaccaaaccatgcaacatcttaatataaaagaaatctcaaggaaggaaatgaagttactgcctcatggttttactgacaagcagtttttaaattgcaggttcacagagggatttgggggacccattaatcccctgaaattatacctgattttgaggcagcgtgctacttctgtaaatgtcttcactgaatttccactagctccaaacctatttctctattctcctttacagcaaatatcctcaaaaaggtgctatactcactctctcaaattctcctttcattctctcttaaacccactccaataagaatgatgaaacaaaccctgccctgaaactaatcttgccaagatcatctgtccacattgctaaatccaatgatcagttctcagtcctaagctgatttttagcagatttttgacacacttcatctacccctcctgcttgaatacgtttttctcatctggcttccaggatgccatataatatagtctatgatttcttggttttcctccttttttgctgatctcttatcagcttttgttgctgactgttgtctcagactttttaacgtccctggacttcgtccttgaactttttctcttctcttccctatactccactggtaatctcttctggtttcccagctttacttacacttgccacacactcacaactaggtatctccaacccaggtttctcacatgaattccagactcttacaccatcttaaaactgtctacttggcatctccacttgagtatctaatactactttaaccttggtgtgtccaaagtaagctcaagaggccaggcgcggtggctcacacctgtaatcccagcactttgggaggccgaggtgggcagatcacttgaggtcaggaattcgagaccagcctggccaaaatggtgaaatcctgtctctactaaaaacacaaaaattagctggatgtggtagcaggcacctgtagtctcagctactcaggaggccgaggcaggagaatcacttgaacccgggaggtggagggtgaagtgagccaagactgcgccactacactccagcctgggagacacagtgagactccatcttaaaaaacaaacaaataatctgctctaaacacagccttcccatgtcagctcctgacaaccccatcctttgagctgcacagtcccaaaccttggaatcatccttgactcctttctttcaacccctaccctacagtgaaattcatcagagaccaggcatggtggttcatgcctataattccaacacttggggagggcgagacaagaggatcatgtgagcccaggagttcaagaccagcctgggcaacatagtgagaccccatttctacagaaagtttttaaaattagctgagcatggtggcacatgcctatattcccatctacttgggaggctgaggtagaaggatcacctgagccagggaggtcaaggctgcagtgagccgtgttcacaccactgcactgcagcctgggcaacagagtgagattctgactaaaaaaatttaaaaactcatcagaaaatactgtcgctctatcttcaaaatacatccagaagtcatatacttttcacaagtctactagcaaatggatgaagcaccaccatttctcacatgaattattatcatgatagcctcccacctatctcattatttctagcctgttgtcccagtctgctgtccacaaaggagtcttctgtccttttaaaatgcaaataatgcactatgggaggccgaagtgggaggactgtttgaactcaggagtttgagaccagcatgggcaacctaaggagagctgtctctactaaacagaaattaaattttttaaaaaaagaagagaaaatgcaaatcacatcatgtcacttctttgctcaaaaccatccagtgccttccccatttcaatttaagccaaagtcctgaaaaggccccaagaagcacctttacattcccccagccccttaccggtgaacatctacctcagaagtcacaacagacatcgtagactgaatgggtggtccccagaaagatatgtccaagtcctaatccccagttcctggggactgccaccaaagattgccagcagccaccagaagcaaggaggaagtatggaatgggctgtccctaagagcccccagaaggaactaaccctgccaaccgacaccttgatttcagacttctggcctccacaactgtggcacaataaatgtctgttgtgttaagccaccaagcatgtgcttgtaatggcagccccaggaaactgacacaccactctaccccctgctcattctgctcccaccacgctgtcttccttgtgcccacttcaggacctttccactgactattctcctctgtctgggaagctcacgctgcagaacttcacatggcaaactcccacacattttagccttttgctcaaacatcatcctctccatgaggcctatcctgactcccctatttaaattgcaaccaccaccatctttccacttctttcaaactcccttacagtatctatttttttccacagcatttatcatactctaatatactacataacattcttgtttattacccattggattccatagaatataagctccacagaggcagggtttttaggtttgcttggggttttttttctcttttgttcactggtgtattctaaacatctataaactatgcctggcagatagtagctgttcaataaacacacgctgaataaatctgttgaacgaacgtgtatatgtatatgtctttttctggaaacagaattcacagtttttatcagattaatgaagtgatctgctacccaaaaaaggtttccaaatctttgttctcaagctttaagtggttaaggaaaagggaattctatcctaaaagaccccaactctaaaaaaagcaaacaaaaccccaaaaacactcatactatgacttcgtatcttacaaatggcagacacaagtttaaatttcatactcccaaaaccaaattttgctaaagaaaaaaagacagtccactacaatttaatggcttgagaagcaccttcacccacttttcacagaaccttgcacactaaaaggtgtacccaggatgagcttatgtctctactgcttaagcaacaaagggtggccagcagtgtgaagcattcacataagcaaatcaaagttccacacagctcaagaacatgatccaatgctccacctaggtaaaatcctatccaaagtaggggagtagaaccaaagcaaatcataacctgtctagcatctatccttactatggaataaacagatatttactcaaaatacaacactgttttaaagaccttgagaaaccatagaagagatgtcatttacatgccccctcagtatgaaccataaagcgtaacaatgaaaggcagtcaagcataggaaaacctgttaatggattttgataacagcagaaaggcacccactacattccttattattgctgcaacatatttcaaagttactactaaacaggtctaggctaatacaatcacaccaaacaccagaattcagcatattacttatccaagcatacattcttcagacatatcttttatattaaatcaatgaccattacagaggaaaatatgcacatctgctgttccatctttcttgttccatcagcaagtggattcacaatgcaaccaagtcctagtccttacctttcctggttccattctccaacagaggaatttcaaggatacagaatctatgacatactttgaagacaaaggcattttaaactctaattaactcataatttgccttgagctgcttttttttgagacgaagtctcactcttgtccccaggctggagtgtgatggcgcagtcttggctcactgcaacctccgcctcccgggttcaagcaattctcctgcctcagcctcctgagtagctgagattacaggtgccaaccaccacgcccagctaatttttgtatttttagtagcaatggggtttcaccatgttagccaagctggtctcgaattcctgacctcaagtgatctgcccacctcggcctcccaaagtgctgggattacaggtatgagccatcgcgctcggcctgccttgagctgtttttttaaatactggtaagactttcacatctcagaacacatcattttatcaaattccaaacccaaccgctcttcatcacctccacgactaccacactaacccaggcccacagcacatcccctgcagagtctggccacactcctcatcagtctgcctgcttccactctgactggcagcagtctaactttcttttttttcaacttgagagcagctactgtttatttaaactgatcagactagaaaaataattgtggtaaacacctcggttcattcttctaagaagcctgtggatctggtcctccctgttgccagcatctccaccttctacaaaatgggtggtttttcttcattctatcttgtggagaaaataatttgaagggccacaggaagttatttgcttctttaaagcgttttccaacagtatagatgtcatgaatcagatcctccatgcagatgatgccatatttaccaagagatagagcaatcaaagcgttatctgtcaaagcaatttgtttattcatcttgccataaccacgcttgtagattagttcatttactgacttcagatttgggttcccccatgtaatatatggctctacaatcctcagcatgttaactgaagccttgttgagcttcacaaaggttccactgaagatttgataaaggcgaagaagctgcaacacctttcagacctctgggctcacaccattggcacctctggtcctgatgacaaaggccaatttgggttctgcaggtacacagaagttgccagcttttcttgccatccttgccattcgaatttcagttctgtacatctgcctatattccttgtgatagcactatgctttttcataaataagctccctccttgcctttcaaagcatgttttgggcaaacttctttctcaggagcttgatcttcagctctgtgaaattcctttgctttttcttaagggtttctggcacaacaggaaccttcttcttctcttcaacaccctccatggttccagctggtaaagatcgcagtctaactttcacacagcagccaaagtgatctttataagacagagatcagattctgtcacacacacctgatgaaaaccttccagtggcattatacttggaatgaaagccagaggtcttagcatggtccacagggaactttatggcctggctcctgcccctctttcctggtatcacctcctactgttctcccagagtttttccactgttccttgaccaaaccagcaggcttccacctcgggatttttgcacctgatgttccctctgcctggaaggctctattcctatacctccgcatggctccctagcctgttcaaggccttgtccaaatgtcacctcttcagagaagccatccctaaataacctacttaaaatggtaccatccgtacaccctgtcagtgtctctctctttgtctgagtatcatggttgcctcattttataatttgtttaatctgagtcagaactgaagcatttatttccctataaaatgaaatctgggcagaacaaatgctattttatagaccactcattttgaagttaaacacaatatataaacaaacatacacacctttaaaaaaaacagtgctttggccaggcacagtggctcacacctgtaatcccagcactttgggggaggccaaggcaggcggatcacctgaggtcaggagttccagaccaccctggccaacatggtgaaacctcgtctctactaaaattacaaaaattagccaggcgtcgtggtgggtgcctgtaatcccagctacttgggaggctgaggcaggagaatggcttgaatactggtagcagaggttgcagtgagccgagatcatgaccctgcacttcagccagggcaacagaggaagactctgcctcaaaaaaaaaaaaaaaaaaatgtgctttggtgtatggttttcctttatcgttcttaatttaaaagtattaccagcctgggcaacatggcaaaaccccatctctacaaaaaatacaaaaattagccaggcatagtggcgcacacctgtagtcccagctacttcggaagctggggtgggaggacggcttgagcccgggaggtcaaggctgcagttagccatgatggtgccactgcactccagcctgggtgacagagtaagaccctgtctcaaaaaaataaaagcattaaaaagaagtgctgtatgtacaagaagtttatggttgtagtactagatagagtacaaaaaagaaaaatggaaataagccaagtgcccaataataggaaaatacttaaggaatatacatgtgaaaaaaacataatacaaccatgttatgttaatgtgttataataacatcataacgttataataatatagtaatttttaatatatgttaataatgactacatagaagcacaaaggtgtttatcaaggagtttttttttttttttttttgagacggagtcttcctcttgttgcccaggctggagcgcagtggcgcgatctcggctcactgcaaccacctcctcccaagttcaagcgattctcctgccttagcctcctcagcagctgggattacagatgtgtgccaccacacccagctaatttctgtatttttagtagagatgggatttcaccatgttggccaggctggtctcgaactcctgacctcattatctacctgcctcggcctcccaaagtgctgggattacaggcgtgagccactgcgcccagccagtgtttttttttttttttaagaagctgtaatgatagtaacaaagaagtccaacctttatattgcacaaatatttactaaccatgtagcatctatgtgcctgaccagccctgacagatgaggattcaggagcaaacaagactcgtccctgtgctttcagagcacacagggtagcaaagccactgacaagtacaggtgggattacagtgaggcataagagatggctcgggggagtacaggggccaggcagagcaccctgggcacagccctgaggctttccaaatgaaatgatcccaaaactcagacctgaagaataaacaggagctaagaagcaaaggagggggagataaacaggtatgaatcagtgggtgctcagggtgagaggcaagagaagacatgaaacagaatatgtgaactattattttttaaaaaactaaagtaacttctatatttgatggtagaatttttggtaaaatttatcttgtataaaatatgatactaggctgggcacagtggctcacacctgtaatcccagcatttggggaagccgatgggggagggttgcttgatcccaggagttcgaaaccagcctgggcaacacagcaagacctcctctctaccaaaaaaaaaaaaaaaaaaaatatatatatatatatatatatatgagagatactaaatgaaagccaaatactttaccaaccactctggcttctcaaagcttatctgtcctgtggctactacctctctttccttcagcctaacctactatctgaccaaacacgagcagtggcaggaagcaattttaacacgtcacacagatgcacacataactctttatcaggactgaccaatacacttcccatccccacattacaaatttggggccaaaattactcagacagagatgtactctccagtctctggctgacgtgctaccttattacctcgccccaattcccttcaggtgccaacagacactccgtgcctagcattccaagcctgtcttctttggtctacctaacttatctggcactattcctccccacaaattctgtacttcaaccaggttctctttactgaacgctgcgcataccatatgcattcctgcctcaggccgacccctgcctggactgtcctaacctgctctcccagtctgctattcaaacagcacccattcttcgatggcccactcagcttttcaatggatctttggtcaacttatttaatccacaccaatctctaacctgaaactgaactaaatttgttatgctaaacagtaagtacttggttaaattccgcttttgttctagaaatctctaaatgttgtattcttgcaaggcttccctcctaaattctgaggccaaagatagtaacttttatttcttttgtatcccactaacagcaacattaaacttggaaaacacacctcccacacctgttggctagctgacagatcctggatggaaagatgagccagagagcattcagtgccagttgcttttctctggaactgcgggttcaagcaccaagattaggactagacttatgtgctcctttgggacaggaaatggcatatgtactgaaacgcgagatagttaaaggacacccccccaaaaaaaattaaacatgaggaaaaacatgtgttcctaatgtgggcaaaccccaccatattacaagtctccccagtaccttctatactatgtagctaataatacaaataaataataaatctaatctatttgataaatgaatagatttaataccactaagagaaatatgaaggtaataggtataaccaacagcctagagtttaataaagctccaaggtaatccctgtatcaatttataagatgctaatgaattatttttacagtttttcaaatccttcatatagaaataaactaagccattttctaggaagaaaaaaggtcaggctttacttacagagtcttgctcttgttatccaggctgcagtgtagtagcacgatctcagatcactgcaatctccacctcccaggttcaagcaattctcgtacctcggcctcccgagtagctgggattataggcatgcgccaccatgcccaaataatttttttgtatttttagtagagatgggttttggccatgttggccaggctggtctcaaattactgacctcaagtgatccacccacctcagcctcccaaaatgctgggattacaggcatgagccaccgcacccggcccaggctttacttctttagggagacagggtggtaggggtttcataatgaactgaaaaaccaaacactgtgtccctttcatttggcaagaactccttttccaaagaagggactcagaaaaaatgaaattacttatataacgtctgagaaatattcttaaaagacaacaaaacatacagaaaggtattttggattcaggagaatacaacctcttccaaaaagagatttactctctactccctaggaactactaatgacatggaaaatcccactcaagttacatgaggtcacacacccacaataaaggtagctgcctgaaggtggtctgccaagataaacaccaacttgttaactccctaagtgctatgcaaatgcccaagatagtatatgcacacttaatgactctctacattgttggagcatcatgtttctactattactacagttctttcagtctgtattttagtggggtttttttcatatctgttccccacttttcatcatgacctccaggagggtagggacacatcttactcatctttatatccccaatgcctagcattatatcttgcaagagacactaaaaaaataaaattctgccaaatgaatgggcaagcccaaaatatcactcagataatcccttattaacagccaaatgcccaggggaagggagacttagatgacagcaccttcctagaaaatatggcctgaaattacagatcatttctacaacaagttacatttcacttactaagcaactggtctatcttttcagaataaattttacttttcatgatcagtgtaagtatacgggaagcatgattattctgaaatctcttcttttcaaactaaacacatagctcctggacacccacaggaatcatacgagaagagggagaggcagtagacattagtttcaaacctataactctttaagagtcaaacaaaagtagaaaatactaagaaaagaaaacttgtcagaaaccatttaaagacaaaggacaccatcatctcccagaatttatcatcaacagaacaggtgaagcttaacaaagataaattaggccgggcatgatagttcacacctgtaatcctaatactttggaaggccaaggtgggaggatcgcttgagcccaggaggtcaaggctgcagtgaactataattgcaccactccagcctgggcaacaaagcaagaccctgtctcaaaagaaggaaaaaaaaaaagaaaacaaaacaaaaagacaaagtataagagcgccttcttcacttaatgaagcccaagttataaattcttataacccattaagtttataattgaaagagtatcaagcatatagctttatctatgcacataaaaacaaacataagttcagtaattcataccagaaaccaggtaatcacaagtccaacagtttaccttatctttgaaatacactatgtagttggctaatttcacagtaatcaattcttacgggatcctcttataatagccactcaaggagaaaatttcaaatactgacctctaattcaatgtaatacaaataagaggtcttccatccagaattatatcaaatggccacaattcctttctcagtaacaccataaacaggctgaagctctccacaaatcttctctgtaagtggatcccacggtggttgtgacccggtgctgagcgcacatacagttactcctagacaatcacctcctaaaagaagacagatgactatcactgtgactaaatgaaacaacttcaaaaatgcagctctgccaactagtttcattagcattttccaaacaaaacaggtgtcacagacaagctcaaaatagtcaaactcctctctctttggtgctttagcaacattcaattccctaacacctcccccagatgctggattctttttaacagtgtcttacatcgggtatgtttctcaatattaggaaggtttaaagaagctgtgaggatcggatagcggaacataaagaagcaggaaggccgggtgcagtggctcacgcttgtaatcccagcactttgggaggccgaggtgggcggatcacttgaggtcaggagttcgagaccagcctggccaacacggtgaaaccccgtttctactacaaatacaaaaattagctgggcatggtggcgggcgcctgtaatctcagctactttggaggccgaggcaggagaattgctagaacccaggaggcagaggttgcagtgagctgagatcgcgccactgcactccagcctgggagacagaatgagactccatctccaaaaaaaaaaaaaaaaaaaagaaagaaagaaagaaagaaggctctattttgatactgggagcctaaactgaatgattctggagaaattcacagatggggctgaggctcaccttcatgacagctgtatcaaaggcctaaatttctaaggctcagaaatcactacaataagcctatcaacagcatgtgatactctccaagcattttgcaaccttaacatttccatcctttacagtactttgatatcctcaaaagatgtcttggatttcaaagccagtcccacaacaacaaggctggcaatcagcatcccagaaaactgcaaagaggttaagacccaagcaaaatggacttggggatgcaaggaatttgtcagcacctgtattctcctaagaagtggtaaaaatatggccgcttcctacaggaagaaactatgccaaataaccaaaccaaaagtgagaaaacctaaattatattaacttctcatgagaagaggcacttaaccagataactctgagtcaggaccgttcagagggcggaaagaaaggacccatattaactgttctaattacaagttactctttgactcttcagatcttatttccttgatgattagactggaataaacaatttgagggcaggtactataacacctgtcatcccagcactttgggaggccaagacaggtggatcacttgaggccaggagtccagaccagcctggccaacatggcaaaacctcatctctactaaaaatacaaaaaaattagccaaatgtggtggctcatgcctgtagtcccacctactcaggagaggctgaggcacgagaatcgcttgaacccagggggtggaggttgcagtgagccaagatcgtaccactgcactccagcctgggtgacaaagcaagactgtctcaaaaaaaaaaaaattttttttttttgagagagaaaaaaatggcctctgaaggctgggcgcggtggctcatgcctgtaatcccagcactttgggaggccgaggtgggcagatcatgaggtcaggagatggagaacatcctggctaacacatggtgaaactccgtctctactaaaaatacaaaagtaaagtcccagctactccggaggctgaggcaggagaatggcagagcttgtagtgagccgagatcgtgccactgcactccagcctgggcaacagagcgagactccgtctcaaaaaaaaaaaaaaaaaaaaaaaagcctctgaaatcatttcaggaactaaaagctaactctggctctctctacatctttatattaaagggtcctggacctgtgattgttgaggtggcagggaaaactgctacctgttcccattcctaatagaaaccatcttttgatgccattcccattgtatttttccacaaaaaatgtatttacagatttctgggactgaaaaattgctgaatttgttaaaagagaagaaaaaggtggcccagcaagatggctcatgcctgtaatccctgcactttgggaggccaaggtgggtggattgcataagcccaaaaattcgaaaccagcctgggcaacacggcaaaaccccatctttacaaaacaaaacaaaacaaataaaaaaaaaactggccaggtgtggtgacatgcacttgtagtcctagctactgccagaaggtggggagggaggggtggctgaggtgagaggatggctgtcacccaggttggagtgcagtggtgccatcatgtcacactgcagcctcaacttcccaggctcaggtgatcatcccatctcagcctcccaagtagccagaaccataagaatgcaccatcacgcccagctaatattttttattatttttgtaaagacagggtctccctatgttacccagactgtcttttattccccgcaagacggagtcttgctctgtcgctcaggctggagtgcagtggtgcaatcttggctcactgtaacctctgcctcccgggtttaggtgattcttgtctcagcctcccaagtagctgggattacaggtgcctgccaccatgccagggtaatttttgtatttttagtagagatggggtttcatcatgttggccaggctggtctcgaactcctgactttgtgacctgcccgcctcggcctcccaaagtgctgggattacaggtgtaagccaccgcccccggccccccacttttttttttctttttaggagacaaagttttctacgttgcccaggctggcctcaaattcctgggccaaagcaatcctccagcctctgccttccaagtagctggaactatagacatgccacatatccagcatgcatttttatattttcaaggtatttccatatctatttgttcatttcagtttatgtactactgtccctatttgacagctaaggaagtagggcacataatcatacttcaagcccatagttcaggtggaaatggactctaggtcttctcatgccaaccaggagtcatggcttatttttcttatgcacagaggctatcacagttcaggacattttagtgaagccagaagaaacaggaattacatggccgggcacagtggctcacgcctgtaatcccagcactttgggaggccaaggccggcagatcatctgaggtcaggagttcgagaccagcctgaccaacatggagaaactccgtctctaccaaaaatacaaaattagctgggcgtggtggcacatgcctgtaatcccaactactcaggaggctgaggcaggagaatcgcttgaacctaggagacagaggttgtggtgagccgcgattgcaccattacactccagcctgggcaacaagaacgaaactccgtctcaaaaaaaaaaaaaaaacaaaacaaaacaggaattatgtagcatatataaattatgttttaaactactatcatataacctagtagttctctccaatgtaatcaacatatcccttagtaaaatattgtttctagagttataaatagtattctgccataggccacccagatctcagatctcatcttgattcaaatgggcactacacaagaatacatggggtgtttaatttatattcattttgttatttttcaggacagtgcctctaagccaggaaatagccttcaagtagaagtggaaacatccacaggctaagttaaatgctatattcaagccactcaatgttcacagtcttattctaagtaatcaggccactgacccaagtgtcagtcagcatcatcttcaatctccctatgaaaagctgaaggaaaagaaaatctaattaaaagcccaagaaaaaatccactttaatcaaaactgcaactaaaaggcaaaggaactttaaggtaggaaaaaaacttaagacatgaaaaaattaggaattacaaaaagggatgtcaagagggaaaaagaggagatactgcgattttttttttagaatagtcaaatacagcagtgagaagagggaaagagtagaataaggagtttgatctgtaaccatcaattaagattaaatcactaacttcagcctgatactgtaatttaaatgactaaaagcaagccaatgaaaaatatgactttccaaacagaagaggcataaaactatagaaaaataatgaaatacgaagggttaaaatacagagaaccacaattttaggaatattttactatgaagaacaggaaactgaatgtttaagtatatataaaagcaaaaggaaggaaacaatacatttagttccatcaaaatcaacagaaaaccatctactatgagcctccgttgacaacttctcccaagtgaaacaatacagatgagggtcacagacttagccagtgataggacctactactctgtaatcatccatgggcaacagacaagggctgtcagaggacccaacagacggaagccagtgctagaagacagaactagtttcctcaaaaaaaaaaatcagtcaaagccaggaacggtgtggctcatgctgtcatcccagcactttgggagcctgaggcaggaggatcacttgaggccaggagttcaagaccagcctgggcaacacagggagaccctagaaaaaaattaaaagttgttttaattgaaaacaaatcagtcaaacaaattactggtatgctttaaaaataactgtgtgacagaagaattacttgaacccaggaggcggaggctgcagtgagctaagatcacaccactgcacaccagcctaggtgacagagtaagactccgcctaaaaaaaaaaaaaatcagcatgaatcacaaaagaaagatacacgccagatcattattgttcttaaggtgaagcaatttagtcatcttagcgtaaacacacatatgctttagtagacatattaagaaatctctggaataaaaaatgaccagactaactagaaagcagttgaatcacccacctaaaaaaccgacttactaatttaaagcacttaccatattttaaaatcttttttaccttagaagcctttttcacttcaggttttatatttaaaacattttccaaaaaagtcagggtttgtgtcacctcttgcagttggaaatcagtttcaactgtaagttactttaaatccagtaccaaagcactgagattccaaagcagttgtcacattaactccatttcagaatccaagtacctgactgcagtctctagtaagagaagcctctaactggaaaagtaacaggaaaagttgtactttctcatttcaaatttggggcctactatgctgaatgaagaaagagagaacttcaagttcagcctaataggcatttactacaaataatatgacaatggttggcactcaattttaaaataaatgactaggccaggcgcagtggctcattcctgtaatcccaacactttggaaggccaaggtgggaggatcgattgaggccaggagtttgaaaccaacctgggaaacatagcaagaccccatttctataaaaaatttaaaacttaggccggatgcagtggctcacgcctgtaatcctagcactttgggaggccgagacaggtggatcacctgagatcaggagttagagacaagcctggccaacaaggcgaaacccggtctctactaaaaatagaaaaaaattagccaggcatggtggcgagcgcctgtaatcccagctacctgggaggctgaggcaagagaattgcttgaacctggctggggaacagaggttgcagtgagccaagatcccgcccctgcacaacagcctgagtgacagagcaagactccgtctcaaaaaaaaataaaaataaaaataaaaaattacccaggctttctgctgtaggcctgggtggctgctataaaaacgggcaagttcatgaaacctggaaagtggtgctgttctggccagacgctatgccagatgctactcaggaagcaaagatatcatcatgaagaacactgatgatggcacctcagatcgcccttacagccatgctctggtggctggatttgaccactatccccacaaactgacagctgttgtgggcaagaagaagatgaagaagagtcaaagatcaagtcttttttttctttttttttttgaggtggagtcttgctctgtcacccaggctggagggcagtggcgcaatctcggctcactgcaacctccacctcccgggttcaagcgatcctcctgcctcagcctcccaagtaactgggattacagacgtgcatcaccacacccagctaatttttgtatttttagtagacatggggtttcaccatcttggccaggctggtctcgaactcccaacctcaggtgatccacccgcctcagcctcccacagtgctaagattacaggcgtgagccactgtgcccggcctttttgtttttgtttttgttttgagacggagtttaacccattacccaggctggagtccaatggcagacctcggctcactgcaacctctgcctcccgggttcaagctattctcctgcctcagcctcctgagtagttaggattacaggaacccgccaccacgtccagctaattcttgtatttttagtaaagatgaggtttcaccatgttggccagactggtctcaaactcctgacctcaggtggtccacccgcctcggcctcccaaagtgctgggattacaggcatggaccaccgcgccccgccaaagatcaagtcttttgtgaaagtttataactactatcacctcatgcccataaggtgctccgtggatatccccttggagaaaactctcatcaacaaggatgtcttcagagaggctgctcttaaatgcaaggttactgagaggccagggtcaagttcaaagagaggtacaagacagtcaagaacaagtggttcttccagaagctgtggttttagatgtttcatttaggttattaaattttttaattaattaaattaaaatcaaaattagccaggcatggtgacatgcccctgtaatcgcagctactcaggaggaggcttaaacaggaggatcgcttgagcccaggaatttgaggatgcagtaagccaggcttgtccaatccgcagcccaggacaggtttgaatgaggcccaaaacaaattcgtaaactttcttaaaacattatgagtttttttgtgattttttttttttatttttagctcatcagctatcattagtgttaatgttttgttttggttttggtttttttgcttttttttaagatggagtctcgctctgtcacccaggctggagtgcagtggcgcaatttccgctcaccacaacctccatctcccaagttcaagcaatttctccctgcctcagcctcccaagtagttgggattacaggaacccaccaccacgtccagctaatttttgtatttttagtaaagatgaggtttcaccatgttggccagactggtctcgaactcctgacctcaggtgatctgcctgcctcggcctcccaaagtgctgagattacaggcgtgagccaccgcacctggccagtgttggtgtattttatgtgtggcccaagatatttcttcttctcccaatgtggcccagggaagccaaaagattggacacccctgcagtgagccatgatcacaccactgcactccagcatgggctacagagtgagactctacgtcaaaaaaaaaaaaaatacataaattaaatgactaaaatccagaaattgcagtctttaaagagtaaattttatagcatgtgaccaatctcaatgaagcttttattatttaaatgtgttttaaaaataaatgacactcagaacgaagtattccatataacataaaccacctgtctctatgactgagagaccacgaaagtatatcttaaaattctgatatatgaaaagatcatcaacttcattcatggtcaaagaaatgcaaattcaaatgatactgtaggagccaggcactgtggtacacacctgtagtcccagctactcaggaggatcacttgagcccaagagttaagaggctgcagtgagctatgattgcgccaccacactccagcctgagaaagagagattccgtctctaaaaaaactttgtaagggccagaagtggtggctcagacctgtaatcccagcactttgggaggccgaggcgtgtgatcacttgaggtcaggagtttgagaccagcttggccaacacagtgaaaccccatctctactaaaaatacaaaaattagctgggtgtggtggcacacgcctgtagtcccagctattcgagaggctgaggcaggagaaccacttgaatttgggagccgcaggttgcagtgagccgagattgcgccactgcactccacctgggtgatacagcaagactcagtctcaaaaaaattgtaaggccaggcatggtggctcacgcctgtaatcctagcactttgggaggctgaggtaggtggagtgcttgagtccaggagttcgagaccagcctgagcaacatggtaaaaccccgtttctacaaaaaatacacaaattagccaggtgtggtagtgcattcctgtagcctcagctactggagggggttgagatgggaagatcgcttgagcccaggaggttgaggctgcagtcggccctgatcgcgccactgcactccaacctggacggcaaaacaagaccctgtctcaaaaaaaattgttctttttttttttttgagacggagttttgctcttgttgcccaggctggaatgcaatggcacagtctcggatcaccggaacctccacctcccagattcaagtgattctcctgcctcagcctcctgagtagctaggattacaggcatgtgccaccacgtcaggctaattttgtaattttagtagagatggggtttctccatgttggtcaggctggtcttgaactcccaacctcaggtgatctgcccaccttggcctcccaaagtgctgggattacaggtgtgagccaccgcgcctggccaaaaaaaaaatgttcttaatgaaaagatatcattgtacacatttccacctatcagattaacaaagattataaaatttcataatatccagggatggtgagaaggaaatgaaaaccctaaaatattctgtgcatacacaggcatatctttgggggcaatttatttacagctttcaaaataaaaagtaaacataacccactgattcagcaactctacttaagagcttatcctatacacatacttgtacaatagtacaacagtacagatatgaggatgcgaaccaaagagtctgagacaatttaactgtccatcaatgggaaaagtgaagtttacatccatacagcgtccgattatgcagttgttttcaaaaacaaacctgagttataagtattgaattgaaaaatatgtttggaatttttttaaattcaagatactatctatagtatgcttatatatgcagagaaaatgtctggaggaatactgaattgtgtgaaagtgattacaatgagtatatattaattttataattataatttgtatttcatttgaacacatgaagctatcaaataaagtcatttaaccctggtgttaaatcagcctatgctatgatcccaacctatctttccagtgctctatggttctggccaaaccagtctgttccttctttgagaaaccagtcccaaggactccctctccaaaatgctcttactatgtggtctgaacagctacccgctacagcttcaaatacaaattacctgagttgaaaaaactacgcctgcctgcatctgctataaaacattttaaaagagatcttttttaaaaagaaaattgaaacacaatttaataatccccatcatagaagcagcaaaagtactcaccatttcccaagttttccaggctctgtgcctttgcttcatgcaatttcctgcctcaaatcctcttagctacttatcacatgtccaaatcctgccaatccttcaaaacacaggtgacacaccaactcctacaccaaatcttccctaatgcccccatccagagctgattctctttcttaaaccacagtatcaacaccttttgaggcactttcttctacctagtactcagttgtgtacatgtctcatctttcccattaatgagaaaatcatcatgggcacaatctctgtcttggtcattttgtatgccctattttgctacattaattaaacttgtatttcactaaagcatataataaaaagaaaggggcaagaatctaaaagttaaaaaaaaacaggcttttagtatgcattcatttgaattaggtcttgtttacctgcaacaaacgctatgtaagaaaagtacgaaaggtaagatccttccctctccatccagctgcccagggccctggtatgcctcctgaaaaggcaataactatgggttctaagaagtccttggacactgcaacttcttaacacattcaggacattggaactaagttgacaaaaagaatttataagttatattttaaaataaatttatttatgacaattacacaattgcacagtttacatgctgaggcaaaatatgacgttcaatacatgggaagataaactgtataaaactatctgagctgtgaaaagaagtcactgttcggccaggtgcaatgacttaacgcctgtaatcccagcactctgagaggccgaggcgggaggatcacgagatcaagaccatcctggccaacatggtggaaccccatctctactaaaaatacaaaaatcagctgggcatggtggcacatgcctgtaaggtcccagctactcgggaggctgaggcaggagaatcgcttgaacccgggaggtgaaggttgcagtgagccaagattgtgccactgcactccagcctggggacagagtgagactctgtctcaaaaataaaaataaaaaaaaagaagtcactgttcattatcgaccatcacagaataaatattccaaggctacatataatcccaagttactaaagttttgaaggggaaggttggtctggttttctgtttttttgagacagagtctcactctgttgcccagactgaagtgcaatgcagccttgacctcccaagctaaatcaattctcccccctcagcatcgcgagtagctgagactacaggtgcacaccaccatgcctggttttttgttttttttttttagagactgggttttgccatgttgtccaggctggtctcaaactcttgggctcaagtgatctgcctgcctcagccccacaaagtgctgggattacaggcatgtgccactgtgcccagccaactaaagtttctgtagcgtcaaaagtgtttaaggattccacaaagactaaattctcactaagctatgcaaacaaaggtgctaaaccattccaaccaaaatatgaaagaaacatgtagatgttttataaagctagatttcctaagaaatattaatattaatgaaaacttttctcaatatattaatagaaacaagatgtctgcacatttttccagtttatagatgttaaaaattaagtctcaacaaggtctttaatcatatgtgtataatcctaagtgtataacaacttaggaaatttcagtaattattcctacaataatgaatcacataaaatatatatatgtacacatggcagattatgctaccaagatcagaatgttcaaatcagaaggcagttcatcttgttagaaaatttacccagcaataaaaatctgaagccatcgttagatcaagacaaatttcagtgaaaattctatactggatactgaactggaggtggggggttattcttacaaataatactgaaggattacaataatactgtcaaattatcaaatgtgttaatactacattagccattctactggtatttatggcacaaactgccagatgtagtgcaatactgattcttcccttcctccagagtaagagaacccctgatttttgactaggcacatagtaatttccagcacagaatatactttctagcttctcttgcagttatgtgtgaccttgtgattccgttataatcgaagggacacagcagaagcgatatgtacaatttctggaaagtatcttcacaagaagggagtgtgcccagcttttgccttttcctccttcctgctggtgagaatgcagaactgatgtgagaaagtggagaagccacctctgacaaaaaggaaagagttacatgttgaaggctgggtcccctaatgagcatgaaggtagcatactggttcaggactgtctatgagatacatgaaagaaaggaaacttctatcttgtttaagccattgttatttttggtttctaccactcactgctgaatctaatcctatctaacacacggcaaaattatagagaaagagtactatatttattaaactttactttttcaaatgattttttttgttttgttttgtttttggttttttttttttttttttttgagacagagtcttgctctgtcacccaggctggagtgcagtggcgtgatttcggctcaccgcaacctcggcctcccaggttcaagcgattgtcccggatcccgagtagctaggattacagatgcccgccaccatacccagctattaaataattttgaatacatagtttaaacttactaggattaaaataaactcattttggggggccaggcgcaacagctcacatctctaatcccagcactttaggaatccgaggtgggcggattgtctgaggtcaagagttccagaacaacctagccaatatggtgaaaccccatctctactaaaaatacaaaaattaagccaggtgcagtggctctcgcctataatcccagcactttgggaggctgaggcaggtggatcacttgaggtgaggagttccagaccagcctggtcaacatggtgaaacctcacctctactaaaaatacaaaaattagccaggcatggtggcaggcgcctgtagtcccagctacttgagaggctgaggcaggagaatcacttgaatcccggaggcggaggttgcagtgagcagagattgcaccactgcgctctaccctgggcgataagagtgagaatccgtctcaaaaaaaaaaaaaaaacaaaaacaaaaattagtcaggcatggtggtgtgtgcctgtagtcccagctactcagaaggctgaggcaggagaattgctcgaatctgggaggcaaaagttgcagtgagccaagatcgcgcggttgcactccagcttgggcaacaggagcgagactccatcacaaaacaaaacaaccttcttttttttttttttttttttttttgagacggaatttcacacttgttttccaggctggagtgcaatggcgcgatttcagctcactgcaacctctgcctcccgggttcaagagattctcctgtctcagcctcccaagtagctgagattacaggcattcgccaccatgcccagctaatttttgtacttttagtagaaatggggtttcaccatgttggccaggctggtctcaaacttctgacctcaggcaatccgcccgtgttggcctcccaaagtgctgggattacaggcatgagccactgcacccggccaacaaacttatttttgattattcaaataactaagctctaaaatgttttttctacactatatttgaggtataaaattgttattatcaataattttttggccaggcacggtggctcacacctataatcccccagcactttgggaggcagaggtgggcagatcaccggaggtcaggagttcaagacctgcctggacaacatggcaaaacccatctctactaaaaatacaaaatttagccaggtgtggtggtgatcgcctgtaaccccagctccttgggaggctgagacagcagaattgcttcagcccaggaggcggaggttgcagtgagctgagatcgtccagcttggtgacagagggagactccatctcaaaaaataataataataataataacttcctaagtatgccttggggtcaagcgattaagccaaatctcccttatctctacctcaataataccatacgttaatattattcattcatttaacaaatgaatgcctactgtactcttcgcaagcaaggtgcactgaagtgaccaaagcagatgatgggcctcttcctccgggagtttgcaagccagtatcaatgcagccgaggcagtagaagcctctgcttccctcttctctagcctccaagttcatcactcccctgctgtcatcatattcttgcttcaggctacaatatgagagtacaatgtgactagacttcagctttgctctgctaatataatcacacataatcatattcctcaaagatgacactcctgttaccaaaattagcatcagcatcttaccaaaatgccatagcagttatcactgatggtgggtcagttttccacatggcaaatcttatttatcacaagatatctttccctaactgtaccttatggggttctcttatccttacattttgttgttgttgagacagggtctcactctgtctcccaggctggaaagcaatggcacaatattggctcactgcagccttgacctcctaggctcaaacaatcctcccgcctcagccttctgagtagcttgggctacaggcacgtgctaccacgcctggctaatttttaattttttttgcagagacgggggtcttgttacgttgcccaggctggtctcaaactcctggtctcaagggagcctcctgcctcgacctcccaaagcactaggattacagttgtgagccaccacatccagctttatccttaaatttgaaaaatactttgcagttccgccgccccccacccagtcccagggactatactgaaaaatgtcagaatgtagggctgcttaggcagatagccaaatatttttagttactcctcacaggccattacatcaacctcattagagatttgaagccagaccaacaagaggtcttgctctttccctcaattgcctttcttcttgaatctctctaagaggatggaacactaatcggattgggtcaagagtccacagtactgattgaaccctgtgtacaactatgaagatcaatgaagattaaaagttacacaaatcttgattcaagtgcaagatagaaaaaaaagtcacatacatgtaagagtttgtgttcttgttcttggtcatttcactcttacacactctaaaagactaattgttggggtcttctgcaaagccatcaaccaaagagtagtaagacagtgaaatttaggaggatgagagagcccttgactagtcctggagcttaagtaatatgatgtcaccctgtttactacacaaatttacattggtattttggccaaaagcccaaattaataataaagtaatacttctaatttcctacttgccattgttctacttatataaatctccttcagaggccaggcgtggtgggtcatacctgtagtaacagcactttgggaggccgaggtgggagaatcacttggaccctcaagatcgaggctgcaatgagccgtgatcatgcaccactgcactctagaacctgggcaacagagcaagaccttgtctcaaaaaaaaaaaaaaaaaaaaaaacctccttcaggaagctaagccatgatattctgatcatttattaacaccccaaacttcaaactgtactattactctattcacttggtatttaatcacatattgtttttagcatttcctatattcaaggaatagcaaacattttagaattggtacctcaaagagaatctattcaaaccatctagagttcacccattgtctcctgcagatctcctgattattataaacaacaaagagaacatactggaaagctagatctctagatgacaataacagtaataataaaaagaggctgatatttattgaccatttactatgtgccagggacctttttaaatactttatatgaattaattactttggtcctcacaacaaacccacgagtattattattatctcaattttacagatgaggaaactgagacccagaaaggtaaataacctgcccgaagtcacagagttaataagcagtgggctgcagattgagtctagagctcttaacaacttttctgcaatagcataatagttagttaacggtagacaaatactacagcttggtaagttctgaaacttagggccaaaaagatattcaaggaggcaaaagacaacacagatctgcatctccagagagagattttcaaaatttgaggctggaccaaattggtgtttaaacaaagtattgagggagggctgggtgcagtgactcacgcctgtaatcccagcactttgggaggccaaggcaggcggatcacgaagtcaggagattgagaccatcctggctaacatggtgaaaccctgtctccactaaaaaatacaaaaaattagtcaggcatggtggcaggcgcctgtagtcccagctactcaggaggctgaggcaggaaaatggtgtgaacccgggaggcagagcttgcagtgaactgagatcacaccactgcactccagcctgggcgacagagcgagactttgtcttaaaaaaaaaaaaaaaaaaaaaaagtactgagggagaggttaatggatagaatcatgaggaacatcaatatttaacataaactcagcacattttaggtcaaaatgataatacagtaaggtagtatttgtgtatattatagatatacaacatatattacaaaccaaaatacataatgattatccctactccataggaagtagaacataatttaactataattactataggtttatggtagcatctctgttggctgtagctaagatttttcatgctaagtccttaggcaggaatgcaacctataataatgttactacaagagacaataatctgctttaaaatctttcttcagacatgctttccagggaacagacagttgtgaaacgaaagtcagcctaaatagatggaccatatttcaatgactctaagactcataatgtttgttttacatttgtatagtatgccactggaattaggaaaggtctcacagaggttaactggcatttttttcattcttagcagtatacaaaataataattcattttacaaatgatggcatcttggagtcaataaaatgtttttcagaatacatctaattttaagtgtgaacacacatactgctgtagtcacaggaaaactttctgccttcaagagatgtataatctaataaagagaacataattatctctaaaatataaatggaagtaataaacattaatacaagacatgaagtgatcaaatgagtgagaaggttataacaagaactgaagaaaaggtatttaagtggtaggaaataaaagtggccaaaccaaaaaaacttcaggcactgtgtcctgagcacagtttgttgtttttgtttttgttgttgttgttgttgttgttgttgtttgagacagagtcttgctctgtcgcccaggctggagtgcagtggagcgatctcagctcactgcaacctccgcctcccgggttcaagcgattcttccacctcagccttccgagtactgggattacaggtacccgccatcgtgcccagcaaatgtatttttgtagagacaaagtttcaccatgtttgccaggctggtcttgaattcctgacctcaggtcacccatccgccttggcctcccaaagtgctgggattacaggcatgagccaccgcgcctggcctaaagttatttttaaataaaataaatccagacatagtggctcatgcctgtaatcccaacactttgggataccaaggtgggtagatcacttcagctgagaagttcaagaccagcctgggcaacatggcaaaactctgtctctataaaaaatacaaaaattagctaggtgtgatggtgcatgcctatggtcccagctactcaggtggctgaggcaggaggatcatttgagcccgagggggtcaaggctgcagtgagcagagattgcgccactgcactccaacctggatgacagagcaagacctttcctcaaaaaatttaaatttaaattaaaaaaaattaattttacaggtgcatctcaaactgtgttctattaaactagaatagtagtatctatcccatgagtatctcatgagaaagaaacaggtattctttggggtaagggaggaaaatgaaaaacaaaaaccctctatagtataaaatgtttctgaggctttaaagagctcatgtgcattataaacgtatttcaccccacacttaaaatacttgcagcatattaggaagccataaatacagttcgggaaacactgacttgggtaggcaggtaggtagacaggtagtcagtaggcgggcagagtcacagaaaataaaaggagaataagacaaatgtaataaagtgataccacctaaaaaaaggatcataactgactacgagttatgactatgaagtctcttgaaggaaaataaggtgttagaataagctatcaaaatcaacaatagccgccaggcgcagtggctcacgcctagaatccacttgtgtggatatacttccccagcatagccaggtcctgccagagaacatttccagtgcctccccaggcagttcacacagacagacatatgcccacatgctcatctgctcacactccccctgaactgtattcaccccacacacactgagtgccttcatcactgtactcccttgcttcccaccccagaagcaggaagaaggtcaagaatcagacctttggctgggcatggtggctcacacctgtaatcctaggactttgggtggccaaggtaggaggatcacttgagcctaggacttcaagaccaacctgggcaacatgacaagacttgatttctacaaaaaaaaattagccaggtgtagtggtacacacctctagtcccagtcccagctactcgggaggccaaggagggaggataacttgagcccaggagttcaaggctgcagtgagctatgctcatgccactgcactccagcctgaacaacagagcgagaccctctctcaaaaaagaatcagacttctgggagcctagggaacatatacaggtgccaatgaatgtgtccgtgcatgctctgctaagtgtgtgcatggctgcgtgagctagaatgggtttttgtaggaggagctctgccctgctgctgcaggactgtctgaagatgctgcacagccatgcttcctcacaagctctcttttaaggttagtccaggccaaccacattaatattgtcccctttggggtggtatatttattgcaacacacagcctggacattcatatacagggccatggcactagggtaaggcgccacaaactcctcctgctgaggaggcaacaaggtatctggtcgctaaagctgggtgggacccatatccctgacagtattccagtatgtatgaggcactgcagacctggggtttttgttcttaggtgaggcctggctcgtacggcttaaatttctgttctacttttccccaacttgagatgactcggaagactttctgttccttgcaatgaaaaacagcctaaccaaagtccttaaaagtcatgtatataactactttaaaattaagataaaacccatggcttcgacttctgatgcaaatacccaagacaaatagggtatgaggattcctcaaataccgagtggtttatgaattagaggccacatcattttataactaaccatataaggaaaattttcacagttaaatatattgctcacacttgctgacatactggcaaattttaccagttaaaaatatgccgtgtgcagtggctcacgcctgtaatcccggccctttaggaagccaaggcaggtggatcacttgaggttaggagttcaagaccagcctggccaacatggtaaaaccctgtctcttctaaaaatacaaaaattagccaggtgtggtggcacatgtctgtaatcccagctactcgggagactgaggcaggaaaatcgcttgaacctgggaagcaaagttgcagtgagccgagatcgtgccatcgcactccagcctgggtgacagagcaagactccatctcgaaaaataataataataataattttacactggcacagaccactttaccaaaaaaagcatcttatattaactgtactctctgacctagttacctaatgtacagacacacagtacatcttatattacttggcacaccaacaagttagctatacaaatcacaattccaacccaaacttgaagctagtaaatatatttagtatttgaacttgagttgtgttcaaatgttcattaaattggcctatgcaatcttaacaatgttctaacacatatttaaaatgctcatttctcctccattatttaaaaaaaaaacacacacacacacaaactataactctgttagacaagaaaccaaacataagccaaaaggctcggcaaaatcacacttaaataggacaaggagagcttcaacttcagaataattatcaggataccaatcacacaaatatgattcaacaatcacttaaatatcattcaagaggaattcctggtagtaaaaaaagaaatcccgtaattaactagagcacagcattatcagaaactgattatgtaaaacaatagcttttctttcaggatgtgtgtatgtgtgtgtaacgaagttcacagctaggttacactaatgactcacttaaacatttgaattttctgctatcttaacctttaaatcgactgcaaaagtagctgccaaaagtagcttagtaggaaagcatactactctcaaaagaacttggtatgtccaacttattttactacttaaattttttttgatcactgatatttgaaactaatttttaagtaatgaatgcttactaaatccatgataatattcagcatatacaggtttttagaagggcacagattatattcttatatgtgtgtttttacagcacctggaacatttctgttcagtatctgttcagtattacacataattattgcaggacctgacagtgtttactatcctattttttcctttttttttttttttttttagacagagtctcgctgtgtcacccaggatggagtacagtggtgccaatctcagctccctgcaacctctgcctctgagttcaagcaattatcgtgcctcagccccccaagtagctgggattacagccacgcgccaaagtgccaggctaatttttgtatttttagtagagacgaggtttcaccatgttggccaggctggtctcgaactcctgacctcaagtggtccactcgccttggcctcccaaagtgctgggattacaggcgtgagccaccgcactaggccttactgtcctattttttaaaagctttttcgactgaccagtaaatcaaagttgaaaaggtaactggtacattttatttcttgatttggattacctttttgttgtgaattggttctcagttctagtttccttgtgacaaaacactgatggagaatatattgaactgaaatcccctgaatccattcccactgagaaaataatacatttgaactgttcacatttcattgtaaaagatacacaactttagagattactcttgaagttttgaaagtaaagtgaatcagaagtcacattcctagaagcagtcagtctggaacagatgtttatcctacacacccagtcccctttaccactgcaaacctctctaatagttcattacattagaacaactgagatgggccaggatttgtgaaaataaaaatcctttgagacatttattaagcagattatctctgaaactgcaccttagtttacaagcctttgggcaacaatttgaccctcttctatgataatttgtgtacacactcatttcacattttctctggcttccaattttaaattctttatctaatccatacaataagtcaccctatcagactttataagactactgaaaacaacactactgcaatgcaaggccactacatttgcaaaattgccgattttagtgagatttccctccttcaactcctcctctacccctctacctggtttaaatcccaagaaaaacctctgtccagtgctacaattttactttccatagagtaggtttatttgattttttattaatgatactaaaaacttttttaaaagactgctggtgtatatagtttccaatactgggaacagaaataaaccctctggtttaatatttcaagagaaattatctcataaaagatgagaaggtatcattcaaaggagtcctgggaagtcacaaagtgtaaatacttctggtaacagaacaaattaatgtcgaagcacaaccagtaacataataatgcctcaatgcaaccgtgcctgtcaaaggacatctgtattagcagctcggggaagtggcatttgcagaaaggcacaacaactgcgcttaaaagaaaatcattaagcctcagccattaatcccctcccccatcctcttcgtctggatctttccaaacaattaaccagtagaaggtgctattctgcaacccacatgtattcacaccaacctccatccttgggccacagctgggtttatcccaggtggactagcctattccctgtccagtattcaaaggagccccctaaacagaaaaccagatcttttcttataacccttatttacaaaaacaacattgacagctcaattgccagcaaacctgaccatcaaaccatcacaccactaaaaacatgcaaacatcatcttgctaaatattaacctcaatacaacctttataatattaatcaataaaatctatttctatctagaaagactctgctcacattcactactaagactcaagtgaacaaatcactgtccccaacaaaatcagggtcaatgagaaatacaaaagcaatgagagctgaacgtaaggccacaacatataaagagggattttatctttacatatacaaaaaagaaagagcagcagaaaccacggctgcaaaaggaataaagggaggcagagagaagagaagtctctgaacatgtttttgagtgtcctttagtttccaatgcactcttctgcctcacaaggttgcaaaaacggccaggcatgagatgggtggaagaaagctgtaacagaaaagcaccctcccttcccccatcttctctcttctctcccaaaaagagctgtgtttgtctgtgcaaacctagtcccaaatatgggagagagagaatgaatgtgtgtatggaagaacaatgagccctcagcttggtattgtgtgtgtgtgtatgtgtgtgtgtgtgtgtgtatatgtgtgtctgtctgcctctgcctcttttcccttcgacctcaacaacaacagggagagctggaagccagctttccacccatcccaggccatcaaaatcaaaactggttgataatttacagtagtattaactcagcaagcaaatccatggaacaaaatatcaacccaaagatgattttattattgtacagatccagcttctctcccctcccccaacagactgagactaaaaagaccagtgtacactagacaaaaaggtctctctttaaatggaaagcaattatgaaaactgtttcaaatcttagatgcatcaattcctgctatattaaaatgtctattttgtaattcaccaagttcaccctcttactagttatctttttttgcgtttaaaaattcgctgtgaagaaggctatttcacgattcatacaaaactactttctaaatgtaccttaaaaaagcaacagatactgaaacatttaaagcacccagtttctcaaggacccattttacttaaatcaatgtttgaagtctgtaatccagaaaaattgtaagcaaaccttggaaaagagacagaggaaaatgacaattcaacaatgaatcattctgttttcctttcaacaacttctcaagcaaccagtttcaaaggaagcctgcaacacttttcccccctcctagcagacacacatacacacgtgtatgtaaaactacgaatctttccatcatcttaaaaattagtaataaatagaagccaccctccttcagagagcagaactaaaacaggatagtaagaattctattctgctgcaagtgactttgggtttcataattttctaatcacatacagctgagaactagagattgggagcacaaagaggaaatcttcccccaatgagaaaatgatactttaataataaagtcctccccccagcaccccgaaatccacaaacattcaagaaatttacagtttcagtccttgacttccttcccttccagtttcagccaataatgtagtcacatgaaatagtttaacctcaaacaagtagaacaagagcatgaataagaggccaagagagagcaggggtcagaaggcacgcaggaacggtcacctggcccggacaggaccaaagaagtgccctgccctcgcccgactcccctcgacttcggcttcgaccccagccttttcttcctgcctccccccgggcgagtgactgctttcacggccgaccctctctgaccaccaggacgaggggccaaaaaagaaagcacacgacccggcgcgggcaagttggacacttaccttcccctaaagcgctacaccatcaatagtgaggtgttcgcggcccagctccggggaaagtggcggggatggggcgggaggccgcgcggaggctgcggggccgcggggcgcagggccgagaggggcggcccgcggggaggcgacgcggaggggctgagggggcttccctgccgtgacctttcctgcgacttgaacctaggctccctcctcctcggtcgggcagatctttcagaagcaggagcccaggatcatgtctggttttgttttccgagggcgagggggctccctgaggatgatggtgatttttttttttttttaatcctcaactaggagagaaaatgaggcagagacaatgtggggagcgagagaggggaaaaggacgggggaggaggcggggaccgaggcccagcggggcgagcgtctcggggtgtgcgggaggctgaggaggctccggagcgcggagggttgctcgcgagcgtctgtgggaacagcggcacctccgcgatggtggcggagccgcggcggagctgctgcaccgacccgccgcccactccccgctcgggcccggcccacctcgcagtatcgcgcccctccattggtacagcgcggtgtgacgcggccgggggcccggccaatgggaggcggaggaggcgggatctctttttccttttttttttttttttttttttttttttaatctttttaataaaatgagcagagaagaaggcggagagaggccgagccttgacaacgccgcggcccggggctcgagggctcgcgctgcaggcggcggccagaggcggtgggctgggctcccgccgcgggcgcgtctttgtgagagtgcgaggccggccctcctccgccgcccgccgcgctccagtaccgccccccgcgccccccgggctgggccgggctggcggcgcgggcaggtcccgggtggggtggggggaagtccggttgatcttgctgttacccgggtcttaattggccttttcagtcattaggacgcggatccatgttgctgcgggctacagagtgggtgtaaaccattctcatatggactctttcgaaattctgatgagcggcttgtaatatttttcaaatagtgtacatgacaaaagatgaattacagaaagaaaaataaaagtgataagtcgcactgcttatttgaaaagaataaaaagtgtcatgaaggcataaaggagagactgtacaggtacagaagggattttagaaagagcagtgtacaactctataaggtacgtgtgaaaaaaaatctaaaaagaggaaaagaccaaacatcacctctttttctttgaagaatgaagtattgtgtcccacttcccgaaagcctgataatcacagggtctatcatgctgtaaagggagtaggggcaggccaaatgatcatattctagttcatataatttatgggattgaggggtttggaaatttcaattatgattagcagtttttgaaatgcacatcatgtttattgagttctttcacagagcctggcacgaatccagggtgaatcatcaacctattgttggtttgttaatattctgtaaatgcttattggtgtccttataccatacactcttcccgaaggagttaaggtccgtataaaataaggggtagaaaacgtagcacaaaataattcactcatctgtttcaaaagaagtgataattttctccttggaaaatctattcagattataatttccacattgaattattcattttttttttttttctgagagggagtttcactcttgttgcccaggctggagtgcaatggcgcgatctcggctcaccgccacctccgcctcctcagttcaagcgattctcctgcctcagcttcccgagtagctgagattacaggcatgcgccaccacacccagctaattttgtatttttagtagagatggggtttctccatgttggtcaggctggtctcgaactcctgacctcaggtgatccgcccgcctcagcctcccaaagtgctggaattacaggcgtgagccaccgcacccggcccacattcaattattctttaaagaataatttggactaacagatactattggaccatgacccaagagatcttaaaaaaaaaaaaaaaagccatagatccttgccatcacatttctgagtaactttcagcaagaaaaatcctctttgctggagttatgaaatggggaaactagttaatatctctttatatatctgataatgtgagaactgaattttaaaacctaataaattcaataaactgcttccaacattctagatatggataggactatctgacttcctgtttggaaatgatgagggataaagtatatcagttagatggcttcactttccatcaaaatctctatctacaggagcattctttcttttttttcttttttttttttttgagacagagtctcgctctgttgcccaggctggagtgcagtggcacgatctcagctcactgcaacctccacctcctcggttgaagcgattctcctgcctcagcctcctgagtagctgaaattacaggtgtgtgccgccacacccaactaacttttgtaattttagtagagatggaggttcactatgttgcccaggctggtctcgaaacttacaggagcattatttctaataaagattcagctctgtggtagacaaatggacaatgcactgccatccagcagggaggagagaggctctccacgttaggaaataacatttactatggtattagggattggccgtcactttcatttatccataaaaatgtaaatttagaagtccagaaatgccacatagttacaaagcataatatatggtatcagaccacaaaattagcaaactaaacccatttaactgtaacagtcccacgaaagaattgtggtccagccataaagccggagagtactggacctccttccaaggatctgagaagctgataatgcagtaaaataatcttcatcgttaagaacaactattaaactattgattgaaagcttatgttcccagtgccctaagaaacatgttacattctttagcccactttttctccccatgaagtgtattattattatctctttttttttttttttttttttttgagacagtttcgatcttgttgcccaggctggagtgcaatggcgcgatctcagatcaccgcaacctctgacccccgggtttaagcgattttcctgcctcagcctcctgagcagctgggattacaggcatgtgccaccatgcccagctaattttgtatttttagtagagacagggtttttccatgttggtcaggctggtctcgaactcccaacctcagatgatccgcccgcctcagcctcccaaaatgctgggattacaggcgtgagccactgctcccggcttattatctccattttaaaagtcaaggaactggggcttacggaagttaaagaactagctgaagattaaagacgtaaaataccgacttggatttttttcccatattaaatttttaaaagtttccttattctcttttcagcaatatttttaagtgggaattaagtaaataaagtagttattgaatctgaaaatatcaaggactttttttagttattttatgtatcttactacaggtaagaagtgatttttttttaaatatacagagatcacatcagagctgtattaaaggaagatggaaaatggggattatttaataaatgatattgggacaacaagatagctatatggggaaacaaaaaacaacaacacacacccactagattcatattactcctaacacaccccacccccaaaatcacaggtggatttctttatttttttaattgaaattttttttttttggagcccaggaatttgagactactctgagcaacataatgagacccccatctctacaaaaaaattttaaaaattagctgagtgtgatggcacatgcctgtagtccaggctatttgggaagctgaggtgggaggatggcttcagcctgggaggttgaggctgcagtgagctgtgatcatgccactgcattccaacctggtgacaagagtgagaccctgtctcaaaggaaaaaaaaaaaggaagttagcccttgcttatacgtgttgaaaatgtttctccccagtctgcctgtttcttgcattgctatggtgtttttatgccttatagggatgtgaaatatttatgcagtaaaatttattggtgttttttcctttatggcgtctggatttcctgccatgttagaaagagcttcttcaatccatgatttgaaaaagttttagtgttcttctaatacttttgatttcattttttaaaatcataaaaatttggcatagacaaaagaatatacattatgtgtacataggttgagggggataataataaaataaacaccagtaaactcaacctaagaaattgtggtttagtggtttcacttttttaatcatttattttaattttttttagagacaaggacttttttcttttcatatcaagcatggataattcttataattaaaaaaaaccattcaagttctttgaacatacagctggtaactagtcttcataattcaccagcagtactcaagctttagaacatgtaaattattttcccctaaaatgccttaagcagaactagggtgctttagcaggccttgtagcagactgaagcttgtttctaggcattttctatgaaattggcttccaagtttatgtagtgcaaatataagccaataacgagcctcagctatatctcccgttgcactttttcaggttgagcctccagcagcacttctttcttccccactgccagttctccgagctcaccttgcatttacccacagcgggttttcactttataatttattgtaaatcgaaatttctccctctccagttttttccccttgggccaggtaagtaacccctggtagcctttgaaagtccctgcactgaattggaacggagaaatggttgatgtttcagagcacatgtgtgagcaaatacagagagaggtgaaacagcttttcaaaacaaaggatcaaatatcagaaacccttttcctttgtttggctgtgatttattgtggattagcaattaagatttccaattctggccgggcacagtggctcatgcctgtaatcccagcactttgggaggccgaggtgggcagatcacctgaggtcaggagtctgagaccagcctgaccaacatggtgaaaccccatctctactaaaaatacaaaattagccgggcatggtggtgcatgcctgtaatcccagctactcggaaggctgagccaggagaatcacttaaacccagaaggtggaggttgcagtgagccgcgatggcgccattgcaccccaggttgggcaacaagagcaaaactccatctcaaaaaaaaaaaagatttccaattcaactctagaccctattgaattttatttccaccaaggtagaagtgggcctgattaccaacacacttacagatagatctcaagaaaccctgcttcactgggccacgtcggatttatgggagggatgcccttccctttgagtcgcactttgagccacagcatgttgtctggggcactaggatgccgtttggatgagatctaaacccaacatctgacttctgaccacttgtggttattaaaagtctcctagggcttgtgaaagaattaaagggaggagacgctgattttcattgtcttggcccaattccaagtttgataattaggagtcctcctccctctgtcttcctgccatttcactgagacatgcaattccacacttcctgttataaacagctgtccactgttaactgagtgagccagagagccagcaaattccaccctaggggaagctgcatttcaaaataaacatttcctccacatctacttgtaaattacctaggtttaccttggaggaaaggtgttattttctagggataagaagggcataataatggggagttgagaactatccacaaaccctagtttgtctaaacaccaaacaaacaagactaacattgatcacaaaggggccctcagaagaaatctcctcactaaagaaaatacattttagattctaaaattgtctttagggggtccagaatttaattgtataacattgatgtggcaggtgctattagccaccaaaactcacttcttcaatccaaggcatctacacaaacagaataaagaggaaaaactctgtaaccccggaaaaaaaaaaaaaaaaaaaaaaaaaacagaaaaattcacctccgccatccacgctccggtgtcgatgtgacacatgcctggacactcattttagtgcttccctcctctttgttcagcttttccaggcaccttaatttcaaaatatccacattcccattcctttcaatgccaaatatctccttctactactccagtttccagaataaattctgctatggctgggcacagtggctcacgcctgtaatcctagcactttgggaggccaaggcgggtggatcaccagaggtcaggagttcgagaccagcctggccaacatggtgaaaccccatctctacaaaaattcaaaaaattagccgggcatggtggtgggcacctgtaatcccagctgctcaggagcctaaggcaggagaatcgcttgaacccgggaagcagaggttgcagtgagctgagatcatgccactgcactccagcctgggccacaaagcgagactccatctcaaaaaataaataaaataaattctgctacatttgcttttttaaaatcttattaataaaaacagcattttaacatggaagcaaccaagatgtccttcattaggtgaacagataaactgtgatacattcatgcaatgcagtattattccacactaaaaaggaacgtgctatcaagccaggaaaaggcatggaggtgctgggtgtggtggctcactcctataatcccagcactttgagagccaaaggcaggaggatctcttgaggccaggagttagagaccagcctgagcaaaatggtgagactccggctccacaaaaatagtaatgatctttaaaaataaaaataaaaaataaagaaaaggtgtaaggaacattaaaggcatattaccatgtggaagaaaccaatgtgaaaaggctacataccatatgaatccaactatctgacattctggaaaaggcaaaactatgtctaggaaaggcatattctgggaaaggcagtaaagggcttagtggttgcgagggctttgacagggggagggataactaggtggagcacaggagatttttaggacagtgaaactattattctgcatgatactttattggtggatatatgttactatacatttgtcaaaacccacagaatgggccaggcgccgtggctcacgcctataatcccagcactttgtaaagggaggcagaggcaggaggatcatttgagcccaggagttcaaggctgcagtgagctgtgattgcgccactgcactccagcctgggcgacagagggagactctgtctccaaaaacaaaaaggctgagtgcagtggatcatacctgtaatcccagcactttgggaggccaaggcaggcagatcacttgaggtcaggagttctagaccaggcaggccaacatggtgaaaccccatctctactaaaaatacaaaaaagtagcccggtggcacgtgcctgtaattccagctacccgggaggctgaggcaggagaattgcttgagcctgggaggcagaggttgcagtgagccaagattgcaccactacactccagcctgggcaacaaagcaagactctgtctcaaaaataaataggctgggcgcggtggctcacgcctgtaatcccagcactttgggcagccgaggcgggtggatcccgaggtcaggagttcaagaccagcctggccaagatgatgaaaccccgtctctactaaaaatacaaaaaattagctgggcgtggtggcacgcgcctgtaatcccagctactccagaggctgaggcagagaattgcttaaacctggagaggcggaggttgcagtgagccgagatcgcgccactgcactccagcctgggcaacagagcgagactccgtctcaaaaaaataaaataaataaataaataaaataaacgatggactttagtgaataagactgtatcaacattgactcatcagtcataacaaagagaccacactgacaggagatgttaataacaggggtagcagtggggagtgaggggtatacaggaactctgtcctttgggctcaattttgctgtgaacctaaaaccgctctaaaaaatgaagtctattggccaggcgtggtggctcacgcctgtaatcccagcaccttagggattacacacccgtaatcctagcgaggcaggtggatcacctgaggtcaggagttcaagaccagcctggccaacatggtgaaaccccatctctactaaaaatacaaaaaagtagctggacgtgatggtgggcgcctgtaatcccagctactcgggaggctgaggcaggagaattgcttgaacccgggaggtggaggttgcagtgagccgagatcacaccattgcactccagcctggggaagacgagcaaaactccatctcgaaaattaagagtctattaatcaaaaaagcaagagcatttgagttctgtcctttttatggtgaagaatggagacttactcaacatctgaagtacagatttagcatgaggaggttccaacgtggaagccaggcaaagcagagcaatctgacctcaggaagggaagagacagaagtgaggccacgggaaggtcgggactgcagctctcttcccagcgttaatgtcactggtcccctgttctcatcttcccaccccccggcctcctcaccctgcaccacgtggcttttcttgacttcacagccttcttctatttgcacctccctcgtaattgcggcttgcatgtggcttctcacagcctctccggttgttccgcagcttatgactgagcagcttgggcggcttctgccaactcctcatgacttcagtatttcctagttaaaattcctaagaggaagaaacctaattggcccaggtcatcctttcaggccccaccctggcctggccactgaaggctgtcagccatcggtcagtgcacagccaggctgtcccagggagctgcttccccaaaggctcagtaggacagcttgtctgaagatgggcccaggggtgtgacagctctcctgatgtgtcacacaaataccagagtatcaccttagctggggatacattccagacccccacggatgcctgaaaccttggacagtaaaccatttctactatgctttttcctaggcattcacacctaagataaagtttaatttataaattaagcacagtaggccgagcacagtggctcacgcctgtaatcgcaacactctgggaggccgaggagtgggggagtggatcatgaagtcaggagttcgagaccagcctgaccaacatggtgaaaccccgtctgtactaaaaatacaaaaattagctgggcatggtggtgcgtgcctgtaatcccagctactcaggaggctgaggcaagagaatcgcttgaacccaggaggtggaggttgcaatgagccgagatcgtgccactacactccagcctgggcgacagagtgacactcaatctcaaaaaaaaaaaaaaaggaaaatgaaaaaaatttttaaaaaattaagcacagtaaaagattaacaagaggactggggcgtggtggctcacgcccgtaatcccagcactttgggaggccaaagtgcaaggatcctttgagcccaggagttcgagaccagcctgggcaacaaagtgagactctgtctttacaaaaaatacaaaaagttacccagatgtggggacgcacacctgtagtcccagctacctgggaggctgaggtgggagaatcacctgagctccagaggttgaggctgcagtgagcactgatcacaccactccactcctgcttgggcaacagagtaagactctgtctcaaaacaaaaaacaatacagtgcaataaaagttacatgggccaagaaccgtggctcacacttctaatgcctgtaatcccagcattttgggaggctgatgcaggagaatcacttgagcccagaagttcgagaccagcctgagcaacacagggagatcccatatctacaaaaatacaaaaattggccaggcacagtggctgatgcttgttatccctgtactttgggaggccgagacgggcagatcacctgaggtcaggggtttga

SEQ ID NO: 1167 - DNA, 33852 bp, Homo sapiens
acctcagtgaaacttttagggcccagtaggctgcttgaatgccaagatatccccttcacagtaaaggacaaattattgcatctcacccactcatttcaccaaaattattctgccaccagggaagcacaccaagctgtgtaggcttctgtgggaattcagaagttggcagtactgttctgactcgtaaactgggtgagatagaaatctgccagttttcagtgggatccatagcatgtaaaagttctctagcaggtatggtgtatttagccctgttgcatggaccaattcaggatattctatgggacaagagtaaatgtgataagaagccatgaaagttgaaggcaagctccaatgggagaatcacaaggtcgactcctggcattctgtggcaaggctgggccatctgcagtgcaaaatcccaaaaacaactctatccatgctaatgtgccttggtaagaactgattatggacatcaagtgaccatgtagccagagaggcccatcatgagctgggcaaaggcaggtggtcaggctcccatgtcatatctgattctttaccaatgtcccttcctcagctcacaattatggccacttgggaggctctcatgtctagcttatggaggacaaaaaagcctgagctgaattcactgaggtttcttggaatataggttcaaaacaaaaatggactgctactgccctacagccccacacaggactggccttaaaagacagcagtaaggagaaccctcccaaaaggcataatgtggggcagtattcctggtcatcaactgtgtgtggaaagaaagtgtcttgaactaagaacatattttcatggcaaataagttggctagttgatcaggggtctggaataagactggtatatcagggacaagaagtctggagaagcagaggagaaatatatcagatatggcacataaggagggctttttgtattgtataacacaatctttatctgccagagacaatccaacatgtaagcagcattaaataaccaagtagacagatttagccagtaaacttcagcagctacaaccatcggctccaccgccccctccctccgcccccaggaatggcacagggggcttatgacaaagtagtcatcttgcaggaatgcaagtgagcaagaagccaatagatagcctccacttatccaatagccactccccaggctgggcgcggtggctcctgtctgtaatcccagcactttgggaggctgaggtgggcggatcacctgaggtctggagtttgagaccagcctgaccaacatggagaaaccccgtctctactaaaaatacaaaattagctggccgtggtggcgcatgcctgtaatcccagctactcacgaggctgaggcaggagaatcccttgaacccaggaggcagaggttgcagtgagccgagatggcgccacggcactccagcctgggcaaccagtgaaactccgtctcaaacaaaacaaaacaacaacaacaacaacaacaaaatagccactccccagtgttaaacaccaagttcctgatacagcaccaaccctcaaggataccaaacagctacttgggcagcaaattgatttatgttggattccttccatcctagaatgggcagtgattctccttgactagaaactgcccatctgcatgtatgagtttgacttccttgcctataagttgttggccagctctactactcacaggtttacaggtatttgatccatcaacatgtatcctgtgtaatattgcctttgatttagggatgcactttacagcaaaggaggtgtatcagcaggtacataaccatgagatccactagtcctatcacatactatataaccgagaaaatgcgggtctgatggaatgatgaaaaacccttttgaaggtgaaactgaagcaaaagcttgaagataatagcctgtgaaaatggaatgaccttgtccaccagggtacagtatatactctaaatcaacactcattttatggtgctgtgtctcatatatacataacatgcatgtttgggaatgaaaggatataaatagaattcctactgtgtagtaggctgaataatggcccccaaatatgttcagatcctaatcctggattctatgaatattttaccttcaagataaaagagactttgtggatatgactaagttaatgatctcaagatacagagattatcctggactatccaataggcccaatataatcataaagattcttacaagagagaggcagatttgcctagtagatgcaatgacttaagcaggaggatggggtgatatgagtaaggggccatgagccaagaaatgtaggtagcctctagaaattgaaaaaggcaaggaaacagactttttcttgaagacttcaggaaaaacagtccagttgatatcttgattttaggcttccagaactgtaagaaaataaatttgtgttgtttgaaaccactaagttcgtagtgtcatagcagtgataggaaattaatataaccacatactctcactcccagtgacccaagtggggagtttggacttctcatccccgcaactttgtgaattagaagtcctgattcccaagagaggaaccttttcatcaagagacacaataatagatcctttaaactttaacttgctgaggtttcccggttcaaggtccttgtgctaggagaccagcaggcaaggaagagtcaccatgttagttggggtaaatgaatccaatcatcaggaggaaatagcgttattgctacacgatgatggcaggaaggaatatacctgtagtttacactcaagaccatatagtggtctcttgatatgtcccaatatcaagtaaagtggacaacttccaaaacagcagggtaaacatctccaaatactggcttctctataaaagcaatgagaacacaggcaaaaatggtcagtcaactttttcagaactctagaaagtaactaaaagcttgaaataatctgaggtgcctctatttgagaaaaacagctaaatcttggtaaacagggaagcattttaacttgccttattcccagcccccacctcttaatacaatgataaatagtaatggtgacagtgagcaaccttcttactcttaactttagggagaatgcttccagcatgtttcaccattaagtgatatgctgtcctttgttaagcagtatccagagtcctattatattgttggcttatcatgtttcccactgcactctagtgtcacttttctaatgaatcaagtgaccctatatgtgtggagtttttctagactttctgttctgttctgttccatgggtcagtttttctatccatgcaccaatactatctcgtcttcattactatagcttagaataggtcctgatgtctcacagtataaatccttcaactttgttttttaagactgccttaggtattcttgaccttttccagtttcttaggaattttaaaattggctttttgatttttggaaaaaagaacctgctgagatttttttttaattgagattacatagaatatataggtcaacatctttacaatactgaatcttccatcttgaagttttattatatccagttgggtgtaactgtgaaatgagaagcaattatcagaaacccggattacaggatcccacctaaggtgaaaggtcctatacttcccatcagtgggatactatagccatcttctctgggctctctgctttgacagatgttttcaacttaagtattacctgtattcttcctctcagcagtatctcagtcctcagattatgcttgaccgtcaccgaagatgaacatattttatcattcactcatattctaatgtaaattaagtcctacttatttcatacaataattcgaactaatatcttcacagcactcctgagtcataaatggagtcactgcaaagtgctgtgcactgcaaagtgctgtgtgtagtaacaggggttccaatgagtgtatctcctacaattggtttactacatgctatactaggtatttaagatgtattgctttaattcttgtaaaaaagcaagagaacatacttgcagaggatcagatcttaggctctggaatcagaaaaatatgaatcagaaacctggctctgccactactattgactgattagttctgtgtccttggacaagtttggtgagggctaaattggatagtgcatgtcatgtatttcatatcttatgtggcaatattcttttccccaaatgatactaaagattagacagcttaaatactttgcctcaagacacagaactagaaagaggcagaagagggctagcatactgccaagcacatagaaagtattcagtaaatgtctgctgaatgaacaaaccacagtcagtatatactcaacatttacttcaaataccactatattctctgttgtttcctttaacttatgcaacaaacttaaaatattttttatttccataggtttttggggaacaggtagtatttggtttcacaggtaagttctttagtggtgatttgtgagattttggtctacccatcacccaagcagtatacactgaacccaatttgtagtcttttatcccttaccctcttcccaccctttccccgagtccccaaattctatcatgtcattcttatgcctttgcattttcatagcttagctcccacttatgagaacatatgatatttggttttccattcctgagttacttcacctagaataatagtctcctatctcattcaggtcgctgcgaatgccattaattcattcctttttatggctgagtagtattctgtcatatatttataccacagtttctttatccactcattgattgataggcatttgggttggttccacatttttgcaattacgaagtgtgctgctataaacatgcatgtccaagtatctttttcatgtaatgacttcttttcctctgggtagataacccagtagtgggaatcctggatcaaatggtaattctagttttagttctttaaggagtctccacactgttttccatagtggttgtactagtttacattcccacttctacatacacagcagtgtagaagtagcaaaaacaaactcttactatttatttggcatctacaaaaccagaaaattcaaatagaattttgatgggcacatctgaatttactttaatgagaagagaaaaaccataaagtaatttaggataagagatcaattgcagtaattcccagggtctgagaaaaagttatggcatatattttcaccatcaatcctacttgctttggttggaatgtgtcccccaaattgcatgcattggaaacttaatccccaatatggcagtactgaaaggtggggcctttaagaagtgattgggtcatgagggctggtgatccattcatggactaatgggttgatagattaatgggttactataagagtgggattggtggctttttttttttttttttttttttgagacagactcttgctctgttgcccaggctggagtgcagtggtgtgatctcggcttactgcaacctctgcctccctggttcaagcgattctcctgcctcagcctcccaccacgccaggctaattttttgtatttttagtagagatggggtttcaccacgttggccaggcttgtctcaaactcctgaccttaggtgatccacccacctcggcctcccaaagtgctgggattacaggcgtgagccaccgtgcctggcctgggactggtggcttcataaaaagaggaagaaaggcctgagtgggcatgctcagcccccctgatccctgcagtccccaccagcaacaagattctccccagatgtggtccctccaccttgaaattctcagcctcctccctaactgccagaaatgaattccttttctttataaattacccagtttcaggcattctgttataaaccacagaatacagactaggacactacccttcctaccagtatccctatcttccacttgaagaaaatacatattagtagaagtggggagtgaaggggttaaatccaagtgcatgtttcctactgcctcctcccactacagaagctagggtgcagatacatgatccaataagcttgaccaattggatggtgatgtaatttggatctcccctgcaaatctcatgttgagatgtaattcccagttagaggtagggcctggtggtgtttgggtcatggggactgatccctgatggcttggtgttgtcctcaccatagtgagttctcatgagatctgattgtttaaaagtgtgtgacacctatccccaccccctcgctcctgtttttgccatgtgaagtgcctgatcctacttcaccttccaccatgagcaaaagcttcctgaggcctccccagaagcagatgcaggcactaggtttcctgtacagcctgtagaaccgtgagccaattaaacttcttttcttataaattactcagcctcaggtacttatagcaatgcaagaatggcctaatataggtggtctctcctgggacttgaaatcttgaggaataatgaaaataaccccttaataaattccctttttgcttaagataacccagaagaatcagtttctgttgtaggaaacaaagacttcattaatgcaaatgtcaagagaaaattcaaactagtttttacacatcctacctgtaaaagttttgaaagctactaaaaggctttctgagctgttaaatctgaaggatttataacagattgttattttcaaacacgagtattctatgtatacagtttgtgtgtgtgtgtattcacacacacacacacacacactcatgaaccacactgtgcagactcaatataaatgtacacctgagttgtgcaacattcaaatcaatgcagaaatcaagcaaagattagattcagtgaattgtagctatttcttggaaacattaccttttttttgagacagggtctcactctgtcacccaggctagagtacagtggcgtgatcttggctcactgcaacctctgctacccaggctcaaggcaggctcaagtgatcctcccacctcagcctcctgagcagctggtaccacaggcctatgccaccatgcccagctatttttttttcccccaagacagagtctcactctgtcacccaggctgcagtgcagtggcgccatcctggctcactgcaacctccgcctctcgggtttaagcaattctcctgcctcagcctcccaagtagttgggattacaggtgcccaccatcacacccggctaatttttgtatatttaatagacatgggggttttaccatgtcggccaggctgatctcgaactcctgaccttgtgatccgcccgcctcggcctctcaaagtgctggaattacaggtgtgagccaccgcgcccagcccacatccagctatttttacaatttttttgtaaagatatagttttgccttgttggacaggctcgtcttgaacttctggctcaagcaatccaccctccttggcctcccaaagtgccgggatttcaggcataagccaccacacccagctggaaacatcttttatcttaaaaattcctaagcatcctataaattacctcattactataaatttaattttaacgtagtattttaacacagttgccaggacctcattcaaaccttcattttatagatggagaaagagagctcacacaggggtgtccaagggagataatacagtcatgggttcttagtttccgcttctggttgggtcagtaaatacctcctcatctctcttttccgcttatcactagaaacagaaactaaaaaccatggcttcaggctgttaacagcctaaaacaaaacagaacaacaacagtaacaaaataaggtgggttggacaagtttggcagagagcctgcttggagaagctgtgtgaaaaaaaaaaaagactgccaccgctcctgaaagttctcggcccaagatggaatttagtcaaagaaactcttacactaataaaatttgtacatcaaattaagatcagggacagttaaaacattaataaagactgaagcatttgttcatttaaaaaattttatttaatatttacatttatttttaaaataaaaattagaggaaagcccatgaactcattttccatgaacataatataatagtactcacctatctcctctacccaacttgtgttttagatgagtccttttggatctttttccccataatggcctctctccttttgctttacagtgcaatcagggcagaataacagatatgttgagtagctaatttatatttctgaagatctccatagaactcttaagttctaagtcttcatagtctttgcaccttgccaagtttgctttcctttgggaattctgtcataaccacaaggttattccccagacatgcagtttggggaaattaacccggcagtagtaaacagactggattagaaaaggtggcagtcgtaataaggatattccaataaccggggaaagctacagaaggatcttgagttaggatgatgacagttacaatagaaaggagaccagtacaagagacggtgaaaacagaatggatacaatttagttgaagaattggctgtgggtgaaaagaagaaatcaaagatgcctgaagttgtgagtttcaggtagccctgagtttataatcctagttctgactcgtactatctttggatatactagctgctgactactaactgaacaaggtagtaaccttgtcatcttgtaacttacctaagtctgtttcctcctctataaaacaaactatcaaaataaagccgatgaaaagattgaagtaaaacataaaacccttagcacagtgcctagtatccattaagcagtagataaatgatggcggtcattattagggagtagggtaaagaacagaaggttaaaaacatgagtagcagtaaggacttttgggtggggattcggtctttctactacacattacacatacctctaagcagagaaaggggttggaggggagtttgataatgtgactaataatcctcctccccctgggggggatcttgataaaggatagccacccacatggaggcctaatataaactggattgcagaatgcacttgagctgggagcccaagcgggccaggcttcttgattcctattttatcccctttaacctaggatagctaggtctatagtgcagactcagacctaacttacactttcatttgcagctgaagtttcggaacaaagacaaagatagccagatcatattaattacacggataggcaagaaagcatgagccctgaggaggaaggaagggactgtccaggtgtacttacctcaaagatgagaaatatcaaagacaggaaaccctaggttcttgcccttcagtcgctatctccttgccattagtaaaatgcggccgatgaatgtcctcacttctgtccatctgggcaggaggtgggaagggtgacgtgcaaatggatgggaggaacccttttttcggcagcacccaccacacccagcctagtgccacgcaccgcaagcgctccataaacgcacacagcgtcgcctctaccaggatcccgggcggccttcgcgggatttctcctggcgtcggctttcagactcccgagggtgggataaatcgagagggtggcatcctttggcttttcttctcccaggcagctctgaaccatgtttatgcaacgtttaatgggctctaataaaacggctaataattttgatccgcggaagcaccgactcgctcgctaagccgaatctgcgagggtgaagctgcaactccaacgccggaaagcgcggctaccgaaaagcgcatgcgccacggggtggcacgaagctagagtaagctgaggaggtgggcggaaaccatggcaaccatgggtgatgacgacatggggagcgtctctagcgctggattatgacgctggattatgacgcaggcagtgggcgcggactctgcggttcgcttgactgacggcgcagcctccgggcctagccacagcagcaacggcagaggccagcgggcgaggtcaagatggtggctccgcgggcgggggaggcagtggagggaggaggagtcagaccttagccagccggaaacaccgaaacccagagacctcctggggagccgccgccgccgccctctcggccatcgctgcctccgccgcctgctccacctcgagggacgcgagcgggcggcggggctggccgtgagagagacaggagaggaaggagggcaggggcggagttgcccgccttagcccccgcccccggccgcggccccgggccctgccccgcgcggccctgcccggcccaccgagccctggtgtggcagcggctcatggcggccgtggggcccccgcagcagcaggtgcggatggcccatcagcaggtctgggcggcgctcgaagtggcgctccgggtgccctgcctttacatcatcgacgccatcttcaactcctacccggattccagccaaagccggttctgcatcgtgctccagatcttcctccggctctttggtaagggaacagggtaccgtacgtcccgggacggctatgcgggccgagacgttccccggggagcgggcaggcgcgcagaggccatgggtcgagtatgtgtctttgggaactacagtttcatccctcaaagggtcgtctttacgggttgggagggggaaggagatgatacttgtctgagttgacagcggagcagtccccctagcgaggattcagtgttgtacctgagtgaggtggggagaaagtaaggatgtgtgagcatgcagctctttgcccgtttgccttgggaaatgagtactggcttaccgcgtcctatgcgacagccttcgaaaaacaactctgctatcccagtctcgtcgtgtgtgaccttggacttctgccaaggcgtgggcctcagtttccctttattaccaaatgccgagtacttgtatgttgtcacttctgctgcacccgagggtccacaggatcgtgaagtgtctgcagtaaatgacatccaagcgaaggagacagggttttgaatgtcagaccttgaaaccattaccaaaaattctcatgaaagcggcgatgcttaaatcgagtcctaaaattttccatgaataaacgagaaggtattgaaagtgactgtaaaaagtgatgagacatttgccaaagagacttctgaaaatcattgtctttgtttcgtatggatggagtgttaaaagtatcttatatttcatttcttcctttccatcttcacttacatcatcagagggagatgcatttatgcgtaaaataattttttaagtaattgtaacttggcaaattttgttgatgaggtaattctggtgatcggtcttaagtaggctagtgcttttgaagtgttgctgagggcagactgatggtgaggtctttaccaagcctttctgaattacaagccatctgttgctttattccttcaaaagaggagtggcaataaaggccgaattttgttcttagcaataaatagccatattttacatttatctggtattttccttttgcaaagcattttcactggtaggtattatctaacctaaccttcaaacatcccccagaggtgggtggtggtattgtcattttacaaaccaggaaacagggtcatagaggttaagtgttttgctcttggtaggctgccgctaagtggttgccagagcctgagcttaaaaatcttttgacattaaatatggtttactttcctccctaacagctgcaatccagatacagaatgcagtagtaatgatcatatgctagatcttaaaactaaagatgtaaacgtgatgttcagcccaagctgcttcagtaacccacctgctacctaattccagcctttcctacttgccactgctaacgtataccaccaccataatttgtgttaaaaactgggctctgtttgagaggattctgcatgttcatcccagaaacagtgtagtgactgctttgaatattcttacagcatgataactgcagattctgtgagaatccctttgggacctggtgctttaatgcagtagtctgttgagcttcaggttaggcagcttcaaggaaaagaagtattttctttaattaaataatttgtagtgtaagaacattgaacaaagcaatctgatattttccttgtactaggcatgtttcttttgtaataaatcttggaagtttgtgtttgacaaagaacaacatgacttaaggcaactgctcagtgctttggtttcttatttttaccttttaaaagatggagagtgaggttatctgtttcatagggtgttaaagacaataaatctattttaatgcttcatttaataccatattttgttagatattttggtcttttgaaatcatcggcaaaatattggtgttgtttatttgaaaattttgatccctggaatctctggatcagactttgagaaatacgaaatactcttcaaatctatcatccgactcttcttactgtgtcatgtaattatgctaatttttcacatttgtaaggatgataagaatgaaaaaaactgatttcggtgctaaaaaattatgttactaaaagacacaggtttgtgtgtaaatatgccaatggatagttgaaattaatcgttctgccttgttagtttttttgtagttgtagacttctcagtactactgtgtataagtcttaccacttgtcaacctcacttttttctttaaaattaatgtgtaaaaatggaaatctctaagtaaaaagcattaccagttttatgtgtggtggtagaagtatttactcccctctacctacaaaatggtgctacaactgtaccttcatttgatatcaaactaatttgagatttcaaccggttagaaaataaagcaactcattttggagatccaaataaaattctatgacaatatatggaatattgaagaacataaagctgtgttttaagggatgttaaatactaaacgaaactcaacccagagcagcataatgctgagttagcaaatttaaatccaaggcagaaaatgcaagcctaggagtttgttttaatagtattactaatatggtgataattcattgaggtgggaaaaggctttaaacataacagaagacccagaagttccaaggaaaaatctgaaaaatttcagtacataaaaataaaaagcttttttatggcaaagcttaaaaaagaatccttaaatgacaaactgagataaaatacttctatcataagtgattcacgttccagtaagagttttaccctgccagggaagctgaggcaggagaatcgcttgaaccagggagttgcaggttgcagtgagccgagatcgctccactgcactccagcctggggatagagtgagactctgtctaaaaaaaaaaacaaaacaaaacaagaaaaaacttatactcccttaggaaaatgcctaagacaagcaattcacaataaacaaaatgcagatgttcaataagcaagagaaaaagtatttagcccttcctgcagtagcttgattttatgggggaaaaaaaaaagtacctagccttgtttataattaaatactgtcaagaccgcttacggtggctcacgcctataatcccagcactttgggaggctgaggcaggcagattgcttgaggccaggagtttgacaccagcttggccaaatggcacaacccgtgtctaccaaaaaattagccgggtgcagtgactcctgcccatagtcccagctactgtggaggctgaggcacgagaatctctcgaatcggggaggtggaggttgcagtgagccaagatcgcgccactgcactccagcctgggcgatagagcgagactgtctcaaaaaaaaaaaaaaagtcaaaaaaaatttatcagattggtgaagagttcaaagttttattagttttgcaaaggtatttacctttttgaaataggtaaatttatacaattttggaagacttttttttttttttgagacggagtttgctcttgttgcccaggccggagtgcaatggcgtgatctcggctcaccacaacttccacctcccaggttcgggcgattctccggcctcagcctcccgagtagctaggatgattacaggcaagcgccaccacccccggcaaatttttttctatttttagtagagacaggttttctccatgttggtcaggctgttctccaactcccgacctcaggtgatctgcccacatcgtcctcccagagtgctgggattacaggcgtgagccaccgtgcctggcccggaagactcttaatttcagtgtaaaaccatttggcagtatcaactgtcatttacaactgacttctcagtgttttgttttgtttttgagacagtctcactctgtcaccaaggctggagtgcagtggcgtgatctcagcacactgcaacctccacctcccaggttcaagcgattctcctgcctcagcctcccaagtagctgggatgcctggctcgtacaacttttgactcacaatttcaattctagggaattggcctagagagatagtttgcttaaggactatgggcaagcattactggaaataacaaagcaacaaacttaatctaaatatgtattgatacaaatctgttcattgtattaggtctagccatgcaataaagttcttgaaagaaatgagatagctatttttggtgccgaaaaagacttcagaaaacctctgaagtgaaaaaacaaagccgaagtaattatcactggcagaggaatagacagagatttctcaacagtggcagtattgacattttggacaggataattctttgtttgcggatgggagctctcctgtgcactgtaagatttttagcagcatcactatcccctgcccattagatgccagtagcaccttgcacccccacaccccagtgtgacagccaaaactgtccctggatattgccaaatcatggttgagaaccattgggatagacaaatagattagtacttagccttatttataattacatagcccagaaacagacaccaatgtatatatagaaataatgtgtttcagagatagaattgaagtacattgaggtaaatatggactgttgaattaatgatcattttgttacacctttggaaataaattatactagatgtctaccttatgtcaatatatagacagtcacttctaggttgagcagtgtagtgagaccctgtctctgcaaaaataaatatttaaaataatagccatacttggtggtgggtgcctgtagtcctatcttactcaggaggctggggtgagaagatcgcttgggcctaggagttcaaggctgcaagtgagctatgattgcataactgcactccagcctggctgggtgacagagcaagaccctgtctcttaaaaaaaaaaaatagtcatttctaagtgtattcttacctagatgtatatgtaaatatgaaatgcagaactttaaatttttagaaaaaaatatggaatattttatttttccaatcttagattaaggaagaaatccttaaaaatatataaaagcaaatacataatgaagattgataaaccgaatgatattgaggttaaaaacctatgttaatcaaaagatcgcaccactgcactccagcctgggcaacagagcgagactccatcactaaaaaaaaaaaaaaaaaaaaaaggaagtcaaatcttgggtaagggggaactactgtacttacatttacccatttattataaaggcaattacaaaggacacagatgaattaacccgatggaaggagatgtacaaggtgagacaaagaaggagagaagaggagaaggggcgtggagcttcagtgttcagctatctgagagctcacagaactcagtccttttgggcttctatggaagttcattaaataggcaagattgattagatcactagtcattggtttatggactcaagtttcagcttctttcttcccagaagtggcggctgggggtaggaatcaaagttataacccttaatcactgggctgattcccctggctacctagcccccatcctgaagctatctaggggcccccaggcaccagtcatctgattattgtacaaaacagtcatcactccagagattccaaggattttagaagctatgtcagaaaatgggacaaagaccaaatattaatattttttttatgatatcacagatgggaaagacaaactagaaaaacttgctttaactcttcatttaacacctctctgtagggtttggctttttaaaatccatgttcatatatttttgataaaagcatacttattataagtttagtttaaaagcaaaagtttaattttgtgttaatacttagaataccaggttttttttcaacctaaaatgagaatccaatagaaatgttttctttataatttatcaagtataccaacagattaacaacatttcaagacactttgttgtaaacttcattgcggaaggctcccttgggagtaaggtagtagtaacatttatttctgtgcttttccatatttattctgtcaggtattgaaatgtttttccacaggttgctttttgttttagaggtatttcgggtacttggagaattgtaaatattatgttttgtaccctgatttttagtcataagtttccaaaagagggtaagggtatgaatagactttacacataaaagagtgaaacactttgttatgtaacatgtatagtaagtttttattttttcttttgtttttatttgcctgtttttggtaatccaaattgaaaaggcctgaactctttcatgagttgagttcatatatagtttcaaagttcctgaattgatttggatacctgcctctttttggctaccttgaaaactctagtgaactctcttaatcactggagaattggactgagatctctgagttgtgatttcagtaaattctgttctcaaaattttttataaagcagcatttatatacagtcttgattacttgtgcaagtcacttccaaatcctaatgagaaactgtctctggacttttatattttcttagacctacagtttaaataccaagaaaggctttcatgtctaatgtaaaaatgcagtgaaactttgatattattctgcaaaggccatgagaaagatgattactttggagacttgttacttaggatattggtttttaaaatgagagcagattcttcccaaattccataggtaggaacgtgactataaaaggaaaatctatgaaccccatatacctacaaactttgggtaggaattaaaacaaacatatactattcttgaaatgttaactcactattacatcttggggggtgtgattttaatcaggatagagtattgtcagattgttacttgctgggatacatccaaattttgaggttgtagtcttactacattatttgtctatctgatgccttcccctttttttctttgatacatttgcataaagcaaaatggcactttttcactagaaatgtttctaaaacccaaataatttcttcatttgtgtgtagtaaaaacaagcttcaggaaaaaagttattagaattttaaaaattagttataaaattatggcaaagctcatgaatagttactgaagattaatttactactttgtgaatagcaagttgacaaaaataatttacagttcctgcttgactttctcccctctaagtggcataaagtagaactagagttattttgttttggttttgacccaacttagaagatttgttttaaagtttctgaagttttgtctcaggaaaataaggtggttttccatgtagagaatgtaagattacatatggcatctggtaggctgaattaattccattttcttgttaccttccatggaagaagtttctaataaaaaaatcttttcagggccgagcgcagtggctcacgcctataatcgcagtagtttgggaggccgaagcgggtggatcacctgaggtcaggagtttgagaccagcctgaccaacgtggaaaaaccctgtctctactgaaaatgcaaaattagctgggagtggtggtacatacctgtaatcccagcttcttgggaggctgaagcagaagaatcgcttgaacctgggaggcagaggttgcagtgagccaagatcacgccattgcactccagcctgggcaacaggagcgaaactccattaaaaaaaatataaaaaaaaatatatatatatataatatatatatattatttaaatatatatatatttaaaaatatatatattaaaaatatatatatatatttaaatatatatatatttaaaaatatatctattaaaaatatatatatattatttaaatatatatatatttaaaaatatatatattaaaaatatatatatttaaaagagcctgttctgagctcacaactctttgggggattattagtggcccattttcttggggaatcaggtggtttgtatttagaggtttatatgtcttctactttattgtgtccttttgttttccttttcacagatgacttgacattttggcacagaatacattttaaatccctggacagagtcatcacttaaatgaactagcccttgcttatatgtgcagtggattgtgaaatgcgtctactgtaataatatgcaatgtcttgattacctgctgaaataaggtggatagatggatttttattttatttaatatttatttatttatgtattttgagacagggtctcactgtcacccaggctggcatgcagtggtgcgatctcagctaactgcaatgcctcccgggttcaagcgattctcccacctcaaccccctgagtagctgggagtacaggcacgtgctaccaccctggcatatttttatatttttggtagagacagggtttcaccatgttgacatggtcttgaactcctggcctcaagtgatccacccgcctcagcctcccaaagtgctgggattaccattgtgagccaccacacccagccaagatggatttttaatttggagtttgtcactttttctgtactccagggtatggtttctcattgtctgaaacatagattttatttttcaagcaggctatattttgtggttgcctttaaaaacatccagatgtgacagacatttcctaatgaatactaattgtacttattttgtacaaaatattgtagaatccatagatggacagggtaggatctttgctttctgttatagatacatgtgtaatagggtagattatacttagataactgcagactacaatatcaggtgatatatgagtgttaaatgtttcactaagttctgcaggtatgctgaaagaacagtttctatcaaagaaagtaggtttctaggataggtaggatttgaatagtcagggattgggaggttggggacatcattccaagcaaaaagaatgtaaacactgctgtagctatagtggagaaaggaatgtgtttggggaatccaagtctggagcactgatgtgtgtgtgttaggaggaatattactgtaaagcaaattgggttcttgaatgccaggagcaagaatgtagattttagttgatagtaatttcagagccgctgaagtattttgagcagggaatgaagaaaggcaatttggtgatggcttgtaaatggatttggacaagatgagggttttttgagacagactgattgattggtgtcacagaaaagggagatagaggtgttagaagaatttggcaactaattggcaaagtttgagcatgtggggctgggttgggagtatctctaaaagaacaataatggtaccttcaactgaaatagcaaatcacaaggaaaagctgattctagtttaaggcaagtcgagtttcagaactttggagatttgcagttgtaggagtgaaagtaggtgagtattcagatgtcattcccattgttgaaaccttggataataatgtgtttattgtaatcctacttaaaatatgcatttctgtcagagtacaaagaaagatggtgtctatggagtgggggaaggagaattaccattttctaaaaacatgtcttggttttctgagtgttacttttgtaatgtgaagaacaataaaaagagttgactattttaagaaacagattcagcattatacaggaaaaagggaacttggaagatgtttctaagtccgaaggaaactaggaggaaaaaaaatggaattttggaccctttggagaatgctcagagttaaggagtaggaaataagagctggcatgagttcacagtttgaagaaaaggaggaattaagtggaagtataaaacttgaacttgatttcctaaagaatcctttaaaaaaaaatctaaaacttggctgggtgcggtggctcacgcctgtaatcccagcactttgggaggcaaggcgggcggatcacttgacgtcaggagttagagaccagtctggccaacatggtgaaaccccgtctctactaaaaatacaaaaattagctgggcatggtggcaggtgcctgtaatcccagttacttgggaggctggggcaggagaattgcttgagcctgggaggcagaatttgcagtgagctgagattgcaccagtgcactccatcctgggcaacagagtgagactcttgtctcagtcagtcaataataaatgaatctaaaacttaataggaataaatgttttccatttgggttatttttaacccaatttttaaaattaattttaatgattatgaaatgataaaagacatattcttttgagttttaaaacttgttaaaatgtatgtaccactacaaattcatcttgaaaataatttagtaatttggtgccttggacagctacagtgttacttgaaatactttggaaattagaaagtaaggaatgaaattttaaagaataatttagtatgtttggtctgttctcctgaactctgactttacaaaacctttattaccctttaagccttagttgtcttgaggcttaatgttcataactgaaaatattcatatttcctaattaaaggaagaatatcataactcttagtggggaaacattcttacaaatacttcattcaaatgactttttctttctttcttttaggtgtatttgcatccagtattgttctgatcttgtcacaacgatcacttttcaagttttacacgtacagctcagcctttctgttagctgcaacttcagtgttggtgaattattatgcttctttgcacattgacttctatggtgcctacaacacgtcagcttttggaattgagctgcttcctcgaaaaggtccctcgctgtggatggcacttatcgttctacagctaacatttggaattggatacgttacactactccagattcattccatctattcacaattaattattttggatctcttggttcctgtaataggcttaatcacagagctaccattacacatcagagagactttactgtttacttcttccttgattctcacattaaatacagtgtttgtcctggcagtgaaactgaagtggttttattattccacacgatatgtttatcttttggtgaggcacatgtatcgaatttacggattacagttattgatggaggacacatggaagaggattcgtttcccagacatactacgagtcttttggctaacaagagttacagctcaggctacagtgttaatgtacatcttaaggatggcaaatgaaactgattccttctttatttcttgggatgatttttgggacctcatttgcaatcttataattagtgggtgcgattctacactaactgtactgggcatgagtgctgtaatttcctcagtagcccattatttggggcttggaatattggcctttattggatcaactgaggaagatgacaggcgtcttggctttgttgcacctgttttattttttattttggctcttcagactgggttaagtgggctaagaccagaagagagacttattcgcttaagtagaaacatgtgccttttattaactgcagtcctgcattttatccatggaatgacagaccctgtattaatgtctctcagtgcctctcatgtgtcatcttttcgtagacattttcctgtgctgtttgtctctgcttgcctgtttattcttcctgtcttactcagttatgttctttggcatcactatgcactaaatacatggttgtttgcagttacagcattttgtgtggaactgtgcttaaaagtaattgtttctctcactgtttatacgttattcatgattgatggctactataatgtcctctgggaaaagcttgacgattatgtctactacgttcgttcaacaggcagtattattgaatttatatttggagttgtaatgtttggaaatggggcttacactatgatgtttgagtcgggaagtaaaattcgggcttttatgatgtgcctacatgcatattttaacatctacttacaagccaaaaatggctggaagacatttatgaatcgtaggactgctgtgaagaaaattaattcacttcctgaaataaaagggagccgcttacaagaaataaatgatgtatgtgcaatctgctatcatgagtttacaacatctgctcgtattacaccgtgtaatcattatttccatgcactttgccttcggaaatggctgtacattcaagatacttgtccaatgtgccatcagaaagtatacatcgaagatgatatcaaggataattcaaatgtatctaacaacaatggatttattccacccaatgaaactccagaggaagctgtaagagaagctgctgctgaatctgacagggaattgaacgaagatgacagtacagattgtgatgatgatgttcaaagagaaagaaatggagtgattcagcacacaggcgcagcagctgaagaatttaatgatgatactgactgatgaaaatagcatttattaatgattgaggtatttgtttaaaattcagttcatccaaaatggagtaatatccttcaccttcagtgtgtaaccaagcacaaaaacagtatcaatgttgaatctgtgaatggttttccgtttactgtgatgtgctactgtaaatatacctctttaattacttctggtctctttggtgacctgtttaaatttgtgtacattattgtacatagaataaaatgttttcacatttttatgacaaaatttgaacaaatagctttttaatagatgtaatgatcatatggtgcgtcacctgtgccaaatattcttcaatgaaattatataatgtaactttggacctcagtttttctttagaaatgggtgggagaatgaaaatgcaaatcaggaaaccacattaaagtcaaggaaataaaataatttgaccagaggataaaggacatgagagagtattttaaaactaaagaaaaaattagctgccagaagcaactgaggaccttttttgaaacttgagtagcagtgtaattgagctgagtttgaaagtcctgattcagagagagactgagggttgacaaataaactgtatcaactaaactttgatataaaccagaatgtgctaaatgttttttatgtaaaattgtatatttgttagccattctgtgtctgcagtattgtcataaaattgtcctttcattcttttgaagatattacaaaacaaaaatagttttttttaaattgttttaaactaagatactcaatgatataaaaacatcctgatctgattttacgagaaaaagaaggggaatggtggggaatggtgtgtaccgatatatagtatttctttagacaacttgcagataatttctttattgaaactatcaggaagttttactatgaaattttacatacatgatggaaagtggaagacatataccaattatattccaggaaaaaatactttaatagtattgttatatagtgtattggctaattccagtggatcctcatctctcactgctgacattatctccaatatttgactaaaacaaaacaaaaacaaaaatggttaaatctccaagtatacatttagttctaaagctatataatatttttccacacaaaggaaaatattggcacacctttaatataataaagcttaacagttattaagtttttcagcaatatcaatagaaaaacttactgccagtaactggaaacagatttatggactgtcttgcatataactagagctaagaaccaggttcaagtaaattattaaagcagccatctgtattatgttcaccaattatagcattaactgagtggaaatgaagagtccttttcaattgtgagtcatagcatgttcattagtgggtcatgatgagcattttaaacattgacaagtacattgtactcaataagggtaagtactgttccattttttgttaggttttattatgtatgtgtgtcctaagtcacaacgtaatttgtactgtgggacagcagccacagttggaaatctactgctagagaactagtccttgagagacagcaaatgaaggtattaggttgctgcaaaagtaatatttacttggaaaaatgtgtggttattgagggcgagggctttctgtacctctacccttgcgagagaaataagcccaggtgtccatccttcagtttctttctttctctgtctctctcttccttcccttccctcccttcctttcctttctttttctttcctttcttttttttttcttttttctttcttttttgagacggcgtcttactctgttgctcaggctggagtgcagtggcacgatctcggctcactgcaacctctgccgcctgggttcaagtgattctcctgcctcagcctcctgagtagctgggattacaggcacctgccatcacacccagctaatttttgtatttttagtagagacggggtttcactatgttggctggccgtggtcttgaactcctgaccttgtgatccaccccacctgggcctcccaaagtgctgggattacaggtgtgagccaccgcgcctggccgcatctttcagtttctgtgcttacagtaatgatgatccgtagtgtctccatacttattatatataagtggaagatttttaatacatgaattagaaagttccaaagtccaaattgaacatttaaatattctttgcctaagctttttgttcccttagtatcttaaatgttaacacctaaaggaattaaggatggagatctaagattaatgggaatttaaaaaattgttttgtaatgtgacacaaaagccttgcttgatgtttatactaagcaaacactacactaaaattttatctgacagtcaagatacactaaaagcaaatctattaacatttaaattaagacagtgaaaatccatttttcttaggaaactactgaatgtccctctgtatgcacttctcagaattggaactcttgattaatgctgctgatgacacagttttgaaggtcacagcagctttgctaagattatattgcatagcaaattcattttattgaaatcgcttataagaaatctattgggctgggcccagtggctcatgcctgtaatcacagcactttgggaggctgaggcaggcagattgaactcaagagttcgagaccagtgtgggcaatatggtgaaaccctatttctagtaaaacaaaaaaaattagccaggcatggtggtggacgcctgtagtcccagctactcgggaggctgaggcaggagaattgcttgaacctgggaggtggaggttgcagtgagctgagattgtgccactgcgctccagcctgggcaacagagcgagactctctctccaaaaaaaagaaaaaagaaaaaaaaatctattggagcttaggacatcctattttactgtttgataatgcagtttatggaaatctttcttcgaataacccttctgtagccaagccatgctatttccatacatcttcagtggtcaaagctgcagttattccaaaatgaatataaagttgtttaatgtccctgagaatttagtggcttttgtttaatgtggcacttttacagtaagcacaggtttttgttttttttttttgagagagtcttacactgtggcccaagctggagtgcagtggtgtgatcttggctcactgtgtgtgatcacacagtggtgtgatcttggctcactacaacctctgcctctcagattcaagtgattctcctgcctcagcctcccaagtagctgggattacaggcgcccaccaccatgcccggctatttttttgtatttttagtagagacagggtttctccacgttggccaggctggttttgaactcctgacctcaactgatctgcctgcctcggcctcccaaaatggtaggattacaggtgtgagccactgtgcccagccaggcaaaggtttttaaagtcttgcaagatctacatgattcctaccctatctcctttccagcccttccccatactgatacaagttatagctttaaaaaaaataattgccactctcctgcttaaaatcctttgggtagtgataaaatctaagcaaaatgctggcatataagagccctcacaatctgggctcactctaccttcccagacttgacttctgcttacactgtgcatcctactttctgccacacttgttcctctggattagccaggcccttctgcagtctgcctttgcttaaggtgtttgtttgtctttctctggcctaactcccagtcatgggtaaacaactgaaatgtcaccttggtataactctctcctgtttcccctcaaagcagacagttgatgtgccctatggtcctggtcatagattcctacttgtataacagcactactatcttggactctgtctgcttatgtgctccaggagggcaggggtcctcgcctgactcactgaatgccttatctaaagtgccaggcacagtgtacctattcatctggtggatggataaagacagggactgtcttggttcttcctgtgtagccttagtaacttgtacctttcctgacatggcaggggctccaaaacatctgttgcaaacaatgtatatctaaaagacctctataaaaataattagaatgtaaaactgttaacagaatggaggttgagaaaatgactttgcaagtagcaattaacttgccaactcataattagcagtagattagaggattgtgtattttttaaatgtggtttaaatcttttcagcttgcagatgctagattttcctaagctctgcaactaactgaagaacaagtattgatgaagccttcacagttcttttttttttttttttgagatgtattttcacttttgtcttccaggctagagtgcaatggtgtggtctctgctcactgcaacctccgcctcccaggttcaagcgattctcctgcctcagcctcctgagtagctggcattacgggcatccgccatgacgcctggctaatttttgtatttttagtagagacaggatttcaccatgttggccaggctggtctcgagcacctgacctcaggtgatccgcctgccttggcctcccaaagtgctgggattacagatgtgagccaccatgcctggccagcctttatagttcttaaacagtctacatttaaaaacaccttgaaattttgtcttgcaaatatatagctaaagtcaacagctataatcttacataagattaaggaaatataaaaaacttacttggatacactgttggcaactacttcctgtaagctggctgctgtcaaaataccagtttcttttctctagtgtccttttagttccccaaaaaattggctgggtgtggtagctcacgcctgtaatcctagcactttgggaggctgaggtcaggagtttgagaccagcctggccaacatggcaaaaccccatctctactaaaaatacaaaaattaactgagtgtggtggcatgtgcctatagttccagctacttgggaggctgaggcaggagaattgcttgaacccaggaggcggagattgcagtgagccaagatcactccactgcactccagcctgggcaacagagcaagatggtctcaaaaaaaaaaaaaaaaaaaaagatttagaaatactgtctcatcactgaatttgcaagtacttacatttctttattttttaaaattttctttatttctttagagacaggggtctccctatgttgcctgagctgatcttgaactcctgagctcaagcagtcttcccaagtagctggaatacaggcgcaggccaccatgcctggctgcttcagttttaaagactttgtcagctcaagcatgttaataaaggaaaagaacctttcaaacatatttttatagaataattcttcactgttcttatctggcttatcttctaatactcttttcctgttaaaaactactgaaaaaaaagatggtgcatatgcaatgaatagtcttaaaagcaacaacctattttgttttcttttttacccctcatgaagacacagtaccaattagtttttgtgaatgtgttataagtatgcccaattgtctgaattggtaaatcatataagactgatataatctagattaatttaaattatctgtttgtgcaaacaaaagaaattggattatgtacccattaaaatgatataaccaccttctcctgtttgttacctttacagctctttgacagatgggtaatagcccctcttttcacttgtgctatatatatatcaccatttaaaagatgattctgatctgctgcttttttaggaaataaaacgtgctaaagtcccaccccctttgattggaaaaagggggtaggaaaaaaggggtttgtccttaagatcacttatccttttgttctgaggcttaaagaaatgtgttatttcttagatttatagaggctgtcaaatcatttaaatccaaaatattctgctaaggctttcttgttaccaaagagtagcaggaagctgcagtgagaatggaacttaaaccaggtatgcaaattcctccaaatcactgcattaatatggtggtcttgaacctgaacttcacttggattttgcaaaattttaattctgtcccttgcgttaattttataagtggcatctggtggttaactaatgattttgaagaccatgaaagcaaaatactcacattatatggcagggttcatttctgtcttttaagcagtgcccactttcccacttctttttggtaggaaatgcagttcttatatattttgatccagcatgtgtacttttgactccacaccaaggtgcatctagttaagcaaagaaagtgtctcgtaaggggtttacatttttaaaaattttttatgaccattatctaatatataacctctaaatgataaaccgtgattcagcttccaaaatggcacagttatttcaacagaaaacagttctaagaaaagcacaagataaaatcttgaattgcatcttaaataccttctaagactcacttctattccttttttctgctaacattgttggtgtgcagcatgctttaaaaaaaagacctaaaccttaaatacaattgtataacaacatgaaaacatttaagttaaacagtttttttttcagttttcaaaatctttttcgctatgcatgtagtgaggtttgcataagttaaacaaatttctatctctactgaatgtgaaactggttttgaatattttttaataaagaattacacattttgcaaacatcgtacttttaatcaaatattttgttttcctgactgcccaaggaaatgaatgtgatttctccagaatggctcagtcttgactttcctaaagtccatggtataaggagagccttgacagggtttagataaaagttttagcttttcaccttattatttttttgagacggagtctcactctgtctccaaggctggagtacagtagcacaatctcggctcactgcaacctctgcctcccgggttcaaacaattctcgtgcctcaggctcctgagtagctgggactacaggcaagtgccaccaccacacccagctaattttttgtattttttttttttttttgagactgagtttcgcccttgttgcccaggctggagtgcaatggcgtgatcttggctcacagcaacctctgcctcctgggttcaagcaattctcctgccacagcctcctaagtagctaggattacaggcatgtgccaccatgcccagataactttgtatttttagtagagatgtggtttctccatgttggtcaggttggtcttgaacttctgacctcaggtgatccgcccacctcggcctcccaaagtgctgggaatacaggcgtgagccaccgcgcccggcctcaccttgttttaagaggcaacggattctaaaattcttatactaaaccaatataaattgttgcactgtacaaagtgctgtagaattaagccattataaagacactgtgtaaacaaaattctgaacagattttgaaacttggaagtgtgatgtgcttagtcaagaccccttgtttagctaagtactcgtaactacaacctcctgagttatattctggcatctcattttctaagtgcttagacatagcaaacttctaaattgaaaaaaatcatttgcatatgtttttccattaataacccccaaagatcttctggaaaacataattgttgaggttgagcatgctgttttaaaatacttgttcacttaaagtttgaagtcaaatttctttctccagctttcctttttgtttggtatggtttaatatgaaacaaagttctgaaaacaaacttacctgtctcaatcattaatttttcactaggaattgacttcaaaacttccaaattagcttcagttttcagtgagcttaaaaaaaagtgtatatttattttaaaaggcagcaattaacgaataccttttttcgtatcacaacttgtctaaaatgctacaaaaccaacccaaaaccctataacactttgttttcagtatactttggaaagtatttgcacacctccatacttcaacaatccagattaacatctattttaacccaatctgccttccggggatgcaattttccatgcttattagttggtttccaatagcgttctatatcagtctaagtaaaatttaactttttaaaagaattcatctgcttctgagtaatttgcgtaacttagaggtgcttctaaggctgtaaacgttcatttcctgaattttccatttttagcccaagacagattcttcactctactttagcagaattatgtatctgcacccttgccatggtttctttgtaggatgaactctattccttgaatctggcgttggcctcaagacttgctatggctgcctgtggcagcctctatcagccaaaacccagctgactcaaagatccatgaatgcaaacataaatgcttcctgtaatgtggcagtgaggtttgggatggtgtagcatataatgtgatgacaactaatactgttcttatattactttaaaaacacaatttctctaatcacaaatttattttaaattactttttagagcagttttaggtttacagcaataaaaagtacagagattccccaaccatatgctcccactctcaaaattctacaccatagtggtaggtacgtttatcattgatgaacctaccttgacacaaaactgtcacccaaaacccacagtttacatcagggttcacttggtttcatgtgttctgtgggtctggacaaatatgcaatgacacgtatctaccattgtggtatcatactgaatagtttcacggtcttaaaaatctatggtccgcctattcatccctccttccctctaaccccttatcttttgacagtctccatagttttgccttttccagactgtcacatagtttgaattacacagtatgtagtctttttcaggctgccttctttcacttgcaaatacacattaaaatcccatgtttttcatgcttgatagttcatttcttttggcactgaataatattccactggacataccacagtttatccattcacctactgaggaacatcttggttgcttccttatgtagcatttttaatttcagcatttgttattacaaagaatttaagatacacattaaattaggtaatatggacctctcatatagttatcacccagccccatcaatcaacacatggccaatccagttccatccacttacccctattcctctcctgtattatcttaaaaggaaattccagatggacagttttaatatttatttcagcatttaattcaggatgtttcaacatgtatctctgagcataaggattcttgtttaagaaaaacccaaatcttctagtattcaaatttccagttgtctcagtggcatacattctaagtttgattaaattaggacacaaatgagaggcccacacattgcaattggtcattgtcttctgaagtctcaacttattaaaatctcctgcatcttttcccccttcaaatttatctgttgaagaaaccaagctgttcacgctgtggagtgccctagtcttgattttgctgatttcatctgcgttgcagtttaacaggttcctctgccctctgtatttccttctttcttcttctttttttttttttttgagatggagtctcactctgttgcccaggctggagtgcgttggcaaaatcccggcgagctgcaacatccacctcccaggttcaagcgattctcctgcctcagcctcccaagtagctgggactacaggtgcctgccaccacgcccggctcatttttgtatttttagtagagaggggggtttcaccatgttggccaggctggtctcgaacttcttacctcaggcgatccacctgccttggcctcccaaagtgctgggattacaggcacaatccaccgtgaccagcctgctctctttatttcttatagaagatctcgagtaccatctacaggctggataggatttgggttggattttttgtggggaagactatttcacaggtggtggtgtgatctttcatccacaggcatatatctggtggtatttttgtgatctaaggcagccatggatgcccaatgcataattcaccaggagctagaaaatgctgatataattctatcagccctttacttattagagtacttccataaaaagaaaattctctatgtctactacttgattgctcaaatatatgtagtttgtataaaaaaaatatgtatctttctgtcaagtgttgattccctagcttcgtccaatggtgctattactttaacatcaccatttatttataatctttaaggagctcttattcttttatgttcttttagcattctgttcatatttcatgtctgtaacatctcaaatcccactatgttgggtcgcactggggttagtttttctatttatcttggccttttttctttcatgcttctggttcacctcattcgtctggtggtccttggatatccatttatattttgggaggttgctagtgttgcgtttcctttgcttttgtgaaagcaggcctgttttactgccagttctcttctcctagtggggattcttagtgggaccttcttgtgggagtgggtatattatgaaacttcatttaaaggtaagagtatagggagctaattgttaggctcatggttctctaaatgcttttctttggggattgatgtaagcactccaagccctagtcctcaccatacagttttttcaattttcttaagaaaacccccacccccggcccctgtgtaaatgtttactgcttttgtcctctatgcacaggagtggatatgggagtgagatcttttctctatataggccctcaattaatcatcatttctagtccgatttcacactaattctaggcccaaagcccccctattggattttgctagacttgctcccatctcttctgaggccccttagtggta

SEQ ID NO: 1168 - DNA, 21948 bp, Homo sapiens
gtttaagagtcaaggtaacctagtgtgaaaatgaagtaagtggaagatttcattcttaggccttttcttactaaaggagttatgtccgttttttcttacctgttaactttggatcttgatttttgtctatagcctagtgaccactatttcctagctccatttattccagaaagatccagcctacctcctacatgataaattaacaatgaactaaatataatattcttggcagttcgttggttcttagcaaacagccacaggggagaggaaagtgaggttctgtctagcagtattaccacggagatgtctcctcgcaatagcatcatcctttacctagaatgtattttccaactacaacagtttttaaaaatgtgtttatgtgattgttttccaaaaaaaaaaaaacttcggaagcaccctgttggccaaaaggcatctgaatttaattgtttagttttctttctttgggaaaacacatgaaggtttttacttgagaatttttatgagagctaattaatgtcttcactcctcaccagacagggtctcacttaggagcgcagtgagttttaattggctttggtaatacttagcaatgtttattccccttgggctttggcttgttctgtgtatgcacattgacaaagttccctttttaattgcgttccttagagttcatgtttatttccttttgctgatgttcagatcttttggtggttgctgggtagcagaatttaatggccaccaaaaggagactaagcctcatctctatttaggagttcctttttcatttggatcttggaacaggcctaaatttgaaaaaggtttatctgtaatccacttgtaccaaaactatgtgatttctgtgtccttatatctcttccaaagcatgttttctttctagaatccaggtactcctttggtgcagaatgactattttgcttattgggccaaagtagtttacaagtgtagttacaatttagcctctcgtgttgtacagaatgggtatgtctgcacagaaggtaagcagttttgtgactatttatatgtctataaaattgtttatatgtttggttcctttccagtgatgaaccagtggcagatattgaaggccatacagtgcgtgtggcgcgggtaatgtggcatccttcaggacgtttcctgggcaccacctggtgagccatcctgttattgttttatccatataggcctgtagcatcttcttaaccctttatggctatctgccaggtaaatttttagagcagagatcttcaggtaggattttcttgggctgcagggaattggaatcagaggagaatgtttaatatagtgagagctaagtatatttgccttttttttttttttgaggtggagtctcactctgtcacccaggctggagtgcagtggcgcgatctcggctcactgcaaccgccgtctcccgggttcaagcaattctcctgcctcgacctcccgagtagctgggactacaggcgcgtgccaccatgcccagctaatttttttatttttagtagagacagggtttcaccatgttggccaggctggtcttaaactcctgacctcaggtgatcttcccgcctcagcctcccaaagtgctgggattatagataacaggtaacgcgcccagccatatttgcctttaaattacaattaatctgaaatttcagagttacaaattaccagaaaacaaggattttcactcttgtccaatgctacaggtatataagtctcccttcctggttctgtaagttcagggaggctagaatctgttagagaacttttccattaagttataatttacatacaatggaatggatttattttaagtgtacaatgctgtcagtctttacaaacgcgtaccattcctgtgatcgacacctctgtcaatatagagaatagtccatcaccccagaaaggtccctcatgcccttttccagccaactcccccttctaaagcaactgctgatctgacttctatcaccacaaattaattatgtctattcatactgtgaattcatttgtggcaggcttctttcagcataacattgttaagagtcattcatgttgttgcatgtatcagtaattcctttttattgctgggggttattcatttttatgactgtgccatagtttatccattctcctgttgatggacacttgggctgtttccaggtctgggccagtcagaatgaagctgctataaatattcttgtaccaggctttttgtggacatgagtacaattgctgggtcatagggtagaggtatgagatgtatatttaactttttctaaactccccaccagttttccaaagcggttacaccattttacattcccggagttctggttacttcacatccctgttaacatttggtgttgtcagtcttaccattttgcccaatctagcaggtgtgtagtgatctcccgtgattttcattcttattaccctgatcattattgctcttgagtgctctgtcatatgctttgcctggttttttaaattgtgtttgtctcttttgtctttatttccatgtgcatagtcagttataccaccttgtattgaagagactttcctttctctgttggaattgtttcagtacccttgttgaaaatcatctgaccatatatgtgtggttatttctgtacttcctattctcttccattgatctatttgtgtatgagtgatttttgtatccccaacatccaatttagggcctagtaaatgtataaatgcttgatgaatgaaagaatataacagtggaggaagaaagaaggtaacagagtctttgctgggccattcttggggaatcctgttattacaatagccactaggttgggcatggtggctcacacctataatcccagcactttggaagaccacggtgggtggatcacctgagctcaggagttcgagaccagcctggccaacatagtgaagccccatctctatgaaaaatacaaaaattagctgggcatggtggcgcacacctgtagtcccagctactcagaaggctgaggcaggagaatggcttgaacccgggaggtggaggttgcagtgagccaagattgcgccactgtgctccaggctgggcaacagagtgagactctgtctcaaaagaagaaaaaaaaaaaagccctagaggtttacagcgattccatggttttcagctagcacctaaggcagataagcttagttgttgagtcattgtttatgtcagaaaggagcttcctgttaatatggttatatgaatagtttcagaagcattaataacttaagctataatggcttagaatactttatgtgttgtagaaactgaataaatatcagctggttgattgttagtgtgatttggttttagctatgaccgttcatggcgcttatgggatttggaggctcaagaggagatcctgcatcaggaaggccatagcatgggtgtgtatgacattgccttccatcaagatggctctttggctggcactgggtaaggcttctcccatgtagtcaggggcagttcagtactctcacctcttacctatacctgcttccacagagaactggattcaaagtgttcatttctaaattattttctcaggggactggatgcatttggtcgagtttgggacctacgcacaggacgttgtatcatgttcttagaaggccacctgaaagaaatctatggaataaatttctcccccaatgggtaaaataaacacactgaatgaggggcgaaaaagggttctgggtcagtaagtactctatttctaacttcaatactgcatccaatccacagctatcacattgcaaccggcagtggtgacaacacctgcaaagtgtgggacctccgacagcggcgttgcgtctacaccatccctgctcatcagaacttagtgactggtgtcaagtttgagcgtaagctttcctcctattttacgtctaaatgacacagacaaacagtattgtgttcccgtggaatgcaggccaggctttagcttaactgagcagtaaaacaggagagaaattgacctactggtaaaggagcaaattataatttccttccctctgccatacccttagatctgtgggaaagcacgcttctcgttgcaggaagtaaagcagactttcatgagtgctttgcttcattctttcctccatggatgctctgagcactgagtccttaatattattctgaatagattctcggtcagggaatgagccaaaagaccttactgttatttgttcccttaagtctgtagaaacaagtttttttaaaaatagtatgtttttgcagacttttgtgcttttgtcttctcttttgaatacttgaattcctcaagcaattccccttctcttctcctgtagctatccatgggaacttcttgcttactggtgcctatgataacacagccaagatctggacgcacccaggctggtccccgctgaagactctggctggccacgaaggcaaagtgatgggcctagatatttcttccgatgggcagctcatagccacttgctcatatgacaggaccttcaagctgtggatggctgaatagatgacaatgggaaaaggacttgaacctcaagctctctctaaggagctgttttcctcaaacgagaagaattgaagtgtttagttctatcatgttttctgccaattaccatgcatagaccctcagtagaattggatttccatgtcagcccccactccaggaaggcagcccaatccctaggtgatggggaacccctctcacggttgaaaatttattacctttttacgccctgccacgaactgtgtagacattgtttttattaatcttttgtttggccgggcgtggtggctcacgcctgtaatcctagcactttgggaggccgaggtgggtagatcgcttgagctcaggagttcaagacgagcctgggcaacatggcaaatgccgtctctgcaaaaaaatactaaaattagctggtcgcggtggcttctgcctgtgattccggctacttgggaggctgaggtgggagggattgcttaagcctgggaggcagaggttgcagtgagccgagattgcgccattgcactctagcctgtgtgacagagcaagaccctgtctcaaaaaaaaaaaaaatttgttcgaatgccttatagccttcctcacagcacccaggattgtgactgactctgcatttttaattcttgaaacttggctttccataacatggtacatgcttcaggactacatatgacccagagagcaaggtggctgaactatagtctggaagccctcaggtaaagaggcacatctcaccactcattggttaaacaatgcatcatagcgagcacttttcctttccctggagaatgggatgtgaagcagtagaccgcagccacgccgatggttatacagtgaagaagacttcacctcttcctattgagtttgcttggaatgctgacagcatcaggcaactctgaactgaacatttgctttgtcagaaaatatctttttttttactttgaagtttggcaaccttcatgttaccccaaagcaaaaccattgtgtcaggagtcaaacaaatgtttagaaagcaaacatgacgtctctattgtacaacctcctttctcttggctgtttaaaggatgtacttcgtgtattaaagggtactttatgttgaagtaacgaaaaaaccctaatgggtgttcctaaacctaaaccttttctttattccacatttgctacggtaaaatcctgttacaaaactaccctataaagaattattttctatagttaagcattttctgaatcctagccattggtccatagaggtctcttttttttggtttgggatataatggatgatctcaaatatggattactctgatttatgtctccttagcaccttgttaacaattttttttaaaatagaaggctgtttgcattttgggccagactgccagtaagccaggcctggactcaattacaattcttaacttgtctgtcatgcacctcttttcacctcaactatacagcctctgaactctcaaattacacagtaaattcaaaaaaatatataggaatttggaagaagaaaaggttgtctacagaggagagttattaaagaaaggcttcttggccgggcacggtggctcacgtatgtaatcgcttgaacctgggaggcggaggttgcagtgagccaagatcacaccgttgtactacagcctgggcaacagagcaagactccatctcaaaaaaacttaatttgctgttgcagagaggttgacaatggctttggtcagctctattctgtggaccctgaatgtgtgatatatagccaaacaactggtttgttttgtttcattttgagacagggtctcgctttgtcgccgagattggagtgcagtagtgcgaacacagctcaccacagccttgacttcctgtgctcaaatgattctcctgcctcatcccctcatcctgtgtaactgggatcacaggaggatgccaccatgcctagctaatttttttgattttttggtagagacacgatttcactttgttgcccaggccggtctcaaatttctgggctcatgcaatcctgccttggcctcccaaaatgctgggattacaggcatgagtcactgtgcctgacctaaacatactgtttttaatctgatttcaattataaccaaatagttgcatttcctatgtagttgttcagcttctgaattctcaggactaccctctgttgctcacttcactattgttcaggtattaatgaattctatttcatagattatgatgaaaagaactttttttcttctttgtagtatgtgtaaaataatgaagaacactggtgaattagcatgcaattggatataatgtgctaacaaagatttttagtttctcaggtttaaattttgctattagttcccttcgacttgtttttctttgttttttggttggtccaagaggtagcagttgggtgaaaacatttcatccaagcctttgacagaacaaataccttgtgggctatttcttcacaggaattaaaacatcattgtaagaaagtggttaagaagcacaaagccaggtgtggcatttgtgaaaatggcaagataaacagccaccgtttcacagaacacttagtccctacctagatggtataccaggcacattcagataccttgtttaatccccacaatcttttgagtttattattccctttttatggacaaaacaggctccaaaaacacttgctcaagtttagccagctagcaagtgatggagcttgaatttgaactgtcatctgaccattgatgaccttatgaaggtttcacaggttccccacactggccagacaaaaggaccggtacagccagcatggcctgtttcctgtacgaagtctgagctttttaaggactctccactttgtataatgccccccacccttttttttttttttttttttaagagatgggatctcagccgggcgcagtggctcacgcctgtaatcccaacactttggtcaggagtttgagaccagcctggccaacatggtgaaaccccatctctactaaatataccagaaattagttgggcgtagtggcaggcacctgtaatcctagctactcgggaggctgagacaggagaatcgcttgaacccgggagggggaggttgcacttagccgggatcgtgccgttgcactccagcctgggtgacaagagtgaaactccatctcaaaaaaagatgagatgaactcctaggttcaaatgatcatcctgcttcagcctcctgagtaactgagatacaggcacgggccaccgtgcccagcttgtatactgcacttttgacaagtcacttccatctctgagctcatgcccatgttaaagtaactctcgcacatcctgaacggatgaggagcctattgtcaacaagatagctatttgcatttttggttagatgatctttcatcctgtggaactggcaacataagcattgcagcaggtgttagtatcccagacctctgagccctaaatgtcagcagtgcaattcaccccctccactgactacaaaagatgctcccatgcatttccagatacattcgaagaggatgggactgccccaagctagagctaccgaatatgaaaacaggagacaccatgatgttcaggcagccctccctctccatcagcgggttctaggattcaaccaaccataggtcgaaaatacactactgaccatatacagactttttttcttgttattatcccctacacaatacagtatagcaacttcacatcgcatttatattgtattaggtattgtaagtaatcaacagatgaattaaagtatagaggaggatgtgtgtaggttatatgcaaacactacatcattttatatcaggggcttgagcatcctcggattcaggtatcttcaggaggtcctgggaccatttccccctgaatatcaagggatgactgtatatcctcacctatcggaaaaaccctcaaacttacatcttgtcttatttgggtggtgtatcaaccactccaaggatctaagttcttttttgactgaaaagactctaccacctactagctgggtggccttgaacaaggtggagcctcagttccatctgtaaactggggattaagcttgctgaggttagtaggcctagtgcagaggccagtgttccttcctgggcttttctcagtttctcctgtcctgagctgccctcgcctgtccgcttagctcagaggacatggtgagattattgcctaacttatctgccacaagtttaaggagcaacactgtgtaaagaaatgaagtcaatggggaaaggtggagtcccagctttagtgtaattatctttgatggcacaaatggagagatagttgctagtcccctaaaggaatatgtaggcagttttgcaactttgtaatggagactttttcttcatattggagcttaaaccgtttggtttttctaaatgtgaaatatacgtattggatattttggagtattttgtacattaaaacacctggggggaatctaacattatttggagcaaatcaaccaactcaaattctggcctctgaacgctttttctgcttatcaaaaaacccccaaaacctcaaaatgttatccttacatatttgtgatggtatcttttgtgtgtgatggtatcgtttttttttttttcctgagacagagtttcactctgctgcccaggctggagtgcagtggcgcagtcttggctcactgcaacctctgtctcctgggttcaagcaattcttctgcctcagcctcctcagtagctgggattacaggcacgcgtcaccacgcccagctaatctttgctggggattacaggcgtgagccaccgcgcccaggctgtgatggtatcttaaccactttaaaattgtttcagagccttgagccaccaggcaaggttaaaactggggaaacagaaatcagagttttagacactgcaaggttgcaacttaccaagcaacagcctgagcccccaaattctgtctgattggttcctggattctatcatgtaaagtgaaagctagggttcccccgctgcctcccatggcctgggatgggagttaaacttttgcctgtgtccagcgtttccatcttcttgaagctggaattatggagcttgggggaagggaatcagaactctaccccatgtccattctaatcagggcctctgtatctgccgggaggaagaaagacctattcctccaaatcccagacttcccctagtccactgatctaacatcgttcacctttagatttcacctaacactccatgaactacatgctggcaagaggtggtctcataaaagcagcagctgaatgagcacaccccttcctgctagtgagggccatctgccacccctggataatcctactcttctcttccctcagttctggcactcagcaccagcccagtaaatggtcgtggaatgaataagtgaatgaattaatgaatacagaacacttttactgcaaccagtggcaagacattcaaagagaaacaaacacacatttacccacagaattgaagctcacttcccaattttttttttttttttagcaacccatagtaaaagagcaactcaaaaaaatatgcactgattttgaagcagctccagtgagaaatgcaacttgctatttgggctagtcaggttcctggataccactgtgcagccctttggcacaacttgctgtggagctctgtggtcagaaccgcttctctgcccttccatgacgccacactcacacccggaggtcgctccacatctcccagtccttcaagcttttcgtttttttgtttttttttaaaattgttcccagaagcaaacacatggcctgaacaatccctggattgtaaaataaacaacactacaaaggaagacaataccaaatgaggctccgtagtcaccatacccagcagcaaccgaaaaaggtttggtttcttgtctgggaacagcactcaccccacaccccaaaggaactgcttggtccaaaagatggagaatatgagcaacagagtgacactgaggatgacggccatcaggtaggcaaagatgcggaactgagggttgcggaaacactccctcaaagagtggtggctggggatgaggatgggcgtagacacggtggcagaggccgtgtctgggggcggcccagtctggcccccaggctgggggccaaggtccagcgtgtagacttgaggctggcgcaggaagtagcggctcttgggctggtccttgaggcacagctgatggccttccaggatgacatggtggggctccaggcggagcagggcgagcatggcagtgtccgtgggcaagtcagtgacaggctgccctgaggccagcactgtgggctggcgacagagtgggcacagcaggcggcgccgggctggagtcacaaggctgaggtgggccagacattccacgcagaaggagtggcagcaatccagcattttgggggtatggaacgtgttgttgaaggggttccagcagacggggcactcagcctcaagctcccggccctgctgctcagccatcctcagccacacacggggaggcttcgcgggagacgtcctggcagaagggggaaaggagcaaaggaacagccatgaagtcccatccttgtgcttggcctggggcaaagtgttctgtgggtgttgaaaggtgtaatcaccacgttttacttaggttcaaaagcgttttgttcttgatcaccagttcctaacccatcgagttgagtcaaatgctcctacagcctcccctctgtcaaggtgaaggcctgggccacccctaccaagagcccccaagagagccggcattggagcagatgtcgccctgggctttggagctggacgcaaatgctccttatggtcattgtctgtgcccttggctgccctgaatccagggagctgggggtaagctgcagtctgcgggttttgctacaggacaaatgtttccttccctgctacctcaaatccctgactagcgcagagatgggttttgtgaattccctggtctgtccctcctatggggacaaatgccagccctctttccctcctccccttgagctagagggccaaccctccacatcctactcacccagtccttggcctggcaaggaagcccctggaaaggcctttctccttacctggaagccttgcagaagcttccctgccccagtccccagatcagcccttccagagcctcttccccttccagagcctcttccccttccagagcctcttccccatcctctgcctaccctggctcctcctccctccctttgtcctgggaaaccttcagggcacgcacctgggcttctgtgggctccagggtggtcaggcagactactctggagggcctgaggctccagttgctccctcccctgaatcggcaaagctttgggagactgccttcttgccaccaacccaggggcctgtctccatggcagcatgcacgcagcacctggggctgccaggtggcccagtcggcagcctcttgagcacacctgcttggagccaaggccagagagcttcctggggggtggggtggggaggaagatgggggacctgagttccccccagggcatggcaactaattgaacctggaagccaagcacctgtgagattgtgggcagtcccttcaacacctggagtccctggtctggaaaggtagggtggcaatttcgtctttgtagatgtgaagagggtaactgagtcttctgggcttcctctctctggggccctcatttctcttcgaaagtggctggaacctcctccttgcacaaaggggctgcctgctcagcactttggttgctgtgaaagtcacctacttcgaagcttaagagctccgactatcagattcagtccagtcacccgctgatcttttaatgtgcctaagtaactgcaatcagcgtgtacaaacctcgctgccttctgctttgttcttagcacacagctggtcagccttctgagatcttagagctggccatcccaccaaccttagggagttaaagcggggagttggagggaggcgcactccagcccagcttctccgtttcaaccagaaatacttggcttttctctgtttctcatatgggtcattcgaataatttgaagagttgatctgctggggaaaagaaaaagtttaaaaaccaattctccatctgaactactcactttgcagatgagagacaagaagtgactcacccaaagtcacccagctagttaatggtgacatgggacccatgtcttcagactcatggttttcgtaaagacagaaggctgcatccatgccgtccccctactcagtgcgtgttactagctagataataagtgtttgcatgtgatcaggaatccttcacggccagaagactcatggtagaaatccaggaactgtggaagaggggatctgggggaagggagtctccctagagcccctgatatgacatcatctaccccgactgagccgatgtctgaagcaaaacctgcttatactctcggacctgtggcttcctggttttcttctagacctctggcactgctccaaacagggaaggaggaaatgaagatatgcagagggagatggagccctaagcgaaactagggtagtttagcagggctctgcaccagtgctttattctgcagtccattcatccactcggacattattgagtgcttactctagcccaggtgctgtgcaaggtattatggtgaacaaaatagacattgtctttgacctcatgacatttagagtgtagtgaggcaaaaagacatttaatgaataatgggcaataaataaatacacaattttaatggttgttaataaagggcaaaaaggaaaatgggcttcgggtgcttggtggctgctcccaatgagaccaccagagaaggtttctgcaaagagatgacagaagagctgagaccaaagtatataggaatccagccacgcacagtggaggaagagcgttgcaggcccagggaacagcatgtgtggccccgaggtgagaaaagctcttccaatttgagaaagtgaaaggagcccagggtgatcaaggtgtggtgaccggagtaggcaaggtgggagggtatagtactcgggacctgtgaactcaggagctcatctggattttattccaggggtgagcggtagggtaaggtacctgatcctatttccatttttaaaacaccattctagctgcagagcagaggacaggctgagagggataagatcgggaagggaacacccgttcgggctgcagcagtgtggctcaggcgtgtgatggtggtgcaggttaggcagtggcagaggagataaaaggggatgggataagtgatatctttggggacagaatcaaagccacttcccaagaagcagtggagttctagggatccagttgtagtttctgtcaaggttcatgatgccagatccatggctatttagggctgtgattccagttgaattgcttgacctctctgtgcctctatttctccttgtgcaaaggaagccaaaactagtaaagcttttagttagagcccagcacccagtaaagaccacaaagcaatgcatgacctaaaaatgggactatgttctcagaaacacatcgttgtatgaacagcacagagagtatttacacaaacctagatggtagagcctgctacatgcctaggctatacggtctagcctgttgctcctaggctacaaacccatacagcttattatgttctgaacactgtaggcaattgtaacacaatgataattgcgtgtgtctttcaacataaacttagaaaaggcaaggtaaatatatggtattataatcttaggtggccaccatcacatatgtaattcactgttgatcaaaacattgttatggatatatgaggcagttgaaattattaatgcaaatggatttgagagaaaggaagggtcaaggttgatttcaaagccgtgacaaagtcctctgcatcaagctttgagaagcccctgaatcccagagtgtgttagaagcagatctttaatacttaccagaggccgtaaactgtatgtaaccttgactcatcatttcccccactgggaatcgattccacggaaaccatcaaggacttctgcaaagatgtgagtaaagagatgcccatccaggcgctggtttaacggtgacgtatggagaactacgtcatcatccagtaataggacattgattaagtagattctgctccatccataggaagagatattatgcagcctttaatatgatgtggtaaaactattaatatggatatatacctaggatataatgtcattaagcgaaaaagaaccagcaacaaaaccatattaccatataatccaatttccaaaagtgtgtgtgcaatggaaaaaatgtctggagagataaacaaccagatattagcagtggttatctctgggggcaagattataagttttttttttttttttaattctcttacctgaaaattctaactttactccatccagtaagcttgtattactacacgtcaagatctcctgtttccccccaaatcagacctaccttctctgaagttccatggccagaactgtaaaaggctgtccaagaggaggaagcatcattattgcctggatctttatctgtgctgctctcccagggatccactgctgtttcaggatcagctggggagagattctggccatgtatcacctccaccccaagccaggacatctcagctacagtaaatcctaaacaccgccccaaagtcatctccttggtctatgaacaagtcatcgccaaatatcaattgtccccagcatcactccattgttttcaaccaagaactggcatttccatagcacttcacagtttacaaagggccctggcccttgctaagatctaagtgtggtgatccatctagataggttactagccttttgggattttttgttgttgtttgcagaaagccatttgatactctaaaaccaccctgtgagagaggctgaatggggagtagaaaggtgccggctttggaaccagatttggaacaatttgtcttggacaaatggcttaacctctctgaacttcattttcctctgtaaaaaaggctaatcatcccactcctacaaggttgctctggggaaggaatagtctatacggtgcccagtagaatacggaaggcgctcaatacagagttagcatgattatttttagacccattttctagatggggaagccaaggctcagaagggtgaggcaacttgccgaagtcttcccagctaaagagtggctgagtttgaaagatgaacccagtagcctgccctcccaggccagagttcacctgtcgcgcgctgcacggctgctgcctctctggactctggagccctgtgacccgtccctccgcgaccctctctgtctccttacctgctccctcggagccgcctcctccgcctccgttcgtgcagccctgcacgcatgtgctttgttttctgacttcccaggcccgatttccaggtagcgtgggtgggtcttatttgcataggtcttagcagcgtttggccagctctcgctgtttcaggttttcttcttccttctggtgactttggacctcctgtacaccctggaagctttggttgctttgtctttctcctgtgagtcactctggctttttctctgaggggatcaagtgcgctcatccttgcaggcctctgttctgggtccgattgatctcctgccatcccctcggattccactgtcctctgtgcgctgacctgcctcgactcctggcttctgccgagatggatccttccctatgctgagtccctgtaaccaaaatacagatagctcttgcaaaatactgacaaaagcggccactaatacagcagaaaaatagtcgggagacggttgagcgtctgcctgaagagccagggttctcaagcaaggcacacttctaggtcagagttcagccctcactgagaatccaaactccgtttaactaccgatggagacttgagcaaattaattaacttctgccagcctcagtttcctcacctgaaaatggccataataacctacctacttgatctgtagattaaatgaggtaatacgtgtcgagatcgcgtaataacacagggcctggcagacagtaactcgctaaatgttaaccagaactattattgttataaccggtctgttcacgtggcccatcttttgttcccgctcaaattctttttgtacctatggtcctcttttctttctctctctctttctttctttttttttttctttcttttttttttttttttttaagacgtagttttgctctgtcgcccaggctagagtgcagtggggcgatactggctcactgtaacccccacctccctggttccagcaattctcctgccacggcctcccgagtaactgggactacaggtgcgcgctaccatgcccggctaatttttacattcttagtagagacaggatttcgccttgttggccaggctggtctcaaactcctgacctcaggtgatccacctgcctcgacctcccaaagtgctgagattacaggcatgagccaccgcgcctggccccttatttctttactgacattttcagccatacttgagaaataaacaagtaaataaatgtatctgcttggtgatgtaatcaaatgccctagtccccgcattttgtgtttttttacattaatttttatgtattgatttattttgagacagagtctcactctatcatccaggctggggtgcggtggcacgatcacagctcactgcagcctcaacctcctggggtcaagcagtcttcccacctccgcctcctgagtacctaggactacaggtgcatgccaccgtggctggctaatttttgtatttcttgtagagatggggtttctccaggttgcctaggctggtctcaaactcctgggctccagcaatccacttgccaaaagtgctaagattacacttgagccaccgtgcccacatttgatttttaaataggtaatatatttacatggttgagcatgtgaatggtttgatttcacagtgaaaactgtctcttcgcagccacctagtttccctggaaatcaaagtattatactatcagtttgttgtgtatctttccaaagatgttttatacatacacaaacagcatgtccatggcaaaacatctatgtattcctttacctcctttttacacaaatgtgcatattatgtacactgttctgcatttttcttttttcatttgatgatgtatttgagatatcattctgtattagtacataaagaccttcttcggtttttggcccagcgctgtgactcacacctgtaatcccagcactttgggaggccaaggcgggtggatcacttgaggtcaggagttcaagaccagcctggccaacatggtgaaaccccgtctctactaaaaatacaaaaattagccggcgtcatggtgcacacctgtagtcccagctactcaggaggctgaggcaggagaatcgcttgaacctgggaggcagaggttgcagtgagctgagattgtaccactgcactccagcctgggcgacagagcaaaaaaaaaaaaagaagaccttcttcggttttttaatggttgtatcagatttcattgaatggctgtaccataaatcacttcaccaatcccctattgatctaaccccctcattataaatatataaatattgaatgaaagaataatgcaaaaatgctgattttaagttagcctagaattgtgtgaaaataaaactgtggactttgggaagttttagatctctaaagaaaatgtctaagtaattctcctctttctgagctggagacgaggtatatgatcaccgatggcctcaaagttcctctcagctctggaattccctgcttttcggtgtcactactggttaactgaggttactggggattcgagacactgatttagtccaaagaacctggtttgtatttgagagtttggaagtcacgctttctggcttggcaacataagaaaacataaagaagttcatctactttgacctaatcatgtaattccccagaagcatcaaaaagatatattttggttgagtgaggatattcattgcagttttattttaatcacaaatgattgaaaacactccaaaaccccatcaattaggtgaaaaactacataatcatttaaaatgatatagaaagattttcattgacttttaaaaatggtcacagtatactgtaaatggagggggaaagcagcttaaaaatggtgcatgttggccggatacggtggcttacgcctgtaatcccagcactttgggaggccgaggcaggcggatcacaaggtcaggagtttgagaccagcctggccaatatgttgaaaccccgtctctactaaaaaatacaaaaaaaaaaaaaacttagctgggcgtggtggcaggtgcctgtaatcccagctacttgggaggctaaggaggcaggagaatcgcttgaacctgggaggcggaggttgcagtgagccgagattgcaccactgcattccagcccaggcaacagagagagaatccatctcaaaaaaaacacaaacaaacaaaccaaaaccaaaacaaaacaaaacaaaaaaacggtgcatgttggctgggcacatgcctataatcccagcactttgggaggccgaggttggaggattgcttgagcccaggagttcaagactagcgaccccattgctacaaaaaataaaaaaataaaaaattagctgggcgtggtggcacatgcctgttgtctcagatactcagaaggctgaagtgggaggatcacttgagcccagaaagtcaaggctgcagtgagcccagattgcaccactgcactctagcctgggcaacagagcaaagaccctgtgaaagatagaaaagaaaaaaagaaagaaaagaagaaaagagagggagaaggaaggaaggaaagaagaaggaaggaagggagggagggaggaagaaaggaagggagggaaggaggaaggaaggaagggagggagggagggaggggaaggaaaagaaaagaaaaggaaagaaagagagaatgtagcataagccagattttgtaaagcataatttatgtataaagactgcaagaccatgaggcaaaatgtcacaattttatctctgggtgatggccactcatgttttcgctttcttcttgcttacattttccaagttctcaaatatgtattacttttgtagtaagaaagttcacttagaaagtaagttaagtctgagttttctgcaaccagggtatccagaacttaaaaagataagcaggtagggcaggtaagaagtcagtcatgacattgtaagcattgaaataaaaataaaataagtcatagccaggcatggcctgtaatcccagcactttgggaggccgaggcaggcagatcacttgaggtcaggagttcgaggccagcctggccaacatggtgaaaccccgtctctactaaaaatacagaaattagccaggcatggtggtgggtgcctgtaatcccagctactctgcaggctgaggcaggagaatcacttgaacctaggaggcggaggttgcagtgggccgagatcgcgccattgcactccagcctgggcgacaagagcgaaactctgtctcagaaaaataaaataaaatttaaaaagtcatggcttttttccaggtcactaattgtctagtgagtctatgcattatcataatgtctgtgggtggtcaggctaaggagtgctttgccaacagtgaaaaatttttccagggagatacccgggagagatagtgaggcatctcaggaacttgagagttaaactaatttataaagttcatgcttgtgggggcaagatcagccatctggaaaagcacctcacctaagcagtaccttagacccgggtgagtgaagagtcatgagactcggtggagcccagccaatgtctggagcagaggcgtggggtggttttaactcatctgggaaggaagaggtggcagagggcagaaggatggagaaaaggtgatgagtgcagcaggtttagaatccggcatggtcagtgtttagcaggccccagtcaagggcagagggcaactctccctagggggccaccatgtcatcatcactcagagccttgcctgaggcttgtctagcatttaggacagttccggcagcataggcatcacttagagattgttagaaatgcaaaatctggccgggcatggtggctaacacctgtaatcctggctctttgggaagctgaggcaggcagatcccttggggtcaggagttcgagactagcctgggcaacatggtgaaaccccatctgtactaaaaatacaaaaatcagctgggtgtggtaatggacacctgtaatcccagctactcgggaggctgaagcaggagaatcgcttgaacctgggaggtggagattgcagtgagccaaaattgtgccattgcactccagcctgggcaacagagcgagactacgtctcaaaaaaaaaaaaaaaaaaaaaaaaagaaagaaagaaagaaagaaagaaagaaagaaagaaaaacagaaatgcaaaatctcagacccactccagacctacggaggcagaatttgcatttttacgagatccctgggagattcagagacacattcattacaagtgaagagtactgatttaggagacatacctccagtatatactccttgatgccttctgattatattcagcttcagattcataaaggctcccaaggacctgacaccttaggcagggcaacgtgaatcccagcctggggatgggcacccccggcctctgctgtgtgcagcatctgaatttgctttccaagtcacaatcccttattcaaaacatttggttccaagtgtgtttcagaattcagaatttttcataattttaggaaggtaagatgatgcatttgccaactctcccaattctcccagtgggatctggggcagtaccctatattcaaacattgatatcttgcagcttattatgaatattgacaccgaaaagaataaacatcacaagatcaggtaagttttggcaccaaatttaatggaaaaccttagttttcaggctgggtgcggtggctcacacctgtaatcccagcactttgggaggctgaggcgggtggataacagggtcgggagtgcgaaaccagcctggccaatatgatgaaaccctgtctctactaaaaatacaaaaattagccaggcgtggtggcacgtgcctgtaatcccagctactcaggggtctaaggcaggagaattgcttgaatctgggaggtggaggttgccgtgagccgagatcgtgctactgcactccagcctgggcaacagggcgaggctctgttgcaaaaaaaaaaaaaaaaaga

SEQ ID NO: 1169 - DNA, 157489 bp, Homo sapiens
aaaaaatgagttattgttaaatttatttttaccggtacaaccctatttcacgttttcttcttctaagagtattttacccaatgtataatctgttatacccaatgtataagtgattggattttttccctctagtatcaaatgacttttttcccattgtaccagcttttttatggaatttcctgatatctttagaagcactgcctgaaggtgctgtattagtagtattccaccttgctttgtggagtgtgaaatcccgtttttacctcaggcagtttcttctctacactcagaaactgacaataggtcgctgacagacagatattggtaagaaacatagagaacagggcttatgatgtttgttcttccttgttcaaacacttcttttaaaaacatattattcacttatattttttaaagggcataagaaatgatctagggaaaaggcctacccccagagggaaaacaactatgaagttatattcaattggaattgctgagatgaaaaattattcacaattttttacttaacagttccaaactatttagttaataaattaaaacagtaacatcagacaccatcatctcacattgaaacttgggatgtctggtcatttgatgtttaaggaatggtgtcattatagataagactggaaattttataaatttatcgtggaatactgccatctcttatttttgcttgagatataaagtattgaaactaaaaaagaaaaataaacaatgtttcacagtcataatatatactcatgctgccaattaatgtaagctttgggtcttaagagaatgaggcagaaagtacaggtaccactgaatcttcctgtgtcacagaacagcaacaagggcaacacattaaatattaaaataaaataaattatacaatttaacagtatatatttttcacatcataaaagcttctggctacattttctactgttattttagggtgcatatttagtttttcttctttatcagaggaggttctaatttgaactccattacacaccctttgttctcattgtccttattgtaaacagaaaaactctataagtgacactaaaaacgttttgcatgatagcttttagtgtactgatctatttattgtgcttacctatcctttgtctacatatcgattatcagatgaacttagagctatcttgtctaagttttcaggaggatatcaagctcaccattgggtaagacctcagcccactggtacacaagaagttaaccagagtacctaaacacaattgttccggttgactgttcccctgagcagtctgcaacattttctcttatattccacagaaggtccttgtgaattcctacctcccagcagatcagaaaaccttcaccctcattgccatcttattcaaatgctatctgttcttcaagtctagattagttctgtctcttctacaaaaccttgtctccccaccacaccgcagtatatggtctcacccttagggaactctttcacctaatgtctgtgccacttatttggcatttacgtagcaataacatttcatgacacaaatttaggagttctgagattgcagtagtcctacagaacattctgttgacacttgacttacagtattctttaaccttagctagatattaagtacattgagcagctaccaccaattattatgaaaaaacacagtgtattaaaatattttattatatgtaaacaaattttaaaatataggttgatttgaagtttagagtacaagttagaaaaagaaaaactggctggaagcctgtttcattaaagaaagtcctcttactaaaagtagtggagagaaattctatcacatttcataggagccagttagtattatacatccttttcctgcccctatatcctgagcctcaatctctgtcttctgctcaaaggtatcatttcgacagttctcttcatcttgcatcatttcttttccctctctattgaattgctcccgttaataaacacaggctgcaatatttcctgtctttaaaaatgcacacaaacccaagacaaaacctcccttgacccatcttcttccagttgctacctcacctctctgttccctttaaatggaaaaatgccttaaatgagtcatctttgttctctccctttactttttaattttctcctgtacctattttaatttagcttcccctacacacaaacttgccaagggcaaccgttagctccatatgtttaaactttaagagcaattatcataagtagtcttttaaattgtcccatcaataggatgatatatcagtttggatcctccgagaagcaaatgccaagacacataccacgcacttgaagccttattaatatattctagcaaatatactacatctggtatagcaactgtagctgaggccattattggagttaacttgtggtattctacactcattctccaagatctatccagttttggcaggagccctagtgaattaaatggagatacgatagaagccatgaaccctgaaacctttagatctttaatagtggtactaatcactgtcatccccctgagatttgtgttgtttttgatttacaatttgtgttgagggaggggaaggaaaagggggccagttttaaaggtttccacttggccttccacactatggtatcttttgccacacaggccaaagattcagtgagggggttacgccaatcacaaagtatgttgatcccaattacacatttaaagagtaggaaaatgaccactgggtggggctgtggcccgagtggacacattgtaggttaggttttagccagaatgcaatttaatacctgctcccataagccccattttaacagagggactatgataatgcatcaggtttctggatgcccatatcaactcagaccctgtatccaagtgtctgaaatgtctgggaattcccgcttccttcagttgtacagtcactggagtaagtggccatagttgccgttgcagtatatgcctgtgatgatgttgcagggtccttccactgtcagtcaatgagttgcaaatccaaaaattggctcaggtccgggaattgagcaaggatcatgatttttatcagaaagaccacgttagccccctgtttctttaattttgtttttatgatcattaactttgggtgtcacatttttgcctttgtgatagttaattttaggtgtcaacttaactggattaagagatacccagatagctggtaacatattatttctgtatatgtctgaaagggtgtttctgaaagagattgatatttgaatcagtggactaagtaagaaacatctttctgtattgaatgtggatgggcatcatccagttgactgggtgcctggatagaacaaaaaggcagaggaaaagctaatttgctcttactctttctgctgctgctgggacacccatattctccttcccttggccactagaactccaggttctctggccttcagactcaggaacttgcaccagttgctcccctcaggttctcaggcttttggcctcagaaagagcattacaccattggctcccctggttctcaggccttcagacttggactgagtcaggctactaaattccctggatttccaacttgcaggtggcaaatcgcgggacttctctgtctccataatcatgagaaccaatccccttaataagtcccctgtctatctatctatctatctatctatctatctatctatctatctatcatctacctatcatctctatctgtcatatatctatctatcatctatttatatatcctatcagttttatttctcttaagaaccctgattaataaagccttctactgattttggatgttaaggactggctgtccatttattttgccctagggatacatgctttgatatggtttggctgtatcccccacccagatctcatcttgaattgtagttcccataatccccatgtgtcatgggagggacttggtgggaagtaattgagtcatgggaatggttaccctaatgctgttctcgtgatagtgagtgagttctcacgagatctgatggttttataaggggcttttcccctttgctcagcgcttctccttcctgccattgtgtgaagaaggacatgtttgtttccacttctgccatgattgttaagtttcctgaggcctccccagctctgcagaactgtgagtcaattaaacctctttcctttataaattacccagtctcaggtatttcttcacagcagtgagaagaaactaatacatgctttattaactatctccacaatatctatggtcaagcccctttggcttcctctctgtcattagtgataagggtccctggcttctggtggtcaagtgcagccatctggcctctattactttaggcccgcattgtgaccatggatgttaacaagctcagctctggatctgcctctcctgccaaaagctctgcctgcagaggagaccatcactgagcttcttcgtgatgcttgtgaggctcctttcatcagcacattcctgatgaccttgatgaatgctgcatcctctggtgggtcttctggcttcacattatatgtccacttcagcattcccactccttagccttttaattccttactctaccttttgacagggaaactcagaaagggcctttgttgtctcctggcttctgaagccaccctagccacaaatttgcctcatctccattggtcttttccagaatgttaaatctcatgtcccaggaaaatctcacccagtgaatgaattcttgcttacccagtcttaccttcccatccccttgaccttcagaatgcaatgccagcattatcccccccacccctgccagtgcatgttagctaattcttggagctcctatgggatgtaatctctttccttccttatcagatccagcatatccctagtcaagttatactgggatttatccagcatagttatcaacctggctgtcaggaaagatgaatgtggttcctgagggcacatcagttgcctggttgagaagaggcctctgtcacattttcctctacagagaaagtgctggctcttactttggaggggtgggccacctctacaagctctgagggatcagaagggtctgctgagccaaaatctttgaggtatttatctaaatacctttattctgtgtttcagggcaccaggttttctcaacagacccaccttgaatgagcacttaaacgtctcaagctctgcagcactatagaatgctgagtttgctcctcacctatatgtatattttttatttattatgtctcctcttccaactacaatgctggaatgtaacctccatcaaggcagagactttgctttgtttaatgctctatttttagcacctgtaacaatactttctgcattttaggcactctattaaatgagtaaatgaatgaatgtgaagatctacaaaggaggggtaaactctaatagatccaccctaagtgattttatgcagccatcaggaaccctcccaaaatatttttaataattagaggtaaagcttatgtaataatgttaagtgaaaaaaactaggagaggtacaactacaactattccagccatgaaaataagctcctattggggagaaaaaactggaaggaaacatcctaaattattcacagtagtgtttggggagtatatttcggccccttaattcttctggttgtatgtgaagaagcccgaaagaatcaggataggtcatctgattcaggctccctgtaaccctgaccagctgccaaaaggaaagttggacaggcttctttttaccaaggagtatcaaagagaagtcaaggacaccctaacatccatcctacattcatagaagctattctgagggtaaaaggtgggtttgggatagggcagaaactgagaatgctaaaaataaatgtttttttcctttagcatatgttcactattacttcaagggcttcaagaagaagtttggtcctcacttatgtctgatattaacttcaaggcagttgcccaacttctataatctgtctaggtctcaactgataactcattattgaaagaatcctcatgagtccccagtggcattagatcaattttctggtatccctggtatgagccataagcaaggacttgtcctgtaataggctggaagtagatgatgagaaaatctatttatcaatccattaaaaacaaatacctactttggcatggagactatataaaggaataaaagacaccatcctatcttcataaagcttgcaatttatttgagtaggtaaaatgcatagaaatagaatggaaaaaacttgcagttactgccaatgagatttaaagacagtaagggcaaaagtaattctgggaaggaacagggttaggggcaggcctttccaaagagttggaatatgagctggttataaaagttgagtgagatttagtaagcagaaaagaataggccaagagagtccaataggaaagtgaaagccaacataggtaagaaatgtagagtgcatctgggcccagaaacagactttttctcaagaacatttggagtaaaccattttaatcagaattatatcaacatatttattttatctagataaatatttcctcaattggcagtgttaaaccataaacaacatagcatttgcttccaaccctatatcgcatttcaacttatttaaatatttttcttatggattatttcttttccttgaacaattttaaatgaaggttagattcattgatcagctttttcatataaactctttccagttgtagcttctgtctttgtgagttattacttctctcaagtcttcctaggtcacatttgcagatttaaaaaaaaatatcagcagggtgcagtggctcacgcctgtaatcccagcacttttgggaggccacggcaggcagatcacctgaggctggcattttgagaccagcctgatcaacatggagaaaccccatctctactaagaatacaaaattgccaggcgtggcagtgggcgcctgtaatcccagccactcgggaggctgagacaggagagaatcgcttgaacctgggaggcggaggtagcagtgagccaagatcatgccattgcacttcagcctgggcaacaagaacaaaactccgtctcaaaaaaaaaaaaaaaaatcaataagattttgttcttatgctaattttttgtgaataatatatttaaacaagagccgtttttagccactgtcaattttttccttttgattataagatctattttttctagaattaacttccaattgtagtactacaatttcagaattaaccaactaactatactttatcaaattatttttatctataatccattttacacatgacatttttagccactattttattttgaattaaatatttctaccactattatttatcttgaattataaaaaatactgctaatttgcacttatttcttagctgaaacatgaaagttttgtaggctgttcccctcagatatcctatacattctctattgcccaaattgtaatgcaaatgtactatacggcaaatctaattcttctatacacttctgatgtctttttgtatcttccagagttaaaggtccatgccactgtcagagcaaaaacctgactgcaagcaacagaaactgactctggctggtttaaaagataagtgtttattaaagggatatggggataactctcagaaccttggagaagacttgagagcagacagcagaacgggtctagcctggctgcccaaactatcagaggcaccaggctctagactagctctgctgactctcctggccttggactcttgatgccacctctagcaccagtgtcccctttgtgccaggagccagattgatatgggttggctgtgtccccacccaaatcttatcttgaattgtagctgtcataatcccaatgtatgtgggagggacccagtgggaagtaattgagtcatggtggattttctcatgctgttcttgtgatagtgagtaagtctcaggagatctgctggttttataaagggcagttcccttgcacatgctctcttgcctgctgccatgtaagacatgcctttactcctccttcatcttccaccatgattgtgaggcctcaccagccatgtggaactgtgattccattaaatctctttttctttataaattacccagtctcaggtatttcttcatagcagtatgaaaatggactaacacacagactattgcagttggcaccatcaccagagaagacttcccgtggtctctgattctttgcatccctaggtctcaattagaagcctggcgcaggtgggtgggtgggtcttagtggtgagggctgggtcacatgcctgccttcttactgcaagagacactgggggagcgaatggaacacagttcccacccagattataaaggcagaggaattacccagcacaggaaggggcttcatatcatggcataacaaaaagaatggcaaatgcccattagacgatgagaagatcagagacaaaatatcctgccttattcagcagaatatcagatgtggcagagtgaccacaaatcctggaccttaacttgggggctgttcaccatagaactaacacattcacttctctgtgttccttgccaatcatctgtgcaggctctcaggtagtaggcaaattaaaagattaactaaactatccaaggtggaagtggatacatgatcttcttccacagcagattttagcaaatgctataatcaaaatgttcttctctatatctagcaaatttcctgaatactgcaactgaataacacacagaatggcttcactggtgttgctgttagagcaattgtggctttaagatttaaatggacaactgcaaaatgtatatattggttttaagttaaggtgtttctctgaagagcttttttatataatagttctcatttaggtatttattttttcatatggttgttaaaaatcacacagcttgaattaacattgtataatcatttatatttaattttaagcataatttgatacaaaatgtaatcttaagtattttatacataaaatagatatggcaaatagcaatctttatactagttaatttccataatagcacacaagtcagagtgattttatacaactgaagattacagaatgcaaaacttcaggacttaaaagatcttcacagtcttattttcaacatgactgaatctactgttgtaagcctcaaaactacaaaatattttacagtagtgattaaagacaatatatatcggctaggcatggtggctcacacctgtaatccagcactttgggaggccaaggcaggtggatcccgaggtcaggagttctagaccagcctggccaatatggtgaaacctcatctctactaaaaatacaaaaattagccgggcgtggtggcacacgcctgtaatcccagctacttaggaggctgaggcacgagaattgcttgaacccaggaggtggagtttgcagtgccgagatcgtgccattgaactccagcctgggcaacagagcaagacttcgtctcaaaaaaaaaaaaaaaaaattaaaaaaagataatatatatatcattgcagtaacagctttccaagtgatttctcaagtcacaggtgctggtttcttctgtatgtgtgaaattatttctcatttccttggtcccatttgagattatctgtagttcagttgacccccctgagcctactccttagcctcttctttatatcgctgaacacacctattctgtctctaaacatgtggccaagatatttttattacagcccaaactgaaaggtgggtaagagcctaaagcacctcaagggagaagggagagcagtgtttcccttccagacttctgagtcttcctaagctttccacatgcttagtgttcatctcataattctactgaaagtcaggcagctggtatggggattgctacaactgaaaccaaatggctctcagaaccaagattagaaatcaggaacgttgcattgtttatttggagttatagaccaccatgacatttatcattctagcagagttttctttcagtaactactgaatgagagtgtttatctcaactctctatttcccaaacaacgctattaatcagacccatctccatatccactgtgagtgagacaggcatagttcaggccttcaggcttgccagaagggcagtaagccacttgtttttcttggcagaaatctttgtctgcatgtggttccttctcttctttcctcagaccacaagattcagattcctgggagcctagaggaccctcagacttttcttcaccttggccacattctgtagcaagtaccatatagtttaacccttctcggttcttcgtttccattaaagcaactggcataatgtcatctgaattcaaacaaatcacatcgccatcttcacctgtgaaaaaaatatgaatgttattctagcatgtatttaattatttatttgtaataatatacaagctatatcagaattatagcaacaccaactttacacatttgttcagcaaacatttatgaagactactaagtgttgggaatacaaagacaaataaaacatgcttcttgtccttgaggctgctgcagtctagcagggaagcagaccatatagatctgctatatgtatatatatgtcacctatagaaggtgacatgcactttaataaaggaatatttttaaatgtagtaggagcacaggggtgattaactctgccttaacaagcggagcaagtcgtggtctttgtgataggacttaattggcccttagagggccctttttgtctaaagtatgtacttttttatacttccacagcaactgaaatatctaattttaaagattggtttttctagatttagtaattttgctaaattaattgcttaatgtaatatttactgatgactactacattccaagcctgtgttctagttattgatggatatagcaatgaatgaaaaacatttctacattcagccctgacacacatccaggtttgatttatttttaatgaacttcaattgaaatatgaggaaaataccataatttcaaaagactaagggaggtaccagtgtacctatttttcccaataaaaatttaatggatctacctatttattaagtttaacacctgaactacaaagcttattttataagaacgtatgaactacatcccttctccccatatcattaggtatgcatctcctttttgcagaccctccgaactgctgaagaacaagatagccaagctacaggttcacaggctctttggtatcatctaattttcctcttcattgttcaaacatcattatagcatatttcaaaacacatgaatagttagatgtgttgtaaaattatctccctaatagaaagaacttcatcagatgccaagtttggttagtacctgggtgttgaacacctgtggaaggtattcaacacctgtggaaggtattcaactgttatgattattgccaatatgcactaatagtcattaagatgcccataagaataacttggtatatgtaataatagcaatggaaaatatttttaaatgttaggaaaaaataagatatttaactttaagtagtacagtaatccaataattggggaaattaggatgttcttaataggcttaaagaaatcagtctaaaggaaagtttagaatttcaacaaaaacttaaatctacaatatagtctacccactcatatcagctatttcattgtcatacatttaatccatgaatgagcatattggaaaacttcctactaaaacatgattttaattttttaaacttttttgcttattgaattttctgaaaaataatattttatatgaggcaaataaattctttttgcaaattctgttgttatgtgtcaaagaaaaatcattagctaactactttattggtttatagtacttgtagcaatatttagtaacttgaccctggcaagctttcagcaattagtacatcttcttgttgcaaaaagagcttacaagagactgcgatagtagagataggttgtcttatttgtttgcttttgtttaaaaattatttaataagtagtctatgggtcagatcttaaggcagatatcctcaacaaagatagcatgcactgggcaacctctttaagagagaaatattaaaataaagacttccaagtaagacggggtatttacagactagacatatgccggctgactggctatgtttagaacagcagaggagcatttagatttgtttcctgtagaactctctgggactgatgaggtgatgtttacacaaatgtttggatgaagtcactgggatatttttactagatgcccagatatgttactaatcttctctctctatcccctttccaccccattaggtcagtaggaccacaggataggcatggtattattgctccctgtttttctaagcacccccacttctttgctttaaaaagtcctttcaatagcttttcttctctacgtacatatctccaacaacaacaatgaagacagtcattttattgctttgctaaatatgcccaccagtctgcaaagcagtaagctattattaaacacattattttttattgaaaaaataattaagtttaggtttgccttgaaaggtctgttgcactatttctatcctttgcagatatgcaaactccgcctttaattcagttttttctctcttccctgcctttcttgctcagtcacaaactcaattatcaatttagtgatttccacatctcttttcattccttatcttcaggatttacattcattgtaaataacagaacagcaatttctcttttcctaaaattttatttctgtcatggcccagaaatgcttgtttctttctaaattgttatagtttgatgatattccctgttaaattcttcctgcatcattactttgaatatttgtctgcttctctattgttgggaatattacttagaattttaattctttctgccaacaacttggtacctaaatagatttggtataaccagaaaaaaatggtgtatattttctagcaggtcataagtaatcattgctttcattatacctagctgtgcagtacactattggtaacataactggggatattgtttgggccatttccctactacagccagggatttgtgaaggctgagaggaaaggctcaacaatggagacaaactctagccctatttcagcagtatgattatgagcaagtcactaaacctcagttttctcatctgtaaaatggtgatatagtaatatccgcttcataaggctgttataaagatttaatgagttaacctacatagcacagtgagtggcacatggaaaagtactaaaataaaattagctactattctaattaaaagcctttcacagaggtattttactctttatattgagtgtgagcattgtttcttacctatctctgcctcatagatgaactatgcaatgcaaaatggtgaaaagattttctcaagggtccgtggagacttcaagtagaacctaaggtgaagctaagctctcaggcctgctaacacccattatggcaacctctgtgacattttttttttcttttcatttcttttttttttgagatggagtctcactctgtcgcccaggctggagtgcagtggtgcgatctcggctcactgcaagctctgcctcccaggttcacgccattctcctacctcagcctctctagtagttgggaatacaggcgcccaccaccatgcccagctaattttttctattttttagtagagacgcggtttcaccatgttagccaggatggtctcgatcttctgaccttgtgatctgcccgccttggcctcccaaagtgctgggattacaggtatgagccacagcgcctggccctctgtgacttttataatgtatctttgcacattagaaggaaaggattccatgagcaaagagttgaattttagaatacaagtcaactgcaaaatctgtgcaaccctctggattgctttacctctctgcagcatttgttcactctttcctttctaagcctctctcctctggatttccataacaacactccctatggctttcctcttccctttctggctgctcctccccatgtccaccatctttgtaagcccctcctataccggctgctctctgggttccacccacttgtcactctcttcttatttcatacactctactttaatgacctagtctgcaccctggacttcaaccatctatatttacaggacagacctttcaactgagtatgaacccatatcttgactgtgtcctggacttctccgcttagatatgccaagccaactcaaaccaaacatatgcaaaactgttcctcttcctatgttcctcatctccaggaatagcgttgatttttaccaactttctcctttctcttttttacgcacttagttgccaagtccgatagcatctacctctgtggtaactccggactcttttttgttctctctacacctgttaccattcattaattcagctttcattacttttcattccttacttttgattagtgtgaccaataaccctccaattttatcacttgccacattctcatgtataataaacaaagtgcagttctatgaatacctcattctctattattccctgcctttctacatgctgcttcttctatcctgaaatacataggatacctcagcttctctttttcatacctaagcttctaagtaggtctcagcttagatgtaacctcctcccaatggtttttcttgactctccctctgccatagtgtagacttggcatccttcctctggactcccacagaacatggatttcttctcaataacaacatagaatgctcatttcctggattctggcagaagatgtaatacaaaatcatcttctcaccaaatccttaaaaataagcttatttgtaagaaaaaaatgctggagaacctactacagaatctacagcccatgaattcctttagattacctaaatttagtatctgaatccagatagtatatatacaaacatacataaatgagcatttctgtaaatggctatatatgcacatacaatatctgcaaatatataaccaaattgttagctctggctagcactggggagtgagataaggatgaattaggaaacttttactttttagactgcttaagtaattttatattttttataataaacataaattacttttacaataaagatctttaaaatgtagatacaattataaaataatacagcaagaacagttactgagattactggaaaagttacaagaaaaatagaaaggaatcagaagtcatttttatggttgtaaaataacataaaaattgtttttaaacttttaagaaggtcatgattgtgttaattaataaagtctataaaattatagtcacaaagaatttgagccttatctgtcaaaaaatttgagccttatttgttgcttttaatgataagagcacgctaatatccctgatgaacacagatgcaaaaattctcaacaaaatactggcaagccaaacccaagagcacatgaaaaagatagcacactatgatcaagtaagatttatcccaggtatgcaaggatagttcaacaaatgtgtatatgttgaagacacatgatacattacatcaacagactgaaagacaaaaaccatatgatcatatcagcagaggcagaaaaggcatttgacaagatttagcattctttcataataaaagctctcaaaaaattaggcatggaaggaacatatctcaaaataatagaggttatatatgacaaatccatagccaacattgtactaaatggaggaaagttgaaaacattttctctaataactagaacaagacaaggatggccattttcaccactcttattcaacatagtactgtaagtcctagccagagcaaccaggcaggggaaagaaaataaaaaggcatctcataaaaggcattcacagataatattatcttatatctagaaaaacctaaagattccacaaaatgtgtcttcaacatatacacatatgttgaactatccttgcatcccagggataaatcttacttgatcatagtatactatctttttcatgtgttcttggatttggcttgccagtattttgttgagaacttttgcatctgtgttcatcagggatattagcgtgctcttatcattgaaactctgagatttgataaataaattcagtaaagtttcaggatacaaaattaatgtacaaaaattcagtgcatttctatataccaaaaataatctagctgataattaaatcaagaaggcaatgccatttacaagagccacataaagaatgaaacacctaggaatatattaaccaaggagatgaaaattctctacaagggaaactacaaaacactgatgaaagaaattgtaggaggcacaaacaaatggaaaaatattccatgctcaaggattggaagaatcaatattgttaaaatggccatactgcccaaagttgtctacaaattcaatgcaatccctatcaaaataccaatgacattcttcacagaaatagaaaaaaatctgaaaatttatatagaaccacaaaagactcggaatagccaaagctatcctaagcaaaaggaacaaaactcaaagaatcacattactggattcaaattatactacagacctatagtaaccaaaacagcatagtgctggcataaaaactcacacatagatcaaaggtacatatacagaatggaatacataaaaaagaacagaataaagaacacagaaataaattcacacacctacagtgaattcatgttttacaaagatgccaagaacatctactggggaaaagacagtctcttcaataaatgctgctgtgaaaactggatatccatatgtagaagaataaaactagacccctatctctctacatatacaaaaatcaaataaaaatggattgaagatttaaatctaagacttcaaaccatgaaactactacaagaaaatactggggaaaatctccaggacattggttggggcaaaaatttcttgagcaacaccccacaagcacaggcagtcaaagcaaaaatggacaaatgggatcacatcaaatttaaaaagcttcttcacagcaaaggaaacaatcaacaaagtgaagggacaatccacagaatggaagaaaatatttgcaaactacccatctgacaaggggttaataaccagaatacatagggagctcaaataactcgataggaaaaaagctaatagtctgatcaaaaaatgggcaaaagatttgaatagacatttctaataaaaagaaatacaaatggcaaacagacatgtgaaaaagtgctcaacatcattgatcatcacagaaatgcaaaccaaaactacattgagatatcatctcagtcaagttaaaatggcttacattgaaaagacaggcaagacaaatgctagcaaggatgtggagaaagagaatcctcatacactgttggtgggaatgtaaattagtacaaccactaagaagaacagtttggaggttcctcaaacaactgaaaatagatctgccatttgattcagcaatcccactgctgtacatatgcccaaaagaaaggaaatcagtacatcaaagagatatctgcactcctatgtttattgcagtactgtttacaatagctaagatttggaagcaacctaagtgtccatctgtagataaatggataggccaggctcagttgctcacgcctgtaatcccagcactttgggaggcagaggtaggcggatcacttgaggtcaggaattctagaccagcctggccaacatggtgaaacccagtctctactaaaaaaaatacaaaaattagccaggcgtggtggcacgtgcctgtagtcccagctactcggaatgccgaggcataagaatcgcttgaaactgaaagggggaggttgcagtgagccgagatcatgccattgctttctggtctgagggacagagtgagactgtctcaaaaaaaaaaatagacaaatggataaagaaaatgtggtatatgcatatagtacagtggagtactattcagctataaaaagaatgagatcctgtcatttccaagaatatgtatggaactggagatcattatgttaagtgaaataagccaggcacagaaagataaatatctcatgttctcatttctttgtgaaatataaaaatcaaaacgattgaacccatggagacagagagtagaaggatggttaccagaaactgggaagggtagtaagggacagggtgggggagttggggatggttattgggtacaaaaaagagaaagaatgaataagactaaatatttgatagcacaatagggtaactatagtcaataataatttaattgtacattttaaaataactataagtaaaaaattggtttgtaacacaaaggataaatgcttgaggggtggatactccattctccatgatgtgattattacacattacatgcctgtatcaaaacatctcatgtaccctgtaaatatagacatctactatgtacccacaaaaattaaaaataaatttaaaaaataatactacaaggctatagtaatcaaacagtatggtactggtataaaaataaacatatagtttaatggaacagaatccagaatccagaaataaagccacatatttatagccaactgatcttttgcaaagtcaacaagaacacatactggggagaaaaacacccctttcaataaatggtgctggggaaattggatatatgcagaagaatgaaactggacccttaccctcaccatatacaaaaattaactcaaagatggattaaagacttacatgtaataaatgaaactgtgaaaatactagaagaaagcctaaggaaaactcttctggatattgatctaggcaaataattcatgacttagacactgaaagcacaggcaacatgaacaaaaatagacaaatgtgacttaattaagctaaaaagcttgtgcagaaaaagaaataatcagtggaataaacagacaatctgcagaatgggagaaaatatttgcaaagtattcactcaacaggggtctaatatccagaatatacaaggaattcaaacactcaacaacaacaaacaagcaaataatcccattaaaaagtgagcaaaggatgtgaatagatgttttatcaaaagaagacatacaactgaccaacaggtatatggaaaaatgcccaaaatccctaatcatcggcgaaatgcaaattaaaataataataagatatcatcctccccgagtcagaatggccattactaaaaagtcaaaaataatagatgttggcgaggatgcagacaaagaggaacagttacatgctgttggtgggaatgtaaattaatacaacttttacggaaaacagtatggagatttctcaaaaagctaaaaatatgatctagcaatcaatccagcaattccattactaggtatctatccaaaggaaaagaaatcattatatcaaaaacatacttacactcatatgtttatcacagtactactcataatagcaaaggtatgagatcaacctagtatctatctatggatgactggataatgaaaatgtgttatagacaatgaaatactattcagccactaaaaaggaatgaaatcatgtattttgtagcaacatggatgaaactggaggcaattatcttaaatgaaacaagacaaacacagaaagaaatatcacatgttctcactcatcagtaggattgaaacaatgtgtacacatagactagagtatgaaatgatagacaatgaaaacttgaaagggtaagggtgtgggagagtgaataagaaattacttaatgggtacaaggtacaatattcaggtgatagataccctaaaagccctgacttcattactaaacaatcttgtactccataaatttattttaaaaaaaagaggagtgatatagttaagaaaatgtgctttcagtgccaagcaagcaaaaccatgttttgcctgtctttcagatatgtctatattcaattcaacccagttactgatgtttttctatcttaggaacaaaagatttaattttatgtattggcaaaccgctctgcatgattgttcctctaaagtttccatatgtgaagttatgacaaataagaaccaggccatgctggagcagattaaaatggcttgagcaaaacattattattaaatagtgaactggtgacaccaatatttcctatggatatagatgtagtcttatgacaaggacaactttcagtatcaccagttaaagctagtttactactaaacttggcaaacaaaattaaagaaactgattctagcttccaagagaaagaaatactctcacctcttgtttttctttaaagcagacaaatggaagacattaaatacaggtgcttacactatgccttgcccccagatcagtaagtgttgaaataatttttttaattatcaaaattttattcagagaaatgtctcattaagtaaatgcttagaaaatgacaaggccttaatagtacctagaatggcttaagggtatgtttgcctaatcctatgtgatcttcacataggcaagtatatatatagagagccccccaaaaggatggagttgctgtgccagttataattcccaagtgttctgccattggcattctaagaatcagctctgtccaggatgatagtgagtagaaacaatgtgagactattaacaaggtttactctaatgagggttatgacgcatggccaaggcatgtgcagccctttccaatctgtcgcttggcagtttgtgttgaagaagttacatgatcagagttttatgctcatataatggatccaaagtcacccaaaatatgtagtaagacgcatagacaagtagatgtctgtccatgggcttcttgtttttatctgctattagtcaagtgcatcactcaaggtgaaggtctcatgtgagggtgatctcacttcaacatctgccacccactgatcaccagggttgattcagctgatgtctggctatgcgggtgtcccctttctccactgttccacgtgtagccctcctcaagttgaaaacttggttgaagagtatgaccttccctgataggaaaggaccattctttaataaaggtgtgcaagtagctctgcaagctctcaaggtaaaggtgtctcctgcactgccagtcttatagtcaatcactgcaaatagcaagaagcctaatttctgcgagattctaagttgcgatccatcttgccagtttcgtttgtaagcaaggacgtctgcatttaaataaacaaagggccttgcaaacttttaataacaagaagttctagataagctgaaggagaaatattttaaattcatttttctgcagccaattaggcatacataacagtaaatgtgactttagaaatgaattaagtgactactgtattttaagtctctttacatttaagtaaaaggcttagtctgtccattatagtagaatggttccagaatattattatcttttttttttttttttgagatggagtctcaccctgtcgcccaggctggagtgcagtggcacgatctcggctcactgcaagctccacctcccgggttcatgccattctcctgcctcagcctcccgagtagctggaactacaggcgcccgccaccaggacaggctttttttttttttttttttttttttttgtattttttttgtatttttagtagagatggggtttcactgtgttagccaggatgctcttgatctcctgacctcatgatccgcccgcctcggcctcccaaactgctgggattacaggcgtgagccaccgcacccggcacagaatattattaacttaatcaccaaatactgaagtcatagaatcagactagatcttagcaagacctgatccactacaataatcatagcaaaattactcatcagaagcaaaggattagatatatacatagcaacatggacagaccttaaaaatacagtgcttaatgaaaacagaaagaaaaatgcattcattcattaaaaaaatacacattttgcaggaaaacatacaaatgaaaagatacacactaaagacgttagaatagttgcctgacagggagggaggaagttgaagaggagaggaatatggggataaaatggctaaacaaacaaacaagacaggagccctgcataggccaatgatgataatgtaccgtaagcaaagagtctataattaactctgtacttgaggtccaaactggtgtgtggggggagaagagaaggagaacagaccttatgaaaatgtagtctaacatgttaattctcctccttactgtcatagattataaatccaggggccatagaactatcctttattttttcaatttagtgcataatacaaataattttcaaagaggaatgcaataaacacttaattatgatgacaaaggtgccagtatattattctttttgcctaccccaaaatgctttctgtgtacattccattttaactttgttcagttcacagtgcagcgaaaactagaaaattctgaagaatcaaacttaccttcaaagctttcatttatgactccactgttgtttgcttcatctctggacttataaatgctatttaagaaaaaatttctgaataactgaagttggtcctgaattctatgaaaagtaggtctttggtcgggttcttgagcccagcactgggtcattaaattccacctaaatatatggggaaagatgggaaagtaaatagcaattggatataattactgataacccaggtagggtcattttagaaaggaaagaatctgagttattgccagttttccttaattaatataagtgaatcaaaacaaaggctttgatttcttatttaagagtggcttttaacattactacgtttattagataacacctttcttttgaaaagctgacattattttaacagttattattccaaataaatagatggataagtagatggtgggaaaatatctactcaacactcaactactcaaggtgaaggtctcctgtgagggtgatctggcttcaacatctaccacccattgatcaccagggttgattcagctgatgtctggctatacaggtgtccctttcctccagtgttccatgcgtaaccctcctgaagttgaaaacttggttggagaggatgaccttccctgatagaagaggaccattctttaatcaagggtgttcaagtagctctctaagctctcaaggtaaaggtctcacctgcactgtcagtcttatagtcaatcataatgtatcaacacataaagaaactaatagctataaaaattgttgaagaggctgacatttaaaagatttactccattccacacagatatttagtgacagaactagaagcagcaatcagatttgatgccagtgttttactgttcattatagtcaggttgagttccctagacattcacagctggttaattaaacattatcttttccttaatggttgtccaagaaatatctgtgcagcactcttaagtagtattcattcattcactcagcaaagatgttggacacttgttttataccagcagtatatcaggagctagggacatggccatgtgactcttgtcctcatagatgatatgtatagtaattataagagaaaggcaaaattcatcacacctcaactcatataagcagaaaaattgtaagtattttatattgtttataattaactaggtctttttcagagtccctacctagcataagaaaagaaacttcatttagtacaatgttgtttataacttagtcccactattttaaacaatctttttaagtaatattcagtcttttctggataataacccaacctctcttattttcaggccatccccactccctctgccttcctgtctaaggtagtgtcaggatatatgttgagtacgaggcttatgtgacttctagaggcatggtgaagaatcctttgaaccccactgtgccctccatatctttgatagtctcagtggctaatccagaattcaataaggagtgacttatctgatccagcctaggcatcagcccctattggcaatctgtgaattatttacctattcttttgacgcttccccactacagtggtccaaacttgtctatctctagctgtaggattcttagatgctatcaagccctgtagatgctctcaaggcccagggaatccattcctgtttctgctgtaggcccacagggtgctacttggcagaatctctagctctcaacaaaatgttcacccaatataggaaacaaaggaagtttggaagcataagctagacctttctgtctggacaagtcattctaccttcttgacaatgctgggtctcccatgtcaaagtgagggtcctccactcaatgatctctttgtaattctcccaaactaggggtgactgagcagttggctttggtggtacccatctcttctaattgaagcctacagaggaggtttccaaacccagatatccagtatcttcaccctcccgcctctatcaagttctcttctttcttcacttccccagggcttggaaggaatgagggctctattcactgccttttttaatttgactatccttatataaaattgtatgtttttacacagacaattaaaatctagtacttaaaacattaacaaggagctaaaggactgtagatgctctctatattccaagcctggttttcaagcctactgacttattataaacaagtacttgctctcattttttactttctggagctatatggcagatcaggatcagggagagagaactgataaagaaacagattgggaggtacttaaaatattagtactactatatgaacaaatatacaatcacaaattataagttctttgcaaagttataaagaaaacaaacacgagttctaatagacatgaaacagttttggaaagttgcttacagaaggcccctctccagaggtgacatttaagccaaagaactttgtaagaaaataagatactactcatgggaatagggtgtggatgggagtcagggaactacaagtggggaaagcatgtgtaaagtcctaaatttggaaagagcttggcacattttagaacctgaaagaaagccagtgtcactgaagtgtggtcattgaggggaaaggatgagatgagatcagaggagggaagcgagatcatgcaggtctcacagggcaggcaaggagttggattttacaacactacaaggggaagcttttcaagatttttaagcggacataatctttacattttttaaggattattctagcagatatgtggactataaattataaaggggcaggttggaaactattaaagaagactagatgagagataatgatggtgtggactgaggtaatgcctgtggagctagaacaagattataatcactaggtaacgatggcccagaaatcattataggtattgtatttaaaatagctagtatccatttggggaattataatgcaatctccattccattataatatggcatacaaactccacttccatttatttcgtttcctaacaagcacctcaggtcagagttggtacaccatatcagaataaatggtatcaaggaaaaccaatattggactgtttcaatgtattgatctgatgacttcacatgtattacaagcaatttacataatgggtatacagtgccaagcttggctctattttttaaaattagaatcatatctgagaaataaccaaaagacaacctaatcttttacatagttctctataacctgtgccatttagaaatggggatgatacaaagatgtcaatgaaggatcattagcctttgaaatgagatattataatcgatgtcagatcacagaatttaaaaaataaagtagagttttgatgattaatctaacagttgtcctcagagttgagaggaaaaagtgaagcattttatttttgaaaataaagctgtgattcaaaaatattgccaaggcatagagagaatctctcaaggttggtcatatttcagttaggaggtttttacagttgtccctccttatcagttttgctttctatggtttcagttagttgaggttaaccatggtccaaaaatatttaaaggaaaattccagaaatgaacagttcataagttttaaattgtatgccattctgagtagtgtaatgaaacatgaaactgagacatgaaactatccctttgtccagcatatctatgctgtatatgctacctacccattagttgactaggttgtcagatcaagaaaacatagtgtatataaggttgggtattgatacgatttggccctgcgtccccacccaaatctcatgtagaattgtatcaccagtgttggaggaggggcctggtgggaggtgactgaatcatgggggcagatttccaccttgctgctttggtgataagagttcttatgagatctggttgtttaaaagtgtagcacctccttgtttcttcctcttgctccctctttgcctcctgttctggccatgggaaagactgtgcctgcttccccttcaccctctgccatgattgtaagcttcctgaggcctcctgagccgtgcttcctgtagagcctgtggaaccatgagccaattaaacctcttttctttataaattacccaggttctttataaattacccagcttctttataagttaccagttcctgatagtagtgtgagaatgaactaatacaggtattattcttggcttcaggcatccactgggggccttggaacatatctcccacaaaaaagggctattgccatacttacttataacctgctttattctgcaaaaaaatcaagatacttagtgagattatttagaaggagagaaagaaaaagaagaaggaagaggaggcccgggaagaggaaggtgggggaaaaagaaaccatccttacagctgccacttagccacttgcacatcactcactcattctacctccaaaagttcagcctcttgtttaatctataaaatccacttaagcagaaattagaaattcctatttttttcaattatggaggcttaaatttacatttaatccaatcattactctgtacttaattttctgatgacaaacacatttgacctgttaatatataaaccctttctgttccaccatgtagggacaaatgaggactaagaaaagaggagctatataagcaacagtcatctaaaagtaaagaataaaacttcggttctcaaatagcaataaactggcaatggaatgaaatgaagaggcttttaataatcctaaatgtatttcttatatcttgtaagtaaattaacaatgaaaactatagtcttggcatggaggatcttcccttacaaatatgtccttgtcaccattctatatcatgcagtgtatactcgcaccaagttatagttacaaatattcaaacatattactctaaacaaatttgcaggtccttcaagtttgttaaaatttacctgggctggttgttttggctccagaaaaatactcattatacttgaagtatctcatttggctaagtagaggttccaattcctccactcaccatgcaaactctttacaactcttctcctcaagtttttttttttttttttttcaaaatagcacaggactcattagctatatccaatgttagcctctatgcatattaaagactttgaattcacaaagcaattgaacttcaatacatgaaaacgtcatagtatttttcagtattaaagggaaaagtttctacaggtatttaaacaaagtacataaaatacagccttcaagattttccttacttattatacctaatcctggagagatccgattagtatctaggtgtacatatttttttaagatgtaaaaataacatggtgaacctctgtgttctcccacggttgcctcccacacctgagggactctccagtaattccagttgccactgtgatatatctgttataaaaccccagaaagctctcacttgaagtagattgccctttgatcccatttcttctcaggagtggtgtggttgttgtgcaaactaaaaactgaagagaatcctgatggctgggctttctatcgtacatctcaggctatggagagaagggcaggaatgctctgaacctggcattccattaatagctgagtacagcatagctatctatgggctcacctgacctggagtgcatccaggtgctgagtatttaagcagtaaatggaaggtgtagcagggctcagtgcagactttcaaacccctaagctgggcctgtgatctcagaaaactgcttcaaataaatatcagttccctctgtactctaaggagagtagttaatctttatcatgacaacttaaggccatggccagattgaatggtattgctgagatctccatttcctagcccagcttgttttcctggttggcaacggatctttaacccttcccagggcttgttagagtcctgcagcacttggagggcttgatgcatggcttatttttattaatgatgttcaaatgaacttcaaaaccaccaatggaaaattttcatttcaaataaactatatttttattaaaacaatggcaatccaatcaataaattattcaagataaaactgtatagaatattatatttttccactcataatcaggaatacttttctagcactgctccttcctccttctagttgcattttttatacctttagatagagcaaagttcaacttgtctacctttttctgctccacaatacagcaatttgttattaacccccctgccccaaacaaaataatcaaacacatcagtcaaaactgatagtttagtgatcaatttcaaagctgcctatccaaaaatattgcatgattgtgacgaggcacgttaacccttggggagagagtggcataagccagataacattctaacagcacaaggaaaattttgtgcaactgaaattctggcaaaaatttctgagtgtttgacagaggtgtaagagatgcaaaacagtgattagtttgtaaatatttaattaaaatttattttgtatttaggtatcctgggcttttttcttaaaccctacatgaaaggttttcaaattttgtataatttcttatccttaatttatataatttttccccatttccccccaaaatgattatgaatcattttttatgcactactatcaaatttggtcagatgtgtgtgtatctgatctccctgtaaacatcgcagagactattaagttaaatcagaaacaagcggtaattccaatcttcttctagctggaagatttaaataatacaaaaacattcaccagtagaacatctaaccaaggtgcccagctcttaatcatcttttggctcaagtctgaataatcctctaaataacacagcatagtcaaggcagtacaaccatggtgtgcatccgcatactgctaattccttttgcacttgcctgtaccacacagtttagcactttattacatgttggcttggcatccaactgctctctgtgggtgtcttttcattcaaaacacattctgagatgctgaagagctgtgtccctggtttaaacacctctgtaatccatacaatccttggcatgctatggtgcacatggagagttcatacttatttgctcttttaggaacttcttgggtaagacaattcttggaaaaagttgtcaagacttaatatttctgctgatactttccacaaggaggcagattaatactcagaataaaaacctttttccttataatttgactaaaattcactcactcttctgagaaatcactattggaattcaataatggccaggattcgctaaagttacaatacttagtcattttttgttatgttcataaacaggtcacaacctgtataatttttagtaatactatttcttattagtcaatgtcagctatatcaacaaagggaatccaactttttaacaatatattcccatttagtataatattttaatatgtagattaagatactagtcaaatcatatctcccaaaataaaaggcatatgtgtgtgtatactctctctctcacacacacacacatacactcggagtgcttttattagaattcacttaaccagaagtattttacttaaccagaagtattttactctccaaaattttgtttctcagtgaaatatcatgtgtatatacaattaaaaagaagccataatatattcacaaattgacacaatgaattgatattttatgtggggtatacaatatttaagttccagttcttattttaacaatttaacaaactatatcaagaggcctaagattgtatgtgcacatgtttttgtttgggggatacatatgttaacataattaacttacagatcatcaggacaatttcttggtggctccagtctccctcctgtttgcacatagtttaacacatcaaggttggaatgagctggataaggctgatgaccaagagttaaaatctcccaaatcagaattccaaaagacctaagaatagtagagggtttgctttaattatacttattacaaacaccaggtttacagtagtttctccaacaacatttttcctggggctagcagggtctactttgtcagtgtattattggcctcataaaaggcaaacggcagatataaaagcaggctgacaagaaaaagtagaacaagacactgcgtatgagcaaatacttcaaaggtgataggaaggcttggaggaggcacacatgtgcacacacagagacagactcatatgcatgctcacatgcatgcacatccacgcacatatacacatatgcacacacagaaacagacacacatgcacatgcatgcacacacagaaacacgtgcacacacatacatgcatatatacatgtatacacacaactcatactctgtttctctccctgactgaatccccactgtaggcctccattatctaagaatttcagagcattgacatgcagacacaccaaagggtgagcacaaaaacatttcagcattttcctcccaagtttgcaggggataaagtgccagtaaacattgagagggaaggcatgaataaaaattggcagcactgagaaattttatctcattcgtaattttgcctagggccagcccaacttaaaagtcattgaacaaacttttacattttgagctgttctattcaaaagttggagtcaacaaacaaaaataaggggcatcattcaaataataaagggatgtccaaatctccccagtgtcctaatcttttaggatacttttaaatccatgatttaaagtttactgataaattaatgaccaaacattcccaaatagtaggtatttgggcacacacttggacattaattcctaagtaccaattcctattagtcataggcttttacatctttggaatgtaataaaatatttgaatgaaatgtatctatttcataacaaaactgattcagggaggagcataaactgctgagacccaggaatagtaccaccttgaccaccaactctcactttagcttgaggcaaatcacttaatctctctggtcttctgttttctcacattaaaaaagcaagattagatgtccttttaaaatcccctctaatgtttgatgattctgtcagcattactctgtgtcccgttaaacttaccatacatcagattgagtagtgaagattccatccatcaaactttctggagccatccaccgaactgggagcaggccttcccctctctttctatagtaatcatttttatagatgtctctggcgagtccaaagtctccaatcttcactatccgtggactggtatagtctttcacggaaacaaggcaatttctagctgccagatccctgtggcagaagttatatttaataataataataataacaacaataaagttccagaaatcaaagaagtagccctagtaggtctgtaaagaagagaaactattttttttttttttactttaagttctggattacatgtgctgaacatgaagtttgttacataggtatacatgtgccatggtggtttgctgcacctatcaacctgtcatctagattttaagccctgcctgcattaggtatttctcctaatgctctcccttcccttgcccccaaccccagacaggccctggtgtatgatgttcccctccctgtgtccatgtgttctcattgttcaactcccacttatgagtgagaacctgctttggttttctgttcctgtgttagtttgctgaggataatggtttccagcttcatccatgttccctcaaaggacatgaactcattcttttttatggctgcatagtatttcatggtgtatatgtgccacattttctttacccagtctatcatcgatgggcatttgcgttggttccaagtctttgctattgaaaatagtgatgcaataaacatacatgtgcatgtgtctttacagtagaatgatttataagagagacttttaatagaaattattgctagtttgaaggaattaaaatgtttaattatcttgtgtgctttacctgcactacaggtgattattgtgccaatatccgtaataaccctgtatccagaagagaattgtacctgtgaatgaaatgcatccgttccaagtagacacagccttttgaaatatctacacacaggtctacaaggtcaaccaaggtgagtaaaggaccataaaactgtaagaaatgaaagaaaaattacaggtagttatctagtttgcatgaaatatatacatatatgtgtgaatataagtggatacatgtatatgcatatgcatgtatgtatctgatgttttaaagggatttttagttatgattataagaattcaaacaaagaggaaaacaaatttatatgtttcctacgcaaatatacataaaaaatgacagctatgtttagtaagtagaggcaatatggaatctttattggaaagacctccaggtgtcaggtcagacagatcgagatgtgaaacctagttctgctacttactagttgtgtgaacttgcttaagttacttaactcactaagcaaatttctcatgtgtaaaatgggcaataatactgaccttgcaaaattcaagtaagttacatatatggctggtcgataacaggcacttaataaacagttgctgctctcataagtagtcaaaatgatcatttaagtgctagctggtttaattattgacccaatggcactctgtcttgccagtcatgataatgggcttgtttctcatacgagccccatgcaaattgttagcaataccctatttcaaagtttcaaattactcctctcatctaagagagtgagtacaaacatacacttgagcctgtactggttgcaatgatttctacatgaaaagaagccagttgaagtttttattagtaccatactgggaaaattcaaagttcctgccctgaagctatattacattgtctgtccctttccattgtcctgcaattaccctggttcaagcttttgtcatccctaatttgatgcattcaaaaatttcccttgtctccagcctcctgtgctttttcattagcttgatttgttgtgacccccttcctgtagagtccattatgaattcctgagcacagcctccacagcacccccaggctgcaccagcctttctacaagtctattaatttcctactgtttctcctctctcaatctgtgcttccgttacactggtccgattgcagttccttatacctactctgcatttctcagcctctcttctttattcctgctatcattttttctcctggaatgtgctcctgtttcttgatttccatggacagccttagctgagtatctcaaatgattccaaacctccaagtccctcaattccttaaaaacaaatgctcttaagtggtgttctccctacctcccctgacacgtttatctcttgctcccaaactaggaataatcctgatgttctggggctcactattgccatggttctgctcagccacacctagggctaataactaggctatgaccttactcccaaatcaatatcctccaaccctattatcatggcccgtatctgagtccctgctggatgtcttgaatggttcactggttcctgtgtacatggaaccctgctctgctcttgacaaaacctactctacctgtgaagactttctctaggcctaggatcctactccctaatttcagtctggtggctagtgccctgttccctgctgacagattttcataatgctgcctgcctgcttggatctctgactattctctctttctgatatcccatgtatcaacctgttgggatacctcatcactgcatgttgggtttccttgactctagatgctactctggactaccacctgtcatctcttgttaaacccttcagatagattaaactttgatctcaatctatccctagtcaaagcctttcataactcagtgggaaagtatagttcagctactgttctacctcctgctttggttgtgtctgaatcagaagacctcttccatgaagccctctcaggtttcctcagttggaaatcactccttcctctgggcttctgcagtatattctccactgcactctaatgagtccacctacttcctactttaagtggattatttaggtatctgtagacttgtgtctgtagacttacaacctaccatgtagcaagttccttgagtgcaagaactacatccttcaccgttgtatagcaaacacccaggaaaaatttggtgaatttaatgttatctggaaggcagcacatttactacatatttgtattactttgacagttttttgtttgtttgtttcgcttttttctatcttaatacaatccttttaacaaaagttaaggctaggtgtggtatctcatgcctgtaatcccaggactgtgggaggccaaggcaggcagattacttgaggtcatcaggagttcgagaccagcctgaccaacatggtgaaattttgtctctactacaaaaaatatacaaaaattagctgggtatggtggcatatgtctgtagtcccaactactcaggaggctgaggcaagagaattacttgaacctgggaggcagaggttgcagtgagccaagatcacgccactgcacttcaacctgggccacagagaaagactctgtccaaaaaaaaaaaaaagttaaaaggagacttaggaagcttttgattcaatattccattttgtagataaagaaactgagtcctcagaacaaaggactagactaagctttccgggcctagctgcagtcaattcttaggcattcaacccaataaaatagtccttgaatgcagggagaaagagaaaaaggcctctgctggttcttctgagatagtgcctctgagcactccatgtggggagaggctggcctcaaaagaagtcagcaggagggagagtagcatttgtgatggctcccataggcctcaggccttcattctgccttcagcacctaacgatgtctctatggttgcagcgaaggagacgaagccctggaagctgtttttggcaaccaccaggaaaggctgcggaacagctgaagtgcatgtgagaaccaatctttataagcattaggatcctgggtgactcaaaacgatctggaaaaagtagatccactttttttttcagtccatcctttttcatcctctcttcacttttcatacccccagccccaccacaaaacaagacaaatctacaaataaaatttattgtttaagatgagggattgaatgtgcgcatttttagttccactctctccccaaaccttactaacatggcagtatagtgaaaattttcataatttcacaagggcaaatcaactgtcatgagaactgacatggcagacaaagcattctggaagagggaaagcagatggaggagtggtaatttagcagagccaagagagatgaaagctgactgcctacagaaagaaaaggcaagaattgagctgtttttcactatggaagctcatagtctccagaatgggaggcagcaggtatccctgaatacagggacaagaagaaggactgaaagcaaaaagaacgtttaggttatttaaggcctaactaaatcatagattcttctaccacagatgaaggcttttgtctatagaaaacaaacaaataaaaacaacagaaacctgaaccagaacaactccaagttcagagatactaccagtcacactgaggcactgtactgaaatgcagagaattaaaattaaatgagagtccacatactgagccttgagacctccagccccctctaaacgctctgagttgatgcatcaggcatttactgtccagaggagaaacgagcaatttcctccctggttaaactggcatatgtcagggaaaagattcagttactgacattggaggacccccagtggaagagcagggtcccacctaacaccaaaaggaagcttccttggacacataggttcccatcattttgttaggcctcacgattaaatatgaaaccagccaagaatactaaacatttgagaaagattctcacattgaatcagattccaaaacaaagaggaacaaggaagccaagacaatgcaggaagcaaattaacactctttgaaaagcataattaataccctaaaagaagatgagtaaaattttgcatctatgaacaaaaccagaatattattttaaaaagcagtcaaaatacaagaacaagactgtgaaaaattaaaatatgttaacaaaaatttttaattctacaaaaagattggggacaaagttgaggaagtctatcacaatagaaggcaaaatgacaaaagctagaaaataggagagagcagctaatagaatgagaagatgaaacaaagcagtccgttataacaggatttctagaacaaagaaatagagggaataaggaattctattcattatcaaagagacaatgaaaaaaaatcctggaactgaagggaatgattagcaaagcaactgttactttactatgagtaaagagtaccacagataaaattttcctcaaatttttgaaggggaggaggcaaaaaacagaccactgataataagctcaggaatcagagtggcataagaattcttattggcaattgtagaagcgaggaaagaaagatgtagtggctttatctgttagataaagagttttcaacctaaaagtccaaccaaattatcaaccaagtgtgagggaagaataaaggacgttttctcaaaaattaaaaaaaagcagatttttgctgcacatgcatactttctcttctaaaacaaacaaaaagtcatgagatacatggaaaaagtcccacatggacaagaattgaggaagattcccaggttgaatgtgaaggaaaccctagaacagcagctgtgtagctagcctagagcacaagcatccacactgcttccaggaaggaagtgtccaagaaaaaattaagtactagattgtctgatactgttagccatattgagaaaagtgttacaattcagttggggagtttacgtatataaaaactaaaatgaaaacaagagatatttattaaactagcctgagaaaaaaacttacattaataacatttggataattcagctctaaaaataataataataactaaatagttctaataatgcaaacctggaaggatggtttatctgcaaaattgtgataattgtcagaggatgaggcaagcaaagttttcctgtgtgtagcgtggtgagggatggacaggtatattatgaggaagtctaagagagttaaatcctcatcttccatactgggcaatcaatttaccccaaattgaaaaatcaacatgtgtcagtatgagcagactatttaggaacttggcggtaaataccacaagatacatgcggggcctgagaggtaggaatgaggcagtgcacagggctcctgtttttcactatatgctttgtcacacattttaattttttagccatatgatgtttattttgatataaaaatttttttaatccaccagatttaaactttgctgacttgtcttatcttacgtgttctcatctaaggtataaggtagattcctacaggtagtcacccccagtcctgtccgccattccacagtatttccagggttcataatgtgctgtgcactgctccaggcactggggatacaagagaagaaggactgcggctgcgttttgcaggcagagtttgttagcatggatgtagggaaagagaaagcaaggaagtagatgggtggagtaggagaggacgtacgaaatcaagagctccgtttggggcaaaatatgtttgagatacctactaaaatccaaaaagatatgtcaactagagagggacatacaagtctggtactcagtaaagacatcaagactggaaatataatttgggacagacaggcatatagattaagtacagagatatgcctttccaactccacgctatccctgtgctccagaaaaacatgattctggcaatgagggtcatgttctcccattaaatactaaaaacaggctcgggctcacatgaccagaaagtgccagaatgttagcccagggttctgattgtcaaaagctaatgtgaaggaaacagaataattctttccatgtaagtcttctaaggttttaccactgcagcctattaaatttaaagaaaattaatagggaattatagggcatttgcattatgaaaccaatattatggatcccaactgcctaccgttgccatccgggctttacgcaaataagtaagaaggtctcctccctccatcagttccaggataatgtattggggttcattcagcagacaaactccaagctgcttcagaatgttgggatgattaaatttgctgaaaggtggaaagacacaggctggatgatatgacagaagcaggagtcctagccgagggtctttatggagtacagcaattctttatcaatagtttccttcaaaacccctgacttagtgtctctaacacttcgttttccaactcctggtctttgtgcttaccttaaagaggtaatatggcaacccctagtggccatgagtatggataaaataggttggtttttagaaggaataacatttgtattaagcatattttggaaaagaaagtaattttgactagtagcgtccttgaaaagatatttaaaaacattgggttttgggtcattacaggtatgaaatatatcctctccctttcaggaaaacaactcagaaatgcgggtttggctacacagttttctcaagacatcaaaccaagtaagtcccaacctaataattggaacccacagcttgagacccaatcaaccactgcctcaagtcttcccattaagatgtgcttgagcagtttttatgaccacaaactcaaactgatagacaagtttactaagacaaaggatattttcactgacattatagcatttgagagaactctctcttactgggtatacttgaccattatcacacatttagatgaatacaagcatgtcaaaagccaaacagcttcagaattcatttgcaaaacatgctccttattgaagataaaagaaaggagaaccttttgtctgaggattgcctgtacccaggctcagaagattggcctctatagactacttgctctgcagatgtagttccatttaaacgtttcaaccatgttgttttagtcatgatccgttaagtcatgtcattttgggtgttaaaaataagtcaagcggacttaaaacttcttacccataccaggagaaaattatttcagagctacctcatcagatgtgcctccttcaggaattcaatcttctcctggtctgtggaacccttcttcaaagtctatacaacataaaaacaagtcaggaatcagtatagcagacatttctgtgagctcagtgggttaatggagattgttctgtttgttctgtaatatctaccctgaaagctggaaacagatcgtagataaaacatgtgcatgtattctacaaacccttcaaatgttacctcctgttattgctagtagaagaatatgcaaaataagaggtctagtaatgtttacacaatattcctccaaaaggtagaaattttaagagaccaagttttgttgtttaggccaatttcttaattttcaaaattttcttttcaatatgttttctccatctccttgctttcgatttatttcttggaggccaggttcccagtcccaagcaattgatcaaagctaatcatgaaaattgtattctaaaattctccagcctcccttggaaattggggtggtcatataactcggtgatggtcaatggcatataagagaaaaactgctgaggcgggaagggagctttgaagaagactttgccttcctgaacatgtacatctcacaccatctttcctcctctccctggcccgaatgaagatgtgatgcttgcttctttgtcagccatcttggaacaatgaggcagcaagcatgaacaacagccaagaaaatttcagagatactggctctgacctgacacactatcctgaaccaaagccagcagtcatcttgttacatgagagaaataaacatttgtttaaaacagtcaaggtgggagtaaattaaagaacttttaaatgacatcatttagaagcagagagaattttgccaacttttctagttgtatagctcactctcaaagcaataaatctctaataagcagagatcaggatattgctcaattacataaaagattcatcctccctttatcaaaagaaagtttttgcaaaaatatgagtatatcaagtgcttccttaaaaatacattaagtatactatgataaataatcatgtagtcagagactgacaaactacagcctgtgggccaaatccagcctgtcacctctttttgtatagcctatgatctgaaaatggcttttccatttttaaatggttgaaaaagtcaaaagaatattactatttcatgacatatgaaaataatataaaattcaaatttcagtgttcataagtaaagttttattggtacacagccacactcatttatttacatattgtctatgacaatacaatggcagagtctgtatggtcagcaagcctaaaatacttactatctgcccagttaagaaaaggtttgctgacccttggtctagtaccttaagaatgtgtttcacaactccagttctcttatggcatgtttgaagaaaaatgattgcctgataggtcttagctaattagtagccttagaggtaatgcaaaccctggagattgttgattacaaacaatgttcctatgtaggaaatgattttttttaaatgtgatttctgtagctatggataggcttcgacattcaaccagtcctcttttcaacaaagagcactcaacttttattataattatatccaggtcaatctttgtagatatggtgatataatgtgtcaaggagttcgaagattcacattaccttcactgctactttgatttctccacttccaactcctaagatgtccactgctgttccttcatacacttctccaaaggctccacttcccagcaagagacgcagagtcagtttttcccgagggaaggcaggaagattttcaatctcctcttgggttggaagagtactgtaaaatagcaacatttttgtctccccaccctccacatatatagggtgtacaagtttgtgttggtattggtatttgtgtttgagagagaaagaaatatctcatggctttgcagtattgtgtgttttatgtgacacggtgatgtggaactttgggttcctaattactttactttactattctacaaccttttacccagacagagcatgatggtccacttctaggcaccttaattttgataaaaatatatatgtgtatgcattgcctcaacacttttattgtagcttgttgagtcaaagttagtaggtattaacttcttcagattgccaatttgtataaaaagctactgcaaattagtaataaatgcatctgggtttataagcttttctcttagctatttcacacatgtgacatcttacgtaaaacaaaatttactatgaccaaaaaaatcaaccccatcaccataaggttaactttaaaaagccaagtttctcacttggaatactacaaggggggaaaatgctgctatgttaaaaatgctttcaatttttaatagagaatcttgagtagcagatatgctgagtatttgctcaaaggaaagtcacctctaaacagctgatttagatcacctttgtgtctacttcaaatcctttgtttttacaccttgcattataaatttctgaaagcaaggcctatgatcatttaattcctttttgcatagatcctaatataatgaacctttgcataagacacttgaatattttccttaattatgacggcaacaaaagttcaaaactcatctatcttaagaaggttttgtgggcaatcatcacacaacttctgaaatggagtaagattgacttaaggctgaccacgtaacacaaggctctcaaaactcctctcctctcaaacactgcctccaggtcaaccaaccatgttaccatctattctcttcaatgtaatatttttctccttctttcatttgtttttgagctacatgacaaaatactggaaactaatggatttttctgtatttttcttaaaaccacataattttccatccatcccaggtcacatttgagagtggaagaggaagttattaataattatgccagaaaaactggtataaaccatgactgtcttgggcaatgcggaattcataggcactctccttactgttgcccaccctttgcctaggtgctccataatgatggccaaagctacatactgtattgcatagcaggcattagccaggcctactccggctgccagacctcgcagctcagccaactctttgtcttcgtttataagcactgtcaccccttccttggcacttttttgattctttaatcttctatgccagactataaaggaaaaaatgacataatttacaaaataaaatattgcttcttttttcctttaggaaatgttaacagtgcatttgaagtgtttttatgcaagaacactatcagtagaatagttatagaagttttcataatttgattttaaaatatcttataaaaaactaattaaatccaggtaaaaagccatatataagtacacaaatcatactacaccatttttaatctcacttcttaaaatttaatgtatttcttactgttgttataaacaaattaaagtatcttaatattaaaacttatttgtcaaaatcacccataaacgagtcaaaataaaccaaaacaaacataattattagtgaaacaaattcatttttgagttcagtcacatccaggttatattcctcagtagaaaagaaaatgctttcagtataatggcaattttttttttttttttttttgcagagtacaagagtgtttatcattgttgttcatatacacatactcgaatatgtagaaaaagtattggaacgaagcttaccaaatgttagcagtggtctgccctagttgtagaatcatgagtaatttgtactgtcttccttatataataagcagtattagttttataataataaaatttttttaatattaaaatacaattatgtcaataggattgtcatctgtactggactattggctcagaagttgaaagcagcaagcatgctttgagagatgatcattaaaatttgaacttaatttcacagtagcttctatgttcaagaagttagagttttattcacatgaaattcaatttgaagggctacacagtgaaagatcacaagtaccttttgctaaattaatttttccaacttgaaatgttctcaccacctcgcttcacttttaaaggcccaatgtaagcccacatcctcaatgatgccttctgaaacctcagcaacctctactaatctttcatatctgaacttgaaagactaattgcgcctctctgtgagtgcttatcctatgcactgtcttacttatttcatctatttttgtcttttgttattatttaacacatatcttgctatttgtcttcccacacaggcatgtcttaactccctcattaaatggcaagctcctgaggtcagcagttgtattttacaggtttacattttcccctactcccagcagaaggctaatgttatgcattagatatgactgctcagaagcaaaggctgtcaacactcattttaaaaattgtctaattttatgtttataactgatgagtgccctcagcacaatacaaattttaaaataattgtgactgttttgttattttaattactcaatcttttctcatgcacacacacgctcttactagtaaaaccacatgcactgctgctaaaagcaaagaaccgaattagcttagctagactcaaaaattcgtgaatttcaaacagaataaagacctttaagtcctgagaaagtcagatatccataggatgtcttggaagcacaataggttgtctgaaattatctcatgttcatccactagagttatgggtttaaacaatggtgatgtacaagaaagcaagcaaaggtcagctgaaggattcttcatgtaattctccttcccagtaggaaagcagacaagcagtcaagcctatatgccaactgccaaatatactgcagtcatatgcgtaagtctggaggggctggcttagtggcacaaacatcagctgtgcaatacttagactctctggaaccacaggttaaaatcctggcagggtcagctgaaatttttagctttccaagtttgctgaaggagtttcacatattgtctgggtggaatctttgaaaaaaatctcaaatcgagcttcaaagtgctctcataaagattgtgactccaatcactttgcagaaagaataaagacttagaacacagtaaagtgttggctgtctttatcctgagagttcaactttatgtttgtgacttttccatcaactttcccttgtaacttacccctacttgtgaacaaaacaagccacaactttcttaatatgtgtttgagtgttcttttctggtaagaatcatgcccttcttttaatgattcagtgtgttggggactctcaatattagcaatagataggggtccatatatcttataagcaaactcggacagtttggggaatgaaagaaagtgctattattatttgtgctgaaacagaaataaacaagaatgtatgatcactgtgataactctaaaagtccaatcagtacttgaccattccctttgaggtttttactgcattttattatcattaaagtaaatcttcttagaaaaaaaatagctttctatctacctaacctaatttttctgccttcctggtcatttataaatgagcagggatttgaaataagcagatcagatgtctgaaagcaagagtcgatcccacaagccagaaatggatcttctgcaaaagaggccctactcattccaaaccagcctgtctgcttagaaaccaaaactatcccaatcaaagattgtcactggcctcccattaattctatacttttttctgtacccagggttatttttcttttatttattttaaaccataagccacaaaacatttgtatgcagccaatcagaaataaatactgttttaaagaaacctaaaagttggtgcccttgcaagtagttttatctaaagtataacatgaaatgtacatgtatattttccataaaatagttatgcctagatcagaaaacaattcacagaagttagtggttataaatgtatagccaaaggtaacaatgtaaattttattaacttaatcaggcaatatttcatgtgggagattagatcaactaagagataaatcaatcaggtatgattaagtaaacagtttgttgcctattttaaaaattctattatacttaccaaaggtcagtgggattgtaacaaccagaaatattccaactataatagtaagtatgaaacttgtttctggtatccaaaaatcatctaataatataaatcagaaaaagaaattaattcatagataaaagctaagttgccccagctctacctaagcacacagagtaatatagcagagctagctactactggatttttgcaagccagttgttagaccgttggtagcttgaaagcatccatacagacagtgtttatgccatgtgaaatcaaaagcaaggtgtttttgcttttttttgcagagagcaacaaaccactggaatatatccactcaatcttctactttaaaatgacttaggaaacatatatatctttttaataaatttaggaccaagaaatctcagtctttggatactaaatagttggcattattattttgtataatatcttcatacatatttaatttcatggatattaaactgaggaataaacatggtaatttctcttaggtagtttcagttgtgtagaggaaacaaacacgtaggccagagtctggcaaactatggcatgaggaccaaatctggctatagcctgattttgtaccccctattagctatgaataagttttacctttgtaaagtgttatttttaaaaagaaggagaaggaaaaagagaacagaaaaagaagaaaagaagaacatgctacagagatcacatgtagcctgcaaagtctaacatatttactatttggttcttttcagaaaaagtttgctgagctgggtagcaaacttctgtacacaactaactagataactaactataatataaacaagaatcatgtaagttttatatagcatgtgagtgtataaaatgcaataattcatttgactaaggagcatcaggtaagcattatgatgagttcatttaagtcttgaaggatgagaagaatttcaattggcagaaaataaataataggaaatcacagctaaggggcacagggtaggtagtggggacctgtattctaggctgaggcaaacacagggccaaagactaagtgacataaaaactttttactggtctgatatggctacagcacagacataaatattggaaaagataaaccacaattggaggataaattacagaagacctcacatgccacaaagaagtttgtagctgattctgaaagcagtaaatggagagccattgtgggtatttcagagagggattaagtaatccagcctgtgcttcaactaaatttaactgtcagcagtatgcgtaagtcaagggcacaggcaagaaatgataccttaaattaggaaagccaaggtggaaagaggaagatgagaactcatcagagaaaaatcaagatggtaaaatcaacaggacctgattactgagtagagggaaaaatcacatatggcactgagatttcctgcctatgtgattagaaagacaatatatcataaactaaaataaaatacacagtggaagaggtagatattggggaagaaacaaaggtcttaggcctgttatgtataatgtaggagtggtcataaggctggtataatgtgaatagaattatatggctggatagaacagattgtgaacagccttggaagcctaattaggagcatggaattgatgtggtaggaattaagggggtggctgattattattggggagaaaaatgacatgatgataatgatgttttagaaagatcacatcacatgaatggaatagtttaatagtttggataataagattatatatatatatatatatatatatatatatatatagtcaccattatctattgctaatgttaagaatgtactgatatttattactgaacctttaggtaataagctagtgtgtagacagacatggtaacatacctccaactaatataatattctcactgattccactatattcaccaaaccctagattatttgcagctactactctgaactgaaatattcctttcaggtttttggacttccatgtgcaaacactactgcaggatccattaaatgtcatcttccaccttaaattctggttctgtaaattatttgaagtgctctttctgcaaaaaataataaatacagaaaatatacatgacaatatacctgttatttctagttgttcatagatcttcttagtgactgaacgccagagagtgtcctttggcacaatttacccttgacctcattcctctcccataatctggcaacacagatgctaacagcatggttttatagtgatcctagtgaggcatggagccaattaactcagcccaccaagaaaactgtgagtaatcagtggtgaagagagagctgagtacctttttcctatactaacagcatgggtaaactttctccagaattccaaacctataagacaattattccatgatttttaactgggaagtttccattttctcaattttcagtcttttacattatttgtagtttacttatgccatatttcaataaaatacagaatacaaaattgataaggaaagtgtgacagttcagctaccaaagttatcattatatctgagattctgaggctcgttgcttccttttgtattgacctacattccacctcaaagtcaatccaattgtttttcatttgaaacatggaaggagcacaagggctgggttcaaaagacataactggaatgactttttacagaatcatcaaaggcaagctcaaggtcttccattatgtcttctctaacaatgaagaatatttcaggtctgaaacttttcagaccgcaatagttttaggacttggtgccaatccacggtaagcttagggatatgtgggagaatctggttctattcctgctaattgactcatccttctgaagaccaacagagagtgaaggctggccctcataagaggcagggaaagggtaagaacatcgggagcagcagggcagcagagttggtcacagctgttccccggagctgagggtccctttaaggaccatcctgagcaaagcattaggacagagtgtttttacacattttgtgacgtctcacctttagcattggccatttcactgtttaaccaaacaactctgatccaaaagaaagaggcccttgagaatttgtgaagtggctctacacaatggccattgagaaaagaaagaagaattctgatgttggttgagcaccttctatttacaacatactgtactggggctttacataacgttgttttaattcactgagtccacaacagcttaaagagataagatagatattatcatctccattttacagatgaggaaacttaagttcaaaaaaggaaaagaacaagcatttaaacatggtttgtgtactggattgagtcatgtcctcccaaaattcatacccactcagaatattttaatgtgaccttgtttagaaataagatcttgacaaatgtaatcaagttaagatgaggtcatagtagtttagggtggaccctaatccaatgactggcacttgcataagaagagggaaatttggacacagagaacaccttgtgatgcaggaggtgatgatgacagtgatgcacctacgagccaaggaataccaaggactgccagtaaacgccagaagctaagaggcaaagatggattctgccctagaaccatcagaacaagcagtcccgctgatacgttggtttcagacttctaacctctagagctgtaagaataaatgtctactgtttcaagccacccagttggtggtcctttattgtggcaacccttggaaactaataaggcttgttcaactcccaagttcatgcactttgcacttccactaccccatcagtgagtacacagagtctaactagagtgtcctgactgaaggacttattttgagacactgaagttacaacaatcattcagtcatcctatagtctatgtcctgacagtggagacctggagcaaggagtatgcaaagtatttagatggagtcattttagtagcacttaaggtgttactcagggtaacacacaaaagaggtcctagcaaaaacctgatgtgtgacctgattgatgaacatcattacagtcacaaaccaccaagacagttctgcaggttagaatgtatttcactctgcatgaaaagcagcaacagaaacttcaaggaggtttcaattagaaataagggccaagggaattctctagtatgaacaggaacattttttaaggttatgggaatgccagagccagatgaagcaaaaatagatctaaagatcaagttgccaggactataattatggaagtgacttttgtccttggaacttcttaaaagatggtttcatagtcctgtgagaggagtgtctttggaatttggaattctcccctcaagttggcatgaaatcagtccttctaagccagttatggttcacgtgctccccgtactggccaggtctgaggctgttcatcagtggctggttttcatcgacggtgtgttttcagtccctgggaacacattgcaaactgtaatcttcccaatgaatacagaatcctgtgtgacctctacacttcagaccatttcagaacctgacctaattttacagtatgagaaatatctacttcatcaccatttctcactagagagtattcaccttgctaaagcaaattatcatcaggaatttacatgccatcattatttaacattaaacatcagctaagctttttaaacaaaactgatattaagttaatactggttgcatgagcctatgatcaaacaatttccataaagtgtcaatgagcagttagagatttctgagaatgacgtgatctgtttataattagcatgccaagaccaacgtctaggaattgagcaaagaacgtaatgatgcatgtgagtcctttaactaaagatctttgtgtttgtatataaatacatttgcataaatagtgttacttttgattactttataattatcttcttagttctttgtcatttacaagtactttgcaaacacacataccttatctcaaggatatagtatgtaattctacatccattatcttcagctttctcccactgtattgaatttttactcccttctagtaatttgggaatgcctggtttatttgggactccagctttagggaaaaaaagaaaatattggttgatatgtttgaagtattaatcttctgcactgaaatctttctacagaatatattaagaggaaagacaacattaaagaaatattcagaggcggggccaagatggccgactagaagcaactccgttcagaggttcctattgaaaaaaaccataataagtgtgtgagtccttcaccggcaaggtatctagattcgctcatcaaaattgactagaaggctggcgtgacccacagagagaaggaagagcagtgagcccacctgagaaccacacggggaaggggaaccccctcccctccagccaaggggagcggcgagcgagcaggctacccagccggggaaattgcttttccaaagaactgtgcaactcatggattggaagatcccactctcgatcccatgccaccgaggcctagcatcccaaccctagaatgtacagattcttatggcctctcagctggaatctgcctaagcttactgaactccctgggggaggggtgaccagcacaggcttctgctgcctgctgtctaagccctttgagctccttgagggaggggcagcagccagcactgggactcccaactgcctaacacgctaatctccctgggcggcggggagaaatgcagcatccatttctatagctccaggctgtgcttttcccctgcgggagccagcgaggctggacagcttggtcccaagacttgtcgccacaacccaacacaccagctgtggtagtcagcggccagagtgcctcttcaggtctaaccctcacccatccttcctcagtgggtggggcttccctgcagaatcttcagtaactgcagccagaggctcagggacagaattcagatctccctgggcctgagcccctagggggaggggtggctgcagtctctgcggaccaacagacttagcctctcctcctggtagttctgaggaatctgggaagcccagacaagtgggctttcccacagcaaaacacaccctctccaccaggggacaaagtgcttcgttaaatgggtcctcctcctggtgccacccaactgggtgagaccctccaacagggattgtcaggacaccctatacaggagcgatcctactggcatcaggttggtgccccttgaagtcagaggtcccagaagaaggagcagacacccatttttgctgctctccagcctccttgagttacatatccaggcgtgggagcaaatcagatgaataaggcctaaagtgaaccccagcaaactgcagcagccctacagaagagggaagtgactattgaaagaaaaacaaataagcagaaagtgacaacaacagcatcatcatcaacaacaacaacaagggcccccacaaaaaacccatacaagggtcagcagcctcaaagaccacaactagacaaactcacgaaggtgagaaagaaccaatgaaaaaaatgctgaaaacccaaaaggccagagtgcctcttctcctctaaatgatcacaatgtctccattaagggtgcagaactgggcggaggatcagatggatgaactgacagaagtaggcttcacaagatgggtagaaaaaactatgatgagctaaaggagtatgttctaacccaatgcgaagaagctaagaaccttgataaaaagttggaggaattgctaactagaataatcagtttagagaggaacacaaatggcctgatggggctgaaaaacacagcacaagaacttcgtgaagcatacacaagtgtcaacagctgaatcgaccaagtggaagagaagatatcagagtttgaagactaccttattgaaataagacatgctgacaagaagagagaaaaaagaatgaaaaggaatgaataaagcctccaagaaatatgagacttcataaaaagactgaacctatgatagcttggagtaccaggaggagatggggaaaatggaaacacgtgggaaaacacccttcgggatattatccaggagaacttccccaacctagcaagacaggccaacatgcaaattcggcaaacacagagaacaccattaagatactccacgagaagatcaaccccaagacacataatcatcagattctccaaggttgaaatcaagtaaaaactgttaagggcagccagagagaaaggccaggttacctacaaagggacgcccatcagactaacagtggacctctcaacataaaccctacaaaccagaagagattgggggccaacatcaacattcttaaagaaaagaattttcaacccagaatttcatatccagccaaactaagcttcataagtgaaggagaaataaaatcctttccagacaagcaaatgctgagggattttgttaccaccaggcctgccctgcaacagctcctgaaataagcactaaatatggaaaggaaaaactggtaccagccattgcaaaaacacaccaaactataaagatcaatgacactatgaagaaactgcatcaactagcatgcaaaataaccaaatagcatcatggtgacaggatcaaactcacataacaatacctaccttaaatgtaaaggggctaaatgccccaattaaaagatacagactggcaaattggataaggagtcaagacccattggtgtgttgtattcaggagatctatcttacatgcaaagacacacacaggctcaaaataaagggattgaggaaaatttaccaagcatatggaaagcaaaaaaaaaaaaaaagagggttgcaatcctagtctctgacaaaacagactttaaaccaacaaagatcaaaatagacaaagaagggcattatataatggtaaagggaacaattcaacaagaagagttaactattctgaatatatatgcacccaatacaagagcacccagactcacaaagtaagttcttagagacctacaaagagacttagactgccacgcaatagtagtgggaaacttcaacaccccactgccagtattagacagatcaacaagacagaaaattaacaaggatattcaggacttgaacttagctctggatcaagtggacctagtagatgtctacagaactttctagcccaaatcaacagaatatacattcttctgagtgccacatggtacttattctaaaatctaccacataattggaagtaaaacactcctcagcaaatgcaaaagagctgaaatcataacaaacagtctctcagaccacagagcaatcaaattagaacccaggattaagaaactcactcaaaaccacacaatttcctggaaattgaacaacttgctcctgaatggctcctgggtaaataatgaaattaaggcagaaataaataagttctttgaaacaaatgagaacagagacaatgtaccagaatctctgggacacaactaaagcagtgttaagaggaaaattcatagcactaaatgcccacattagaaagccagaaagatctcaaatcgtcaccctaacatcacaattaaaagagctagagaggcaagagcaaactaatccaaaagctggcagaagacaagaaataactaagatcagagaagaactgaaggagacaaagacacaaaaagccctccaaaaaaaatcaacacatccaggagccgttttttttaaaaaataaaataaataacaaaatataccactagctagagaaataaagaaggagacagagaagaatcaaatagacacaaaaaaaatgataaaggggatatcaccactgaccccacagaaatacaaaataccaccagataatactataaactcttctatgcaaataaactagaaaatctagaagaaatggatacattcctggatgcatacaccaagactaaaccaggaagaagttgaatccctgactagaccagtagcaagctctggaatggaggcagtaattaatagactaccaaccaaaaaaagcccaggaccagatggattcacagctgaattctaccagaaatacaaagaggagctggtaccattccttctgaaactgttccaaacaatggaaaaggaggaattccttcctaactcattttatgaagccagcatcatcctgataccaaaactgggaagagacacaacaacaaactttgggccaatatacctgatgaacattgatgtaaaaatcctcaataaaatactggcaaactgaatccagcagcacatcaaaaaacatatccaccacgaacaagtcggcttcatccctgggatgcaaggctgattcaacatatgcaaatcaataaatgtaatccatcacataaacagaaccaaagacaaaaatcacacgattatctgaatagatgcagaaaaggcctttgataaaattcaacatcaacatccctttatgttaaaaactctcaataaactaggtttttatggaacatatctctaaataataagaactatttatgacaaacctacagccaatatcatattgaatgagcaaaacctggaagaattccctttgaaaaccagtacaagacaagggtgtccactctcaccactcctattcaacatagtattggaagttctggtcagggcaatcaggcaagaggaagaaataaagggtattcaaataggaagagaggaagtcaagttgtctctgtttgcagatgacatgattttgtatttagaaaaccccatcatctcagcccaaaaacttcttgaactgataagcaacttcagcaaagtctcaagataaaaaatcaatgtgcaaaaatcacaagcattcctttacaccaacaataggcaagcagagagccaaatcatgaatgaactcccattcacaatagctacaaagagaataaaatacctacgaatacagctaacaagggatgtgaaggacctcttcaaggaaaactacaaaccattgctcaaggaaataagaaaggacacaaataaatggaaaaacattccatccccatggacaggaataatgagtatcatgaaaatggccattctgcccagagtaatttatagattcaatgctattctcatctaactaccgttgacattcttcatagaattagaaaaagttattttaaatttcacatagaatcaaagaagaccccatgtagccaagacaatcctaagcaaaaagaacaaacttggaggcatcatgctacctgacttcaaactatattacaaagctacagtaacacagcatggtactggtaccaaaacaaatatatagaccaatggagcagaacagagacctcagaaattacaccacacatctacaaccatttgatctttgacaaacctaacaaaaacaagcaatgaggaaaggatctcctatttagtaaatggtgctgggaaaactggctagccatatgcagaaaactgaaactgggcccattccttaaccttatacaaaatttaactcaagatggattaaacacttaaatgtaaaaaccaaaaccataaaaaccctagaagaaaacctaggcaataccattcaggacataggcatgggcaaagacttcatgactaaaacaccaaaagcaatggcaacaaaagccaaaatagacaaatgggatctaactaaactaaagagcttctgtacagcaaaagaaactatcatcagagtgaacagacaacctacagaatgggagaaaaattttgcaatctatccatctgacaaagggctaatatccagaatgtacaaggaacttaaacatatttacaagaaaaagacagacaaccccatcaaaaagtgggcaaaagatatgaacagacacttctcaaaaagggatttatgcagccaataaacgtatgaaaaaagctcaacatcactgatcatcagaggagtacaaatcaaaactacaatgagataccatctcacgcgagtcagaatggcaactattaaaaagtcaggaaacaatagatgctgatgagggtgtggagaaataggaatacttttacactgttggtggtaaagtaaattatttcaaccattgtggaagacagtatggcaattcctcaaggatctagaaccagaaataacatttgacccagtaatctcattattgagtacatacccaaaggagtataaatcactctactataaagacacatgcacatgtatgtttactgcagcactgtttacaataacaaagacatggaaccaagccaatccatcaatgacaaaccagataaagaaaatgtggtacatatacaccatggaatactatgcagccataagaaggaatgagatcatgtcctttgcagggacatggatgaagctggaagtcatcatcctcagcaacctaacacaggaacagagaacaaaacagcacgtgttctcactcataagtgggagttgaacattgagaacacatggatacagagaggggaacagcacacaccagggcctgttgagggataggagctgaggggagggaacttagaggacaggtcaataggtgcagcaaaccaccatggcacatgtatacctatgtaacaaccctgcacgttctgcacatgtatcttattttttaagaagaaattttaaaaaaagaaatattcagaaatattcttatatgattacatatttttaaatgagcatttgaagtttttattagtgatggatttgatgaattggtgataagattaacaatatatctcaacttgaaacaaaataagtgataaatgaaaataaagaaaactatcataagttttggagcattttccctccattctttttttcaaatttttttatttttagttctggggtacatgtgcaggacgtgaaggtttgttacatgggtaaacatgtcccatggtggtttactacacctagcaaaccatcacctaggtattaagcccagcatgcattagctatttttcctaatactctctatccccccacccctccccctgacaggccccagtgtgtgttgttcccctccttgtgtccatgcgttctcattgttcagctcccacttgtaagtgagaacacgcagtgtttggttttctgttcctgaattagtttgctgaggttaatagcttccagcttcatccatatccctgcaaaaaaacattatctcattcctttttatggctgcatagtatgccatggtgtatatgtaccacatttgcttcaaccagtctaatgttgacgggcatttgggttgattccaaatgattcattattgtgaatagtgctacagtgaacatacgtgtgcatgtatctttgtaatagaatgatttatattcctttgggtatgtaactagtaatgtaatttctaggtcaaatggtatttttggttctagatctttgttccttccattcttatagagctcatctcagagttaaggtatatctttcagaacactagttaatttttaatgaacttcttatatttttcatcctagtatctcaaatatagtagccaataaatattttttgaacattcagtaacactattttcatatagttatcaccataaaattgtcatagctagacatgaaataaggatactgaaagaagaagtaattttgcccagttcaggatccagccagacccagccagtattatttcattactgcctgcaaggtctcctatattttctgaatttcttcattcaagttctagaaataataatgtactgcttttaaagaacaatttcatatatctctaggattagtgaaataagtgataagaaaaaaactgaaacacagagttttctgagtattgagtatgttagtactcaccttttgtcttaaagctttctggaagtgaggtgctattttctcccgtcttataaaccaccactactctgacattatatgaagtataaggttgtagatttgtgatattacagacataagcaggaccttggctgcatgaagttttaacatggtaaaactcattgtatttccactagaaaaagaagtctcgattaatatttttgtttctctaagaaaatattcttaaaacacaaaaatgtataggcttatagcaagtggttaaaatttaagcattcttttctattaaagaataagaacttctttatgaatgatcccaaacattaccccactgcctatagtcgttttgctttttatgacaagatataactgatttacatgactgttcatgggagaagctcaaagtgggacatacacctctgactatatgtcaacgaggaagattcagagctatgacttcttgttatcccaaagggtagatacctacatttaatcaggatggctaagaatgcaaatccatagctgtgggacaatgatggatcaaaacaatggtaatttcaaatcccagggatttgttaatttcatagcaataatatttttacatgttttgattacatattttgataaagaagtccacagtgacttacaaactaagacttttttttcctcctaacaccctcttcagacatgtaaacagaattctttatttttatatactggaagcctacatagccaaaagaagaaaaattttgcccactattatgaagctactaagtagcaaggctagaagctaaatacagaaaatcttgttttcattccactttagatattgggcctctaattgcagctatctgaaatttcttgctctgtgacattgctttctaaaaatctgtatatttggatccttagtatcattatttgaaaatgataatttcttaacatacaaataggaaaagacaaaaagatatggcaatttgtcaggggttcttggtgtattttccctgtagagtttcataaaaaggtcagtttccataaataaacttaatttatatcttctttttcacttaacactcatgaggtcacatcatttcattaaatggatactttatattagttttctattcagtaaggaatgattctctatagcattttcagtcagtagaccactatgtacagtaagaaaggggaataagggaatggaaggaatgaaaacttaaaaaaatagaactgctgatgtcagggacattgcctgcactaaactcataaatgtatcaatcctgctgagacatttagcttaatagcttaatgaaacgggtgcattgaatccataatatttactgtgaacctcagagagagagaaattaactcctggccaaaaaaaaaaagtcttaactctttatggttctgtctccttcattatctggtggagaaattacctatagtgaatagtctaggtaacccaacattccaaaccatcaagaaattatcagagctccttgaaatgtcaggagatgtttgaccaagcttaccgctggaaaatggtagagtgttggcatcaccacagcaatgagtgtctgggcagaccaccaacttggagaggtgccacaggatatcccagtaaatcacaagggtgtcaggactttccatttgtcagaagccaacaagtgcaggggtgaaggctaccatagagggattttcaaattatgtgggtgggagtgagggggagtgtgagctaagatgtctgagagtttggaacttcagaaacttatggttctgctagggatttgcctgaacagctgagaaaaacacaattttaatggacttccgtgaaaaaaattaccaaacaaaattatttgtttcctccccattttaaatatgttcttcttctatacactgttgtgagtttcttgtattatatagaatttaagatctagatcaagcttgtccaactttcagcttgtgggccacatgtggcccaggacgactttgaatgtagcccaacccaaattcgtaaactttctttaaacattatgaatttttttagggaattttgtttagctcatcagctatcgttaatgttagtatattttacatgtggcccaagacagttgtttcagtatggcccagggaagacaaaagattggacacccctgatctagatcgaaacttcatcttgtgctctagttccctcatttttcagataaggaaattttgacagaaatgacagagacaaagtttatcattttcttcctgtttcctttctaaaacattactaattaaagagacaaatattctcttttattgcccactcctcagagtttcagtatgcagttacggtattatttccagctgtcctgtcattgtgagataggctcaagttgttcaaaagagacagcactttctgactatatagcactcatcaacccttgcagaaccacagacttttactgtactcatagttagtatttgtagatggccactcatgtacaaatgactctatcttgtatttgcagcttcatgattttctaaatggtctgcctggaacctgtgttgagcaaatgtgaaaacagaggaagtttagaaacaaaaagcactgcatgaaagtcatgagaattcaaccaggagatctctgtctgctgtccttctccccaaacttgaaagagtgggatggatgacttaatgactcctattccttccacggacagcaccctaataggactgctgtagggagaagtcagccctggggtttttctctgcctggtgacatctggcatctgtctagatctccatttctgatcaataaaatgagaggctagggtgtcaattatctctgaagtcttttcccatttcatttctttgataatcttggaaatgaactttacatccttcctcttggttttagactgaactgcattaagtttactaaaatagatgttattttaaaaggcactcctccaatttctccaatttaactgcatttttataaggtggcaattttttaaatagacaacaaattatcagaaacatgctcaacagaaaaagtccaatgaaactatggtctttgagtttatcaactcaatattcagtgttgttccacagttttcatagtttttatctataaagtataagatcacaaaaataccttacataataattttaaacatcctggggaataactgcattttaagaagtagtgaggccatgattatactgatttgcttttgagttaccactgaacaaaacatttctaattaatctttaaaaacacgtacacatacataggcccagaaatatacaaacatgcacatgcacatatataatagttaaaataacaagtagcaattataaaaaattaataatcaattttgagtttatcaccataaaagtcaatgtaggctttccccatcaatgaattaatcaggttaattgatgacttaaaattcagtgggtgcttccttattggttaaagcgtgaaaagttttggatgaggaatcatttaaagtttgcaagccaacaacaaaactactttagaataagctggttttatggtttacttctctcttgttactgcacagcccttaaaatgatgaaagaacatttctaaacaaggttttggttttttctttcttcagttctttttcatttttttttcatggaaaacaccaagttactatggactttaaaccagagaaccatgctaacatctaaactaagtaaaatattataaaattagtacactataacttatacccttttacataaagccttttaaaagcaaattaatctccctgagaattcttcccaccagaaattagtctggataactcactgcttctgcatgccaaacataaatcaatgaaagttgtcaaatatattgtttatttatacatgagcatgttctagatgcatgaaaaagccctttccaatttattctatatcataaaataaagacttgcattaaaagtctaccttctgtagctcaacccaaaatctgatgaggttaacattcaatggagccttccaattaaattgcaaactagtgttctctggaaccaaggaataaggtttctctggtgtgttaaacatttccacagtgacaggatgactctctgtacaccacatttcctcagagtggcaggcaagaaccttttggtaaaaaagaacaattgcttaaccttttgagagccttgcacttgagaatgacaataaagagtgcctagtaaactcactgtacctttaacacataaatatttccaccagacagtctagtaacaaggagagtgagccttccatttggaaattcactttgtcttagaggagtttcaggaattagggccaggtgtgagattgccaactgataacggactgattctttaggtccatttggcttgtgagattctctccaagatataatgaggctggtgtctgaccgcacagttgtattaatgagctgcactgcctctggtactgaaataaatagcaaggaatgataaaggatgctgcaatagcactgaaagatggaaagaagtaatggagtttgggttgaagagtaatcatgtggtatgagcagaataaataacacatgtccagaaagaaagtcagcctcttctataatcgtaggttaacagactgcctaaaaggctcccacttatttttgcccagtgaccaaatcattctctgactccagctcaaggatatggccaacggggaataacccaatttgggtgagttttgtgaatatcatcagagacatctgaaataaacgtcatcacctcataataatcaccacctcatcagctcttagaaaaccttttcagacctattttctttaaggctatactgttgcataactttacagctcaggcctcagtaaaattcacatagaaaaaaagcttggtttttctatagctcaccacatgtacagaaacctatgagtatctggaaaaagtgacactgtgtggtgagaccaaataatgtgtttcttggtcaaacaatattgatttcaatgttttacctcctagttgctttctattttaatagaatattattagttagcttcaggggttagagtaagggtcaggtcaaagttttctacaaacacatttttcttattaaacttaaaaaagcttactaaaattacttcgcattcagattttaaaaaataaacatcaacatacacagcacatatatcacaatattctgcttgagaaacccacaacaagcccataacttacctccatttttagtttttccccaaatctcttttcctggtggtaaatgttccaaaggatctgaataataattttttacagctatctgtatcatgtatgttgaaaatggttgtaaatcttcaataagagctatactgtcctgaaattcctgtaattgattttttaaaaatcaacatcttatttttaacattttatacaaattggtagaaattatttaatcaaagagagaacaaagttaaaggctcaaaaaaattaatttattttaaattctggattattaatggtaataccactgtccaatctacccagacctgagttgttcaatgtttccaagaataaataccaaatgattggtagccttcagttggttttgtggcataaattgtttcacatgggaagttaaattcctagaagaggacactatttcattaacattgtattagaaattcagcaagatggtagaaaacatgtgacacatatgtgaatacaataaaatatttttatagtatctaatcactcttagaaataaagtttaagagagtaaaaagactttccttagaccaatggttctcaactttgtttatactttgctatcatctgggaagttttaagaaactactatgcctgggttctattgccagagattctgattgagttatctggggtgaagcctagatgcagagtgttttgttttttttttttaaagcttcgatgtgccgccaaggttgagaaccactgtcttagaccactgttaatcaatgagaagacaataagatagattaaatttaataacagacatgaccagtgctgccaagtccaatcttggccagccaaatgatctatctgaaattacttattttagaaatgtgtaaaaagggttaattagacaaaattaaggaaggaatgaaaaatcacatacactttatgggaaaacatatagtgtttaacatccaacagttagtcaatttcaccttttgaacaggctaaataaagccaagcacaaagcaaaatattggatatatgtgattccatcactaagacaactgaaatactaatgaatacatttcatcatttcaatgattgaatgaatagtgccaattcattcaagaaatagttagtgaatgcctacacagtgccactaactgtgctaggtgctaggcatacaatgatgactaaaaacagtatctgcatagcagtatatttctctgcacataggaaacaaaagacaaaatataatgtacaatttttatattagataaatgctgtggagaagaggtataaggcaatgttctttccgtccagttcatttcttactcttcaatcttcagtctgctccataggctgcaaaaataattctctatcattctctctgaggataattagataatcagggaggggaataaacccaattctttctggacactcagaaaacggttaccatggcaatccatcaatgggcaagagttgatatacttccttgaagcttaacttactcccagtcaagaaaactagaacacaatatgttttgatgaatcattagctgtaaaaaagttgcgtactagtccatttcagaacatataggaaatactttactatggctcataattttatatcaaaaaagaacatcttgtgaaaagacaaagaccactagttccaatcttaccagaattctatatttcaagtcagagctgtttttcctgtcattaacttctgcataataaaccaggtatgttggagtagggctggtgatgccataccatgtgaggtttgtcttggccagaggtaatctgattgtgaggctagtgttagtggcattaagtatagttggttccacagtgtctgaagctagagacagaaacgctttatctaaaataagaagaaaccaaaagattaaatatctatactatatatatgagaggaaaagcagatttttaacaagaataatatcaaagcttagaaagaaatttgtagagcatacataacttttgcttgaaaacataaatatgaaaatgatttgaaataatattctctttgaagaaacaaaaatggctgcagcttgatactgtgtgtagtatgtgtagtatgtactgctacagtctacccaatgtcctctccttttcttcaagttcatatatatctgatattgttcagggcagtatgctgggaggaaaaactgtttctgaagtttgattgcagcccagacaatcatgtgacacggtctggttagtcagatgtgcttatcactgtggcgcacctctgtccttcaccctcccccaacccaggaggcggacactatgcaagaggggcggcagccatcttgtgagaattgaataaaggactcactaaggatgtttggggaaagatcaagtccaggtgattgatggcattgtggagctccctggccaccgcttacaaccaaacaccttgcacgctgcacaactccagggagccccagtcacagagactacaatggaaatggtctgttctagaccagtgcagtagcgcaaccataccgcaggcttaagcctcgaaaaatcgcagatctgtcacttgcagctgaacacaacttcttgacctattcactctcagtctttatgtaaaacatcacctaaaaatgtagcataattacataatatgcaaataactccaaatatgattttaatatgaaatctaacaatcttacaccagttagccaactctttaactcattgtgcgtggcactgtgcaatctggctcctgcccgcatatccagtctctgctatgcaaagccatccttcactctaaccacagtacactatctacacactgcaggacttctacccctccaacccttcacataggtagtctcttcaggttggaatgatcttccccatctgcctaaccttacttaagcctcaattcatgcatcatttttcctgggaagccctttctgccttcctattccaggtgaaggacatctcctctctgtcctcactccacttcacgtgttcttctaccagtgcactagccacatgtgattttggttttggttttcttttgctgctttcttttcttcatctagcactagaatgtaactatctttggctgagactgtgcttgaattatctttgttccaccagagccccaggagggtgcctgacatatattaggtatttagtatgtgttgtcgatccttatgaattcatattagccacatataaaatacaacctttgcattcagcaagtaagaaaattagggggtaaatgtctaagtgacaaaaacttgatgaagccagctccttcacttgctaacttttttgtcttgggaaggttactccagctcttctgtaaacagagacaatggcctgctttacagatatttatatatcactctatccctagcacatggtaagaacattaaataaatgttagctattactatcatcattactgagactaaaatgaaaagttagagaaaataatgctggtctggtctgggaattccaaatatgaattccaaaatgcaggaaaaaatgtttaaaattagaagtacatcgaaaatctccaacaacagtgtcaagggcactgtgaacctaagtttgaggacatttggaaagtatgggggtttagagatggataaccttactaaagttacaagatgaaccactcttcagttcaaccaatatttatccaatatattcagtttgtactgatttctgatctgaacagagaatgggatacacatgtgagcaatcagagcaattatctaattcaaaagtcattggtaattttgtcgttcttttatttaattgatataatatgacatgttgaagtgtcagaaacattattcaggacagaaagacaggtttttcccttacatttttttttttatcccatacattttgaagataattgaataccttcagaaaaaaaggaccaagataacttgtaattgcttaaaatttccagcagatggaggtaaagtattcttaataatgtacctagaaactagcaacataaaatagactccattttttaaagaaaataatgagtattaatcatactcttaatgagttccagtttaaaaaaaaaactcatgccactcttgggacttcattttggagcgtgtttgtgtatgtggctgggaggaggatatgtgtgtgtgtcgttcaacttcagatactgcatggacgtcttttttttttggtaagactttattttttagtcagttttagattcacagcaaaattgagaggaatgtaccaagatttcccagatactccttttctccacacatgcataactttcccccattatcaatacccctaccaaagtagtacatttgttacaatcaatgagcctacaatgacatcattattacccaaagtctatagtttacattagagttcagttttgtattgtacattttacgggtttggacaaatgtgtaatgagctgtatccaccattatagtatcacatagaatagttccactgccttcaaagtcctctctgctctgtctattcgccacttcttcccccagccttctcgcaactagtgatcttattactgtctacatagttttttactttcccagaatgtcatatagttgatatcagccttccccaactttgttcttctccttcaatactgtgatagctacctattctaggtcttttgcctctccatataaactttagaatcagtttgttaatatctacaaaataactttagctgggattttcattgggattttattgaatctatagataagttgagaagaaatgacatcttgacaatattgagtcttcctatctatgacatggaatatctctatacttatttagcactttgatttctttcatcagggttttatagtttttctcatatagatttttgtgcatatgctgttagatttatacctaagtatttcattttctgtgggtgttaatgtaaatgatactgtgtgtttaatttctaattccacttgtccattgctggtatacaggaaagtgattgagtttagtatattaacctcgtgtcctgcaaacttgctataatcacttatgagttccaggagtctttttgtcaattctttcagattttctacatagatgatcatgtcatctgtgaacaaagacagcgttatttcttcattcccaatcagtataccttttcttgtattgtataccttttcttgtattgttgcatgctgtgacttccactgcagtgttgaaaagaaattgggagagggaacatccttaccttgtttctgatttagtgagaaagcctctaatttctcactattaagtaatgatgttaacaacaagtttttttatacatgttctttctcaaggaagttacccctattcttagtttgctgaggatttttcatcctgaatccgtgttgaattttgtcaaaagcattttctgcatctatcaatgtgaccgcctgatttttcctctttagtctgttgatatagtggactacattaattgattttcaaatgttgactcaaacttgcatagctgggataaatcccacttgactgtgatataaaactattttaatatattgctcgatttgatttgctaatattttgttcaggacttttgcaattcttgcaatattcaagagagacaccggtctaaaattttcttttcttgtaatatatttgtctagttttggttttagggtaattctggcctagaataaactcattcattggcctaattggaagtaggccctctggttcaattttctgaaagacattgtagagatggtataattttcccataaatgtttgatagaatgcatcattgaatccatctggcccaggtgctttctatttcagaaggctattaattattgattccacttatttaatagatgtggacatattcagattgtctatttcttcttctgtgagttttggcatattgtgtctttaaaagaattggtccatttcatctaggttattaaatttgtgagcatagagttgttaatagtattccttgattatccttttaatctccatgggttctacagagatgtccccgccttcatttctactattagcaatttgcatccactctctttttttcttagcctggctagaggcttatcaattttatttatcttttcaaagaaccagtttttggcttcattgatttttctctattgatttcctgtttcaatttcattgatttctactatacttcctttttattttttcttttgttttagttttgtttcttattattatttgggacttaatttactcttctttttctagtttcctaaagtaaaagcttaaataattttagatctatttttttaatacatgcagtcagtgctgtaaacttccctctaagcactgattttactgattcccgtaagttttgatgttttgttttcatttttagttcaaaatatttttaatttgagatttcttcttttacccatttgttatttagaaatacgttgtttaatctccaagtgttctgagattttccagctatctttcagttattgagttctagttaaatggcattgtagtctgaggacagatattgtatgatttctattcttttaaatttgttgaagtgtattttatgttctgtcttggtgaatgttccatgtgagcttgagaagaatgtttattctgctgttgttggaaaaattattaatagtagatagatgtccattacagccaattaattgatggtgttattgagttcatcagtatatccttagtgattttttttctgctggatttgcccatttctgatagatgtcgtgaagtcttcaatggtgatagtggcttcatctgtttcttgcagttctatcagttgttgcctcatgtattttgatgctctgttgttagagatatatgcattaaggattattacatcttcttggagaactgatccctttatcattatgtaatgtccctctttatcccttataactttccttgctctgaagtctgctgtctgaaattgtttcttctttcatttgattagcgatagcatgatatactatctccatccctttacttttgatctatatgatgtgtctttatatttaaagtgggtttcttatagacaatgtatagttgagtctgtttgttgatccactcaaacaacttctgtcttttagttggtgtatttagaccactgatgttcaaagtgactactaatatagttaaattaagatctaccatatttgttattatttttcatttgttgcccttgttctttgttcctacttttgtcttccactttttttctgacttttgtggttttatttgagcattctaaatgattctatttactctcctttcttgggaatcagttatacttttctaaaaatatttttcagtgatttgcccttgaatttgcaatgtatatttacaactaatccaagtccaccttcaaacaacactataccacttcacaggtttgcagtaccttataataacaaaatactcccaagtcctcttttctatcccttgtgtcactgctgtgattcattttgcttaatataaatataaatatacacatatatatatgcacacatacatacataagtggatataattgaatatgttattgctattactattttgaacaaactattatccattaggtcagttaagaaaaagaaaaacttttactttactttcacttatttattctctaatgctcttcctttctttatgtagatctgcatttctgatctatatcatttttcttctttctaaagaacttcttttaacatttcttccaaagcaggtctactgataacaaattctctcaatttttgtctgagaatgtctttattgctccttctcttttgaaggataatttcacagggtatggaattctaggttagtgtttttttctctcaacattttaaatattttacttttctctcttcttgcttatatagtttctgaggagaagttggatataattcttatctttgttcctctataggttaagtattttttcctctggcttctttcagaattttttttctttatctttggttttctgcagtttgaatatgataggcctagtgtagattttggcatttatccttcttggtattctttgagcttcccatacctgtagtttggtatctgacattaatttggggaaattatcagtcattatttttcaaatatttcctccaaatatttcttctgttcctttctctcttctttttctagtattcatattatacctatcttacaccttgtgtagtttccccacagttcttgaatattctgtttcggtttttttcctttttttttttttttttacctttatagttttgcaggtttctactgagatattttcaagctcagagattccttcctcagccacatccagtctactattaagcccatcaaacattcctcacatgttacagtgtttttatctctaacatttcttttttttcctcaaatatccatatctttgctcacattgaccatctgttcttgtatactgactactttatccattagagcccctagcatattaatcatagttgttttaaattctcagtctgataattctaacatccctgccatatttaaatgattgtgatagttcctctatctcttcaatctgtgttttatgccttttagtatgccttgtaattttttcttgatagctgaatatgctgtactgggtgaaagcaactgctgtaaatgggcctttagtaatgcggtggtaaggtgtaggggaaggggaggcattttatagtcttagattagatctcagttaacttcaagtgggtttttgctttgcttttcgactgtgaacttcacaggttcttttcagtccccccaccccacttaggtgggacacgacggctggagtgggctggggttgggcacttctctttacccaggtcaattaagctctgataaaacccgagcaggtccagctgtgattagtgtatcttgaatgcagcccttgttaagaagaacagaatgctctggtgcctttcaaaatttttccttttcccttctctctgtgggaagcacaaggagattctctaagaaaaaaaccagttaaagctcctggaggtaaaacttataaaatgaagccctcctatgacaggatgcccctcgagtttctaactctcagagttacccacactgagcctcaagcaattcatcaattacagtttggatttttctaccactaacactgctttctaaaaagatttcagctcatgggtttttgctctggtaaattgtaattctctgtatttaccaatctgtctttccaactggggacagcagtttgctctgtgacctcacttctcttgtggatccaagaagagctgttaagttttcagtttgctcagacttttacttgtttttgggtggagtggcaatttctaagcttctgggccagaaaccagaagccacatgaacttttaaaatctcttaaatttctcaaagtgaaaaataaattattttacaaaaatacaaagtaggctttatttataaattttaacatttttcaatttacatattttataactgaaaacatttaaacaaagagagtttatgtcattcatatctgtccctctccagaggagagttatagttaatttagaatgatatttgcaccttagtggcaaagacggctttgacaaaataccaatgaggccatgcaattctgtttttgtttttgttttcagacgagtctcgctcagtcgcccaggctggagagcagtggcgcaatctgggctcactgcaagctccgcctcccaggttcaatccattctcctgcctcagcctcccgagtagctgggactacaggcacctgccactacgctgggctaatttttttggcaatactgtttttgtttttgtttgtatggtttttagatttcaacaatgttttattatgactgtcagtagaaaatatatagtcagttctgctataacatgatacatgcctttctaggaatcattgcactgtacaaatcacacaataaaattcacagtttatgggaaaagtaggatgaggggcataacactaaaaacttcatcagtgacattttttttaaaaaagataaaaacttaataaaaatggtagcacaggcttactcatgttaaatggtactacatattataatagtatatattaatacttagtgatttgatacctaatactgcatactgcatagtaacagaagtatgacctgttaccttgaaaacaaggttgtatgcaatgctttttgacaccactgggaggcctaaaatatcagcaaaggagaaataagagaaagaagagaaattatgggactgagaagagaaagaggccaggcagagagaacaacaggacgcaggtttcccatgtctaaagttgcccaccacaccctgagctgtgtttacacatagaagtaatttgtgatccagggcaaacagcaatcacagtgcacacagaagactagcagagtttggagcaaggatgagagcacaacaaaggggctaaagggacagccttggagaaggagatgttatgagatttttctgaccctaaattgggagaacaagctgattacgaatgtgactttattacctggaaaaggctgcataactgaactgtaagccaagatatgcctactccttagggccttcacctgggaaacgatggccccatttcctttctttgcctgataaatctgtgtgctgtcctttgctgtgatgatccagtatataagatctccatccacagttaagctaacaagggtttttcctgctgttaaaaacataaggaatataaagaacaaaattaatatcttacattttttactctaaaaatgtatgaaattttttctatattataattgctaaattttgaatctattatttcaacattaaaaaatacctttattttatgtcatttgactaagggttttagagatgttctctcattttagcaccatatcaagccaatcaggtaactactattattactaacctcattttgtggaaaggcaaactgaagtttaaaggagttaaataatctgctcaaggccaccaaagggcagacccaggatttaaaacccacctatgtgactcaaaatcaaataatgccaacctgagggaaatattaaatgataggcatagggctcagtgcatttctcaatatttttatcagtggtttggaatgaatgcatagtaaacatatttatcaactttgcagataataaatgattatcaccatcactagcaggttcagttacagccttgaaattcaaaaatatcataacagaatcaggaaattgattcaaatttgatacgaacaaatgtaaaatcctaaatttaagtttcatatcaattctgtaaatgaacgaatgaaagggatctggcttaataataatgaatgtggaaaagactatggtctttcaatggcaggcatcctaaagatctgattccacttttggctacaacaaaaagaagaccttcatagttagagtctcccttcactgacaagaacacattgagagtgcagtgtctttatgggggcaatatttaagagaatattaactagctggaatgaaatcacgggagggcgactaggacaaagatttagatgccacattgcctggggagcaattgaagatacttgaatttttcctccaaagaaaatgcttgattccagcatggtggctcacgcctgtaatcccagcactttgggaggtcaaggcaggcagattgcttgagcccaggaattcaagactagactgggcagcatagcaataccctgtctctacaaaaaaaatactaaaattagtgaggcatggtagtgtgcacctgtagtcccagctacttgggagactgaggcaagatgatcacctgagcctgggagatggaggctgcagtgaaccatgattgcaccactgcactccagcctgggcaacagagtgagaccctgtctcaaaaaaaaaaaaagtgcttacaatgagctacaacagttatctctacatagttgaatggctatcatgtggaaagtgattaaattattctttgtaaatttagaggtaagaactaagactaatgaacgggagaaatgaagagaagacaggctaaatataagaaaaaaactaatattcataattgtccaaaagcttaaacagacttccttatgaagtagcagggttttttaaagaaacagttgtttaagcatgactatttttaaagaaaaaatttcttgcaacatcataacatctaaatgatccctaaaatctttctaattttctaattttaggattttaattacaggtttatgaaaaactgaccagttttatacatatataatggtctactaggtaattcttgtgtcttgtgtatcaaatattaaagaaaaaaattattctgacacttgttaaaatggtaagaaagactttagtcaagataagtgcaatagcgcactaggaaagacaaatattgcaacatagcaaagacagttggggtttttatagccaagaaactgagtgaggaagtcattgggtggaaaaatacagggacagcatccaggatagagcaatccttattaaattagcctaatgggattcttgctaaaggcaggccaagagcctaaacaggattcttacttaaatcagaccaatgtccatcaagggtgggagatgaagaacttgatcaggtatcagtggtagggggttctcctaaactgactttgtaggattcttgctaaaactgaactcagcaaggatggacacatgaagaccaaggctgaggcctagtcaagaagaggactcagaggagcataaccacattttgatcaaagaaaaggtctttgtcacaggtttaacagaaacaagtaatataactaaggaggaatcattcaaaacattacctctatcattaaatctacttaatgataggaattgtttctaaaaggccttgtttctaaaaggcctctaaacataggaattgcttctaaaaggccttggttgacatgtcaacaaaacctatatacaattataacacatacacacatatttgcaatttcaaaactttactgtataatccagcagtgaccaatagatttcagtgatgatgaaaacgttttatacctacattgtccaatacagtggccattagctatttgtggcttttgagcacttgaagtttagctagtgtgactgcgagattaaaatgtttaattttatttaattttagtttttttttttttgagacagtcttactctgtcacccaggctggagtacagtggcaccaccttggctcactgcaacctccacctcctgggttcaagtgagtcttcctgtctcagcctcctgagtagctgggattacaggcatgcaccactgtgcccagctaatttttgtatttttagtagaaacagggcttcaccatgttggccaggctggtcttgaactcctgacctcaagtgatctacccacctcggccttccaaagtgctgggattacaggcatgagccactgcacctggccttaatttcaattaatttaaacttaaataaccacatgtggctagtgattaccacactgggcaatgaaaagtaattttaagagtatatggggtatttagagtatatatttttttctgttgaattactcctaattaggagacttccaaattgtactcgactttcgaatatttattctacaagcatctgaatttcaacaaatagactcaggtattgaccaattcatgttgaaagtggaatctatgggatcatcaaagtggaaataatttaggatagtgggaagatcatgcatgttgtagttagacccagtttcaactccttctaactaactgtggcccttgggaaaagttaccttacttttctcagcctcagtttcctcatctgtaaaatgaggatattagtacctactgcactgaggtattatgaagattaaataaaataatgcatttagtacatgctaagaatatacagttaagctcattaaattgtagctctattgttaattacaattttttaaaacacagatttagaaaattatgtgaatgcctacatacaattttcctggaaacaacttgatttgaattctgcaagaacacttggcatggtacagagcaaatatcatgtgtatatttgagtatacgcggaatgcaagccctttgtaaatgcagttgaaggggctgctcttattaacaaatatctgtgcacatacatcagcatcttaccgagcatagcaggtactgtgataactctccaacactgacagccttccagatccattgcccagatctcttgtgctttggcaaagtatatcaatggtttctctaggttagaggtatcaatagccattgctccacttaactcaaattcagtcacattacaagaacattgattccttttgttttgttggtttgtagctgtgggttgcagaattcggtgcaaggtgtgactgataatactgtagtagaacatctggtagccaaaattggaaacttctgtccaatacaagcgactatagaggaaaaaaaagtccccccaacttaatgagtaaaatacatcatttcaaatattggtttctaatgcagagcaactattgctaatgactgtgagggacaaatggagcctttggagagaacatggtcaagttttcaataacctttttctgagatggaagaagtcacaagaagtctaacttgtagcatttccaatgatttctcaatagatgtgtttacaactaaagtcttggaatataatgaccttaggtgctatattaaaaggcccacttaataactgaaatataaaatatatttgctaattttcatcaatgtccatctctattcccctcctctcatgtttgtttctgcttcttaatactagttaatgatctagtttccaaatagcctatccccatgcttatggcccaaacagaaatccatctttccagcctgcgaaattgctacttaggtgctaaaaggaaactttaaagctcaccttatgaggatattagttaaactaagatggatgagcacagaataacttttactgtgcaaggcatgctgcccatctgttcctgctcacctcttgccactgtctcaatccacttcttgtacttgccaactgatgatgttattgcattcactagtataaaaatctgctattgtttccttttaggtaattagcctaactttgttagtcaaattgtcagtatgcattaagtttacatatttgtagttgtgcctcctaatttatatgaagaactacttactataatatagtgggccaagagccctaagcatcttatttttccataattgtcttctactattaaaccaaagacattacattaaatatgtctatatctatttcatcacaatataaaaaaatacttgcatttacataccttaaaagaggatatacagaaaaagaaattattgttgaattcctattgtgaatcttcacctctctgggatatttcaccttgtgttcaagatcaacatcaaatacttgcattccattttgtgattctttcagtgcaaagtagaggtgccttgaaatccagtcaattgtaataactgtgatatcaaaaaccagtgaatcttggaaaagcttaacaacaggtagagaacacagccaagaagagagtggttatttttttatttgaagacttttctatattcacccatatcatttgtttactgcacttctcatttgtaatcccaaacctcagcaatctggacggtataccattgtaacatgggcactgttctcacatttttcctaaatgattttaactatcatggctttaactgcaatctacaaaccagtgctacaaatttatatcttcagacaagatctttaatgagtcactgattcaaatatcaaactgcctactgaacatttccatatgaattatcccagaaaacagacttcatcacccaccccaaaacctctttttctcctgcattttatatttttatggatttccaacaccacccaaggagctaatcctgacaaatatggtcctccttgacttcttctcattactacccatagtaaactagtcccttttttttttggagatggagtctggcggtaacccaggctggagtgcagtggcatgatcttggttcactgaaaccttcgcctcctgggttcaaacgattctcctgcctcagcctcccaagtggctgagactacaggtgcgcaccaccacgtccagctaatttttatatttttagtagagacagggtttcaccatgttggccaggctggtatcgaattcccggcatccagtgatccacctgccttggcctcctacagtgttgggattacaggtgtgaatcactgtgtgcagcttgaactagtcccattttaaatgtccagtttgtcatctcctttctcacctcatgctcatcccctcactcaggcccataacattttctacctggatttctgtgacagcctcctaattgtctcagacttaaccctctctaagtcactattcacactgctaacagacaggcctttctaaaacacaacttgaccatgttaatgacccactaaatatctttactggcttgctgttggcttctagaatgacacctgtctccttagcacagtaaaggaggcccattatgctcaggctcccacctctccagatttcccaccttcctttcactccactctcatccaaacactctatggctctttgttttcctgtctttgtaccccctcagccttcacctgtctcatctttgtttccaagatgtttttccattctaccaccaccaagccaacctagactacgtgttcattctctgtgattccaccacatcctgctctcagcacaacagttatcctagtctgtcttcactatcagttaacatttagtgaatgcctaccacatgccaggcattgtgctaagtgcattacatggattatctcatttaatcttcatgggaaccctatgatgaggtattacttaaccacagaggttaaataacttgccagtggtcacaaatctagtaagtagtagagcccaaattgcattctaggtagtcaaattccaaaactcaccttcttaatcactaggcaatactgccttcctagtgttggactaatactagactgggtttattaagagcaaagcctataaactttcacccataatatcccaggctctaacacagcatcctaaacccaataactatttgctaactgagtgttgaatgacatttgcccaaaatgtagtctgtattcatttgtggctaaataattatacaatatctgtccttttcattctaatcttaatgactaaaccgttttccagtcattttaactacaaagtagtgtcatatgcaaatacttcacttcctttatttcggaagaattacatagtgaaatacctcagagctagagcgattgtgcaagtgcagaagaaagagtgagtccccttcagcataatatcccatctcattatcagctgtgtagcaaacggcactgataactctttctgctgaaaacgtccacacaacttgattttgatccatatctaaaaaaactatcttgttaccaagaagagttatgaggtgaggaaatgggttgatttctgaaagcaaaaaaacatgtagataatatgcatgagaaaactgactttagcttagcaaagtctcgatttaatatctggcagttttgaagtccatgggctccctttggttcctctaatagatctttctcagtgataaccttgtaggctctctacccctaggtttatttaaacatattttggtggtgtgttggggtcaaaaacatgtttttgacctaaactttagcaaagagacagtgttcatatccctaaagacaccaatgggacacacacacacacacacacacacacgcctctaaattattatttgcacagattttagaaaacaaatacctgatgttgtagactttacaacgtcagcatatggtcctggccccttagatgtaaaggccctaacctaaagaaaaggaaacaaaaattgcattcagtagtgttctccgtggcaacaattaagttctgagactgagagattactaaatgtttcatttcatactcctgatacacaatattaatagtttcaaatagttattgacattaatatacagcaatataaatcaccaagagaaaaaatattgctctatatttatgttgacagattttttaatctagaaaagtgcaagaattggaacaaatctctcttgctaaaaaatgaatttctaaaaatgtctggggatttaatgtacagcatggatggtgatgaatgtctaattaattcaattgtgataattacacaatgtatacatttattaagtcatgttgtacagcttgaatatatatatatcaattgaatatttttaaataaagtaaggtcattattttcaaaattaagttacatagaacatttaacagaaataaaactgtacaaattatgataaacttccatttttcttgaattcaacaactagaagcttcaaaaaactaaatttccagactttttagaaagagtaacttttaaaaataattaaatcttacatttgaaaatgattgtgcatttcaaaccagtttcacatacattgtctcttttgatcttcacaactactaagagtagaaactggaccaggatactaataaaggtaagtaactcatgcacaatgacgtatgtagaaactggcatcagaaccaagtcttctgaggtctacatacattttttcccattgggccatgccacattctaacagtaaagtttattttttttcttagatattttctattatgtaataaattatttccatttccaaaccttgcatatgtacagtagcctgcaaagaaaattgacatctataatggtggactcaaaatataaagccccaagtactttatcaacaaaacattgtattatttttattatacttttagtattaaacatattttactgtattttatatattactatctgtatgatttataatggtgcatatatatatatatagtagtgtttacttttgtacaaaactgtgttaaatgaaactcatacatatccatgcatatcactttgcatggttccatggtgaccaaaatttgaaactatatatctatatacatatttatattatatattctatataaatactatatattctatatatagacacacttaacccgaatattattttaccaaaacactcctaatttttaccaaataggaacgtgtactatctttaactttcatgtataacttatttgattagtatatgtagacaacaaattatcaaaataattattaaattagaattttatgaaaagaaaaacaaatccctacacaactcaaatctccaaaacactccccaagatgttattttccccaaaaagaaatggtggaaagcattacagcacagtgctttccagccacgcagctttggtaattgactgatactctcaacgacttaactttttctttatagtatgaggatcaaatgagataatgaatacaaaaatacctacagtggtgcaaggcctatagtgattttattgaaaaataatggtttatcaaaataacacatgtaccccaaatgtatgtacaactataatatatatcaataaaaaatgtaaaacaaatcagtaatgtgtaacatacagaaattaaaatcatgatacagcttcaaaagaaaagcaaaaagaaaaagaatgacttactctgaatttgcaaagttccctgaatgtgagaaagttgtgaaagtgtccttcacccaagcaatcccctcttgcctctctacttttgctgcccacttgacctctttgatcacagtatacctaaattattgacagggtggcagaattcttaacctagtcctttaattattcttctgtttaaacttttttttttaactgcagtcgtctttaatggaataaaaacgaattcctgcatattaatcctcaaaaggtccactttccatttctttaacagtttactttagtcactcttatctgaattacctccattaattttctcacataattttaaaaaactatagtggccaatcaaaatctaggtatgtgtgccatttacactgtaacatatcccagaaacatagtctttccctctccccacaatgccgctattaagactctcatatcttctgttttctctctcatacctggaaggcaataaagcatctgggactcatgccttcaagttgaaaagacatcactgagggagtgacattgacagcaatccagtcttcacatgttttgtttgtaatactttgattggatatattgtagaaaatttcaaattttgttaacaccccattttcatgcttaggtttgttccacctaaattccaccacaacttcattcttgttgcagcattttccacttggtaatataaatattctggggttctctggtgctgatggaactgaaaagtagaggcacaggtagagcagaaaagaatataagaatataaagaatataagacttttaccacttataataagattgtaaacaacttaacaatatttctcattccaggcagttgcagtatatttattacattcttaaagatcttcaggagagaatattccatagatttcttcaggaacccatcctgataatttcagcacatctgactgacaggcaagacttccttatgttcaactcaaatccttcctactaccacttaagcacacctttcttgtctgtgccttgtgtagatggaagctgtctggttctccccgtaaaatgcaacattcacttttatcctgacagagtgatttcagtgaaggtgaaaatgtcatcatcaggatggatggcagtaagtcccaccagccttcagccagttcaggttgtaaaacacagcataaatcagagacctaggccctgtcactctgaagttcctagaaagcagaaagtttaggggaggctgatcgtaccccaagagtaaggtttgggagtattcatttattctagagccaaaccaagcaattcagtatctctcagtcctttaatcaagagaaatgtctctgcctgatttctaagtcattctctctggatggccctctcctctcttaggactcctccacaaggtcttcattccctccctcattccaatcacattgctatttaatgtttaacactcatactattattcaatctccaggccttcttacattaggcttctcttctcacatgggatacctcttcttgctccatctttcagagtgcactaaagtttccatttcccaaaggcaccttctctcttaaaaatgcctgaggcagcttgatataggtgaaggtttcataggcttgtctactcactctatgccactgctgctcaggtataactctctagtatctattatcatttgctgtgcatgtgtttatctccctcctgttttatgaactccatcagagaaagcatctcttcttattccttgttaaatcttcccatatctagtacagaactggcatacagtaagtggttaataaatattggtcaatttggataatttcctggctatattgtaaatttcctgaaggcaaaggccaaatcttgtcatcctttcttattctccaatatccagcagagtgctgttgactcttgctcccactggatcccctgatggatgcagtcaagtccatttccacaggacaattcaaccaagctgatatcccaaggaaatctcaagcagaacattcctggatccaatgctaactgctccggaacctgcccaggccccactatgttcctgttgtgtaattcgtagatggatattgttgaaataatcttaatagtaaaaaatgcaatggagaatggatatctatatttattaagctcttaccacctgccaaatcctgtattagctttacataaattactatcatttaccaacatttgtaaaagtgactgaatggagatttgatgaaactgtagtgaaaagtccagattaagtcccagcccagccacttagtaactattttatttgggcaactactaggctttcattttctttcttgcataatcaagataataagactttcctacccacctcagagctctgtgaggatcaaatgaaatgatgtttctgacacatgataggtatgtagtaaatagttaataaaggagtgatacataaaaatgtgttttgtacactttaaggtgatacacacatgtaatgatatggctagtatcttttttaaaatatcttttccccaaaacattaaatttagatatcagttattcacctacagaagattctgagttcccatctatgagaacagtctgccttccaagaaaactgtctctgcccttaaatgcccattttccttataaaggattttgcaaattacctgaaatatgcatctgcatcttctacatcactacaatcaaatgaaatggctgttaagaaatctttgaaatattcttttggaataaattatgcatatttatgttaatgacgctattctaatctccaaaaagtcattgaaagggtattgaatctaaacacatctataaaactgaaagttatttttaaatatcaactatccattccagatcatgaaaagtgagattctgcttttttaagaaaaaagacagattttaacccctgtacctgtttcaggtgctcgaagtgacagagatgttttggggccctttccccagtaggtataaggagtgacagaaagattaaataaggcataaggttccagtccttccacagtaaatacaggtaaagagtgttgttcactagccaagaactaaaatataaacagaaaacattattttctcagggagagaattataaaatctttcattccttattatctaaaatctccaaactttagttcacatgtaaaatcaaaatttgcaattttggaagtgctaattttggcaagttctgtgttgtgccacacagaccagttaaagtgtatccagcacagcagttagcaccaagcagtcagagactggctgcaaacaagtcttctggggaataatcttaatgaccaaatgctatgggaatgacaaagaagatgggcttggctaagtcaagatgatacaggtcagtgtgggcaaggctgacacagatggtacagtctgtttgggaaatgaaagttactagaaccaacaccataccttagaatgagcactaaattctacactgtagaaaactacaccccagtctaccgcagggggaccattccacaggatttgaaaacttgaagcatttccttcaatcctaaatgaagactcttgaacagaatctggaataaccttaggggtaaaggaaaagttccctacaggatgaaacaaaaaaaagaaataggagaaaaaaatggggattattgaccaatatagaaatcatagaaaatcaatagcaattactaataattagaactgaaacaaaatttttcttttctttaacatatcctgaaaaaaatcatctttttctgactttttcaggctgtaaatttgggttaagattaaactcactgcaagcaaaccaattgaaattactgaaaccttactcctcttaaaacttaattcttaagaaaaaaaaatatcccaacctaaacatttatttaactgaaggtatagtggagtagggtaagcaggaatgaaatactgtacctggcaggggcttaagggatgtctgaataattgtgaactgattaaatctggctggttccaaaacagagacactggttttctgacctatttcttgagttgtgataatcctaaagccattgatccagaacagccgaccactatagtacatcagtgcattctgggaaatttcagaagtactccaggctgcaaattctgtgatggtggtatccccagtgctgctaaaacataacaccaattagtgtgtgtttctggagtggtggaagggctggtccatgcaagtagtcatgagaatatatgtttgtgagtatctgtacgcatttgtgtacattaaaataaagaaaatactttctaacgattattgtctttttttgtttcatattaagttgggtttttattttacatttttaaaagtagtagacctaaagtaaattttctgggggctttccttgtttctttgagatggagtctcactctgttgcccaagctggagtgcagtggcatgatcacagttcgctgcaacctctgccttccagcttcaagatactctcctgtttcaccctcccaagtagctgggattatatgcacacaccactaagcctggctaattttttgtatttttagttgagtcagggtttcacatgttggccaggctggtcttgaacttctgacctcaagtgatctgactgcctcggcttcccaaagtgctgggatcacaggcatgagcactgtgctctctgggggcttttcttattaatgtgatattgcaatatcaagggtgtttagataggttgcagctttttaaaaaatgcttgtgattttggtaatactctacaacaaaggcacaacctggattctcattacttcattagttcagagattacatctttggtttattctatgtgctcctacaactcttgcattagcataagaaagacatgaggcaaggttcttacaggacctggaaataaggtaatcatccagaaatgaaacccgtaaaaaccaatgcctgaagtataaatttgccatatgtagaggtgaagcagaagggctttgggaccaatcaatgcaataaattagcctatagatgtgaagttagcctacggatgtgaagcagaagggctttgggaccagccaatgcaataaatcatgatggagacagcaagttaggattcaggtacatgttcctttaaaaaggaaagcctattgcattgagggatttgaaaaaaagacacacccaaagagcaagaatttccaagcatttatccagaattgacaggaatgacagctcttaaatgtggtagccatgaggactccagtacctaggcacacagaataactctgttatgagcagagttcatcactgctctgacactggcctgtgtgggcacccttctagtctatccaacaaccctcactcagattccttgttcttaaagcaaccacctcacatctaacccagttcacgtgatgccaagaaggcatggcctgcatgcccacatgactattctcatttctgaatgagactaggccccactgggaattaatgaatttgcaatgtaggggattcttcagaaacagatagaactgcatggaaccccagctcagccaattattaaatgtttgacttcaggcaaataatttaacctctcattgaaccatctattaaatgtgggtataacactaataaatctgcatctgggtgaagctgatctcatttcatcatagttttctcaagaaataaaaagattgatttaaaaaaatcaattccatgaccccaccaccccaaaatgaacagccaggcataacaagataaacagggaaaatcaatcccgaaggcatggtctgttgaattttttctccccattgaaccacgccttcctcctactcttggttagtcatctgatttacctgccatttattatcctagcctgctgggtccttcactttatactactcacaactgtatgttatttcaatgtgtatcagtttctatagtttgatcaaagtgctccttttcagactaggaaattcaagtaaaaaactttaaattgtgtttagaggtttttttcccctcaatggaaggaaattttgcaattatttttgcttgaaaaatctgcttggttgtttctgaagttgtaacagttgtttagtactcaaaaaaagaactatctcagttatcctcagcattttggagtgatagtttgattttttttttagtgatttctataaatcattttaaagcattcacttttctctctttagaaaaatataaataaagttttgttttgagaatttcacagtacctcaaataggtttactcttgtataaactaaagggaatggatgtacataggagagggaagagtagtttgaggggcaattcaattacaattctcaagttcggaatatgatgagtgacagcaatcagtttatctcatctctactacagactagagccgtactgctcagtgcagcagcaactagctacatgtgactacggagcccttgaaatgtggttagtatgaccgaggaaccaaaagtttaatgttatttagttttaattaacttgtggtaaattttaaaactaatatttgattcatatattatgaatcacgtataatatattaaaatatttttgagtattttagaacaagtatgtaaatcaactattttgcctgtaaattttatgaaatctaaatacagatcaaatattttctatgaaaacttagtttgcaaattaagctatgctataaatgtaaaatacaaacagaacgtccaagaattaatgtgaaaaaaagaatataaaataactttataatttttattcagattgcatgttgaagtgacattttgatatgttatcaaaatattaaaatatactattaaagttacgtttacttgtttttactttttttaatgagccaactagaatatttataattacatatgtgacttgcattatatttgtattggacaaagctgatctaaactaaagggaaggaattttgattatatgttagaaaatactttctccttataagatgactctggaatcccaatctctatatataaaacttctttttttcctgataggtttaaaaggcaagacttacttggaaggcaaaagtacctgccctttgttatctcactgggagctgctatgctccactgtacatacatacaagaaaacattactaaacttgaaatgaggaaatacattttttaagaaggaacttccttcctctactttatattgagtctgtggatgctcgaggagctagactcttaaagaaaccagctctccctggctaacatggtgaaacaccgtctctactaaaaaatacaaaaaattagccgggcgtgttggcgggcgcctgtagtcccagctactcaggaggctgaggcaggagaatggcatgaacccgggaggcggagcttgcagtgagccgagatcgcgccactgcaccagcctgggcgacagagcgagactccatctcaaaaaaaaaaagaaaccagctctctggcatatacagacacagagaatgcagagaatggactatgatccttcaggacactgttgctttgaacattgtctatgtctcactttagacagcttgttttggcaatcagattgtcagtaccttaagttcctaaggaaaggaataatcagttttctctgattcacaggtaggaaactagccagagctgtctgccatacttgatatgaagtaattgatcaatcagatttgttgtgtttatgtgcttataggcattatgtgtgtgtgtgtatatatatggatatatacataaatatctatctacatgcatccacgtgcatacacatatatatacacatccatatatatgtatatgtacatgcatatacacatatgtatatacatatatgtacatacggatgtgtatatggatatgaatgtatgtggatatatatggatatatacatatgaatgcatatggatgtatgtgtataaatctatatctatagatagataaatatacacatacatacactcctttttcagggtctccatgacttggagtttttctacttaccaaaaaaaggaatttttattctaaaaatattgtcagcattgtcttcataaaatagttattgaactttaggagacttttttggaattttgatgaaagatatgaatcctcaattgcagagcactgacacatcctaaagccttctatgaaccctttggggacccaagaacctaataccagaaatctttacctttagagtatatgatattttgctttactttaatcacttcctgaccattcctctgattaacaatgtgatattaggaaaatgtgtgaatatctctggacctcagtgtcctcatctatgaaataaaatgatctctaaattctccctctaaattttgggttctaatgactttataacctatattttaattttagatgtgtaacttctcccttaaaaactattagttaaatatttttaaattattggatatttaaacaagtagaagtaaaacatatgacacgaagaacactaagagtaggatggtaaaaattaaacatatataaagttttaaatcatttatgaaggatatatttggatattgacttgataagttgaagatgtatcatgtaaaaaaatgcatattttaatttctaatgcaacctaaaaaaataaatagacatacttaaaatgtcattagaggagataaaatggaatactaaaaattattttattcacccacaaaaatggcaaagaagtagaaacagaggaacaaggagctgagacacaaatggaagtcacatgtcaagacagtagacttaaatccaaacatattgataattatattaagtgtaaatgaaccaaatgccgtaattaaaatgcagaagttgttagattgtgtaaaaaagcaacatcctgtatgttgtttacaagaaaggcactttaaatgtaaagactcagatcagttcccaaaatagtgaataggaggcaaggactaacttgcagctcccattcagatggacagagcggcatgtggagactcacatcatgaacttttgctccaagaactaccacaggaacataccaggaaagccgagagaatccacagacgctttgaaggaagaggcttgctgctgtaggctttgtgagatagccaaaaaactgagtgcccaaagtgtgatatggggagtgtccacccccgaacacacatcctctgtggaaaacctgaaggtccagatcatgggagaaggatttgacctcacatgcagctgaggcaaatttacagccaagcaaaatataggggtagaggaagcagcaggacgagccctgtgggcacttgcagtccccagggaaaccattcctgactttgtcttgcagagatccttggggagggctgccagtgtaactggagaaagaccataggaagaagaaaagttccagctgaactttgtaaaaatttaaaccgaatacagtttcctggacagaacctgggaaagggggcaaatagggagtgcagatatgaacacagaaaccatgacaggtgggaggtatgaaacctgaaagccctacttgctttttcagcagggaggcttgtaacctgcggcaagttcttagtcctactcactggctgcatgggagacatggtgggagtgagactggcctttcaggctgtgtgggagttgggcgaggccggtcactgctggcttttccccactcccctggtggcctgtataatgcagtaaagtcagccataatatccctgggaacataactccatcagcctgagaactacacccccatcccctacagcagccacacacagcaagctccgcccaaggagagcctgagctcagacatgcctaaccctgccccaactgagggtctttctctaccaatcctggtagctgaagacaaaggacatactctcttgggggctctatagcccccaaacttcagcatcctttatgattaaaacctcagcaacacaggcatagaaggggcatatcttaatgtaataaaagccatctatgacaaacgcatggccaacattacactgaatagagaaaagctgaaagcattccctctgagaactggaacaagacaaggatgcccagtcacaccagtcctgttcaacatagtactggaagtcctagccagagcaagcagacaacaaaaagaaagaaagggcatccaaatcagtaaagaggaagtcatactatcactgtttgctgataacatgatcatatatctagaaaaccctaaatacttctccataaagctcctaatactgacaaattaattcagtaaactttcagaatacaaaattaatgtacacaaaacaatagcactgtttccggaactggtgggttctttttctgactgacttcaagaatgaaaccacagaccctcgtggtgagcgttacagttcttaaaggtggtgtgtccagagtttgttccttctgatgttcggatgtgtttggagtttcttccttctggtgggttcgtggtctctctggcttcaggagtgaagctgcagaccttcgtggtgagtgttacagctcttaaggtggcgcatctggagtcgctcattcctctcactgggttcgtggtctcactggcctcaggagtgaagctgtagaccttcagggtaagtgttacagctcataaacgcagtgtggagccaaaaagtaagcagcagccacacttatcacaaagagcaaaagaacaaagcttctacactgtggaaaaggatccattcgggttgccacagctggcttgggcagcctgcttttattcccttatctggccccacccacattctgctgattggcccattttacagagagctgattggtccattttacagagagctgattggtccgttttgatagggtgctgcttggtgcgtttacaatacctgagctaaacacagagtgctgattggtgtatttgcaatcctttagctagacataaaagttctccaagtccctaccagattagctagatacagagtgctgattggtgcatccatgaaccctgagctagacacagagtgctgattggtgcatatacaatcctccagctagacataaaagttctccaagtctccacctgactcaggagcccatctggcttcgcctagtggatcctgtgccagggccgtgggtggagctgcccgccagtcctacaccatgcgcctgcactcctcagcccttgggcggtcaatgggatcgggcgccacggagcagggggcggcacccatcagggaggctcgggctgcgcggaagcccaccacggggggacttgggcatggcaggatgcaggtcccgagccttgccccgcagggaggcgctgaggcccggcgagaattcgagcatggcgcgggcaggccagcagtgctgggggacctggtgcccctctccacagctgctggcctggatgctaagcccctcactgcccggggctggtggcactggccagccgctctgagtgcggggcccgccaagcccgcacccacccagaactcgtgctggcctgcgaccaccacacgtagccctggttcccacctgcgtctctccctccacacctccgcacaagcagagggagctggcttcagcctcagccagcccagagaggggctaccacagtgcagcggcagcctgaagggctcctcaagcatggccagagcagacatcaaggccaaagaggtgctgagagtgagcgagggctgctagcacgttgtcacctctcagcactgctatataccaacagcgaccaagctgagaatcaaatcaataattcaaccccttttacaatagctgcaaaaatatactcacaaatgtacctaagaagataaaagacttctacaaaactacacaatactgctgaaagaaatcatagatgatacaaacaaatggaaacacatcccatgctcatggatgggtagaatcactattgtgaaaatgaccatactgccaaaagcaatctacaaattcaatgtaattcccattgaaataccagcatcattcttcacagaacaagagagaacaatcctaaaatgcatgtggaaccaaaaaagagcccatatagccaaagcaagactaagcaaaaagaacaaatctggaggcatcacattacctgacttcaaactgtactataaggctatagtcaccaaaacagtatggtacttgtataaaaatagacacacatatcaaagtaacaaaatagagaacccagaaataaagccaactgatcttcgacaaagcaaacaaaaactaaagtagggaaaggataccctattcaacaaatggtgctgggataattggaaagccacatgtagaagaatgaaactggatcctcatctcttgccttatacaaaaatcaactcaagatggatcaaagacttaaatctaagacctaaaaccttaacaattctagaagataacatcgaagaaacccttctagacattggcttaggcaaagacttcatgacaaagaacccaaaatcaaatgcaacaaaaacaaagataaatagatggaatttaattaaactaaaaagcttctgcacagcaaaataatcagcagagtaaacagacaacccacagagtgggagaaaatattcacaaactatgtatttgacaaaggactaatatccagaaactacaaggaactcacacaaatcaacaagaaaaaagcaaaccatctcaaataatagatgttggcatggatgtggtgaagagggaacactcttacactgctgatgggaatgtaaactagtacaaccactatggaaaacagtgtgaaaattccttcaagaactaaaagtagatctaccatttgatccagcagtcccactattgggtatccacccaaggaaaagaagtcattatacaaaaaagatacatgcacatgcatgtttatagtagcacaattcatgattgcaaaaatatggaaccagtccaaatgcccatcaattattgaataaagaaaatgtggtgtatatataatggaatactactcagccataaaaaagaacaaaataatggcattcatagcaacctggatggaattggagaccgttattctaagtgaagtaaccaggaatggaaaaccaaaaagtacattctcactcataagtgggagttaggctgtgaggatgcaaaggcataagaatgatacaatggactttggggatttggagtaaagggtgggaggagggtgagggataaaagactacacactgggtacagtgtacaccactcaggtgatgggtttaccaaaatttcagaattcaccactaaagaacttatccatgtaaccaaataccacctgttccccaaaaacctattgaattaaataaattttttaaaaaaagaaaacctacctattgggtaatatgcttgttacctgggtaacaatctgtaccccaaacccccaggacacactatctatagaacctacctgcacatgtaccccttaaactaaaataaaaaatttaaaaccaacaataaaacaatacaataaatgtaaacaacacaatttaaaagtaaataaatggaaatagctgtactatgcaaacactaagcaaaagaaagctgatgtggccatagtaatatcagacaaaggaatctttaagatgaagaatattagcatagatgaataggagtattttataatgataaaaaggcaatataattaagtatatagataatcaatatactaaatataaagcacccaaatacattaaccaaaaagaacaataggcaaatcaacaatcatagttggagacataccaaaatttgttgaatacaactaatatagaccttgaaagaaactcatagttttaaatgccagtgagtggaatgatacaaaaacaatgacctttcttttcaatctaaaaagctagaaaaagaacagaaaattatgcctaaaataaatagaaaagggaaaataataagattagaagttaatgaaataaaaaatggacaatcagaaaaaaatcaataatgccagaaacagattatttgaaaagataaataaatctcataaacttttagcaggagtgatcaagaaaaaaatgtaccaatagcagaagtataaaaggatatcacgacagaccctatagacattaaaatgatattaagaggatattataaaatttgaaaactcatgcaaaatgacaaattcttgaaagcatgaattaccaaactggctcaagaagaaataaaaataaatagccttatatccttaaaagatgctgaatttgtaatcaaataattttccacaaagaaaactccaggtccagatgaattagcttgtggactttatcaaaactaaagaagaattaacagcaattctatacaaatgctttcagaaaattgaggagagaatgcttcctaagtcatttttgagactactataactcttactaaagtattctagaagaaatctactaggacatataaattaacttaaaaatgtataagatacaaagtcatatacaaaaagcaattgtattttcccacactagtaatgaacatttagaaaatggaattttaaaaagtaacatatataaagcattaaaaaaattagatacctaggcattaacctaataaaagatatgttagacatctacactaaaaactataaaacacttctgagagaaatcaaagaaaacctaaaaaaatggagagatacaccattttcattgattggaagattcaaaattttgagatattcattcttcctaaactgaaaagagattcaaaattccagcaggatttattctagaaattagtgagatgattttaaaatctatttggaaaggcaaaagatcaagtatagccaaaataaaaatattggaaaagcaaagcaaagtagaaggactgaatttgcctgtcttcaagtttttctctgaatttacagttatcaagacaatgtagtactggcaaaaagagtagacaaatatatcaaaggaacagaacagagagtccagaaatagacctacacatacacagtcaaattattattattattattttgacagagtttcactcttgttgcccaggctggagtgcaatggcgcgatctcagctcactgtaacctctgcctccccggttcaattgattctcatgcctcagccttctgagtagctgggattacaggcgcccatcaccacgctcagctagtttttgtatttttagtagagacggagtttcaccacgttggtcaggctggtctcgaactcctgaccttaggctatccacccatgtcagcctcccaaagtgctgggattacaggcgtgagccaccacgcccggcccaaattattttcaataaaggtcccaaagcaactaaataaagaaagagaaaatctcttcagcaaatggcgctagaacaactggatatccctacagaaaggaaaaaaagaaaactttaactcatatctcacaacataccccaaaataaatttacgatgaattatagatctaatcatgaaagctaaaacgataaagcttctagaaaaaatggagtataaaatcttcacaactttgggataggctaagatttcttgtagaaaacacagaaagcacagaatatagaaaatgcataaattggacttaatcgaaatgaaattcttctcatcaaagcacaccaccaagaaaataagcagataaactaaacactgagacaaaatattcacaacacatattttgacaaagtgcttatatacagaacaacccaataatgaaaagacaactcatttaaaaatgagaaaaatacttgaacaggcatatcataaaagaagatatataaatggctgataacaaatgaaaaagtgatcaaaattgatagtcatcagggaagtgctggttaaaatcacaatatttactgcttcccacaccaaagaatggtgaatataataaagattgtcaaagccaactgttgagaggatatggaagaaccacaattttcatacattttttatgggaatgtaaaatggcacaaacattttgaaaaactggcaattacttaagaatataaacatctatctaccctatcacccagcaattctactcctaggtatttatccaagtatacatccacaaaaagccttgtatacaaatattcagttttatgcataataaccaaaattaggaagcaattaaaatgtccatcaagacatgcatagaatggatacacagacagtggtatcttcacacaatggaataccactcagtaataaaaaagaaaaactagtacacataacaaagtgaatatatcgcaaaagattgtatgccaagtaaaagaagccagatacaaaaagtacatatttctggagtggtgcagattgattggcaaggggcacaggaattttttgtgatgatggatatgttctgtgtctcaaaatgcatttgtctaaactgatgtaatggaacacttaagatctgaatatttcacattatgtatattttaactaattttttaaaataaaagtgtaaaatttatttttaaaatatctgacaatgctaatgtggaagatgtagagataccgacaagatcaggacagggggataagcttgaggacacagatcaaggagataattcatgtggtccctttcactctctaattttcatttaagacatcacaggaagagttctgccttcactccataatgtatactctattttgtgaagaagcagaaaagcttatccatacacttcctgggctcttaagcagcattctcctgagtgtctatactgtactctcttcataccccatcacagcacttaccatattctactgtaactagttatttacaaacctctttaccctacaagcccaatgcctgcaacacagtggataaccagaaaatgtttattgaaggaataaatgaatttccatgcattatcatttatgactgacaagttttcttctcaatcaattgcctttgagggactctacttacctctgtccccgaagaacagctgtgtacaggtgaatacattgactgtcttgaaccaaccaatacaggagcccatcactgaggtctaaagttagagcaattacctaagtagaaagtaaggtaagaaaataaaccaaatacatgtttgaagcataactttgtgaacaggtcacacttaagctatagatttctctttaacatcctctttggaataataaattcagtaatttttacttttttctgactataaaacttatatgattatgcttattactgttatttggatataaacactggtgtcctaaaattttacaaaaaggcaaggagtgtattattcacttttatatacttagctccagtaattatcaaagtatgattctcagacctgcagcaacagcatcacctggaagcttggaacaaatataaattatcagtcacactccagagttactgaatctgaaatgttgagcctgtgtcaagcttgcctaaaggtagtggtaactctggcctatttagcaacatgagccagtgaattttgttgttgtttaaacctgttgttatcaaacatagctgcatattacaatgatctgtggagttttttaaaaatctcaattcccaggctgcactctattaattatgatctctggggatggaacctaggctccagtatgctttaaaacttctcaggtgattccaacgtgccaccaatggtttaaaccattttgaattgtattttctattaattgcaacccaaaacattctcatacactttaaaaagatcatacacaaaggatgtttatgtattaaaattgaatagtaatgtgtatataaagccctatttccagatgacatatgagaaccacttcttactactctttgctttcttgttgcaatgtatatcttaagtttacatccagtcatctagatgaggcctgatggcacagaatccatgagatatggcatagaatccatgagacagatagaagttactatccaaagatcctgtttttgctttctttggctttacaaatatttttcaaataagctaagattgccagtagcctgatttcggagcagtgcaatctccctgtaacatacctagaagctgtgaggtataaccaatagaattaaagttgacgactacatcttcagcaagatacagcagcatttaaacaaatatgatgagccagtgaaagatgtgaaaagactacaataaggtatccaagagctaaaaattcttcctgaaaagttatcctgctacaaagaaacagttataaggtacatgacgacaaaaacccttcggttgtcatacaaatcacagccttctatcttcaggaaaattcaaccaacttattctccagaaggtaaaaatgtattctggcaattctcagccttttaggagttgaatcatgtccttgctccatgctgagagagatctattgatttttttttttcagttaaaaagaaatcaggttaaccttgtttggttatttacaatgagatacactagagtttctacattacaaattaagtctatttcatctattttaaaaaggagattctacaattttttgctggaatacaacaaactattcaaactctaagtaaaattcaggtgttgagtcatcatcccattcctccacagcagtcagcagcttcatatttaaacagtcagagggtactccataccttttatataaacctctctgatctaaactaaaacccttatgctaaattttaattctgtggtaaaatgtaccatatgctgtgagttgagctcatcagatgtggcaaaaggtatctttttaccttagaagaatctcttactttgttcattctttttttatcacacaagtaattgggcctttctataaataattgcctgactgtatttcattatgtcggctgattgcaaaatatattattactgcataataaatctgtacatgacatcaatgaacaagagagagatgaagagctttgctggatgcaaaatgcattgccttcaaaacatccactgtcactaagggagtcagatagattagacatcaaaccatggaaccagaacacagatttgcaaaagcaacaacagcacttgacaacctgggagaggatttgcagaggactgtttttttttttttttggttaatttccattcttttgcttttattatatatatatttttaacttcaatagctttttggggtacaggtagtttttggtcacatggatgaattgtacagctgtaaaggctgagatttcagtgcaccagtcacctgagtagtgtaaaaatgtacccaatatgtagggttttttttatcccccacccaacttccaccctccctccttctgagtctccaaagtctattatattactctgtatgcttttgcatacccatggcttagctcccacttataagtgagaacatatagtatttggtttgccattcctgagttactttacttagaataatggcctccagctccatccaaattgctgcaaaagacattatttcctccttttttttatggctgagtggtattctatggtgtatttataccacattttctttatccatccactaatcagttgatgggcacttaggttggttccctatctttgcaattgcaaattgtgctgccataaacatatgtgtgcaggtgtctttttgatataataacttcttttcctttggggagatacccagtagtgggattgctggatcgaatgatagaaatactattagttctttaagaaatctctgcactgttttccatagaggttgtactaatttacatccccatctgcagtgtataagcgtttggaggggggatttaaagaggggtaagaaggatgaatttcccccaaacatgctgagatgactcactcatttatggggaagtccccaaggtcacaccagagctttatcctggctagtgagagtactcaaacaaccatatcagaacactgggaagattactgacaaagtccctgaggtggagaagaagttactcttgagataatattatcaatatgtttttacaaaaatgaaaatgcttttccctaacaattatattttttgaaaaacaaaaaaaaatgctttctttgtattcagactcaagtgactccaaaatagaattaagagacctttttattatttgacaagaatgattgtctttggatatggtacataaatttccatctcttttaaatgtctgtgttataatccatgtaatgcaaatcaggtctctttaaatatcctaggaattatggcccatatatgttattggaattggagatcaagtgactcaactattagttcatatatatacatacatttttaaaatcatctggtattctgtattatgtatattttatctctgcagaaaaaaatgacttaaaataagaaaatcttaagggatatattaggtagaaatggtgtgaataatttatttattcttaatgcatttctgcaattttcaagtttttcacagttgaaatatgtcactattatggtcagaaaaaattaaaatttagaaacttagatggatacctagtgggtagctaaacagaatcaacaaaaatagttattgcttgtaaaagctgaggaagtaaaagtaacatttgctttagaaacattcctgtatttgcaggttgagtaataataatatgagcttaactacggagcatttactttgtacctggaactattcccactcctcatgaatactctcatataatctttataaaaaaaaacttaggaggtagaataatagttaacagtcccatttttcagataaggaaagaaacacggagaagtgaaatcatttgcctagtttttagaaacagtttttaaaacagtcagtgcccaaaactgattgaaaatagtaaaatgcctagtcaccacctgattcaaagcttctaaaatattcaacagaagtccttaagactataaaaacagttataaattaaaatacttttaagttgggttcactcaaaataaagtaaacaaaaaaaatctccatagtgcatttgaacttacataatcacttatcaccatcaaataaggctttcaattgtgaccatcaaataaggcgcttttttttcaaataacagaaaacttggttaaaccaagatcttaccaaaacactatttcctttaggagtctgctttaagtactcacaataagcgagagaaagtattatcataaatatagagctattcagtattactaaatgatcagatcttttaatttgtcacctttttcccagaaaaccaaggctgtgtctgtagtacaagggaactttccccatttagtctggtgctttccactgaatagagtgtggtccagtagagatatccaccaactgaatccaccaccatgtcattcaccaatagcttcacgtgggtaacaatgtctgtgtgtcccgtcaacacagactgcctttgtatctaaaaaacataattgtatggccagttaatggctttcaagtgacattattatttctgaatatttattgcaatcattaataaattgcttgattaatcattcattcattcaaccacaaatagtgattggcactatgtgctgggtagtgtaataagccttggaaacacagcaacaagcaaacaggcatggcacctgccctcatggggcttatctgttttcatgcctccaaagagaagggaactaaatttactttgcataaaaataactgcttttcctaattatacatccagacaatgtgaacactgctggataggaatatatttgattagactcccgaaaaaagatgtttatgtccctataaatgatgacatctctccttgctcttctctatcagtgtagttccctaatatttcatgattatcaataatgtgccaggcactgtacttttttatctttaaaaatataaactcctgtaatcctcacattaagcttatgaaggatttctattccctattttttcacaggtaaagtggattaaagttaaacaatttgtcctggagttaaacactttaataagagatagagaaaatacttaaaactggtttttatgtccactcttccatttcctttttcaaaactatttttaaactaacctatttgagggagtgttttctgactaaccccactcaatttcattctgcttgcacatctttggcacttatgaattcagattgtaccatattgctttgtctctaaatacattgcttcatatgcttctttattttatatatgtattttatctcctcagaagagcagggacaactgatgatggctgtacatcaatggacacactaaaaaatctctgaattctacacaataaaagaatgaattttgtgttatgtgaattatatcacaacaaagttgtttttaaaatagcagggacatgtcggctatttgttttatattccctactttgccttctttcaaggatttcaacgcattggtagtagataaatgattgctggacaaataaataaatggacagcaagtactttcctgattaaaaattatttcaataccttatttcttgatctgtcaggccaatgttcttgtcattagccatcatctttctcttcaaaatatatcactccacaggtgtgctggatgtctttattttgcctctaggtctaattcccacccttctccaccctactctgtgcccccataggccaacatctatggactttatctgctaggctgaagggttgttgtctggcttctggggaggttcagccaatggaagcactggcagattagagggcaggaggaaggaggggttggggttcttattcctttagctggctccttgccagaccatacatcttgatagtggccagcttctgtgcctaaagtcacagtccatatcagctactctcctacagctacagccctcaccaggttcttccacttcttccccttgcctattcacacctagacttatgtcttcgcacacttgtaaaccgtgaggatgcctcaccatcatttgttcattttccctagccctgtgcacacctttgaaaatagtctcttcacttagttgccttgaatcatgcttttggagcatgccatgttcctgccaagaaccaacgctcaggtgagcattttcatgtatttatttaaattattattggggaaaaaatacctaattcaacaaatagtgataacaaatttaatttacaaaaaaacatattttaaaagtgagatgaggccgggagcggtggctcacgcctgtaatcccagcactttgggaggccgaggcaggcagatctcttgaggtcaggagttcgagaccagcctggccaacgtggtgaaaccccatctccactgaaaatgcaagaagtagccaggcatggtggcatatgcctgtaattccagctactcgggaggcagaggccaagatggcgccactgcactccagcctgggcagcagggtgaaattgtgtctcaaaaaaagaaaaaaaaaatgtttaagtgacttggtttaaagataaacattaaataaataatagcataagtggtgcacaggtatttaaaaaaaaaaaagaaattggtgtgcaagtcactgaagtggataagtatcattctagagcatccagaatgccatgctttaactcaccacatatgtctttccagcccagtagagaaagtgacccagccactcaaaagctaaagcccctgctcctgcaatgctgggtaggtgataattctctgagatatccgtcccattcagcagccacacaaaaacgtcgcctttcgtgtcactgtagtagaggctgttgttataccaatccatgtctcaaaataaagtgaatgattagcagttatttttcatacataccaacaaaaacataatgagtcaacaaatcacatctgcacctcaacataattttaaacaacacactgacacatattcactagaacttgatctgtcaagaatatttaaataatgtttcccaaactcttaacccctgaaaccagggagaacagtggatacacatcgagcatctcctctttgccaaacattgtcccaggcagtttacagatctcatttagttcctaaaacaaaattatgaagtaggaattattctcatttttgagatggtaaacctgagacaaggtgagatcatgtgttctgcctgagggctcacagatacatcaagaggaagcccagactcagccaatgccaaagtggcattctctccattggtgccacattacctacatttggctcctatgttggtcagaaatgctgttgtacttttaatggccaaataaatcaataaacaattagataactatggaagatgtcatcttcaggcaagatcactgttataacaccctagaatgaagacttttcttccttctaacgccttccaggcaaattacccattcattacttaataatcctctttgtcaaccaattattccttataccttatttagaactctatgcagcagtttctgctcctgtcttatagcaaatgcacagtaaattatttaagtataactgtcttagtggaacaagataggctgttaatgtgagatggcattggtagattaatacatcagcattatatcaaagccttcctggtgggcataaaactagaaacaacctcacattttgtgacttaataaatagcgttcctatctaagaactgacattttcttaacagaatcactggcagtagagttcagtcaatattttttcctttcactattgaccaaatacaaaaataccctattcttttgattcattgaatgatgtgggaagtcttatgagtagaaatctgtcattcaagtgaacagaggacttggggtttacctgacacatttcctatatcagaggataagaactctcctgggccaaagctatttaatggtttactccaaagcccatcttctttcacagccatgataaatggtggttcactagctgtttagtaaaaaagaaattaaaagaaacatcagggaaagcaaactctttaaaggtatcttatatacttatatctatgccttatatcttatgattttctatataaagtaaaagaatgtcaacactttgaaaagttctataaaaggatatgagtaattgttatctgtgtaacaagaatgatcccattaaacatactttctgattttcacataaatttttgaaatgtgaagaaaaacgcatggtgagattgcctctataacggtgtcttgatcattgcagaattttttttgagggggctttgactactgtttgtcatggtctcattcagagcatccagaagagactgtgttaacaatagtaatatgaatggtatagtcatccttccatttcttttcagccaagaggatggaattcagcataattcacagcctctcaacttctctcagcaagaccctcagagttcagaaatgccactgcttaatataccataagaaagaagaaacccgtaaagaatcaattatagtgtttccttaaaaaatatcttggaaagtttaaaatggcaggttagaaacactaattaaatatcacacagtgctttatttgctttcctaatctcagaaaataaatatgtactcaatatgtgtttactcaaacacatactcaagaggtcaatacaccctcattctcatttctttaaacccaaggcaaggaaatttaaagggcactcagctagtcctctttttgtgagagtcactccctaaatccagaacattttctcacctggcaccagggtagtacccactgagggctctgaccaggggcctggcctctttggagaacttgctctcacagaaaccttgtatttcatagcactctgcagctcaggtacattcagcatggttccacttatgttcaagaaaatatgagtgacttcaggagggtcttgggtggatactttcacctcataggtccagttctgccaggcagaagggcctaattcaaagagttcaataatatcactgatcaggatgacatctgcaagggcaaaccaaggattctccataaattcacctacagcctcatctcaaatgggagagcaattgggcagtaatatccgctaccccgataatcaccagggatcatttgttgatgaggctaggacagtgttcattcctcatgccgctcatttggctgcattgaaggagacagcattcccaacaaataggactgtccttcagtcaaagctatatgcttgctgcatataattgtcagaggggttctctacaacactaatagatataatcaggctcttaataaaaaatgcttaatgatgaacctttaatgtaattaccactgtttgtatagtaccttcctccaagaagcccaatcaataaaaaaaaattacctattcattttcagccatctttgagatatgcagcaaacagacataattaactttgttctaaagcaaaaacagccaatgttttctaaatacttactatcgtctaggggatcagggattggcaaactccactcacaggccaaacctggcccactgtttctgtaaataaagttgtaatggaacacagccacagttattcatttacatattatctatgactgtcttcacactacaacgacataattgagtagctgacagggaccatctgacccacaaagtaaataaaaatatttactatctggtctttcctttacagaaaaagtttgctgacctctgtgctagatactgttctaagtgctctactaatgtgttttaattttatctgtacaacagttccattaaaagatataataaatattccccatttccaggtgtggaaactgagacacagagtggtttagtaacttgcccagggtcattctattaacaaatggcaagtatttgaatccgtgcaggctgactccagagcccacctgcttacccacccacatactacctctctccagagatggagattcgagttcagagttttagggaattgctgaaattcatgcaagctttcaacagcacaaaaaatctcaacccaagtattctatctccctggctatttgttctgactagaatgtcaatgcctggatcttagcagacactcaataaatgttcaaattattctattgggatatacatgagaagtatagagattctcctaatgtaaaactaataaatgcagaacaaatgtataaactttttttttagctaagtagctgcttctggttgatgactgaatagccaaatggggctctcaaaattgaatcacaacgccaagcagttcaaaccttcctcttattccagcaaggccagtaaccacactggggacagagcactcactggctcctatggcaagggcaggaggcttccattgaacaagagcctggtgagagccaaacagcaccgaaagctcctgcgggcggcctggcagagggtgcagctgggaggatgagccaaagatgaccaagttaccaaacccaaattcttctatgtgactcaggtcacatcccacgatgaattcattaaaagacaaagcatcctgttggaaaatgaccttgccatctgtgacaagaaagtcattgttttcacaagcaaaacttttcacatcagcaaaggggatgcgaggtaggatgagatgggaagcagagccatccagaaatgttgacatgaagacttgggcagtgtcattgaagtaaatgattcgcttggcttgtggcttgattgcaaagtcctttaacgtgcaactctccacaatacgcacagcttctgcacaccggccagatggtacaggaaggtctgctctataaatgccatctctcaggaggtaaaagacatacctgacacaggaacaaaagaaacctcatgagattcagtccaaaggttgatgagtaacctcctcagctaattgcttcattctgttgcacaatcagaactatgtatctctgatgttgctaagtacaggattttccaaggtagaaaaaggtaatttcctaagatatactctattcgtttaagttacaagttggaacattagaaaatttcagcctcacttgtaatgcttagtctcttaattattataagtgactttttaaggaatcaaaaaattcaaaaacaggaagggtcttttatttttttgagacaaggtcttactctgtcacccaggctggagttcagtgacacaatcacagctcactgcagcctcaacctcctgggttcaggtgatcctcccacacctcagtatcccatgtagctgggaccacaggcttgccaccgtgctcggctaatttttgtattttttgtggagacagggtatcaccgtgttgcccaagctagtcctgaactcctgggctcaagtgatctgcacaccttggcttcccaaagtgctgggattacaggcattagccaccagccctggccaggaagggtctttcaaaattttaaaggaaaacatactatatagaaatcacatggctaaatatggtatttactatcaaacattttcctccaaaaaacacacatccttaagtctaattttatcagtaaattttctcatgcattctgagtgataaatggaagaaagtaaaacatttaaaccatttttaattgtacagttatcattttgctataactagcatggctactttgcatttgcagtggactaattttttttaatctacaattgatgcaggcaatagagctaccattttataaaccacaaagaaataccccacacatgactgaagcaggaaaatccagcaatcaggagaaagaagccaacggaagaattagagaagcacatctaatttaaagtcaaacctcacagtaacgaggcaggttattttaataatgaaaaagaaaacatactgccaaaatatttcattgacaatgaaatatgtaaataaacttttaactaaaatataaaaccattaatgtggatgtagctaatttacaattcgtgattatggagaaaggtgctaacagaagtatactttgataaattcttatcccaaccccaaggactggcagcattccaacctctcatcaaaactgtcaaatcattttccttgtccttatttagttctgctctaattccccttgatgactattccaaatcttgatcaattttctcaaaactcctatgctagaataatatcctgagatataagctccattttgagatatgtagctatgttcttttccctgaggacggattgtagcaggcaaaaagcaaaaacagcttggctcttaattttctgcttttgtttcctaaattcaaaattgttaatggaatttggaggaatttcagagtagataaaaggaaaactatctgtggtaaatattacaattattatattgaagcagggaggaagagaaagaaaaatagaaaaggtgaagagatctggtgcatgggaagaggaggacagagtgaggaggagaagctggggtggaagaagatggggaagtggtggtaggaagaaaagcagaggttttacagtaagtctgaactcaatgaggagacaatttgcagtgcaaaaagaacagcatagaggaaaatatttctaataccaggacaatacactgtttcacacatctgatgtcctttaggactactaaacacaaactattgctgaaagttacatgctgatttttatagaaactctcctatcatggtatagagagatggttagaagacaggccctggagctagaagtcctggagcaagatttcttgttccagggcctgtctggttccactggttccatcgcaaaacagctgtataatcttagacaattacggaatcaacccgtgtttccctttccttatctataaaactagaataataaaagtacttatttcatagggttgaatacaaattaaatgaattattggacataatacacttagaaacacacattcagtataaatactaattatcattatcatttctagtcacattgcaaaatctaagcacaaatccattttatcctaatggaaaaaaagagccactgaagacctcagtgatcgcatttgaatgatcgattagtgggtaaagttcattatcctcagaatgagtcattttgtgtaagtgtcaacaacaaagttacatttcataggaccgtagacctttacacatgaaaacagtaagatccagagaatccttgtcctacatcacaaagcattaaatattccataattcagtaattcattcaaacctagaagttaaaataaatctttagtaaattgtgaatgaataggaatagaaagcttgattttaaaatctataatgaacaatcttttttaaaagaaagttttgtttgtgaaaaacatgttatgagctgtattttttttttcattcaaaatgaaagcaactttattcctacaggaaagaaaaaagtttaatcttacaaacatgggctttgcctactggttactaatctgttattatctggtcatatctgagaaataataactccaaaataactttctatgtgtttatccttcatattcatatatatctggagttcacaaaatacatgcacaataaatacctcattttgtcttcaaaataacccaactgggtaagtattattaccttccctatatggattgataaatcaatggtcatagacatgatattacttgcttcaggtactactccaatttaacagcaagactgcggtacaatgtgtccatttcatttgggggtaggaggcagagttatcaatcagctcctgtctcctaaggtggaagctagcagctttcttattaaagaacctcttgatagatgtgagaaccaaaccagaggaatgaactacagttgaatggctcagcaaaaggaacaggtggaatgaaggggctttatcacaggtagtgttgaggcggaaagtgagactcaatcccatgataaagaagtggcaaatccaggactagaacccaacccctgactcccagacaggaggtctttcccatattcccatatttggctgtgaaggagagagaaataactactttataagagttgatttatgtttgaaaaaacattccctcctggctctacagaatgaaaactttgcctgaatttaattaaattcacctaaagtaagatgcatagataggctcatctggtactacaatgtttcattagcaagcaagtttctcaaagattatttattcccaatggaagagaattcatctttacaaggctaacacatacccattgtatgaatcagccacaattttttgaggtgcactaatagagggtggagtaatttcctcgatgtttgagcagttctctaaatcacagacacatacctaaaaaaataaaaaatataccggtaggattagcatctgtctatacagcattaaattcagccaacaagtatccctgagtatctgttctgttggaattgtactaggcactgagcactgcccaagacaaatgagcaaaaaaaagcccttaaacgacagttttatatcctatatcctaatgaatttatacattattgacatcaatgcaatacaagtgcctattttcctggcttgtagaggcattcaactatttttaacatttaagcgatatctaggtttatgcactttcaaccacagcaatggctgttgcttactgtgataagcctgtaccttccaaagaagtagaatttgaaacatgtcaagactgtgtcttcatcagctcaaaatagtccttatgcaccaccaccaccaacaacaacaacaaaaaatggtcttccgaaaagtacagtactactgtgtttttggagaactactaaatttccctctggttatgatataattttaaatgcttgcagctaactttgatcatgactggcagtcttacctaacaataagacaggtaccaccactatcttatagaagatgaattatttttagtataaactcatgactctaaaaaagtacaaataaaggtgatttaatgctatgtcaggactagcactaggtaaaggctacaccctcctataggccagatctatgattcattgataacctagtatctaaggcatagtaaatacttgagtatgtattgaataaggcaattgtgtttagtattaaatataccaagatatgcatatcagtatcactgtctatcactattcctctttaacttctcggactaaccagttcatccatgatgaaatacattctttgataaagccaatctatggagatagaagaaattaatcctgaacctctgtaaaaaattctcaggtcagatacatcagacatgttggcagccttcttcgcccatatgagagttccttcagagaaataaacaatttgctggtggacatcaacagatattcctagaagagccatgcaagtgcacacacattattatataacaaccaggacaaaaaacttgtatgaatgagaatttatttatttaatgattaataaattaaaatagaagtattttattttaaaagaaaatattcttctaaattattctaatatattaggatattaagagaatatgttccagaaatattcaaaaattttcttttattctagaagtacttcttttagaatcttcttttcacactaaggaatcatttatccttatcatactgacctgtaatattatggtatatagcatccaaccgaaggcaatgtgcttcatctactaaatgttttaaagatctctttcttagagaagtttttctggataaaaagagccactgttcctcttgttgaactgaaaaaaacaacacaatttgcagacaggtagaccaaccacaggtacactaacagacacaaaaaagatcagtactacccttcaaagcaaggggactagtgcttgaaagaggctggtcaaattttctctaatggcactggagaattgcatctatggtataactcacattattctatgattggaggtaggaagtacagtaacaatcaaataggatttatgttcatatgcccctaaataacccagaaatgacatcacatgatgtatcactattctcaacaaccttgccccagctcagcttattattttcagccatgagaattggctcggtggaggtggtccaccccaggccagagtgggttatgcatgacacacacatattgtcagacactggttgtctctgtgttgtcttcagtatctttgcctttagggcagaagaaaggtccttaaaggaatgacattggaaggctgcagaactctgcttgatatcctgttcaagtggagactgacacaaggtgcatgggtgaacatttttagggtatttaatgaatgttatgcaataatcacagtaacaacaaccttaaccctgctctatatttaactcaccctttggacgtgcttcttacataacaaaaatacctctcctttcctagagtctaggaacagccaaaaaaacaaaggctgatgatggatgacactcaatacccattggcacaggcatgtacagattagagtaaggggcagtcaagtcagcaaatagggttctagtaaaaatagaaaacaggctcccagaattgtgaatctttggatgttctcaaaaatcttttattagtttcccctcaaatttccagtacttcttagaaagcattttcatttgttattttgctcacacatatatcatacagtaagtattcagtcacttgaggtaatcaataaaacaccaaagccaaaaagaaagggtgcttacaaaataataaaagatactttggcagactgaatacttatatagtaaaatgtaaattattaaagtccagatatatttaaaaacaaagatactggaaaacaatgtctgatatatattaaataattatatataatctaaaatagggattagggcagaaaagttatatgtatcccttaagtgtgtaaatgtgagtcagaaacactagtgatttcaactgaaaccaaagatttgaggccatttttttaaaaccctaaattttttattctgattttcaattcccaaattctaatatctaaccacttactttaattcatcaaatacttaggttcatttaaaatggaaaacttaacaagtacccaaaagacaataatcatttgggcagaagaggtgggtcttgaggtctaccaggtgacccagggcttctggctctgaaaccacccttgccaccctcattcctgtgtagctaaaggaagaagcctgacccatacctgctgaagatgaagtggtaatactagattctgcttctggaccctcaccaacttcatttactgctgcaatagaaaacctattccaaaaacaatttggagagacgtgtttcacatggcatggtgtgaacatgagataaaaatagaaggagcaataacatttctatttaaagggtgatgtggcaatgcatgagtctagttacgtggtgccactgctcagcaccgaaatgaccatcaatcacatccttgtttgcattcccctagaacagttcagggtcatagaggtcaaaagctgaactctgctatctgcatgacccccattcttctccgaatttaaagaggctctagtaaatgatagaaaagctaacaataataaaataattaccctaatggttaataaaaatgcctaaacagaactctacctccttacttttttcatattggattaaatgaaaatttgacattcatggtgtttacgatgtctttattagccatatttataagtatcctctgaatataatagaaatacttgagaatgtttttgcttaggatgctataatctaataggcatataagcctgaggaaaaccacaatgacttcaacccaacaccatggagtcagtggcgcttctcaaagcacatttaaactatttgatacccatatttcttaaataattatcatgcctgcagccatgctggttacattttcctctgtatcacttaattcttacctgtagatagtatttggtaaagtggagtaaaactggaaactggttctctgtgtccctgcatctaatttttgatttttgctgatcagccttaagttataacccaaaataggtccacctgggaattgaggtggatcccagctgacttccacagtgtcgggacttgagctctcaatattcctaatcaaaggtgcagtttcaggaactggaagagataatggtgacataatgagcagaaaaatgtgcaagcatgatgtttttaaaataagatggaaaaaagtcttgtttttttttttgaaaacttaatggaaacgaaataattttattaatactcaaaatatgtgatagaggaaaggtggtaagatgtctaaaccagttcgctcctttcccaagaggccctttcaaatgttactttcctcacttctaattaatgaaataaaattaaatatagtgtatacgaatacaataatggcccttttaaaaaaagtcatcaggaatctctagagacttaaatgagttgaaacatgggatggaaccagtttaggaagaagaggagagtctgactaaaactggagtcaatgatcgacgagtttaaaaaaaagtccatcctggggccttttcactcatttgagtggggcagccttgctggttccagctggagatgtgggttcagacaagctggaattcgaacagttggcttcacttttgttggcatcagctctaatgacccagactacattttccttaccccagctctcaggtcctggaaatccaggctgactgagcttcagcacccctgccctggcaaaggattaaaggagcatgtatgaaacaactgagcgttcacacacagtccccagcagctacttaagtggaaaaagaaaggacaacaaatgatctgacagcctagcttccatctgtgtctccacctgcttttcaaaccaaacccctaaaaccagactctttctctcctctttccatagaaagacacaattagaagttactttgctcttgagtagatttctctccctctgaacacttttggcaaatgctctgcatcaccactgacttttaaaagcccttttaattgctctctcagcctttctctgatgcaattcatctctaactctcagactaattttcagcaaacacaagcatcattgcatcactcctcggctccatgtagtcagtcaccatgataaacagggaagaaataaatttctcccactgaattataatataattagaatgtcaaaattttaagtcattagggtcaatgcccaaatgtgatcttccaccattgaagcaagttaaatgtcacctacatggcaagatgcgatcattgtccaggtcttccccaccgaaaaaaaaacaacaacacaaaaatcatccctgaaatgctggtatcccttgtctgacaatcattcctttgttaagaaattattttctgaaaagacccagttaaaaggcaatagcaccatttaggccgggtgcagtggtttacacctgtaatcctagcactttggaaggccaaacgtggaccaatcgcttgaggccaggagttcgagatcagcctggcctacatggcaaaaacccatctctactaaaattacaaaaattagccaggcatggtggcgcatgcctgtaatcccagctacctgggaggctgaggcacaagaatcacttgaacccaggaggcagaagttgcagtgagccgaaattgtgccactgcactgcaacctgggtgacagagtgagaccttgtctcaaaaaaaaaaaaaaaaaaactcgcggtgactcatgcttgtaatcccagcactttaggaggccgaggcgggcggatcacgaggtcaggagattgagaccatcctggctaacatggtgaaaccccatctctactaaaactacaaaaagtaaccaggcatggtggcatgcacctgtagtcccagctactcaggaggctgaggcaggagaatcgattgaacccaggaggtggaggttgcagtgagctgagatcgtgctactgtactccagcctgggcaacagcgagactctgtcttaaaaaaaaaaaaaaaggcaatagcaccatctaaaatcatgtcattcccacagctaaaagagaatagggttatgaggcaattaacacaatacagataagtttctaagttttgatgtagctagaaaagtgagaatcagaaacatgagatgctatccataagaaggacacccatgtagggtctagaagacacagagggtatgtgagcttgcttatccaggagaaaggcccagaaatgaacagcaaaatttgttttcattattttgatttgcccagccaatgtccctgcacggtatttctgtagcaccggaaaatgtcccagcactgttggataacatatggcattgcttggaacaaggaagaattcattctcctctgatctggaaaatttcgaacatggtcctaggccagtgtttggtctgaggcgctaagcaagaatagtcagaataatcagcagaggtggccacacaaaccctgagatctgacaagcaaggagagagcaaccatcagggaagggggaaaatgccccaacccacttcatcagctgctcggctctgcttaggtccaaggcctagttcagcctgaggctctctgcacataggcacatctccagagctgagggttagggcatccagcctggagcatgtcttcctgggttgcctcagctaactctgagggtgagggcaccagacaactctccctcggtgtctgccccagcattcgccttcctctaaggcttctaggcttgaatgcttttcctggtgtggaagtcacatcttcaaaataataagtcagagaataccccaatatatgttctgtttttaaaaagctgttttgataaaatcttaaaataatatagtaacctcccagctggtctctacctctgtactttcaaatctcactcattctctcaatctattctatgtgcagttgccaaaattctctttttgagaagcaagtgaagcaattactattgtgctttaaaaccttccatagctcctaactgcattctaaataaagtacaaactccttacccaggacatttaagattcttggtaatctggacctagtctgccttcccagtgttattctcactatttttcttcctgtattctatgcttccagcagatggcatactgactaatttccctccatgccttagaatccaatcttggtgaccctggtcacatagacacctggacctgcccttttctctcctcacctcatgtctaactcaacaaatgagacttcctccaaagagatttatttgatatttcatttcagaaataaatacttccctcctctaaacttccatgggaatttgtcagtacgttttctatgtgtttaataaagctttaccttactatgaggttagttaggcatgtgctttatctcttctacaagggagtaagcttcttaaagtatccatgcatctatagatatcccatgaatatattttgaacaagagaacaataacatttatttagagctagaattgctctaaggatatattagtattcagaggacagcagctcagataaagttatattctgatagggcaacattctgtataaagggtgggaaaatgaggaagcaggaatctagcagataagaagctttttgttgctttccagagataatgtcactgtttcatactcaatcaccttcatttatgaaacacttttatcacttggctttgagacaccacaagctcctgagtctctccttctccatgtcctttgctgtccctcttcttcttcccagccaccaaatattaagggcccttgggctgacaccttgaccttctccttttttcaaccacattcactttcagcatattgcctccaggcccatggcttgaatcacatctccgtggtgataactcctaaattggtagtttggataccttcgacttacctcctcagttccaaatccttccatttaattgcttcctcagcaactccacttggatatctaacagacatctcaaattttgcttggccaaaacagaactgacgattttatctaggaaagccactcctcctttacccttgtccctgtctcagtaaatgatgacattcaggtgttcagactgaaagtctaagttagcaactttgattttcccatcttccttgccaaatccattcagccaccccaacagctcaatcttcaaaatatatgacaaacctttccctgttttcccatcaccatccttgtcagagccatcaccaaatcaagcctgacttgcttggcctcctaacagctccccagcttccctggccctccttccaccctcccagtctattctccatgcatcagccatactgaaagttttaaaatttgaacaagtccctcccctccttagaacactccaaagacattctgtcccacttagaataaaatctgtactccttatcagggtcagtatggccctgtgcgaccaagtctctggctatgtgtcacatcgcacttcctactttaaaatctatcatcatacaatttggcccttatcagaaataatattgacattcctgcagccatcttctggccgtttttgttttatcttttattggttcagaattcagactaagaagaaggatgctattcattgggtcttcccataacccagaaaatacttttacttaattacttatcggactgtcttccctagctggaatgcaagctccataagggttaggattttatcatctttagttcctagaacaatgtctggtatataatagtccttgataaatacttgaatgaatgaaaaaagtgcgcaatcttcctttcaattatattaaaaatataatacaaaaaataacaaacttttcagtaaaaaaaaaaaaaaaaaaaaacaggaggtgaattttgttactgatgttatttttccacagccaaagaagtttataacctaggcaataaaaagactaaaattacatcaagaaataaaaatagaatccaaacatatctataccacaccactaccacccctgggcctctcacctgggtcaccacatggcttcctaccagttcttcctgcttcctcccacaccccagagttcattctccatacagcagccagttttccttttaatgtataaggcagttcgcatcagatcgtgtcactcctctcctcaaaaccttacagtgactctccttccagaataaaagccacattccttaccaagatccctgaggtagactgggtctggcccccatctctctgaccttagctgttactcctctgcctcctgcactcttgttcagccacgtgggccttctagttgctccttgatcaggccacagatgttcttgccttaggtcttccacacggaccatccctctgcctgaaactctctatgtgagatagctgcctggttgacttccttgcctcctttaagtctttgctcaaactttaccccaccagctcaccaaggctcattctggccaccttatttcatactgccactggcctctccttccctcttcactcttcatttccaatcctctaaatgacaaaccctgctcaaaatattcctcttactatagcacacagcaccatcccacttacaatatactttatttatttcttatgtttattgcagaatatttctgttccaacaacatgtgagctccagctgggcgaggtggctcacgcctataatcccagcactttgggaggccaaggcgggcagatcacttgaggtcaggaatacaagaccagcctggccagcatggtgaaaccccatctccactaaaaatacaaaaaattagccaggcatggtagtgcatgcctgagtcccagctgcttggaaggctgaggcaggggaatcacttgaacccaggaggtggaggttgcagtgagccaagatcacaccactgcattccagcctgggcaacagagcaagactctgtctccaaaaaaaaaaaaaaaaagaaaagaaaagaaaaaagaaagtgagctccacaggagcaggggtcattgtctcttttgatcataaaggtattgtgagtacctagaatactacctggcacatagttatgtacccagttgttgaatggatcgattaataggaaggaatagatttatttcattgtttaaaataaaaacaaactaaatcaaagctttggaataatgtcctttcataagaaatgtgtgcacaccatacctccatgaggatgagtcctgtaactgggacttggaggggagtagagctgcagctgcgctgtgaagatccaaaccactcggaaaatgtactcagtgaaggggtgcaggggcttgaccacataggacggtctggacacagtctagatcaaggagtgatcaatcatcagcattatagaatcagcaccccacattgggactaaaaagcatagattaatttgtagaagatggatggctcaacagagaagatgaaataagaggcctggagcttagagctaagccattcagatatcagcgtgcagaattcactcagaaattctccccttcaaaatagcaaaattatggattcaattatttggcatttacctcaaggacttgaatttttctatgttagtacacatagtatcttgggactattttttttttttctaaactttctcatgcttccctaaaagacacagtcctggatgaccaccatagaccgtacttctgaattgctacaacccccatgagaatctttcttctgccctccatcctagctagactcatcttagctgtgatgggcagataatgactaatgaggtgaatggttacgtgatgctgtactgaaggaatagtatatatgtccaacattatattttccttataaaataaatattttccctataaaataagccttaatgttaaggcttagcattagcatgttacagagcagctgagattaaagttcatctgaacccaactacccatcttacagctgaatcttttctagaaggcctttacgcttataagtaataatttggcacttttaaaaattgggggcagggcgaggtggctcatgcctgtaatcccagcactttgggaggccgaggcgggcggatcacgaggtcaggagatgagaccatcctggctaacacggtgaaaccgtgtctctactgaaaatacaaaaaattagccgggcgcgatggcgggcgcctgtgggcggctgaggcaggagaatggtgtgaacccaagaggcggagcttgcagtaagctgagatcgcgccactgcactccagcctgggcgacagagcgagactccgtctcaaaaaaaaaaaaaaattgggaaggggtctgggttgaggtacaaaggcagcctttcataccttagtataagtccagcttcccagaagttgtgcatatttccactgaatgatgtattttactccagagaagtttgcagatttccatcgtaatgtcatattgtggcttccaatggaagaagcaaagggagcagttggtaggtctgcattttctggggaaaaaacaagatttcactcaccacgcactcctgtccatcagcgcaagagagtgtgtgcctctctcatctagggctctccgtattctcttgctaaaactgcatcttgccacaataactcacttgaataatcaatggtatgcatattcagtttattttaaaaaatcaatcagtcagtctgtcagtcttttttccacagaatttattgttatctttgaacacagtatttttttgttcaggttttgcttttacaggcagatgacacagagggttctgagctgtccagttttctctttcaataccactctcttacaggcggggggagccaatgctcagagcatgtctgtggcacaacagaaccatccattatcctgggatgtgtaccccaatatatttctgaaattttatactctaattctactattgctgtgcatcttaacaagaaattattttttatatgtacagagcaattgcctttactccaaaggacactatgattggctgtttcacattataaaatatttcaggacatctaaacattagacgtattacaattggcagcaatttctcaggtgctgcttgccaggcatggtactaagggctagatttctgaatggtatgtcactgggatgaaatgattttactctactttttatatttttccaaaattgtgatgaatttaatgcttctgctttcttttatagaaacaaaatcagcactctggttgagaaagcatggtaaatttggtagggagcttaaaatggttaattacaaactcctgggaccttactctggttaagagaaaattgacgcaattctcatcattaccaacaccagacacggaccaaataaagtctatactctgtaatccagaaaaatcaaggccattgtcatccgaggacctagcccacaaagaggcctagcacaacccttctctgcttattcttctttttatagtccatttttgactattataactgaataagcaaagcacagctccattttccttccctttcttgttgtgagactctcaatagcaggaattaggtatgctgtggacaccttgaaggggagtccaatgatggagttgtcagcagagtgaggaaaaataaccaggaggcatcagaaatgacaaaagttgagaactgggcagatgtgatcagttatataagtacaagtaaatgtaaatatcatagctaaacatagacatatttcaaagccatggtgatacatatgaaaaaaaaaaggtaaagtaggtttatgctaaaatatcaaggcaaagagagagccaaatgaaaaagggaagctagactgagctccatcctattttcagtacatggcacagtgggtaagaaaaggctctgttaccaggcagctgggttatactttcagagatatcccttaccagctatgtggcctcaagcaagtatgtaaactttgtgcctcaattttctcacctgtaaaatgaggttaataatagtatgtataactctgaggacaaaaggagctaatacatattaattaatgagaaaagtggtcaactcataaatgcctaataaaaaatagctatttttggccaggcatggtggctcatgcctagctactcaggaggctgaggcaggaggactgcttgaactcaggcgtttgaggttacagtgagctgtgattgtgcccctgtactccagcctgggtgacagaatgagactctgtctctctctctctctctctcatatatatatatacacacacacatatacatgcatacatattttgtatatgcaaatatatatgtttatttatttatttattatgttattagctatttatttaatatgttattagctattaccattttccatcatgtgaaaagagatatgggaggtatctaaagtgaacatagcatactcaccgataaatgacctagaaatcagatgtgttaaagacaaataaggtcttaggatcatggatgaaaggattcattataacagactatagatatggtctttaagtacaaatgtctttatttagacttggtacatctcatttgttagtggtacatagacattgatccatagccaatgagaaaataaaaataaagcattgattacacttgtattctaacagaattgtataattaagttggtaatataattttagaatataataaaggaatgtaaataaaagattccacacttcctcagttctggtgtccttagtttctcagaaatttttttatggttccctgaaccaaaagaattctctaacagttcgactttttaagtagtatcacttaataagtatgtgttaatagtcaatttggtatctaataatttggtagatatttgaaacaaatacgaaattgaaagataaaactgtatatttatttcatctttaaataaaaataattgcatgctaatggggcctgtgtacctgttgggcactgcacaactcctccaatcttatgatcagattgggtatcaccatccaacagatttcacatatctctgtgtttaccttgagtgtctaaaatactccatggctcctcatgagattgctgtaatggcctggagcacatcagtgcacagcttggacccccataaaatatacattttatccacagctaattcccgtgacacagaaaaaaaaaaatgtaatatcactacctctccacagaaacgtctagggtgtcttttgtgggacactaaagggcagaagcaaatcagaacagcaagataagtttccccttccaatttccatcagccactgagagcaaggaacaagccactgagtcaagaactacaacatatggaagagccaagcatccttcagacttaagggaactgtctacagctcggtgggaggatgccctagggaattctggaaatgatatctgctgacatccaagccatgacttatcaaagcgctggcctgttagaaactactagagagttaacacactaaggcaaagctactttgacatgcccaacctatgctgaaatcaggcagagggagctgataaacacccaagccccctacttgctcaaaatctaacactgagaagcataccttctgtaccttttacaaatttctagagccttttggggagtcatacacacagtacgcactctataggataacttttagctgaataatgaaaggtgcattcaatacaatatgcctatactttccagtcattaaaacatactgcccaaagtaatttacagattcaatgccatccccatcaagctaccaatgactttcttcacagaattagaaaaactactttaaagttcacatggaaccaaaaaaatgcccacattgccaagtcaatcctaagccaaaagaacaaagctggaggcatcacgctacctgacttcacattatactacaatgctacagtaaccaaaacagcatggtactggtaccaaaacagaaatatagaccaatgaagagaacagagccctcagaaataatgccacatatctacaactacctgatctttgacaaacctacaaaaacaagaaatggggaaaggattccctatttaataaatggtgctgggaatactggctagccatatgtagaaagctgaaactggatcccttccttacaccttatacaaaaattaattcaagatggattaaagacttaaacattagacctaaaaccataaaaaccctagaagaaaacctaggcaataccattcaggacataggcatgggcaaggacttcatgtctaaaactccaaaagcaatggcaacaaaagccaaaattgacaaatgggatctaattaaactaaagagcttctgcacagcaaaagaaactaccatcagactgaacaggcaacctacagaatgggagaaaatttttgcaatctacttatctgacaaagggctaatatccagaatctacaacgaactcaaacaaatttacaagaaaaaaacaaacaaccccatcaaaaagtgggcgaaggatacgaacaggcacttctccaaagaagacatttatgcagccaaaaaacacatgaaaaaatgctcatcatcactggccatcagagaaatgcaaatcaaaaccacaatgagataccatctcacaccagttagaacggcgttcattaaaaagtcaggacacaacaggtgctggagaggatgtggagaaataggaacacttttacactgttggtgggagtgtaaactagttcaaccattgtggaagtcagtgtggcgattccttagggatctagaactagaaatatcatttgacccagccatcccattactgggtatatacccaaaggattataaatcatgctgctataaagacacatgcacacgtatgtttattgcagcactattcacaacagcaaagacttggaaccaacccaaatgtccaacaatgatagactggattaagaaaacgtggcacacatacaccatggaatactgtgcagccataaaaaatgatgagttcctgtcctttgtagggacatggatgaagctggaaaccatcattctcagcaaactatcgcgaggacaaaaaaccaaacactgcatgttctcactcataggtggtaattgaacaatgagaacacatggacacaggaaggggaacattacacaccagggcctgttgtggggtggggggagggtggagggatagcattaggagatacacctaatgttaaatgatgagttaatgggtgcagcacaccaacatggcacatgtatacatatgtaacaaacctgcacgttgggcacatgtaccctaaaacttaaagtataataaaataaataaataaataaaaaagagagaaaaaaaactggcattctctgacatcaagtctgctcaggatgtacatttgtctgtcattaagagagaagtgagtgtacctactgaacttgaggacaaaatctggtcctaaacattagtcatgtactgtttactctgttttgttctgaaagaagaatcttgctgaattttatcagaatggcctatacgtttgaaattattgaattctctaaatagatatttttgatcatattgagatgcagaaatcaagatgttttgagaggtgtttcgttatctttacataagtacaagtcactagagtggtgcagcctattttttaaaagtcgtgtgtgtcctcttacccagtacttcctcttcatatgcaccttccgcgctgctacagccaacctcacacgactcccgctgtggaagacagggagcatgacagtcagggcagccttgatactggttttgctgataagcttcaactaaattttaaaatccgaatgcctaatatgcaagtatatctttgaccaatatacgagtaaatctttgaaatcggagtgcctaatacgcaagtacatctttatgtcaactatttcccctgcagtaaaattcccacttgctagactggcatttcccaaacttttgaccatgctccatagcaaaaaataatttaacaaaacaacttagtacacacatacatgttgaaaaaaagattcctgaaatgatccttacttttccctccatttttagaagttttattgaaatatattcacctgccataaactcacgtatttaaagtacacagttcagtgctgttagaatattcagagttgtgcaataatcaccacaatctaattttagaacattttcgttgtccccaaaagaaaccccttgtctctgatgtgctcttatatgtacaatgatattctattctattgtttcattttgtttaatgtgactcttggttggctgaattgatttgacgaccctctaatgtgtcacatcgtatggtttgaaaaaacactgagcttagcagtacaattatctgcttgccattttggtcaatgttttaatgagcttaaaatctaaaactttagagtaaaatgatgcttagggattacctatttattttatatatcccggtcttccttggaaaattaaaagtggactataaatttgtagagtagctgaatatttcaatgaatatctttataccaatgctgagttttaaaatctatgaaaacttaatgatatttacattttatctcattaatgaaaaacacagtacataatttgatgactgaaacacaaatttcctgcaactcttaacagatgcattaacatcagctacaaaacacacacacacatacttgcagaaaaggcgcatattgtaaaactacaacacaatcatgatcaatcttcctgctgtctttcaacttgtaactataatacctaggacaacatgctattgtttctcatggtaatagcggaaagcaggcacaatacatttgccctaaaaagaagagctataacttgcaaacatgaacagttcaatgattgatctgcatactaaaaggaagggtgcctgataagcccaggtttgcttaggtaaggattaatttaaatacctcagtttgggtttggaattatttaatttcaagatttagtatacgtttcgcatcctgtttacatattttagtgaagccttcaacatatttatgaactgcagagaataaacaaaccaattcacagcaaaattattatataacatgaggggtttttttccaaaaaagaaaactgaggagaagagacgagatgtatttggaaatacagattattttgaaatataggtagtcttgacaatcaggagaaattgtggtcctgttttttctgatattttcaggggaaatcgataataaaattcccatccttctgggagtttaaaagttatctcaagtggaggcaaagctaacaactacgtttccttctctcaatctctctctctctctctctctctttctctctctccctccctccctcccactctctccatccccccactcctttcacctcccttcaccccgccctgaaccatggtggcaattcaacattggacttcaaataaagttatccagtgtttctcaagcttgagttgcctagagagaatctaaagatggttggatttaaggaatttacagaatctgagcctgaagcctctggatgggacattcatgtggaatattccacgttactgagctgccattcccacagtggaggccaagtatactcttccaggggctacatcagcttgctctctccgttcccccacattcccatcttcctcatcgtagtcagtccatctttattgtccctctggctccacccttggtttcccagactggcacacaggctgccagtgccctttccagcttctgtaacactaggaagcctcgcccactgccctccatatgaactgaggcattgttcccttaaaaattattcattcattcattcaagaatatttgaacaattggcttttttcatgccaagcatggttttgggatctaagaatatgacagtaagcaagaaagttaaactccctgccttacaggacttcccttagaaggaggtagataataactgagtgacaaatttttaaaaagaaaaaataattctgataatgaaaattgctaggacgaaaataagtcaaaggcacaggtataactaggcagagaaggagactttattagggtgatccaagccaagacttcagtcattaggaggagctgggcttgcagagatttgggcaaaagcagaagcaacagcacgatgaaaactttgaggcaggaatgtgtcttctatgtcaagaaagagggaaaggtcagtgtggccagcacagagaccaaggggagagtatgagatgaagtcaagacaggcaggcagtggagctggtagacctttgtattttgtaattttttccaaagagcagtaaaaagccattgaaatgtttcaggtacaataagatcaattggctataataagatctattttgactattttatactacatatataaatatatatgtatatatattcttttgtttcattctatatatagctatatagccaaaggccaagatgcaatgataagatctaatttgtgttttaattatcagggacaagccatctcactagccatcgtcattttccaagttctatttcactgagctatcactttcaagattattctttccaagaaataagaattgcaaaaatgacaagcttcctacgttcaaacatcaatgagtaaggagtttgatttcctaaaggtgtggataactgaggtgatagatagatagataggtacatagatagatagacagatagatagatagatagatagatagatatacacatagcatgtattcctgttcagttctactttatttaaagtgaaacattttaaagtgtaaaatagcaaagtataaagagaaagaatagttatacaagttataacactgagaggaaagatttacactatataatcacagaaaactgagcagcataatgattaacaaagaattagcacattacagatctaatcctgggctgcttcgatgctttaaaggctctctctccctgattttcctgacactggtacatttatcctagggactattctttgggggtaattttgctttcatcacataaaaggatttgcaggcaatttttttttctatctcaatgaggagagacctttgtctctttacatatgggtgacttttctcctctgttttctgtctctcttcttagccaaccctcacctccacccattcccaagaaaaattgctcagatgcaatttttataaccaaccagtaacaactgagaaaacatgccaatttaattttttgtttgtatttttgctctctattaagagggaattttttctgttttactaatgaaggataatttatactgcttccccaggcttctggttaccagtttcaaggatatttaaaaaagaatacaacataggttttaaagttttttttctttaggggacagtcgtgctatgtttcccaggatgctctcaaactcctgacctccagcaatcctcctacttgaacctccgaagtagctgggattacaggtgcacaccaccatacccagccaacataggttttaaactgataaataatgtagcttcttcatatcatctattgtcaaataaccttattttgaagggatgaaatacaggacaggtaagttcagctgaagactaagtaggaaacatcaaaacgtcaaggtctctttgaaagagagaaaatcaagtgtagcagaggttgcttagagcaccgtaaggacacctgggcagggcagtgtgagacattacttaccattgggagaaggggtgggtagaagctgtcttgcaaaatgttggcaaaggattttgttgcacaagaaagaaaattacggccaggcttggtggctcatgcctgtaatcccagcacttcgggaggctgaggtgggtggatcacttgaaatcaggagttcgagatcagcctggccaacatggcaaaaccccatctctactaaaaatacaaagttagccaggcatggtggcacatgcctgtagccccagctactcagaaagttgaggcaggagaatcacttaaacctgggaggcagaggttgcagtcagccgagattgcaccactgcactccaccctgggtgacagagtgagactgtgagaagaaagaaagaaaagaaagagagagaaagagagggagaaagagaggaagaaagcaagaaagtaagcaagcaagcaagcaagaaagaaagttgcaattaaaggattctcttttaatgtcctatatttaatgatagagcactatacattgtggggaagaaaatggaatcagcagagatatctctgaatgtgcctcttccttctctcccctccattaccccaactccaactctgcccagggtccagggattataacctcccaaaccagattagagtaatatatatgcaaatggtgaatgtgtgtgtatgcacataggaacatatatattatatacatgcacatagatacataaaacagtaaatatttgtgccaaaatggaattttacagtcatctgtatactcagagtaataacactttgaggaagaatgtctcagtgcactgagaattttaggtttcttcacccctattttaaaagctttttagagaccagagatgaagacatgtggcttgattacatcttttttgtgattgccaactcacctcacaaacggtggcataagtatcattctgcatagaaaaaaaaaaagactacttaaaatcttgaaagttgtaaataattttagtgacactgagctgtacaatcatttcaaattaatttattgccccaccattgataaacaaccaaaaaaacaacagaaacaagggagcccagagcaggaccccctgtctaggcaggacactgtataagcagctctaaaaattaagctgtttgcatcactggaaaaatgggagaatatgatgtccaccagaaaaatctcagcaggctgaggtaatctgtggtggaccaagttaagagagtgaaggagtatttgcaaatgccaaaggtaaatagaacaggaaatgaaaaccaccaatagctcttgctagcaaaggacagcagattcctctgcccatgctggccactgcagcagccacacagcctcctggattgtttcccagcaacaaatggtgcttcccattcattccttcagcaaatgttgactgagcagctgctatatgccctgcactgtattcagtgcaagagataacaatctaaaaaagacagacagcatcctgccccaacacagcttacatgttgggataaaagatactaaacacacaactagacaaattatttgtttgagttgcaatttctgagaaatatttaatagccactaagtccagatagcacatgctgtaccttttggtaacttccattctgtgaggcactcagtcacaaatgtgagagtgggcataggtaactgctataatagaactttgcaaggacacactatataagtaaaactatgaatatactctaaaaactatgtatataaaaagaggttaatgcattatttaaatctcaatgttataatttaactcattaatagaaaatgacattaggattccccagcattaccacaattcttattgatttaacccctgacctgaacaacctaaacaagggaacccacttttaaaaggcaaaattcttaatcatgtgatcagagtagttacaacacgacaggctctatctttaggagaaagattctgttattatcctaaaatggatgaagaatgtaaagtaccaaggggttaagtaccttaagttacacactgagtggcaaaagccaggctacataataaaatgaaaaataaagtatctggggatgtatttcctacataaaggggagtaaaccaggtgtttacggccctgagttagacacctactatatttcctgcatagaaactttgaacatgacctacggccctggtatccaaaatgtggtctgggaaccaccagcattgcaacacctgggagcttgttacaagtgcagaatctcaggctccacccaagacctattgaatcagaatcagcattttaataagatcccggataattgcacactaaaatttgagacgcataggcctaggaaatttaacaaataccggagattctactaaaaaacatttatagttttggagcgattgaacatccctgggttctgttattggcaataaccttccgtgacctctagtcacattaaaaatgttaatctcaatctcttttccattactatgtattatccaggctattggttttttagttttgttttgttttgtcttagggtcaagcaaactagttgaaagccaatggaaatgcaaatgggaatcctcttacacaaatttcctcttgaaagaaacatcagtatcaaaatagaaatctaattaatacttacacactttaaagcacagtttttctgatctacagagttccaaaagtgacatccttggatacactgcaagagacaataacagacaatggtgagtgattgaagaaatgtgactttttcttgtcacctgaaagtacaatgtagtaacaaaaggcatcactctgtgttttagaaatagaaacctaccaagaaacctgaggcctccaaaagatccaggattttgggattccaaacagagctgtcctatctacaggtagaacaagtcttgtggctcactgcagggcagcagagttgctgagtggagttaagcctggcatgtgcaggcctagaagccagagaacagccaaccttcagcgaagacaccgtacactgggtagttgtcaaaggtaaagcccaggacaatgtggcattggtatatcctgggtccctaaggtgtcctcacatatcaagcaaaactcaaaactggtgattcaactagatggtagcatgtcaaacctaaataggtagacagtttggggagtcggctgcctactagcacctttcaccccacagctgccctgaaaaccctgagttgccctgacctgctatcagacagatttgatatatttcttcttaccttacttaattcatctgtacctgtcttgaccattccctccacaggccacggtggcacctggattcctttttcttacttcctgctcagtctcctttgccatctctttttgcctctctccacccctttggtgtttgtgttccatcttcagctttttctcctctcactcttctagttctcccggagcgagttcatcccctacctcagcttcaagtaatctggatgttgatatcccccaaacttctaactgcagctgaggctccatcctgagctccagacccagatatccactggctcattagatgtctccatttaagttcctacaagcacttcagatccatcatgtggaattcaattccttactttccatcctcaaatttgctctttctcctgtgtttcccattaacgcgttacattctcctgagttgtccaagcctggaaccagggtgttttcttctctcaccccactctcccctctcatggaaaacccatcacgaagccctattgacttatctggtcattaactaaaatccatctgagttcatcactcactgcctcaattttctgttttgccatttaccacttgccaaaaacctcaggaaggacccctcttgttcccacatttggagtgatctttttaaaacaaaacctggttacactcttatctaaaactctgtatgtctttccaacaacttgtgagttaagaccaacttagcaagcatggcagacaaggcccttcgtaatgtggctccatgtaacttggcaattggtatgtaacttggcaatgggtcttccacttccctaccctctatacatgtaccccaatttccaagcaagctgaaatactcagtttccttaacaacttaggctacttcacacctttgtgtcttgacaaaaagggccttctctgatcgataggctttttcccctctagtccatctggaaaactcttcctctttctagttttagtttgaaggccttgcaggcaagtgaggtgccttttactcttgtgtattctcttttcactcctcacacacaccacaattctggttctgatgatgctgtctggccataattttatgcatatgtctgtctctctggttttaagtatgcatctcaaaaaggttgagagtccttttaaacagagaccctatttttttcattgttaagtttctagttcctggcacagtgccttgtgcatgcttataccttaagtcactaaacacttgttaaacaaatgaatacatgtgcagaacagtaataaaaccataaaatgtcattgttagaagaaatattggagacgatctcaaataacacataataaaactaaatctcagaaaaattaagtaatttgtccaaagccacacaattacatagagacaaaatcatgcacttggattggtcctgtgctatttccacttcaacacacttcatttttatataaattcagacttctcattattttcaatttgtcttcttccagcaaggataaatgagattttacttagcaattcttactgtgataaaatctgatcattgtcccttcattatcaacacaaacattgtaatattcttgacaactgaagaaattacttaccggttcactcagattatgtggtgtgccaaggtcaagctgctggccctgaaatgaagaaggaggtagtaaacaccagccatcagtactgggttccgtgtaactaacacaccttttaaaaaagcttcctgaaataacgttgcctcctccgcattttgtaactctaaagtaaagagccaaatgttttagaggcattaaattcatcactaccagacaaaatgctggtgcaaattatagatataatgtcttaagaactttgcaggtactacaaaggtggaagtaagaatgtggctatagggagagagtctcatgcagaattaaataatcctgtggcattggtcagttaatcaagtcaaaggactcctaggtgagtgatgaactgtgttcagacttttcctttttaaaattaagagcagggagaaaatgcaaattggtatgtagtaaaacataagattactcttttatggctcacatacaaattttaagaacttttttatactggaggaaaataaaagaaataggaactaaggacagagatctataaattgctcgttatctctctggtcataatttgaatagagtccttcataaacaagacagtttacaaaggatggcaatcagataatctgggccatcagataatcagataagtacccacatagtgttctgtgcttgctagagagaagagagcagcattctatcactgagctcactgagcatgctcctgctttctatccatttggctcttcactccatcctcagcacctggaacactgcctgctagaaacaggtgttcaataaatactgatgtgctaaaggagtaaatccattaattcaaagtggtttcccatgtaaggatgctccaaaagtcccttgaaaacattatccaatggcttaatattgtgtgggttgacttgaaaagtaatcagactcaagaaccaaagaacaaatgttgcctgtttttttctttaatttgaagcatgagtgaggattcctttaaactccgttccctaaccggttatatttgtaggaaaagaagaaggatgattattggcttttgtttttagataataaacatttagacagtaagaattctatctgttagatgaattttgcaaccgagtgcttaatagtactgtgttttcatgattttgttcaaaagttggttgaatcgcaagcaaataaaaatcaggtgagagataatgagttgaaaattgaatcttttcctaccccttcaaaaatgcatgttaactcataaaagcaaaagggtggatgctgggtagtctttgtgttccattttaaacagtaggagagcagagatatttcttgatgatcatagtcacactgtaacggtagtgagtcctgatggctcttctcaggagtaaatttaacgggctgagtgaaatgaccatcaaatggtcttgggcagggtagcctcacagtcaggtctaagggtttctaatgaggcagattttgtcaacactcttccctaatctccactcattccccattcttctcctcacaattacaatagctaacatttattgaattattgctatgtttcaggcactcttataggtgttttacactaaatctcattgaatcatctcagcaaccctataaggtagctgctataattaacctcattttacagctggggcacagggaagtttagtaaattacctggattaggatttgaagggggcagagtgattgactccagaacctgtgctcttaaccggatgccttccataatctccaccaaaatcacatttttcattttgaacattaggatccccgctggtttgccttagctccaactacgccaattatctgcttccagtagtcaaattcagtcccagatctcaaactttcttaacctaatacccacttcttgacataagcttttctattctgcccacctcaggcagaactaatctcattctttacttcctaccctaataaatgttgtggggtggggggaggggggagggatagcattaggagatatacctaatgctaaatgacgagttaatgggtgcagcacaccaacatggcacaagtatacatatgtaacaaaactgaacattgtgcacatgtaccctaaaacttaaagtataataataataaaattttaaataataataataataataataataaatggaacagagcagaatgatctgtattttaattccacatgatatttgctcccaatgtgatattctcaaagttacctgtgccatctaaacttagtggtcgtatccgggacataagtaggataatacttaattcataagcttctgtgaagattcaattaaatgcaataattattatagtgcagtgcaggcacttagaaatgtattagtagtattatgtcccaacttgctgttaacagccttttgcatacatatctttggttagttaaacaataatatcctcagataaatttgatgcataaattagaggtatattttctctttcaattttgagatttaataacgcattcttttctagaaatttatccatttacatccaaccaacaattcatgaaaatagaagtttacctgtaccttttcccaactataaatgtttttatctttgccaatttgatagaagaaaaattgataatttatttttattctgcaattctgtggttgctgtgaggttgaatatctatcacatgctttttagccatttttataatatatattatatattatattggaatatatgaattggaatacatattatattggaattatatatattatattgcaatatatatatatataggaaatatatatatatttccaataccttttggggtacaagtggtttttggttacatggataaattatatagtggtgaagtctgagatcttagtgcacctttcacccaagtagtatacattgtacccaacatgtagtttttcatccctcactcctctccttccctcccccttctgagtctccaaagtccattataccactctgcatgcttttgtgtacccatagcttagctaccacttataagtgagaacatacggtatttggttttctattcctggccaaataatggcctccatagaataatggcctccagctccatccaagttgctgcaaagacattatttcattcctttttatggctgagtagtattccatggtgtatatatatcacatttttttatccactcatcagttgatggacacttatacttcttttttgaagtggctgtttatattctaaattcatcttacatgcttttatgtgtatcagggattttttctttaaaaacattatttatcatgtgtaatactttttttccactttttggctttgcagttattgtatactgttgtcataacagtttaagtttctaagtagtcaaatttattgataatttctttttagggagtctaaattttttaattaggcttcttaaggcatttctacttcaagattacagaaacagtcaccccaatttcttctaatatttttatgaagtaaacacttgctttgttttgtttatttgtctgtttgcatttaagtaaacctttctgtttttgtttcttagaaacagagtcacccaggctggagcacagtggtgtaatcacagctgacagcatcctcgacctccctgctcaatcaatcctcccacctcagcctcctaagtagctgggactacaggtgcatgccaccacgcctagctaatttttgtatttgttgtagagacaggagtctcaccatgttgcccaggctggtctcaaactcctgggctgaagggaactgtccgcctcagcctcccatagtgctggaattacaggcatgagccatcgcacttaaccaaaagtcatacctttttacaaaatatatcctgaaatttatttgaatctggcagttatgtaggaattttttatgctacatggatagcaactcattggtttgaattgtcatctttatcatatttcacattctttatgtacatggttttatttcttgattgtattctgttttactcacaggtttattcctgtagcaataaaaactatgctaatttgtaaatattttataaaatttctgaattatgatcttattatattattttgttttaatgttatatattgatatacaagacaatttttcatgtctgtacattaattttttaaaaatcttccaaatcctattatttctaatagtctttcagttgattttcagtttatttctttggaacttaagatacaaatcaaaaataaatgtattgtcatcaccctctaatattataaaagcacatcatgtttgtaacagcctttaactgtctagtgatagaaaccttgatatctcagtatttgataacttactttagggcattgattacataattcacttcttttgtattccgaattgcatccaccacagagctgaatatacatagatacctaggaaaatttattgaatggaatccattcaataaattgatattgaatgaaatttattgaatggaattgatactcctgagcccttctcaatattagttcctcagttgttgtgatttgttaattcaaaaaaaaaagggggtttgtgatgtaattcaggaatggaaaaccaaacatcgtatgttctcactgataagtgggagcaaaactatgagaatgcaaaggcataaaaatgatacaatgggctttggggacttaggggaaagagtgggagcagggtgagggataaaagactacaaatatggtgtagtgtatacatggctgatgggtgcaccaaaatctcacagatcaccactaaagaatttactcatgtaaccaaatagcacctgttcccccaataacttatggaaacattaaaaaagggttttgttgctaaagatgggaaaattatgattaaacaaagcttttaacatgttattgtgccctgtgaatctacaaaaagagggcatagcaaaatacacttccacaaatgattcaaccgtgaattcttttttctttatcataaaggatctcacaatactagagttctgaagagcattaattgtttgttgttttctgcagcacatggcttctagaattcaaaaaaacttttcagttaatactttcaactagtacatgcagatctctgttaacgtaagataaaagtaatgtaaaataccaatgctcaagcatagaactctgcttcgtgcaatttggcccacaattctaacattttatttttggacaagacattcttgtggtgactttttttttttaagaaaacatttctcaatatcaagaatcacccaataaaattatagatgaccttcagagtaaatgtccatgtttttaaaaatgatgcagaaaatataataaacttgagcactttgtatatcctctcctgtgaaccatggttacattcaattgtacattcacttcacttttgtccctccaggccctatgtgggaacatgtagtactttcactggtcaaattggcagaccgtgtctctcttgctgttgccacacatcagctgtgccattctctgtaggtggtgaacggaaggcaactcaacaaaggaacaaactgtctattcctactgccaaaccctggaagcaaggagcccacacaaaaagataagaataaataaaacgacagtaaaataaaatggagactgcaatattggaaacaactaaaatcagtttcagtagcagggaaattaacaaataaattatggtggtacattcatataatggaatactctaaagataataaagattctgtttctaaaaaaatctcagggtctaggggaaaactcacaatacaatgtaatgaaaaagctggttgcatagctgggtgtaaattatagatatatatgtatacatatatatatatgaggaaaaatactaaaagaaaattcaatcaaaagattactagggctagaattagaagttttttattcttctgtagttctctatgttataaatattttatttaaaatgtatactcttattataattagaaaaaagttaaaatcttttttagaacatttagttttccattcagtagttgaaacatttagtagttccattcttccatttttaagtttgggttacaaatataaaaaactaaagcatgcaattctatattaaaggcaatgaagtcttcggcaaagatttatataaaatactaaacttttaaaaaaatgctactaaccatggtaaacctaagtagtgttttaaactacagtttaaatcaaaagtgtataagtgcaagtttctttttaatctgccacataattctatctccaatactttagaataatataatgaatactatatttagtacttgcattatgtttaaaagtatggctatagatagggtcatatgcaaactatcatgatattttatttgtctttagacaggaagagtgcattttctctgtctatagagtacttggtttttaaagttaattcagtgactgttttaagcacaactaaattacaactgaaaagagatggtacaatagttagagaagggatgacacccagaaatgagaatgaaagcatgaatttccatataaaaaactcactaactaaaataataaatgcacaaacagaaataaagaaatgtacaaataattattgctttaaaatattattttacatggcaactgtatctgcttcctttttcatccagctccctacacagctggaattagcaggcattatcctgtggccaaaccgatttcaggtttcaagacaactactaatgactttgtaataaataagtttaaatagaaagtttttaagtgtgcaaaattggcaaaattgattccatttaaacctcctttacccagtcctctagcccaaaaaatatatgaccacataccctaaagaaataaaatagcctgctttatcttctgcaattataagggctcctaacttatttaagaaaaaataatctatcttgccttgttgccaccacttctcataagaaaactcctcataaagagaaaacaattctatcagttataacaagctgaatgctacatgttctagttcctgcaaagacaaatattagattgtgagacttaccagattagttacacacgactttaggcagctatttaaaactgtacactgcaccacagaaatccataggcagccaagagttgcaaaattgacaagcttcggaataagacagtaaatgttcttcatcacttcaccaatggcagatttttagatggccggtctaattttctccattttgctatatgaattatttgggcttcatcacttcaattggaggagtagctgatggattttgctttgtttgttttgctatattaggatatacttgccttttgaaataatacttagcctttttcatttagacctttgaatgcttgaaagcttgtaacagttccataagagctatttcataacagcttccttttactcccataaagtcacccagtgactaaaggttagttcttagaagtgcacttcacatggaaattaaagaaaacgaattgtatttcagcaagggtgtgacacatgcagtctgaaactggaacatttcagtgggtcgtccaccaccttacttctctgagctcttttcagctctgcagggaattgggttttgaccacgtatgctttagcaaacagtagcactattataataaagaattattggaaaaatagaggcacccaaatcaagcaatgcaactgagagagaaaacagaactcagaagccaaatacatatttttaaatttaagagcaaacaaagctgaaattaatagacaaataccctgggagagagttaaaaacaaggaagttggttagagtactctcagaactttactacatattaactaaaatactgacttatcaggtctatcgagacagctgaaactagttaccagaaacctaagatatgttcaagtgtctgctttgagaaggaaacattgtacaagcttccttcctgcctgccttccttcctctctctctctctctctctttctttgagactgaatttctgtctgtcgcccaggctacagtgcagtggcatgatcccagctcactgcaacctccgcctcccaggttcaagcgattctcctgcctcagcctcccgagtagctgagactacagacgcccgccaccatgcccagctaatttttgtatttttagtagagatggggtttcaccatgttgcccagagtggtctcgatctcttgacctcgtgatccgcccacctcggcctccaaaagtgctaggattacaggcgtgagccaccgcggtacaacaggccaacctccttgttttcttaaataaattatactaaatgtaacttaaccttttcttaatgatataaggttctccctatgagtaacacatgcatgaggttttgttttgagctgaacgtcttttgattggatttttgtttgtttgttttttaatttttgtgggtacatagtaggtgtatgtatttatggggtacaggagatgttttgaaacagacatgccatgtgaaatgagcacatcatgaagaatggggtgtccatcccctcaagcatttatccactgagttgcaaacaatccaagtatgttctaagtcattttaatatgtacagttattattgactgtagtcaccctgttgtgctatcaaatagtaggtcttatttattctttctacattttttgtacccattaactgtccccatctcccatcccccaccccacccaccaccacccttcccagcctctggcaaccatccttatactctctttgtccatgaattcaattgttttgatttctagatcccataaataagtgaaaacatgcaatgcttgcctttctgtgcctagctcaattcacttaacgtaataatctccagttccatccatgttgttggacgtgactgaatatggctgaatagttctccattgtgtatatgtaccacattttctttacccattcatctgttgatgcatacttaggttgcttccaaatcttagctattgtaaacagtgctgcaataaacattcacatgcagatatttctttgatatactgattttctttcttttaggcatatacccagcagtagaattctagatcatatggtagctcaatttttagttttttgaggaacttccaaactgttctccatagtggttgtattgatttacattctcatcaaaaatatacaagggtttccttttctccacattgccaccagcatttgttatagcctgtcttttggacataagccattttaactgggtaagatgatatcccattgtagttttgatttgcatttttctgatgattaatgatgttaaacaccttttcatatgcctgtttgtcattcgtatgtcttttgagaaatgtctattcaaatcttttgcccatcctttgattggattatttgattttttttctatagagttgtttgagctttttatttattctggttattaatcccttgtctgatgggtagtttgcaaatattttctcccattctgtgggttttctcttaactttgttaattgtatcctttgctgtaaagaagatttttaacttgatgtgatctcgtttgtccatttttgctttggttgcctgtgcttgttgggtattgctcaagaaatttttaccccaaccaatgtcctggagatttccccaatgttttttgtagtagtttcatggtttgaggtcttagatttaagtctttagtccattttgatttgaattttgtatatggagagagataggggtctagttttattcctttatatatgtatatccagttttccccacaccatttattgaagagactgtcttttccccagtgtatgttcttggcatctttgtcaaaaatgagtttactgtaggtgtgtggatttctttctggattccctagtctgtttcactgatctgtgtgtctatttttatgccagtagcatgctgttttggttactatagctctgtagtataatttgaagtcaggtaatgtaattcctccagttttgttcttttgcttaggatagctttggctattcttggtctcttgtggttcaatataaatcttaggattgtttttttctatttctgtgaagaatgtcattggtatttttatagggattgcattgaatctgtagattgctttggggagtatggacattttaacaatattgacttttccaattaatgaacatggaatgtttttccattttttgtgtgtcctaatcaatgtctttaatcagtgttttatagttttcattacagagatctttcacttctttggttaattcctagatacttaattttatttgtagctattgtaaatggaattactttcttgatttctttttcagattgttcactcttgacatacagaaatgctactactgaattactaaatttgtttatcagttctgctagttttcctgtggagtctccaggtttctcagcatgtgagatatgtcatctgcaaacaaggatgatttgacttcctcctttacaatttggatgcccttaatatctttctcttgtctgattgctctagctgggatgtccagtactgtgttgaataacagtggtgaagtgggcatctttgtcatgttccagaccttagaggaaaggctttcagtttttccccattcagtataatactagctgtgggtaggttatatatggcttttattatgttcaggtatgttccttctatccccagtttttttttttagggtttttatcataaaaggatgttgaattttaccaaatgctttttcagcatcaattaaaatgatcatatgcttttgatccttcattcttttgatatgatgtagcacactgattgatttgtatatgttgaatcatccttccatcccagggataaatcccacttggtcatgatgaatgatctttctaatgtattgttgaattcaatttgctagtatttagttgtggacttttgcatcaatatgtatcaaagattggcctgtagttttcttttttggtgtgtctttatctggtttcagtatcagggaagtactggcctcatagaatgagtttggaagtattccctccttctctgtttttcagaataagttgagtaggattcgtattagtttttctttaaatatttgctagaattcagcagtgaagctattaggtctcaggcttttctttactgggagacttttattacagcttcaatctcattacttgttattggtctgctcaggttttggatttcttcctggttcaattttggcaggttatatgtatctaggaacttgtccattgcttctatatgtttccatttattagcatatagttgctcagagtagccactaatgatcctttgaatactgcagatatcagttgtaatgtctcctttttcatttctgattttatttattttgatcttctttctttttttcttaaactggctaaaggtttgtccattttgtttaacttttcaaaaaaataaaactttgtttctttttttttgttttttccattttgtcctgctctgatctttattatttcttttcttctactaattctgggtttggtttgctcttgcttttctagttctttaaaatgcatcattagattgtcatttgaagtttttcctttttttttgatgtagatacttagagctataaaattctatcttactattgcttttgctgtatcccatagattttggtatattgtgttttcattatcatttgtttcaagaaatttttcaatttccttcttaatttcttcattggctcactgatcgttcaggagcatattgtttaaattctatgtatttgaatagtttccaaaatttctcttgttattaatttctagttttatttttgtcagagaagatgcttgatattatctcagtttttttaatgttttaaggttcgttttgtgacctaacatctggcctatccttaagaacgattcatgtgctgaggaaaataatgtgtattctggctgggtgtggtggctcatgcctgtaatcccagcactttgggagcctgaggtgggtggatcacgaggtcaggagatcgagaccatcccggctaacatggtgaaaccccgtctctactaaaaatacaaaaacttagctggacatggtggtgggtgactgtagtcccagctactcgggaggctgaggcaggagaatggtgtgaacccgggaggcggagcttgcagtgagctgagactctgtctcaaaaaaaaaaaaaaaaaaaaaaaaaagtgtattctgcagcccttggatgaaatgttctgtaaatatctattagatccatttgatctatattgcagattaagtctgatgtttctttgttgattttctgtctgaatgatctgtccaatgctgaaagtgaggtgtggaagtctccagctattattgtgttagagtctctctctctccttagctctaataatatttcttttatatatgtgggtgctccagtgttgggtgaatatatatttaaaattgttgtatcctcttgctgagccaaccccccttatcattacatagtgacctacttctcttcttattgcttttgtcttgaattctattttgtctgatgtaagtatagctactcctgctcttggcatggaatatttttttacaatcctttattttccatctctgtgtatctttataggtgaagtgtgtttcttgtaggcagaagatcaactgttttttttttcatccattcagccagtctatgtcttttgattggagagtttagcccattgacatttaaggttattatggacaagtaaggacttacacctgtcattttgttcttttcatattgttttttggtcttctttctttcattcttgtcttcctctagtgaagattattttctctggtgatatgatttagtttcttgcttttttttttgtgcattcattgtatgttttttaatgtgaagttaccatgacacgtgcaaatatgattttaaaactcattattcaggcatataaaccagccagagtggcagtagcagaggcaagaccaccatagcaccaggagtagcaactcagagaaagcacagagcaacactgactgcagtgacctggtgacagcatgagaggtactaggttttaaaaaatttgtatcatgcttgagtataaattagtcattcttggctcaggagctgttggaaattctgctttgactgtacaatttgtacaaagaattttgttgaaaaacatggtcctacaataaaagatattacagaaagcaagtggaaatagatgcacaactctgtatgcttgacatattggatactgcaggaacagaacaatttacagcaataaagggtttgtacataaaaaatggacaaggctttgtattagcatataccatcccagcacagtccacattttatgatttacaagatctgagagaacagattctttaagttaaagacactgatattgtcccagtgattgttggtaataagtgtgacttggaagataaaagagttgtagggaaggaacaaggtcaaaatctagcaagacaatggaacaactgtgcattcttagaatcttctgcaaaataaaaaataaatcttaataaggccaggcatggtggcttatgcccgtaatctcagcattttgggaggccgaggagggtggatcacctgaggtcaggagtttgagaccagccaggccaacatgatgaaaccctgtttctactaaaaatacaaaattagccaggcgtggtggcacatgcctgtaatcctagctactctggaggctgaggcaggagaatcacttgaacccaggaggcagaggttgcagtgagctgagatcacgccattgttttccagcctgggcaaaaagagtgaaactctgtctcaaaaaaaaaaaaagttaatgagacttttatgacctagtgtggcaattaacagaaaaaactccagtgcctgggaaggcttgcaaaaagtcatcatgtcagctgctttaatatactaaatgcactgtagctctgagccaggtctgaagaatgttgcccaattcaacagtgcctgagcaattccaactttgttaaacctaccaaaggcttaagtggactctcctgtggtgataccctttaagagagagatgaaagataccatatcagtttgcacattctaataactttccagtatcacaagagagatttttacttatctaatagtcctagagtatgcagctggtaaaaccagaggctacatccagtattactgctaagagacattcttcatccaccaatgttgtacatgtatgaaaatggtgtactgtatacttgaacaagccccatgctttgtattggagagtacaataatgcaaattgtaaaagcaccactatttcaacataataaaagaaagtccaaagagatcctatacagactactccagatacttttgttttgttggtatttgtagcttatcataatttttttaaaaaaattcaagatcattatcattgtacaaaatatgcattttgattaacacagctatatagttttttaaattttttaaagagaaactatgaagcagtgatcttgtctttaaaatataatagtcctttcagtataatatcttattttgaagatgttgcctttaatatctgttgggaaagaaatgtccagacttttcaaatctcttattatatttttcctttttcatttaaataggaaaaatgtttatagttgtgtgtacagtaagagtctacaacaagaagtggatattttcaaacaattttttttttttttttttgagacagagtctcactctgtcgcccaggctgaagtgcaatagtacgatctcggctcaccacaacctccgcctccagggttcaagcaattctcctgcctcagcctcccgagtagctgggattacaggcatgtgccaccacacccggctaattttgtatttttagtagagacggggtttctccattttgtccaggctgatctcgaactcccaacctcaggtgatccgcccaccttggcctcccaaagtgctgggattacagtcgtgagccactgcgcctggccagcttacacatttttatgcatgaccatgcaagataaagattgcctgtatagtaagccaacattggggtagagggtcatagtttacacgcaactggtggtctcctcaagggagaaaggaaaagatttactgactacctagtcattatggttgaattttgtaccatgagcattagagattcaaaaataaattgaaaaataacaatttttaaaatattctgcactatgatttgaaacataagacttaaaaagcctcctaatttatctcaagttagaataagatattctaaataaatcacaaaagttcagaccaagcaagctcctctgaagtgtctgaacaaaattttaggtgaaagtattaaaatgttgtcctaacaaacaagactgaaacttctgcacaatcccttataataaatcaaattttccataggatcaattctacaattaagagattacattctgaaacaatggcctttttcataaactgcatcagtgaggtagctttgtgaaagagcaaattgttaaaatggttcccatcatctaattctaatcttgcttccttgggatgagcactacaactggttagcaacagaatcgattttatgtcatcagatacattatgaattctgaaattatatgcattgaaaatataaagtgtatatcctcagactcagttgtatgcaagaaatatcatatgacccaagggaagttagattgtatagtcataaaaaagagccccgaatatggacccactgactttttaccattaaaaaggtaaaaagtctagagaggagccatgtcaacattcaagaactaagaattttacatgcaagaaaattcttactcaagcacacacttctgccatcatttctctctttttttaattgacacaatctatagggtacatagtgatgtttcttacacataatgtgtagtgatcagatcagggtaattaacatattcatcatctcaaacatttatcatttctttgtgttggaacattcaaaatcctccttctagctatttgaaactatgtaatatattgttgctaactatagtcatcttacaatggtatagaatactagaacttattcctcctatctagctgtaatttagtattctttaacaaatctctctctacccctctgttctccgtacccttcccactctctcatatctttctttctttctactttttacttctattacatcaactttttttaactcacttccacatttaagtgagaacatacagtgtgtagctttctattcctgacttattttacttaacctaatgtcctctaattccatccatgttgctgcaaatgacagaatttcattctttttatggtggaatagtactccattgtgtatatatgccacatttactttacctatttatctgttgttggatacctaggttgatttcatatcttggctattgtgaatagtgctgcaataaacatgtgggtgaagatgtctctttaatatactgatgatcttcctttggataaatgcccaatagtgagattgctggatcatatggtagtagttccatttatagtttttttttaagaacctccaagctgttttccatggtgactttactagtttacgttcccaccaattgtatataagagttctcttctctccacatcctcgccagccattgttattttttgtctttttgataataggcatcctacccggagtgacatgatatctcaatgtggtttttatttgcatttccctaatgattaatgatattgagcattttttcatatatttgttggccatttgtatgtcttctgtgaaatgtcttctcagatcatttgcccattttctaaatcaaattgtttgattttttgctgtggagatgtttgagtttcttgtatattctgaatattaattccctatcagatgaatagtctgcaaatgttttctcccactctgtaggttatttttcacttgctgattgttttctttgctgtgcagaaagtttttagtttgatataaccccatttgtttgcttttgttgcttatgcttttgggctcttattcatagagtgtttttttaaaaccaatgtcctgaagtatttctcctacattttattttagtaattttatagtttggggtcttacatttaggtctttgattcattttgagttgatttttgtgtagagtgagaggtgtatgtctagttttattcttctacatatgaatatctagttttcatacatatatgtatgtactttcatacgtataggtatgtactttcatacatatatgaagtaattttggggatctctattttgttccactggcctatgtgtctgtttt

SEQ ID NO: 1170 - DNA, 48703 bp, Homo sapiens
tcccaccctgggttcaccgcattcccacagcctggctggttctgaccagttgtgctgggtttgggggcctccctggggtccccagacaatccttaggaaacaaggccagttctgagtctccacagaccctccccaagcccactggcaatacaggaaagcctccagagccctgaacacccacttccaggaacgagggagcaggcaagaagggatgccggatggaagaaccagccctgcttcctaggcttcccctggcccccagaatgctccaggtcagccctctctgatccctaggagccagggccctcagactccccaccactgggcaccactgctggcaccagctggccccagtaagcccagtcctcagcagttgcgtaaatgaagcaaaacaggagaaacaggaggtgagctctttaggcccagactccagcctggagcagaagggcaggaagctggggtgcctgtggagagacagttgagggggtggcccaacacccctccaactcccccacaatttccgccagaggaggctttaaagtgtgacttcctgtgctggggctgcagagtggggaggcgacgctgagatcggccttgtggtctgaccccgatccagccaccttgcagggacccaattagtcttcctttccccctcattcatgtgtctgttcatttaatgtcaaggtgttgggggaggtcgtggcagcttctcctccaagggcccagttgagatcccatctccctcccgtgaagccaccattgacgatgtctgtttcctccaccccggctccttagacccatagtccctgtgaactcgaagcacgtgaactgaccctatctacttttggctcttatcataatatggttatgttgggtgacagatatgatctccccaaagtgaccacgaaccttataagatgagagatcaaaaaatgtcttggtcagaaagtgtcttatcctcccctggtgtcctctcagctcccagaaccagacctccagactgggagcagataaatatggatcaactgatcgatctaatgatacatctgtcttccactctagtagaagccagtgattcccaaagagggaggtgaggagacagcacccctggtaggaatatatttatctccgggggagagttttcagaccatccccccacctccccacacacaagcacacacacccttacttaagagtctggtgtgctcctctccttttgagaaccactgatgagtgaacacagtgtgtctgaatgatacaaaggcagaaagaagttgcagcacctctcctccagcttggtaggcgcacccttccacatgaccatttccctgacccttaacatgccccagacggaattcatccatctcctcacctagacaaatgacacaccatcgacttcccggacgaatgctgagaacttgccacgctctctccccagggccccatccctatccctgccgccatcccatgtgtcagttcatcttgcgaggcctccccctgtgatctctcggtcctctccgcattcctgggttgcctcacacctgggttattgcaagtgtcttctagcctctctcctgctcccatccgtcctacacactttttaaatcttcattcaggctttaacttgcacgcacaagtgtgtgaaccttcctctccatctccagggcctggctccaaacagcatttccatggtcatggaaatgatctgaagacttccacagatgcctcactacttttttttttttttttttgaaacagggtctcactctgtcacccagggtgaagtgcagtggcacaatcatagctcactgcaaccttcaccaccaggacggaatgtagtggtgtggtcagggctcactacaacctccacctcctgggcccaagccgtcctcccgagctcagtctcccgaatagctgggatgacaagcacgccccaccatgccccgctaatctttgtattttttgtagagacagggttttgctgtgttgcccaggctggtctcgaactcctggactcaagcaatccacacacctcggcctcctgaagtgctggaattacaggcatgaaccacagcacccatctgagatgcctcacctcacttctaatcacagtctgggcacagaatgtgccctaggagaacagcttctgaataaacgaatgaatgaattcctccacctggaaccatattcaacactcttcctccatcctctcccccactccctctaattctcccattcacatttcttagtgtttctcaacatggtttttccactcccgaaccaaggtgtctggcttcctgccaccctgcccatcaacacaaaatcccatctctccattcctctcctcttcctcacatcagtatccaactctgcttccctcctttatagctaccctgacaggcagtgacttcagatgtcagctccacatccacttttctatgaggctttccctccgccatcccatctgacacatctcttgttccttaattccttcagcaaatagttaaggggcacagttaatgtgacaggtcccgtatgggtgctagggatgctgaggtggataatacacagctcgtgctctcaagagctctcacttgagtcaaagacagtcagttgtaggcactgagatctatacagggagtgctgcagttgcacagtgaaggacactgaagcagcgtggggaagctcctgaattttctggagctgagcgcaggagctgagacctgctaagcaaggaaaggcagtggactaaggctcacctccttccccagttcctcctcctcccaactggtgctccaggacaccacatcacaatgcatttgtggatattttcctcgggattgctctgaaatcatttttcactgtaagccatcttggttactaggctgtaagctctttgagagcagcaaaatcctgtttgctttgccacagtctctcctgtatcattcttccctactcccctaccccacttctctctctctctctctctctctctcacacacacacacacacacacacacacacacacactgtgagctctgcattgcccactgaatggtgagaaattcagaaggatgttgcattccctttgttttccctttcctccagctccaggccaggcttctgtcccttaggagacataatcccacctgggctgaagcaccccaggacgcaggcacttccctttacctgttcaggctacctttaccctctgttttcccaacacaggtagccacccagtaattactactagtcacagcaatataaaaactttattgagtgctttctatttgctacaacctattcccctgatggactgtcaaagctgtgggcagggattttgttctctgctgtaatcccagcacctatcacagtgtctagcccagagcgcacacttaataaatcaaatgaacacttaacatgtatcagtctattcaatcttcaaaacaacagtatgaggtcaagactgtgacacccattttggagataaagaaacgaaggcatggaaggttaggttatataagctgctcttgttcatgcaggaggtatgtgagggagccaggggccgcccccaaacagaaaacagaagcaggatgtcagggcagctggctggtggggagaccgtgggggaaggacagtgggaagaagggaagagcgggtgggactaaggaggcaggaggaggcagaagaagaagagtgagaccctgaccagagacgtgctgcctggggacctggggccgggaccagagcggagcagagaggaggggaaggaggattagcgagaaaagatttcaaaaaaagaggctctgagaagtctgaggagagtctggggagattgctggaagaaaggaatggtaggagaggaagagtataaggcactaaagagaggggaggtaggcgcagccttcagaggccgggcagggcagggaaaatctgcctgactagatgggcccaggacatctgaacaggatgattcccggaccaagacgtggaggacgatcaaggatacattgaaacaaggctgaggccagagaaagggacattttccagtgacgaaaacaactttctaccaacttccccaaactgaactgtagaataagaaaccaagggattgttgtttaggtctgtgagaagcagcggggaggggaagctggaggacaggcccagggacactgaccaggtgggggtaggactagctccctgggaaggctcagtcccacagcggctacctgcctagcagcaggcaaaagggtaaagaatgtccccaggtgagaggccggggcttggccagggcactggggacactgtccactgggttgccctgccccatccagtgtcccagcccattctcaaatacctcccaccatgagcatcccaaacccaccacaccagcccatccccactcctcaactcactcccccacttcaccagccgccaaaatcctgccctacagggtgtgctccaccaagttccacaggcagcctcgcctccccacggcccaacaccctccaggccagccagctgaccggagggacagaattcagaaccgtctggactccccgagcactaatcttcctactcccactcccttcttttccccgccaaatctgccccaccctgggcctatctcctgcccacattcccttggccgcccacaaacttccaccgctgtcaggggccagggcttccttttactctctccctttcaaacttctcccattcccctgcctcagcgcagcccctactccaaaaggcggatgaatggggaaccccacactggcagtggctgaggttaggacctgcaggcctgaggctggcgccaggaccaggcccgggcaggagaggctcggccccctcccggagagggcccacgccagccggaaggtgcctcgcccaccagcccactcttccctttgtccctggtctcaccagtggcagcagcaggtcaggcacggtggagaggcccatgccagacagctatggcctctcactcccccatttgggctcagggcagtgtggcagcggcagtgctggggcttcccgggactcggtctgtccaggacgtcccaagtgccttggggtgacagttgagggttgagactcgggcatagagatcacggcctggtcccagtgatcttgaaccccaaaggccagaactggagcctcagtccagagaattctgagaaaattaaagcagagaggaggggagagaaggtgggaggggaagagtgaggcagtgttgcaacagcgggacaggaagagctggaggaggaggccacaggaggcgggaggaggaggcccaacgttctttaactctttgtagtccagtcacaagcacaggagtcccagatctggctgccttgtgcccccaacccaccaatccgaccactcccaaccaaacaccaaggggcaataagccccttgcccacatcactagcctttcccagatggatcacagcagtgaaaagatccagagtctgggagtcaaattctctgggttccaattcagaatgcttagctttttagctaagaatgtgtcttggacacataaatgaacttctcagacacataactgaaactgtctggatctgttttccaatttgcagagtggagataacctgtctcctggggttcctgtaaggatttgttcagatgggagagatatagataagcgtccgacacatgataggtactccatgtcccttagtaatcctcccctttactccagagttcttcactagcctcctagtctccctctttcttgggaatttactgatccaatccaaaactcaaagtaagtcccaaccctcgttttctgccctgactgggtgcctgccattcctcaccccaggtctcatccagtctctgcctggccaggtccccccaccctgccccactgttgatcctggctctgccaccaatcatgcgacatcaggcaactcctctcctaagcctctgttggttccttgtttattaaacaggggtaacaatgtctgcccacctacatggggaaagtgatgccatgagaatcaatgagacgtatccacgaagctgccgtggaaataaagatacctccatcaggtgttcctagcatattcccagtgcccttttcctaaatattccaatacatcaattataactcaccttacagatcatcgactacaaccccctaggtttttttatttcttcgtttgcttgtttttcatttttgtttttgttttgagggtccgctccgtttcccaggctggagtgcagtggtaccatcgcagctcactgcagcctcgacctcccaggttcaagtaatcctcccacctcagcctcccaagcagctgggactataggtgcataccaccacgcctgggtaatttttgtattttttgtagagacagggtctcaccatgttacacaggcaggtcttgaactcctgggcccaaatgatctgcccacctcagcctcctaaagtgctaggattacaggtgtgagccaccgtgcccacccaactgcccggttttatagaggagaaaactgaggtccagaaacccaatgtgccaggaggcagagccaacagagaaccccagactcccgactgccggtccaagggcccctttggctatgagagacacactgccactttttctgtcactgagtcagaccccacatcctgactctggttactttatgccatcctcattgatgcagacatctcccaagagaatcctacaacaaaggtaccacatttacccaactatcttcttggtacaatgaccttccctacatccagccccgcccaagggcctgcagctgctgaggctgctagaaatgcaggcagacagagaagagggaggtcctagggctttggaacttgaaaccagagctcctcaccccttatccctctgagatgacctcccagccccaagtccaccgtcccctggctcttcctggcttcccctctgtgatccgcagatgagaatggagcttcagtgtccctcactgcggggggagctgactttactccaccccatcgtccagcttctggagaactgtagggttgaagctggattcagaaaggaagcagctcaccaccatcacaaagggagaccccagggacaggagaagcgaacccaaagcagtgttcttgaagaagcaggagcctcagaatcaagtgcaagtttccagtatgaagcagcgagaagaacctcggtctgctcatctaaaaaatgggaaacctgctggtacccttcacagagctagcttgatgcttaaatcaagcatataaagtgtttggcaagtgtttgccatatattaagcatttagtaagtggtagcaattaattttttttttgaaacaggagcttgctctcacccaggctaaagtgcaatggtgcaatcatagctcacctaacctagaactactggcctcaagctagcctcccacatcagccttccgagtggctaagactaccatcgcacaccactatgcccagctagttgtattaatgattaataacaacttcagaaggataagtgatacaggggagtatggtatgtgagagggcggcaaaaaaaaaaaaaaaaagcagagtgcggtggctcacgcctgcaatcccagcactttgggaggctgaggtgggcggatcacaaggtcaggagttcgagaccaacctgaccaacatggtgaaaccctgtctctactaaatatacaaaattagccaggcgtggtggcgcgtgcctgtaatcccagctactcaggaggctgaggcaggagaattgcttgaacccaggaggcagaggttgcagtgagccgagatcctgccagtgcactccagcctgggtgacagagcgagactctgtatcaaaaaaagaaaccaacttcaatgtcctatttttttttttgatagagtttcactcttgttgcccaggctgaagtgcagtggcacaatctcggctcactgcaacctctgactcccggattcaagcaattctcctgcctcagcctcccgagtagctaggattataggcatgtgccatcatgcccggctaattttttgtatttagtagagacggggtttcaccgtgttagccaggctggtctcaaactcctgacttcaggtgatccacccaccctggcctcccaaagtgctgggattacaggcatgagccaccacgcccggcctcaatgtcctatttttaatgttataaggtatttctaatagtctgtgcaaagcgccaaagccgtgacacatagcctggtacaaaaggagaatatttttcaatatttaggatacatgcttatttactcaataactttacaactttgacacgtcatattacatttttcaataaaattttgtttaaaaaaaaagatgatgagaagtgagtggatctaggaatatgaaaagctaacacgtttcgtggaggaggtgagaatgagaccatcatccctccagggacagaaaaaaatcatggtcagaggagatggagaaacaggagaggggcagactagggatgacagaatcggctgttagggcttgtagagcaaaggatgaagaaaacagctacagagagcagggaccttcctcccgcatcatggcacacacacacacacacacatgcttaacccaaagggtcactggactccaagtccagatgacgtgggttctagccccagacctgccattcagactctatgtgtcacagggtggcagggtgagtcatagaaagggagctgggttcatggcaggttctctaagaattatgaagctcagcaagtcacttcaactactaagcctgataaggaaaatgagtcaacttgaacccttttatcgctaacagcctgattccaactcctaaccccagggtccaggagtaacccatagacaagtgaatggagataaggagacagctctggggaaaaaagcaggaggcaagagaagcaggagcctgggggagctgactgcagtcatccgtaatacatctggctatgtccggcaggtcctcctgccccagccagaggagagggcactggggaccaggtgggccaaggctgaggctgagggggcagacaagtgccgtctgcacctgagggctctgacagaggagactgcaacaccatttccccttcatcagctcaagtccaggaaagggaagtcagcagtcgtcacaccgtttcaggtcatgaccctgtctaccttcctacccctgtcaccagctccttctcctctttccccgaaagtctcttcctcctttggctcctcagaacagggagactgcaattaagatgaataagactaaggtggcagggacagaatccccaaagatggtgagaaagggtcacttctggattccaggtcttatgctggagtgggggagaaacaaggatcggagagctggagttccactcgcacatccttcagcccctccctggacctcagtctctcctttactaaagctgggaggattccctgtgcccctctctgcaatcatgtaccaataagaccatataaggctttgcatttccaggagaaactggcctgagcctcatcatcctccaccaccaccagacagctgatgggaggcaggcagatgagggttcattgccgccaggtggtaagtgggactcagcaagtggagtgggggatggggaggttagtgatgatggtgactaaagcagagaaggaaaaggaggttcagacagtggagagggcaagtctccccaaacactgtgaggtaggtcccctgaaggggtggcatcatgtcttcccccttccaccctaacatggccatgggcacatagcagacgctcagcaacacccatggaggaattcaccagaacgtttgtccctcttaagaccccgtgaagaatggtcacttccatggtgcagccaaggggcatgggagtctgtaccctctcccagccccaggacctcccagaagcttgggtgatgacttgtatccaccccctaccctcttcatgatgccccatccagctctccagacattccttcatgcaacaaacatttattgagctcctgcctacttgctccaagcaggatgatgggctagacatggagcatacataaacgggcaagattcagtccctgaccgcaaggcacttacagtctagttgggaagggagacacaaatgtacaagaaagtatggtgcaacagcaacactccagcagatgttatagtgtgctacgggagcccaggagaaggcggagtgatcaattttggggaagacaagatgtggcagaagcgttcacaaaagtaatggtgtctgagcagggttctaagggatgcataggagttctctggcagatggttggggaaactttcaggctgaggaaatatctcaagcagacatgtagaggtatgaaagacacagggcagaggtgccggggcatggctctgtgagggcacgggtatgaggctagaggagccctgggtctgcctttacttacccgggtctgctctagccctagccctcgggagtcagggaaggggaattgcctaagtaacaaagggggcttttgggtggggtttcccacccaagttcaagaggaggagcagacatctgtgctactggagagcagtgtggccaggccagtcgggggctggcttaagccgtcgctgggcaggaaacccgtgcatgcctgcgtgtacccttggttgtgttttgtcctggttatcagcggtttcttaggaaagttccttgtcaaagctccaagtttcgcttggctgatccaagggaaaaagagacttagccgcagttgggtggggaaaccagagtgttcagaggcagtaccaaggggtacagggctggagccaaggcacttctgggcagcttcatcagctactgttcttggagcaacttcctgagcccttacccatcttgcttcccctccacacatcaacggcagtttgggcggctctgagaggaagccctgcacatccttcaatcttgccagggccagcaccctcccaccagaggagcatctgccttggtgtgagaaacctctccttccctctcagggcccccccagaggacaggtggaggaactggcccctgcagagccccctggagatgggcgggggcccagggtggcataggcagggggaggggctgtcaaggctggagagggagcagggcctggctgggacaaggacagagacatggggtgggggcagaagtgggaaggaggggaggatgccagggtggaggctacctcctgagcacccctgccccctcggcctggagaccagtatcggcttcggaaccttcggagcagcatgaggaacatgatgaccagcaggtcaaagacgagctcagccatctccaccacagacaacaccgaggagccgaaccacaggctccactggctgcccaggttggacaggagggtgaccatctgtgagaggagaggtacattgacgatgggacagagggttctggatggactctggcagaggagcccccttccctcctcaccaagctgtctcccttcatccctgaagacccccgagtcctctcagcctctcagcagccccctgggctctttgtctctgctcctggccagtgtcacccagagaaaactgataactggcccacagttaggggcagctgaaatgggggcatgggtcaagcgccttcaccccagcatctagcatgcctgtccctcccaccacccccagagaccttatgccccggccgagctccttcttccaaccctcccaacctctcccttgaccctcttctttggtcccctgcctttgagactcagagccttctggcccacagagacaaccttttggttttccccgacagccgccctgctaagtaagacccccagagcatcacaggctccatccaggcacgacctaccgtgacagagggagactcagaattggttttgtagttcagctccttgaagaagatgttgactttggccactccatttcttaggtgtggggcagagggtgggaagaaatggtagaggatgaatttcctggaccttcctctaatcaaccatatcgatccctcttcttaggtctattttccctcccaaagattcccttcttgtggctgggaccagggcaggactgacctcttgttgttgacggtgtaattgttctgtcgcgatagcatctggaagacccattcctaggaaagaatgggggtgtcatcaaggtcactcccatatgcttcaggcttacagggatagggttgtgtcaaacacactcatacacataatacccagagaaggccacagcattacatgggcacacacatcccccacccatcccttccccacactctacctgggatgtcaccgagggccatcgtgagtaaccagcagagagctggtagctggtcacgctggggatggagaaaggtgctcagtgttggggcagagctctcccaaatgcttggctcggtaacctgtattctacccaacctgtacccggggaaggggacactaacctgcatggcttccggcacttggtgaaacagcccaggtggtctgaggagaagtcaacctggagcttatagtagcagtaccctgtgggtacagagagatgcctgttctcctagggcacctcagctttctctaccccacacccaagaggtctcccaagatccctgggtacccactttacaagagcattatttagcattataatgatgccttatgagtggcagtaccaagaagcgtttaagaaattaagctaagccagggacagtggctcagcactttgggaggccgaggtgggagggtcgtttgaggccaggagttcaaggttgcaagtgagctatgagtgtgcctttgtactccaactctggcaacagagtgagaccttgtctctaaaaaaaaaaatttttaataaattaattttttttttagacggagtttcgctctgttgcccacgctagagtgcagtggcgcaatcttggctcactgcaagctccgcctcccgggttcataccattctcctgcatcagcctccggagtagctgggactacaggcgcccgccaccacgcccggctaatttttcgtatttttagtagagatggggtttctctgtgttagccaagatggtctcgatctcctgacctcgtgatctgcccgcctcggcctcccaaagtgctgggattacaggtgtgagcgaccgcacctggcctaaaaaataaattaataaagaaagaaaataagctaagtcaggcgaaaaacaaaacaggatacaccagtgtaaggaaatatatgctatggacaaaaacataaacgccataaagaaaaatgggaacaggccgggcgtggtggctcacgcctgtaatcccagcactttgggaggccgaggcgggtggatcacgaggtcaagagatcgagaccatcctggctaacacggtgaaaccccgtctctactaaaaatacaaaaaattagccgggcgtggtggcgggcgcctgtagtcccagctactcgggaggctgaggcaggagaatggcgtgaacccgggaggcggagcttgcagtgagccgagatcgcgccattgcacactctagcctgggcgactgagcgagactccgtctcaaaaaaaaaaaaaaagaaaagaaaaatgggaacaataattgtataagaataagggaattaagccacaataagataccacttcacacccattaagatgtgtgttatttaaaaaaagacaataggctgggtgcggtggctcacgcctgtaataccaacactttgggaggctgaggcaggtggattacctgaggtcaggaattcgagaccagcctggccaacatggtgaaatccagtctctactgaaaatacaaaaattagtcgggtgtggtggtgcacacctgtaatcccagctacttgggaggctgaggcaggataattgcttgaacctaggaggtggaggttgtagtttgccaagatcgtgccactgcactccagcctgggcaacagagtgagagtcttctcaaaataaataataaataaataaataaataaataaataaaaatttaaaaagacaataacaagaactggcaggatgtggagaaactgaaaacctcttatactgctgctagggatgtacaatggtgatgtcacttcggaaaacagcctggcagctcctcaaaaaaggttaaacatagattaccatatgacctagcaattccattcctaggtatatacccaagaaaatggaaaacatgcgtccacacaaaaacttgtacacaaatgctcacagcagcattattcacaataaccaaaaagtggcaacaacacaaatgtccactaactgataaatgggtaaacaaagtgtggtctatccatacaagggagtgttgttattcagccatataaaggaatgaggcactgctattgctaccatacggatgaaccttgaaaatattatgctaagtgaaataaggcagacacgagggtcacacactctaagattccatctatatgaaagattcagaatagccgggcgcagtggctcatgcctgtaatcccagcacttgggggctgaggtgggcggatcacctgaggtcaggagtttgagaccagcctgaccaatatggtgaaaccccatctctactaaaaaatacaaaaattagctgggcttggcagcatgcgcctgtatgtagtcccaggtactcgggaagctgagacaggagaattgcttgaacctgagaggcagaggtagcagtgagccaagatcgcgccactgcactccagtctgggcgacagagggagattctgtctccagaagaaaaaaaaaaaaaaagattcagaataggcaaatccatagagagagaaagaaagaatcgtggttgcccaagggctggcagtggtggaggaggggagggaagcttgggacttgctaatgagtacaaggtttatttatttatttatctgagacagggtctcactccattgcccaggctggagtgcagtggcctgatcatggctcactgcagccttgacctcctgggctcaggtgattctcccagctcagcctcccaagtggctgggtctgcaggtgtgcaccaccatgcccagctaatttttgtaaagacagggtttcgccacgttgcccaggctggtgtcgaaatcctgggctcaagtgatctgcccaccttggcctctcaaagtgctgcgattacaggcatgaaccactgtgcctggcttgagtgagtacagggtttcttttgggaacactaaaaatattccaaaactgattatatgatgattgcacaactctgggactatacttaaaacgtaaaattaaaactaaaatttgactaaaatgaagctgtatgctttaaatgagtgaaatgtatgggatataaattatctcaataaagctattaccaaaataataataataataatggaactgtagattcacctcctcccctatttcccaaattctaagtaaggttattttgtcattattgctacttttagttcctcagtctgaagtccttcttcatttctgacccaaatccctaccagggctggagatctttaggaagaaggggaagcagctggccctcttctccggggaagtaagccctaggaaatgcaacagactgtgcttttagccttacttcctctctcatcctcacaacttctcagcaatcaatattgttatttttcactcacagatgtgcaaacccacaaagtagaaataattatttgaggggagggagaaatcacaggtggcatctcctccatcccagttctgtataccctgggacgtgtcacatcctccccctggaccttaatttgctcatctgagacaggagatgaggccagatggcctttgggtttcccccagttctgatgtgctacaatcctctaaggtcagagagacaggaaccaggaggccacgactggaaagtccaggcagaagagaactgcggagccagcccagggaaggacagaagtggaaaagtcaccacagacaggaacaaggtagggatggacgctgaactctggggtgagacaatccgctgcctttgagggcctctgtgtctccagtgcccactaccatgtcccctcccgtgatggccctccgcccaccctgtgggacagctgggcccaggggagagccctgggaggaggaactgcagggggaacaggccagctgtgccagggaagagcatgaactccaggaatgcaaacccttgcagcttacatattttctttttgtgattttctttctctctcagcttcctggcacacgacttccctgccaaacaactcaactgtagtcaaaaggaaagagatttgtctagtcctataccaggataaggaggagattccaaggtgctccaaactttactgattgtgcccttgttcagttaaaaaaaaaatcttaaacaggtccaatacatgtatttgatttataaattatatacctctactattgaatggatacagtatgtccattctaaagcacataagatggaaaatgtgaaggaatgagacagacccatgtatcttctaatattttcttcctgctccccagggaagtgttgtgtaccccacccagcccctccagagcctgcccagctaagcgccctgggcactgagcagggaagctgtgggcagagcatgcactgaaaccttaggagccattgaggaaccgctggaggttttctcacgtgctcttccttccttctgctgcaggttgtttttatttttatttttatttatttattttatttatttatttttttttgagaccgagtctcgctgtcacccaggctggagtgcaatggcgtgatctcagctcactgcaggctccgcctcccgggtccacaccattctcctgcctcagcctcccacgtagctgggactacaggcgcccgccacctcgcccggctaattttttgtatttttagtagagacggggtttcaccgtgttagccaggatggtctccatctcctgacctcgtgatccgcccgccgtggcctcccaaagtgctgggattacaggcgtgagccaccgcgcccggcctgcaggttgtttttaaatgggacaattccttgacaaacacacaaaggccaaaacagagagactgcaacactgagagggaggaacagagatagaagagagagggaggccgaggcgggtggatcatgaggtcaggagattgagaccatcctggctaacagggtgaaaccccgtctctactaaaaataccaaaaaattagctgggcgtggtggcgggtgcctgtagtcccagctattcaggaggctgaggcaggagaatggtgggaacccgggaggtggagcttgcagtgagccgagatcgcgccactgctctccagcctgggtgacagagcgagactccatttcaaaaaaatagaaaaaaagagagagagactgagggagagggaaactgacagaggcagagactaaaggctgaaaaacaagagcaaggaaggattcatcccagcaggtgggagccagaagtcatccccacaaacaggggactgagaggaaaaagtgcctcagtgagtactggggtcagtggggcagggtgggggctccctggagtctcaccccaggaactgtgctttctgtagtcacagtactccacgttctggggccgcggatagaagatgtaggcacagccacactccttgatcatgctctcctggaagcaggagtgaatacacacctggaagggaggagggtggagaggagagggggttcaggcctgaactcagcagttctctgcacagagcctccatcctctttccaccaccccccagtttccctctctctctctcacatacacaacccctccagctttgcagggccagccagggcagtggctgggagtggctgccacggaatcaggttgggcctcacctgctgtgtgtactttgaagggtaaaggttctcaacaggaacatcactgccattcttggtgcagtcgccataatcgcccccaagtctgtccagggtttcctatgaacccacatacaccaagagatcagaggacagagcaagtgcctctgggttctctgccttccctcagttccaggttgtatctcacacctgccagcccctcctactggcctcgccctctcaatacatgcttccagccacccccatgcccacccactgctcatttcaaggccactaggcccagagcatccccagaaaccctaagcatgccttgaatgccttctcagcacttgtcccccagggtccaccctgcagggctttacttcccagtgccagcccctctgcccctcattcctgctcctgaagacctccacatgctcaaggcccaccccacatgctctccctctccagcctcccatgcctccccgctgcccctctgcaatctgaggcgctccttccaggcctcccagtcagcatccttgccttcctcatgctgatggaggtctccacgccaggccgcaagttaaagccaccatcatccataaaggcaggttcatcctgcccgtgcaccattacccgggccccagtcactgtggacagcaggggaatgaagtcattctgctctgcgcgcagcatcagggacagacctaggggtgcagagagagcagagttggcagaggcgggaatcctagaaaagagttaggagatggaaatccactctcccttccttgcccagtctctaaagctgcaagagaagcaagttcaggaagacccgcaaagggacctggcaacccctgagctggaatctggaggcaggaggaagacctgggacgggattcctctcatgcctggaacggactatgtggcacctattggggagagacagcaggcaggacccctcccagcagctctaggaggtgagctcaaggtaagtacaggtgagtggctgaagcagagggcgccatggagcaagcagggagcttctcaccgttgttgattccaggcatggaagacatccagaggttggagttgttcttgtcattgaaagtatagcagtttccatacatcgggtggtggaagtgagagtaattccttatcaggaaagagagagtagggtcagagaggaaagtgtaggtggtgcagggaatagggagatgaggcagagagaaatgtccactctcttaaactcctacaggacttgtgcctttcagagccatttgtttcctgatcacctactatgtgctggcacaatgctgagagctttactcacactccctcagtcactccaaccaacagcctgtgagagtctcatcctcatatcacagaggaggaagctaaggctcagagagctcaaacagctggcccaaggtcacacatctaccttctagtccaggctcctctcaccaggccatctgggttcaccggcattgacttccgtgctgccttgtaacttctctcttgttgcattacaaagattcttgcatgtccctaactgcccatgcatctaagtgttagttccccattgaatcatgagctccttgatgacaggagccacatctcattcatctctgtgtcatctctgggttagttgcatagatcctgtcatctaggagatagaggagatgattaataaatagttgttgagtgaggaatgaatgaatgaatgaatgaatgaatgaatgaaggggaggaggggagcagggttaaaggagaaagtgtgaccagtggtgagcacggagctgaggggaggaagatcagtaccaagtgtttcctgggagcctcttgcatcagtatgtctcagaatggtaggtccaaaactcatctgtgacaggtgtggggacagagagaaagcaatcacagaggcaacacagctgcagtaggactgcaatttcacagcaaatcacaggttccagaacagggaggctgtgtgggttgtagcacagcacatgtgccacacggcacagagaggatctgtgttctgctaccctgccatcttggagctagcgacgggagccaggcaaagacggaaaggggacttcggccagtgagcagcagaggaggactaaagagaagagggagaagaggctggccagagataaagggtggggttctggttgtacggtctcaagcaggtcattgtttctaagcttattctcctcctctgtaaaatgtaggatgattctgtaaaatgaggagattggaactaggtgatccgggatattccactggccttgaagaacaaaggcacagaggcgtgacatactggtgcacattctaggatgtactgggaagtcagcacttctagagcccaggctagatgcagggaaggactgaaggagaggctacagaggtggccagtcctgaaggctggtgagcccttcgcacacagagaggggacaagtataatggtgggtgctgcccccatggaaagcaggcacaagttccatcagcggtggagaaacacggatgggttttaaaacatagagcttcgaaaaaaaaaagtggtggggcacagtggctcacgcctgtaatcccaacactttgggaggctgagacaggtggatcagttgaagtcagaagtttgagaccagcctggccaacatggtgaaaccccgtctctaccaaaaatacaaaaattcgccaggcgtggtggtgggcacctattatctcagctagtcgggaggctgaggcagaagaatcgcttgaacttgggaggttgcagtgagctgagattgcaccactgcacactacagcgagactctgtctcaaaaaaaaaaatagtaagaggtgaaatgagatctataacacaataccatttatataaattaaatacagattttgcaaaaacacatagagatacacactaagcacattactatagtggcctatgagaatcagtataatgtgatggttaagagcacagactcagccaggcgcagtggctgacgcctgtaatcccagcactttgggaggccgaggcgggtggggtcacctgaggtcaggagtttgagaccagcctggccaacatggtgaaaccccatctctactaaaaatacaaaattagccgggcacggcggcacatgcctgtaatcccagctactcaggaagctgaggcaggagaatcacttgaacctgggaggtggaggttgtcatgagctgagattgcgccattgcactccagcctggccagtaagagtgaaactccgtctccaaaagaaaaaaaaagagcacagactccagaattaaattccttgtatttgaatcctggggctctaacaagtattagatgtgggaccaaacaagttacttacttaatctctctgtacctcagtttcctcagctgtaaaatggggataataaaaatatcaacctcacaggggtgttgagcatgaaattatgcttagaatggtgtctagccttagtaagagctgtattagctcactagtacgattacagggattcattaagatggctaaagtcaaaaagacagacaacagcatgaggaggaggtagagaatttagaaccttcatacattgctgttgggaatgttaaatggtgtgaccatttggaaaagtctggtagctcctcaaaatgttaaatatagagttaccacatgacccagcagttccactcataggtaaacacccaagagaaataaaaacatagatccatgtacaggatccacaaaaacatgtacaggaatgttcatagcagcattaatcataacagccaaaaagtagaaacaatccaaatgtccatcaactgagaatggataagcaaaaatgtgggccgggcgtggtggcttacacctataatcccagcactttgggaggccgaggcaggaggatggcttgagctcaggagttcgagatcagcctgggcaccatagtgagacctagtctctactaaaattaaaaaaaattagctgggcatggtggcatgagcctgtagtcccagctacttgggaggctgaatcaggaggatcgtttcagcccaggaaatcaaagctacagtgaggtctgattgtgccactgtactccagcctgggtaacagagtgagaacctgtctcaaaaaaaaaaaaaaaaaaaaggtggtgtatctacacaatatcatagtattcagccataaaaatgaagttctgatccatgctacaacatggataagctttgaaaacgttatgctaaatgaaagaggccactcacaaaagaccacatattgtatgattccacttatgtgaaatgtccaccacaggcaatccatagagacagaaagcagaagagtggctctcagggcttggaggaggggagaaaatggggaagaactgctaatgggtacagggtttctttttggggtaaggaaaatattctaaaaacaggtagtggtaatggttacacaactccaaatatattaaaaatcactaaattatacatattaaaagaatacatttatggtttgtaaattatatctcaataaaagtgttattaaaaaaagattatagggtgggggaaaagggtgtagttatcggggaggaaaggggtgagaaagccatgctaaggagtaccaacttgatgctggaggccgtgagagacactgaacgattttaaacaggaggatacagtttggatgtttgtcccctccaagtctcatgttgaaatgtgatcccccatgttggaggtgatcctagctgggaggtgtttgggtcacaggggtgggtccctcttgaatggcttggtgccctcctcacagtaatgagtgaatcctcacactattaattagttcacccgatagctggttgtttaaaagtgcctggtctctctctctcttgccccctctcctccccttctaccatgagtaaaagtttcctgaggcctccccagaagctgagcagatgctggtgccatgcttgtacaatctgcagaaccctgagccaattaaacctctttcctttataaattacccagactcagatattccttttttttttttttttttttttttcagatggagtcttgctctgtcgcccaggctggagtgcagtggtgcgatctcggctcactgcaacctccacctcttgggttcaagcaatcctcctgcctcagcctcctgagtagctggggccacagatgtgtgccaccacacccggctaatttttatatttccagtagagatggggtttcgccatgttggccaggctgatctctaactcctgacctcaggtgatccgcccatctcggtctcccaaagtgctgggattacaggcatgagccaccgtgcccggtgagatattcctttatagcaacacaaaatggactaacacacaggactaactggaatagttacatgtggtgacgtgaagtaaggttgaagtacaaaggttcctgtagttgcagaaggaagggaggatttggaggcaaaagaacgcagtagggtggagtggtgggtataacaacccaggcgagcaatgaggctctgagctgacctaagcgcctaagtgccaagataaagatgaaccatggactttctgttgagggggaggcaggcacacagagcaaagggagggcatcgggtgagggcatagggaaagcacaggtgtccatggactttctgttgatggggaggcaggcacacagagcaaagggaggcatcgggtgagggcatagggaaagcacaggtgtccaggtgacagttagaggaacttggtgacaggtgtgggcggactcaggcttaggtgttgctaccatcttacttcccagctggtagtttctgtcctcaaacaaatgcaaagactaaaaacagaacaaaatcgtgtactgggcagagtgtgtgtgaagggtaagaagtgacaccttgccctgtggccattcttcagcaacaggggagggaatgccccctgtagagtggagccaggcagaggcagggagatggctccggaaaataaacgagcaggaggagaaggcaggggaggagggggccagaggttacagaaggggacccccccctcgcctcagcctctcccagccctcagagaacctgcagctgctatgagctgcttgcaaggacattataacaggggtcctcacagaatgaatacccgaggggtagtggggtgggaagaatccttagccagggccggcccattcccaagggcaagtcacttcacctgtttgagtacaagagtaatgaaacccatcatttactgtggtctataaagtgccctcacgtttgtatctcacacacttggtacagctcttgagatgagtgttatcgtcatcatcttcgtcacttgagtaaaagtgccaaaggagcatggattatatagtttttcctttgatgtagtccaaatgcctagaacagtgactggcacatagcccagatagtcaaaactatttgttgaacgaacactgaatgaatctcattttttgttttacttccattttacaatctaagaaataggctctgaaggatgatgtgatacatccagagtcacctggccaggaagtgacagagctagagtgggaacttaggtttagtccctcaacccatgccactccacctcactactactgccagcctcagctcagggaacagagtatgagacagatgatctcctaggcccttttgagctttgatgctagggagaaaggggccttagaaagaccaagaccctggccaggcatggtggctcacgcctgtaatcccagcactttgggaggccaaggcaggcagatcacctgaggtcaggagttggagaccagcctgaccaacatggacgttgaccaacgtctctactaaaaataaaaaaattagccaggcgtggtggcgcatgactgtaatcccagctactcaggaggctgaggcaggagaattgcttgaccccaggaggtgaaggttgcagacagccgagatcgcgccattgcactccagcctgagcaacaagagcaaaactccatctcaaaaaaaagaaaaacaaaaaagaccaagatccatgcttccagcctttggtttctcaaagccccagtcttcccaaggcatcctgtgaggccacttccctcagatccagcagtgcagggagcagcaggagttcgtagggcgctctctggggcagggtgtgggcccaaagccagtgcttccccctggcctgctggcactggcatttttttagtcaacaagcatttcctgggccctgcccatgcagggcgtgaggctgacccagggaagcggaccccgcggagagcaaggagccaggcaggactgactcacgcctggttgcaggagacctggttgaagcggcaggcgaagatgaagttgcccagcgtgtcctcctccagggatggcagagtctctggcagcctcgacaggatgttgatgtagtggaagcggtaccactccctcaccgcatccacccctgatgagtatgtctggtagaagcagtccgatttgttctggttgcactggacacagagactagagtcagaggggacacgcagccggggataagccccttggcagggccaagggcaaagaatgagtgatctggggttctgaggactgacggacaggagtcggaagccaggagtggggaaagacagaagtggaagagaagcagaagtccctaggagcatggaccaggggagcatgggattaagggagttgcaggccaggaaaggagaccagtagctgcacacacacggttttggttcatttatacctcccctgcctagggtggaaggagcaagactttccctcccatttcactgatgggaagactgagggatcaagagatttgtcccagcaagagctgggactaggactccagtccccagcccactcttactaatgggaacttccctgtctcctttccttggctcctccctcattttcccttgctcctttctttctttttttttggcagacgagctcactctgtcactcaggctggagtacagtggtgtgatcaaggctcacagcagtctccatctcccgagttcaagcaattctcccatctcagcctcctaagtagctggaactacaggcttgtgccaccacatgggctaatttttgtattttttttttgtagagatggggtttcactatgttgaccaggctggtctaaaactcctgggctcaggtgatctgcacgcctaggcctcccaaagtgctgggattacaggcatgagccaccgcccccagctaagtttcctttttttactgtctccttattctctatcttgggctgttagcccagttctccatcacgctggagggtcctaactgagtcccactagtgggcactggaattcagaaagttgcattttccttcctgaatcaaggaccagaaacagtaaaacaataataataataataataataaaagttcattttccataataaatttgacttcctacccctgaaatgcttctacataggaccccagggaggaggccccaaaagcttgggcaccaagaggtgttattttaattatctagttattatttgtatttatttacttttttttttgcccgcgagcccacgaggccccgcgtggtgtcactgggctgcgcgggcgggtcaggaaaggagcggagcccatgggtgggcggggccaggggccggcgaggggcggggcgggcccctcggcgctgcgggcctcaccagctggaagccgatcttccagtccttccagtccacctgggggttgttgtcccgcaagctggaggccacgctacgggctcgacgggccccgtgaggcgggggcgggaccctcaggcgctgcaaggggtgcggcagagtcccccgcaggtcgcgacggctgcgggagccggccacgagagtggtgaaggagctgtatttgtacaggtcaaagagcgtctgctctgtgatgcggtccagctcctccagctcctctttaatttccgggtacctgaaggggcgaggggaagagggtcaggccaggggccctggagcgagtgtctggcccctccggggtcagggtcctcatctgtgccccgggaggccggtccatcccggagaagcctgggcggggctggggtcgtcgtggcgcctcctggccgtccggcggtgaagggtaaacaggtgtgtccgccgggaaggcggaggccacggcgagcccagccgggacactgtggactgtttattgaaggagagaggcaggaggcgcctgtcgtctgtggggcgctctccccctcgcccggacctagaagggaacccggaacttgtctgccctttcccaaagaggggaagggtgagggcctcggccttggcgtgaccgcggtacccaggtcatcccgccctgatccccgcaggcgagtgtcggtggcctttcggcttgagtgccgcttggcaccgaaatcaagagttcacaactgaacttttagaatctccaactctaaaaatacaggatgccccacccaccccgcctccctcctccaaagactgttctaatgtgtttcgggtgcggcctaaacaccgtaaattaaacacagctcactgtaaatccctacattccttcttaatacaattcctattaccatctccatcatgaaagtccagagtagcagggcctgagggatgtcatctaccaaaacaaaacaaatatagaactaacaaactgaacaaggttgcagggtacacaacaaatacacaaaaaaaattaattgcatttaggccgggtgtggtggctcacgcctgtaatcccagcattttgggaggccgaggtgggcagatcacggggtcagggtatcgagaccaccctggctaacacggtgaaaccccgtctttactaaaaaaaaaaaatacaaaaaattagccgggcttggtggcgggcgcctgtagtcccagctactcgggaggctgaggcaggagaatggtgtgaacccgggagacagagcttgcagtgagccgagatcgcgccactacactccagcctgggagacagagcgagactccgtctcaaaaaaaaaaaaaaattaattgcatttccgtctcaaaaagaaattaattgcatttctacatgctggcaacagaaaattggaaaaccagaaatacaacagcaatattaaataacataaacaacatcaaatacatagaaataaatgtaacaaaagatgtgcaagactgaaaaatatattgaaatccctgctgaaataaatcaaagatcagaataagtggagatatatatatatatggattcaacacaatccctatcaaaattccagctttttttttttttttggacaggatcttgctctgtcacccaagctggggtgcagtgacacaatcgccgctcactgcagcctcctcctgggctcaagcaatcctcccgcctcagcctccctagtagctgggaccaaaagtgtgccaccacaccaagctaatttttatattttttgtagagagggggtttcaccacgttgcccaggctggactccaactcctgagcccaagcaatcaccagcctcagcctcctaaagtgctgggattgcaggcgtgagccactcactgcacccggccccagcaggtatttttaaagaaattgacatactgcttctaagacttatctggaaatgcaaacaatctagaatagctagaaaattttagaaaagaagagccaagttggaaaatgtattcctcctgactttagtatttactataaagccacagtaatcaaaacaatgcggttcttggtaaggagagacaatagatcaatggaatagaatagagtccagaaataaactcatgcatagatggtcaactgatttttggccaaaacaccaattcaattcagtgtagaaaataaaatttgttagcaggttctgctagaacaactgaatactgtattggaaaaaaaatgaccctcaatctctaccttatgctatacaggcaaaaattaattcaagatggatcataacgtaaacatgaaattcagaaccataaacactctagaagatggaagatatcttcctgaccttggggtaggcaaaattctcttgtaagaaaaatatctaacaaataatccctagaacaaccgtatgtagtaggcactttatgaacagacctacatttttttttttgagacggagtctcaattgcccaggctggagtgcagtgccgtgatctcggctcacaagctccgcctccgggttcacgccattctcctgcctcagcctccctagtagctgggactacaggtgcgtgccaccacgcccggctaattttttgtatttttagtagagacggggtttcaccatgttagccaggatggtctcgatctcctgacttcgtgatccgcccgtctcggcctcccaatgtgttgggattacagtcgtgagccaccacgcccagccgaacagacctacatttttaaaagattctgaccctgtacacagctagtgagaatataaaatgatacgatcattttggaaaacaatctggaagttcctcaaaaagttagatatagagttaccatataacccatccattccactcctaagagaaatgaaagcatatgcccccacaacatacacacacaaatgtgcacaaatgttcataccagtattatttctaatagccaaaaagtagaaataacccaaatgtccatcaattgatgaacatattaagaaggaatgtagggatttacagtgagctgtgtttaatttacggtgtttaggccgcacccgaaacacattagaacataaagatttgtacatgaggctgggtgcagtggctcacacctgtaatcccggcactttgggagggcaaggtgggtggatcacctgaggtcaagagttcgagaccagactgaccaacatggagaaaccctgtctctactaaaaatgcaaaattagccgggcgtggtggcacatgcctgtaatcccagctactcgggaggctgaggcaggagaatcgcttgaacccgggaggcggaggttgcagggagccaagatctcgccattgcactccagcctgggcaaccagagcgaaactccatctcaaaaaaaaaaaaaagaaaaagatttgtacatgaatgttcatagccattttatttataatagccaaaaagcctgaagcaactcaaaggtgtgttgaaggtgtgtgtttggcattctagaaaacttgctcattactgctaattaaaagaatggtaatctgcggggcatggtggctcacacctgtaattccagaattttggaaggccaagtgggtggatcacttgagctcagaagtttgagaccagcctgggcaacacgacgaaaccttgtatctacaaaaaatacaaaaattagccagatgtggtggtgcacacctgtagtcccagctactcagaagactgaggcagaagaattgcctgatcctgggagtttgaggctacagtgagccgtgatcgtgtgactacactccagcctgggcaacagagcaagaccctgtcttaaaaaaataaaaaagaatggcaatcatagctagcatttattgagcacttactatgagccaggaactatggtattagaatgtgcattatttaattgttaaaagaagaacgttaggcaaaattaaatttaacagagttgacttgagcaaagaacgatgctcaaatcaggcagcccctcaaccagaataggctcatcaaaaccactcagcaataaaaaggaactgatacgtgcaaaaaacacagggaagaattccagaaacattaagcaaaataagtcagacacacatacaagaaaatacatactgtatgatcccatttatacgaattctatgaacagacaaaaccagttgatagagatagcattcagaaaatgacagtgggagaggaagaggaattgatggaaagggggcaccgggtaatgggagtgttcaacatctcgactgtcaaacctgagtgggcactcaagatttgttcattttattgtacatcaattatgcctcacttaaagaaaaaaataccagtgcagggtcttacttgccagattcagatttaatgggtctgggctggagccagaacaaggttgtttgaaagagcccccacgtggtcctaacgtgcagctacattaaccaccgtctagtccagatcttcacttcctcttccattcagctctatttccatctctaccagaaaagtctagctggctgggccttaggcatcagctctggcagcccctgaacttctcacaggagaaaatgtagctctggttgaaggtgtgtttggcattctaagagacttgctcgttatttataattaaaagaatggcaagcatagctagcgtttatcgagcacttattatgagccaggcactgtggtattagaatgtacattatttaattgttaaaagaaaaactttaaacaaattaaatttaacttgagtttcactgagcaaacaatgaacctcgaatcgagtgccccccgcccccaaccagaatagattcacagtgactctgggggctgctgcatgattcgataatattcgtggacaggaaaaggaaagtgacccacagaaaacggaagtaaggtacagaaacacccggattggttacacccccggcgtttgccttatttggacaaggtttgacaagtgggctgcctttcattggccaaaactctgtgattgctataaaggtaggttatagtgtgtttacatatctagttaggtggcagttcactatgcatgaagaaacctttaggacaaactttaaaaatgtaaagaggcaactttaggctaaaacttatttaacatgatttaatcttcagtgtaacacagtataccgttagccactgttagctaacacaattgtcattcccttttccaggtgaaaaacctgaggcatgatgacttattccagttggcacagctagcaaatgggtcagacagcactccaaccaccacactgccctctggtccgtccctgctacctctggctattttaggagggccacatggtgccccagaaagagcacccaagccagaacctctctgagatgtagggcctggtgttccagccacacactttctgtctgtgtaactcggggtaagtgacccagcctttctgactctcagtctgagttccttatctgtaaaatgggcataacactagatctgcctaccgcatgaagctcttggggggttaagtgagaaaatactcagtgacacaaagtgaagagaccatcgactatcaggaagacacagaggagccaggagcccaggaaagcgaatttgcctttctcaaggtcacacaggaagaatccagatcccccacttgcctggagttatttccaccacatcctggctgggcctccctttccactccttccccaggctggctcaagtcccttctgcctcctgcccctccctctctctcatcaccaacttcaatctggttgtcacttctctggccacactcctctcccctggggagcccccatgccatctctgtgcccggcttcctcctccatgctgccaccctacacgcctccctcctgccaccctactcacctccctcctgccaccctacgcacctccctcctgccaccctacgcacctccctcctgccaccctacgcgcctccctcctgcctggcctcactgatgagcccccccactgagcacagcctgggctcccagcccttgatcccacacacacaaacctgtgacaaggcctccagaggaggctgggttccatagggccccaccttcactctcccaaaaggtctactgctcctcttttttggcataagataagacggaatggccgggcgcggtggctcacgcctataatcccagcactttgggaggccgaggatggtggatcacgaggtcaggagattgagaccatcctggctaacacggcgaaaccccgtctctactaaaaaagtatgataaattagccgggcatggtggtgggcgcctgtagtcccagctactctggaggctgaggcaggagaatggcatgaacccgggaggcggagcttgcagtgagccaagatcccaccactgcactccagcctgggcaacagtgcaagactctgtctcaaaaaaaaaaaaaaaaaaaaaatctctccctccatgaccccgtgatactagaaattcctatagcaggaggcagagcctttgagttgacacctagagctaagagaattgaccactaaacagaaagcacattgaagacatccgatcttgttttgaggagaccagcggctggagggaagggataaagaatgcccacagtgggttcttccagacagtccagcccttctggccttgacctcctcctcaggtcatgctcactgccctcactcccatctgctctggcaggcagccctacattggagggtgagtcaacccttacacaattccatcgggcaggcattattatccccattttacagttgaggaaactgaggcctatcaactaggcaaattccccagggtcactcagccaggaaggactggagccaagatgtgaacccaggcctgttcactccacggcccctgctttttccactgtgtctgcctcccagctctgaagcatctgggatcaggcagcaaaatctcctttccctgcagctggccctctcccctctagcccctcttccgtgtccaggacggagcagcagggtgcaaggaccctgggagacttggaggctgacactctgctctctcctcctcttccctccctcttaccccggtggcctcctctcacagaagagcccatgctcatcctaacagccgtgggagccgcctaggccccatcccacctgggatgagaaggatccaaccaccatggcagggttagagggatgtcaactctcaacagtccaggctttttttcctgccagccctgctgagcacagcctggtgtccagactgcccagggaatgcagggtctgcccgccacgtctggggaccacaggcagggacggcctccctagctcagggctttcccatcctccccacaggagctctctctgggaaactgccccttgcttcacccactcctggcctcctgctgtgccatttccaggaaagaagctaccatgacctccttcattgttcaagaaccccaagttcttgggtccagcctaaaccgttcctgggactggatgaaaaatatgtctgtgggctctgttttccatgactgtaggtatgactggccctctcctttcagtgaagaagccctttgttgaccagagagaaaggggctgcagtggccaacccttcccttcggactcagcacttccttgcttagtctgaaaggtcttcagtgctttgtcccctttccttgaagttagaaagcagcacagagtcctgcatgtccactttcctcctctccctctgctggtggcgaccctcagcaggtaggcagccctgggcagctctgcctcactccagttcctctagctcatcaaccgatctcctcggtaggagtcattcactgcgctcccggtgattcactcacaggggctcattaacctgtttacctccctgccactctcctgagtaggagtggccctggatccctccctcctgcacgcctgacaaattgtcctccaatgactgctgctctgcccgctgggctcccaccagctgcccccgaccctgggaggtctttgcctgatccctacttaaagtgtaatgggtaaaagagctttgaaatcaaacacactaggtttgtgactcagctgctaacctgagatgccctggctttccattggagcgtggcgggggggcggggggtgggggtgagggtggacggtgggggtgggggtggggcggggggcgggggatgatttttgagtcccagtttcaccacttgttgtctgtctgaagttgaggcagttacttaactctctgggactcagtttcctcatccataaaataagagtcatcatgagacctacttccaaggtgtgttgtgagaattaaataatttaaagcagaatcatttgatttagattcatttgtaaaaagtctggcccataaatatatacaaacattattattgtttttttttcctttgagactgtgtctcactctgtggctcaggctggaatgcagtggcgtgatctcggctcactgcagcctcggcctcctgaggtgattctcctgcctcagcctcccaagtagctgggactacaggcgtgcgccaccacacctggctgatttttgtatttttagtagagacgggggtttcaccatgatggccaggctggtctcgaactcctggcctcaagtgaggggctcttttaaacaaccttgtttgagctccatcccagatccctcaatgcctgccttggcctcccaaagtgctgggattacaggcgtgaggcaccatgcccagcggttattttttaatttaataaataaataatgtatgttcccttgctcaaattatttcctcttgccaagccttaatttcctcatctaaaaaaatgggaataatactgcccacctccctggacttgtcagtattaaatgagagagtgtctataaagcacccagctttagggtgtagcacataatgtgactacaaggtcaagtgtgtagtgcttggtgggtgttgcatctcctcccgctgtgctggggagcccttccccgactcctctcctctcctaggtgtactctccctcccgactcccacagcagcccttcaagaaggagggattctttctgggcagatggctgcctcccagcctgcaggccccagaggcagggcttatggcttcctttccccggctttttcctggactgtctagggccccgcatccagcagaacctaagaactgtgcaggcctcacccgattcacccctgccctccctttccatctctcactgacatattttcaaccacaaatatttattgagtgcccactgccccgcctgctgtccttccccttcctgctgggtccctcccctccaccaaggcctaaaggggtgaagatgtctgcaggcagcagggggagaaaaatgaggctaagaggaaggacccaagagagctctgaaatgaggcggaagccacatctgactggaagtttcattcactcaaagccccacatcttgggtattaaaaagaggcagagttttgggattaggcgtaaacaggatgagtcacagctcagtcactctctctgtgatgttgtgacttgcctctctttgccttagtttcctcaagtgtaaaatagggataacaatagcaccgggcttgtaagatgtgagaatgaaatgagatacccaagacaccttcgcagcgtctgtgcacacggcagcttcctaaggaaatggtccctacctgggacattatacagacgttaatcaacgaaatgacctggcttttttttttctctctctctccaggacaggacgtcccaccctttcttagtccgtaacgcacctttggacatgatggaatatacgaaggggcctccacccacagcatgaccaatccccagcatccaaaatcgcacacataccaatatgtgcacacacacactcacacccacacccataaagattttgcactccttgaaggtacactaactcaccatttttatcatacttatcccagtgtgccacagttactggcttatatgcctgtctctgctatcttattttatctgtctccacaacacagcaaactacctggccttcaataaagggcttatgaattattcatgaatccattttgccaggtgcctagccctgtgtctggcttgaagcaggtgttcccaaggtgtggcatggctgagtgaatacaaataaaaggtatacaaaagcactcagccctgccctcctctcttctccacgcttaccacctgctccggtttccagacccaacattggcaaagagcaccgatgaaacccaaaagttcaggacacacccaagcacgtaaaggtcaggcacctgggcaggtcaacagtgcagcattttagcctgggtcttttgggggaagagcttcacaaggagctgctctctagcctgacccattctccttgttctgtaaggcccctgcccccagcctttgggctcacttgcagccctaacctccacgatccccctctttgctttctccataataaattccccttctaaacaaagactgacagcaccacctccacagcacctgcacggtctcgcctcccctcacctagcctcacccctccatcagactctcctgctgaggtggacgaggtcttatactttgctggcatcttgctccagaaaagggatgcagctgagcacacccctgcccttttgcaagcactccctcccacttgcaggagggagaagggaatgggagggaaggagaagagagggcaggggagggcaatgctgctccaacaaccacactctgggtgagcctggggtgctaggatggctccactgggcagggacgccagtccagtaagctggaggctcctcattttgccagcagtgagctctacctgggacaggggtgtcagttcccaccctcaggtctgaggctctgcctgcccagtgagcacctcagcaccctggaccacccttccaggcgcaggcaccagggaaggggcagagggactaaccgacctgtagggattgagggtgcagatggtcactgcggggaagacgagcttgtccgagttgaggttgatgttgaggctgacggggtagctgaagtactctccgaaaagcaggccgaattgccagtacatcatgccaaaggtgcagagccacagcactgcccagaaggccgtcttcatgcggttgtgctgggagcacaccaggcggatggcgccgtggatggtggtgttgttgcagaagaactcgaagagctctcggtaggagcggtggaactcgatcagggcctcctcctccgccgtgggctgctggggcgccgcaggttcggggcccagcccctgctcctcacgcttgttccccttcatgagccctggagtggactgtggagggctagagtcctgctcctccagcttgttcccctccatgagacctggtatgggctgcagaggtctagggtcctgctcctccagcttgttccccttcatgagccccggagtggattggggagagcaagggtcagggtcaaggctgagctctgggccctgagtgccctctcccatcacccctggaacccgagtgaggctgcccctggccatgcccatgtcccaccctgcgcccacattctcccactcctccctccctcctccacctttcctggagccagcagacctgcgggagttggggccaaaagtgccggagctgggcttccctagaacggcctctcctctgcttccctgatagggccacctttcgagttttgtcctagcacctccctttctgtctctgcccccttcctttggtcttcttcctccaggatctgtgtctcagctcctgcctctcactccctctctatctgccttctgtttctctttgggtctctcctgctctcctctttctggcctgcctcctctctctaatcctgcctctcttcctctcccccccttgccttgccccctctcactctaggccctcagctccagcctctggccctgacctcgagctgtgtcctgattctgtctctgccccaggactgcagggctccaggaggtctgggctgcctccagcttcccactcccaggttgcggctggactgggactggttcctttccagttgaatctggcagccaaacctctcctccccctcacctgacaggtgcagcggcctggctggggagcccgcccgctggccggccagggatggaagcgacaggaatctcattagcatctcaattaaaggtgagcagggcggggggaggggctgaggaggagtcagagccgggagttttccgaaggaaggagggctcccgagggcaggtgaactgggagtactggacctgagaaggcggactctgggcaggggctttagacgcagacaggcaaggaggctgggggacaggatggcaggtgaggggcaaagatctgaacaagtagaaggatcctgagcccacagctaggagggcaacacaaggagaaggggccagccaggctgagagggcctgggtggggaaccgggaggacaggagggcagaaagagggagacaatagagagggacagcgaaggacagagagatagggatggaggaggggcactgagtgagtagaggcaggtggggggcagtggtgggggcaaatagaaggagccagcaccaaagggagtctgtctccaggaaggagagcaaggggggagtcccaagtgtgcttccaggagctagaggctcagcaagtgggcagccctccaagggcacccacaggtcagcctcaccctcaggccctgcagagaagagagaagaggtctctgcaggtctcctccccgctcactaagtgggagcagcgcactcaggtgggatgcgtctgcctcctcctggtccctcctctttcctgctgattcctcgccaccccctccaaccttgtccagacccgggaggggcccaggtgaagctgggggctaggcggggccctaggacattctgttcttttttacactgttggctgccaggccaggaatgtgtaatcgcccctgctgtggtcacagagttgcaggaatgtgggcaaccagaggcagcgcgagggccacgcaggacactgtggacacagacccggagcccaggaagaggcagggaaagcaggcactgaaggtgcagggaggatgtggccagcgctggaaaggaagagggtgggcatggcacacgcctagacaggccctgggaggaggagaaattcgttgatgggctatattttctccaaaatctctttccaaacttaatgcagcaaaaggataaggagtggagtgccaagtggtgagcaaggagagagaggagggtcagagaatcagacccaaaaagggctggaggagactcgggagagccacccacacaacccaggccctgcacgcggcagggaaggctgccgcttcctcacgggccccacaggaggcagcccagagtgcaggaatgtggtcactggcttgtcctgcctccctccacaagccagcagacaaaggcccagcctgagcattgatacacaccgggggaggagataggcctgcaatacaataagataaggtttctatttgtacactttaaaagattgtctttaaaacggacttctaacaaaagtgcagatctcagatttctcagagataagacataagagccaagggctaggggagcctaggggctcactgcaggagactcaggaagccttcccagagaaggtgtcatctctgctgaatcttgacaagcaaggagtttagcaggcaaagaagagaaaaggcagtactccaggctcagggtccaacctggtctgtggcttcctctcttgcggcagtctcttgcgacttcttaaagtgaaagccggtgtcaaccaggattccaaaccaggttcccttgcttaccttgatactgctcatgatacctccccttggaagggacagctggatttttcttcattgtcctaatgaagaaactgacccttcccaaggataaatcagttttctgaggttagaaaacaaaataggagcagagctataaacagaattcagaattctcctcctcctctggggctatctacttagcgcttttgccatttacttcctgagacagactcatgggggatcggggctcaggtgcacctggatgtgaaagccgggaaggcctccctcactcccacacagagcccgtggattcgtctgctctctgggtgctgggttatctccttggctctgtgaaaaggtctctgcactgtccccactgccccacatatcccagagacccctagaaactccagtctcccttgagccaggtccttacattgggcatggtcctccctgcaataaggtgctcagcaccctggctgtttgatctcaaaggttctgaaaagcacctccctgccttttctatttgccagctcatgcctgaaatccaaccactagcttaaggcagcatggcaaatagttttcatatcaagggctctgtgagaagaattgcaatgcctggtctgggctgagccaaagggtggtgaccctgccacgtcctgccgggtatgggagtggcaatgcgagcctagtgctgcagcattctagacctggagcgggctagaacaggcttggtgttgtgaggaaaatagaaatctgagacctggactttggtcagaagtccattttaaagatgatcttttaaagtgtacaaataatacacaaatatgtttttgtcacagtacaatttttcagcaatacagaagtatatagagcttcccttagtccccttcctttccctccccaaaggggagccaccataatttgtatatctgtctatatctttttgtgtgcctttataaacttacatgtatttttaaaaaacaaaatatatagttcttttttatgacagagaccatgctataggtatgtttctacaacttccatttttgcttttattttcttatttatcttagagacaggatcatgcactatcctctaggctggagtacagcagcatgatcatggctcactgcagcctccaactcctaggctcaagcagtcctcctgcctcagcctcccaaagtgctgggattacaagtgtgagccaccatactcagcccctatttttgcttttaaactatgtgactttgagaaaggcacttgacctctatgggccccggtgatcttacctgagaaaatgaaagggcaagaaggggtgggtaaggcaacccagatggacaaagactttttccagctgaccttgcatctagccccctgcttcatgcatgaggggactgaggcccacagaagcaaagtgacttggccacagtcacccaggagttaggggtggggtcagactgaaaaccaggccactcctttccaagcccagttctccttctctgactttgagagaagtacagttttgttctataagaagtcaagagctttgtagactctgtcttggaaggaccccctgccttcccaggactacccccagactcccccagagccccagcccttcccgccaacccagggctgccttcccctcccaacaccagctatcctctaaccctgtggtgtggccataaaatatgcacggctgcagggagagaagtgaaaccagaggggctgccatgggatgagggttatgagtgcaaagggtcttcctgcctcttgttctccgcggacaggagatgacggaagtaatcactccaccctcctagggagagcctatctctgcacttaccactgtttactattatttattattattatttactattatcctgatgtatgtgtgtttgtacgtatacatccgtttggggtccctgacttcccgcaacacaaggacagagaccaggcgtattcatcttggtgacctcagtgtctagcggtcactgtttgctgacccagtctgcagaagacagcagaactggcgtctttcctagtttatctttgacagagcgggatatgctacgaaaaagcatctgcaaaacttcaaacatcctaacttcctctgacaacccatttatttgtggtctattaatttatctaaattttcttcacttttccctgttcacttctatcctttccaggataagaatcagttacttagttaaatgcaactctttattcttactacttggagctaattagccacttcacactgggggctgcccactgtggaagacaacagtcctttcagctgcccttatgtggtacagatttctctttcatttaaaatgatggaccagaaaaatgccactcttcatctagtcccctggcagtttacttagaagttcactactagaagttggccgggcatggtggctcacgcctgtaatcccagcactttgggaggccgaggcgggtggatcatgaggtcaggggatcgaggccatcctggctaacatggtgaaaccccgtctctactaaaattacaaaaaaaattagctgggcataagtggtgcacgcctgtagtcccagctactcgggaggctgaggcaggagaatggcataaaaccggggaggtggagcttggagtgagccaagatcgtgccactgcactccagcctgggagacaaagcaagactctgtctcaaaaaaaaaaaaaacaaaaaaaaaaacaaaaaaagaagttcactactagaagtttatcactttgattgaagacagggtttatcaaccttggcactattgacattttcggctgtatcattctttgtggtgggacaggatgattctgtcctatctacaatcctgtgcaggatgttcagcagcatccctggcttccatctattagatgctagtagcacctcctgagtcattgtgaccaaaacatctccaaatattgccaaatgacttctggggggcaaagtcacccccgttgaaaagactgggttaaggcattgtcaccactgaaaatgcaaatactctggaaaaggacaaccctcatctgttatgcacttctgggtgtttgccagaccatttccaagagcactagtcagctaagagcagagtggagaagaagagagaaagaaaaagtatttagaagaatccattcctggccgggtacagtggctcgtgcctgtaatcccagtactttgggaggctaaggtgggcgaaatgacttgagaccaggaattcaaaaccagcctgtggccaacatggcaaaacaccatctctactaaaaatacaaaaattagccgggcctgttggcgcatgcctgtagtcccagctactcaacttgggaggctgaggccaggaaaatcacttgaacctgggaggcggaggttgcagtgagctgagattgcaccattgcactccagcctgggcgacagactgagactctgtctcaaaaaaaaaaaaaaaagaagaagaagaagaagaagaatccatttccatcagccccctttctggatgcctaatgggcctgtggaaagaaggctctctcagcagctccttcggaagaaggcctgggagaagagtcccaccctcacacaccttctaggcgtcctggggtgctcggtctgggtctggtgttgcccagtggaaatcagtctcaggaggctctggtgaaaaacacaaaaggacaggagtaaagacaatgccctgcccgcggtgaacctgtggatttctcacccctggagtctccctttatcctcctggggatggctgggcattatagtagccatttattggtaagatttgtctttcgtgatccagctgggaaacaagaaacactctaagtctttcaaacagaagaagtttaacacagagaactaactggtacatgggtgatggaggagctgagaagacaatgggaggcagctcagaaaacagcagagcgggaagcagctaccatctctaggcctggaaagatggcagggtgatgtagcatcaaagaccaagaagcctccagagccatttggcaggaactaaatagtgtggactactggtaggagatgggattatggaagtggggaaggaaggaagacaaccaactgcaggtgaagccagaaagcagagaggagagaaatagcctggctgcttcactcctcccatcccacctccatcccacagacctgcaagcaaaccagtagctgactgacacaataaagaggcacacagagataaagtgatggggccaggatcaaaacccagatctcagggctcgttccttagggtgtagagagtccatgagggctgaagcgccagcttacggctggcagcagaaagaaacatacagtccagccagctggggttaaaaggggtctggacatagtggttacctgtgaagcaggaagctttgactgggaagggcatgtagcaaacatttgtagtgcaaggaacattctggggccgggtgccgtggctcacgcctgtaatcccagcactttgggaggccaaggcgggtggatcacaacatcaggagttcaagaccagcctggtcaacatggcgaaaccccatctctactaaaaatacaaaaatcagccaggcatggtggcaggcgcccgtaatcccagctactcgggaggttgaggcagagaattgtttgaacctgggaggcagaggttgtagtgagccgagattgcaccactgcactccagcctgggcgacaaagcgagactctgtatggaaaggaaaagagaaaagaagagaagagaagaggtgttctggaccagttgggggatatgcaagaatacacaaaagtgaagactctctgagctgtatctgtaagatcagtgtaccttacggtttcattgtattatatgttacacctctattaaaagaaagggtctcagcagcataagacagggtggggaaaaaaagaaaaatagaatagagaaagagtccctgtcttttagggtaaaatcctgaaatattttcaaatgaaatgatatgatgtctgggatttacttcaaaataataatgagggatttgaagagtgtgtgcgttggtgggggagggggtatacagaataaatgaaactgacagtgagttgaagctgggtaaggagtatatgggagactcccaatattactttttctcttttggtatattatcttgcatgtggaatttccacagtaaaaagtaaaaagaagagagagaaaaaaggacctagggtcgctacacacacattcctttacgcgtttaagagctcagcagggactctcatcccagcccccagcgctagggccctggaaggctcagcagccccgcgcagtgcatgctgttctgatacttctgccctttccagccatctttggcccatctgtacggtgagctgcctgcaccaggtgaggggagagagcctcacagagtgaaatgcctacagcctaggcaggtcctttcccccttttgtgacctctcctccccatgcacacttcccatcacctgcacctgtccagacatcagacctgaagttagacagaccagtgtaaggacgagtgctgaacagagtccttcagggagggggatagtgcccaagtgacctatctcaagagaggttagcccctcatcccaagggagacatccctgagccacaaggagttggcaggactgctggaatgagttgggacctagacatcaggagacccagattgtagctggctctgcggtggactggctctgtgatgtggccatcactcatttattccataaatacctattgggcacatggtatgtgccagactctgctaagcatggggaacacagacttgaagattcagcctgggccatggtggcactcacagcctggtgggaagcaaacaagacagccaggtacagagggcagtcttcacggggactgtgcaacctagggcagaggttgccttccagagcctcagtgaagcctcaaggacaggtgggagttaggaagacggaaacttggggaccagagaaccacgtgtaaaagggggcagctgcaagtaactccacgggtgggtggggtgttgggttgagggagatgggaggatgaaacagggcaggaacgagaccaggccaccctggaatcccggttcccttatgtatcacccttagcctccctctccatgcttaaggtgagggggctggactgcgtgggctctcagctttctccagttctaaggggtttgaaggttcatgggcaaagaagccagagcagagggactgagtgcccaggtccagcctgctggccccaggactcccctccgcatatcctccccctctctttgggagggaggttccctgaggacagggagcagggcaagctgcacagctctcaagggtctcctaggtgacctgtgcccactcctgtgcggattgggctgggttggtagcgtggggggctggctgatttgctagtcccttgtaatttgtctgaaaaactcccacagtagggcaggacaacgggggaggaacccgggcatctgccagccggttctcctcggtctcagagctgcttctgcggccttgcagtccccgcgccctgccctctccatgactgcccgtcctgggcccctcgctttccagatcccgcacccagctgtcccttgcgctctctggaactccctctgctctccctgcgaggcttgtccaagggctgaccccgggcccgccgcccttccctcggctgggccagggctgtccgcagtccgctctcccgatcgggcttccgaagaagggaggaggccggttccggccccgcggccctcacgtgctttcccggccgcccctcccgccccgcatcgaggcagacaagcctgttcctcttccctgggctgcgattgcgacaggccggcctggctcccagcgctccctgtccccgccccgcggccagctcgctccactcccacttcctgagctccgccatgggagccctggaggcccggcctggccgctcccggccctggggtgcacatcggccctgagtcccgtcccaggctctgggctcgggcagccgccgccaccgctgcccaggacgtcgggcctcctgccttcctcccaggcccccacgttgctggccgcctggccgagtggccgccatgctcctgccttgggccacctctgcccccggcctggcctgggggcctctggtgctgggcctcttcgggctcctggcagcatcgcagccccaggcggtgaggaaggggcctggtaggagtgggcgagggtgggcaagagggatctgggcagccgtcgctccattccctctgccctcccaagctgacccctgactaattcttctctcctcttctccatctccctttgaaggtgcctccatatgcgtcggagaaccagacctgcagggaccaggaaaaggaatactatgagccccagcaccgcatctgctgctcccgctgcccgccaggtgagaggcaatggcaggacgaacctgggcctcggaagtgggtcacgggggctccagccccctcgcggcctcagagggaaggtgggcactgtcccccaggaaaactggctgctggagacgagcgtgggaaaccctggacatcacgtggaggagatgggactggccctccccactgggcctcctctttccttacctcactgagagggagccggagggccactggcaggatgatggggggccagagagaccgagggaaaggccagggtcacactacaggcagcggaggtgagggtggagcctcgtctcctgaggctctactgctccactcacgttctaggcacctatgtctcagctaaatgtagccgcatccgggacacagtttgtgccacatgtgccgagaattcctacaacgagcactggaactacctgaccatctgccagctgtgccgcccctgtgacccaggtgagtggggatgtgcctgcgggggggctggatcccctggagcttggcccctccctgagccctcccgtctccccgccagtgatgggcctcgaggagattgccccctgcacaagcaaacggaagacccagtgccgctgccagccgggaatgttctgtgctgcctgggccctcgagtgtacacactgcgagctactttctgactgcccgcctggcactgaagccgagctcaaaggtcagaggtccctgaggggctggatgtgaaaaggaggctgggtgccagggatctcaagtgggagcagggaatatggtactgtgtccacggcgaccccccagatccttggcttaaaattcctcttctcattccatgcagaggctcacagaagggttctggagggacatgga

SEQ ID NO: 1171 - DNA, 32332 bp, Homo sapiens
agcttctctccttcagactggacttaagtcaagtgaggcccatgtgaatctgcctgggcccaggccgtgtgggatgtccattcctctgggatgggggccctgtttagggtccccaggattgcactgcgtctgctgtcccaggtctcaggaacctatagccgatctcctcactgacatgatggagctctcacatccataaggttcctccctgacccagggcttaatgccagcccccagggagactcaggggctgtgcccacagaggagcctgtgccccagcccctggagcctgtcctggagttgccccgctatgagtcggaggtccctgccacacacgtgggctgaggctcctgctgtcagctcaggggagactcaggtattgctggttccagccctgggcctaacagcaataagggacccggggaggttgagctctccagaaaaacatgagtgtgtgggagaggaagtgatgacaacaggcctggcttctcttccaggctctgtcgctcaccaacgatgtgatctcagaaaagtatttccacctctccatcttccttttgaagtgggaatatggggagaatgaggtgaaatcaatgtaaatgtgaagctggacaacgggaaggggcctcagaagcagcgctttgcggggaggagagggctgggtttcgaacccacaaagccttcaggacctgtgagggccccagcaggtagaggagcggaccatgaaccaggtaggagagagggaagaggggactgaaaaggtcgtcaggccatcagagaagttaatgaattcacctcaccctttcaagccaggagttctaaccaagagatcaagggcagaggcccctgggggcaggaaggtggggaccggagagcagtgaggagatgacacagtgtcctctggaatctgggtaacaagctctgaagggccagagctaaaagggcatccctcctcctctgagactcttagggagtggccatggggtccaacagggtcttggactctggctcaggctggaggtttgaatgagcagggtaagaaaaagagagcctggctgcgcgcattggctcacgcctgtgatcccagcactctgggaggctggggtgggtggatcagctgaggtcaggagttcaagaccagcctgaccaacatggtgaaacccggtctctattaaatacaaaaaaaaattagccgggcatggtagcgcatgcctgtaatgccagctacctgggaggctgaggcaggagaatcgcttgagcccaggaggtagaggttacagtgagccaagattgcaccattgcactccagcctgggcaacagagggaaactccatctgaaagaaaaaaaaaaaaaagaaaaaagaaaaaaagagcctgaggcggaggggcctgttggagagcaagggggcatccctaaggctgaatccttcctgcctctacaggtggagacacaggtgaataccaggacaccagaggggagtcccaccctggggaaggcaggagaaggggaaaatcacacccgaccgagccccgccccccagctcttaccctctgtaggggcccaccctgtgctgggcactttgtgagaaatggaattccaacccccaactcactctgccccgcaggatcaccaaggttcggacgcctgggttcaaatcctggctctggccaagaggagctaaaactctgcgtgcctcagtttcctcctgtgtgaagcgcagataagaattcaggcagggaggctcacggcgctctcccccagcgtcagctccagaggaggctgagggagaactcctcacccagcagagcctgtgggttgtgcagagaggctcgctgcgctgccttgcacacaggccatccccacgcactctcagggcttctcgtgctcatgggccagtctagggggctgtggggatgctcagtccctgtgttcaggaaactcctgtcccggaaatcagcctggggcgcctccagctcctgccatgctttttgtctccagtgagcccgatctcacccgagggtctcgctgttcttccccggatgggctcagtccaacagaaccagcctgtgctgtgcagccatgtggggatgtgggtggaagggagccccgtggccatccaagatccaggttcctctctccttgacacaccctcagagaggtgacgagaggagccaaggaattcatacacgctaggggcctggaaccgtggctgacccttggtagatgcccagtaattgccagctgcctgaagtcaccaggcttgtgtctaccaagaccctggcctgggaatctctcaccaggagctggaatccttgttgctctgcctccatagcccatttgtgtgggtacttagggtggtgacaccagctgccaagtgccacccgagggctcctgggtgtgactgggaaggactcgttctctccactctagtgaggggtccttgtgtgaggataaagggagttagaccctctcattctcactacatctgcttctgtttcatgtaacacacacagttacagacacacaccgactcagagacacacaatcacagaaacacacagacacaccctcagtttagatacaaacacctagagacagagacacatgtgcactcaggcacacacactcacagacacacacacaaacaaggaaagacattacagttacatgccaacacacagagacacacacacacacacacacacaaagacacattgacatatagcatcacacagagacacggatactcagatgcacacacacaatcacacacacacacacacacacacacacacacacacacacacacacacggtgcagcccctctcttcctggaccacacagacaccacaaaaggccatacacctgactccctgcaactcgggtcccaggcctggcaggggggaagctgttgccgtgaccccggcagtcacctgcagacaacctgtccttcaggccgagggtggtgattctctgttagtgagaatgggaggctcaggatggtgacttgtccatgtcactcagtgtcacagcgttctgcctgcactcaggccggggtgggccctcctgcggtgactgatgccaggctacatctagcagctgtatgagctccccaaatcactgatttctctgaccctctgttgaccacctgtaagcgaacctgataatacctgccctacctcccctcatggggatatagcttctaggacagtactttgtgagttataagaaactgcaaaaattcttagccaccttgatggagaagataatgagaactagaccccgccccttgggagggctcccaataagcccagatcagccatgttcacttcaatataaggcagtttgttttattcctttccttgggctaagagagaaattgtagctgccccctgagggaaggaatagaatgaaatgttggtggtgggagtggtcgggagaaggtgcctgctgtacagagagagagactccaggctcagtgagggacctgccctcctgctgtccctcctcaggaggccaaggcctgcctctgtctggaacaggggacatgggacctagacaccattgcagggtaggtttacaagggccacctctatcccgttcctgaggctacacacagttcacctctgaagtcatttttgctgcagaatctgcctgatagtcggggttttgcgctcatctccatttcgctctcacctggaggggctccctgttggaggggctgtgagtctgcaccccccaggggggcacagccacctccagatctggccctggctctgctgtgccactgcctgagagaacgaccccaccatttctctccatcccctggcgggggagtttcaccctggctccgagccttggtgctgctggccctccacctccaaccctcttccttctccttctgtaccttggcccttcccgacatcccaggtgcggtctttgggttgggcttccacagctctccttggtggcgcttccttcacactcctttcattccttccctcttccagccccatcatcccctcactggtaaagtagggcattctacaggctcaacagcgccccccagagatatgttaccaactatggaagaaatgtccttgcagatgtcgttaagggtcttggtaggagaagacaatccaggtggtccctaaatgctatcgcaagtatcctcctgagggggagggggagggagacctgacacagatggagaaagagggggcagtgtgacaacagaggccgtgactggaggggcaacaagtcaaggaatgccggcagccaccagaaattggaagaggaagaagtggcacatcccctagagcctccaaggacactcggctttcctgacaccctgaccttgtcccagtgatactgttctggacttctggcctccagaactgtaaaagaatgcattctattggaaaccacggagctcatggtaatcagctaaatcagctacggcagccacaggggactcacacggggtcctcacctctgctgcttctgccgcagtctccatgcgtcggtctcaatgtgagatgcgatttttaagagcagcctgggccctttccctgtgcctcctctgccccagatcagcagtgggcacagggcacacaggtgaaagactgacgtggggccggcctgaagccctcagagctctatggaatgtcaggactccagggacctcaatgctcacattctctggtgaggaaactggggctcagggagaggagaggatgtccgcagtgttaggtggcacattagtggtagacctgggaaaagatcccaggctgattcctagctcagggtcattggtaacaaacttgtgaatatctgtaatttattcctctgttagttccctgacagagcacggggcactgggggaaggtagccacaccactcacattaactaatatttttggaatccacagtattcattaatgtttggtggtcatttaagtagcagcacttttttagggtgatgctttgcatattattcatgaaagtaacctaggagttttattttacctgtcttgcaggtgagggcgccgaggcacagagagctgtaacagcccactcaggattgtatgctaaggagaaggtggagttgggattcctgtgttctttccactttgctaagaagcccttagcaatttcatcctaatattttaatgctgaaagacacttacttgatcaatctcagaacatattttgagggtattaactgccaattaaaaggaaaaaaagttttttacttaagacacactgctgactttgtttgctccccgtgccctctgtcaaggaagcccagcagagtttaaacacaattctattagctctgattgttcattcctttttgttggtgttgttcctaaatcatcccaaacagtgagcacttcaattgtggaaaatcagctttgacttctgagagcaaatgcccctggaagctgttggccaacagtgcgtggggtggaggccgtccccttgctggcttgagcccctatgagtctctcctgcgtgactcagtgctcacattcctaccgttccttgctcaccaccggatctgggcgtatttctgcatggcctgtgctgagcatcttgtaactagaactttctaatggggtttccttgtgggagttcctttagccttcccggtgtttttcagatcttagtcacccttccaggcttgcgtagtaggtgaagacttctttgatgcatttcatgaattctggttgtttcagtcaggatgggcaaggattgtgctgcagcaaccgagaagctcacagctcaatgcttcaaccctttagaaagggttgattcctctcccgctctacttgtcccatgtgggatgaacagaggggatctacccaccctggggacacagcaaccagactgaaggaggtttcagctcctcacttccccgctccagaccatctgactctagttcctttcatcattcctgatgtcacgatttcaacagtaagcgtgataccaatgacagtgatcagaaaactcctactgccattgaagcgtctgctgtcagcatcttccaagcttggataaccagcccttctgccctgcccaagtgccacccatttgaggaaaaggacaaatgaataagacatgtttttgtttgtttgtttctgatagagctgatattggagggtgaggcttatgcctgttgggatttgggcttctagaaactgacctctcatgctggtcagcttcaccatctccagcaatgtgcgacttaggccaggctccacaactaggccagaggaagatttctgggctacatgggacaaggacaaggaactttagagaaataagtcattgcattgaaacctcaaatttgatttacattttgcagatgaggaaactacggcacagagaagttgaggaacttccctgagagcacacagcctgccctctcccatatgatacaatagtgacactcctgcttttccgagttgctgcctgggtccctgctggggagggagtttgcctcagtgagagtgcctttctctgacttctctactcagggtcattccatttgtccttttagaactgacccaggttcctgcggaagctgtccctggttctgagtcctgtggtgtgccttgtttacttcattgcctgtgaataatccaaccaagagcaacacaaaagcctcagcctttcaaggagcacttggggtgtttgaggtcatctgtgggtgtaggctgactgtttctcatgcctctggaaaggtcctgggttacaccctgaccctctccacccagatccatggatgtacgcctcatttattcactgctccccactgccatagaccagcattctccccgggatggacctgggtttcattctctctatcccccatacacagctcatgtttgcttgtttgttgtttggataaatgcttcccgctcggatttatggagaggatcaagttgctcctgggaaggagatcagtgtgaaatctgtatttcctgtttctggtgtgagagcctggaagctctctgactattgtcctcttaacaaatggggctcacagggtgccccctgtccggcagagcttgcacttcaaactaaggcttcctttatttaggcttaaaatccgaaattcgtgtgttctctcccctgcaaactcctaggcgaggtaaaaggtcaggactctaaggttcctggctgagctggaagctgttttctgcgtttccctctcatctgtttcagagcaggatgaggttcctgcctgcagagggaaagtgacttggaacacccagggtgccccgcagcttggccttcagctgatgttagggcacagcaggttgatgcagtgtggtcctggaggatggagttgtttatcgtgatcccatatggactgaggaagtatgtgctgttggggacagccaggcctaacagtggagaagacctgccttccaggcccacactggacagagcatttgacctgctgggcctgagtttccccatgtgtactttggggataatgagtcctaggctgcgtcctgcagaacctgtctggaggatcacgttggacagtgaatacatttttttaaaactctggaagatacagtgaagctgaggtcttatggttgtcccatcacggacttgtgacatatatttgtcttcctcataatgaggttgtcatgacactctgcccatccttgactgatccctgttgattcccaggggagcccaggaattccctctgggaggttatgctagtttgaatggggtctctcccatcctgactgtcaactcgtgtgtgacagacaattcttcaaagtaaaacgatggtgtctaaggtgaccgccctcagcgctgccacctccttccctgccctgggctctccagaaagccaacttgtctttgactctgcccctgttctcctaccaaatgccagttaaataagaggagtcctgtgggtcgcccaaggctgcgggctgtgtcaacatctggtggatgagcttctgctcaccaccttcagctcaatgcctgctccacactgggcacagggtgtttttctcatgaagtgtgctaggcgtgagctgtgggccaccagcaacccttctggtttaaggaggaattacctctgcagaagtttagcgtgaccctcgaaggggagagtgtggtgaggtggtatggttcagaggaacaagtagcccatcaagccagctttgccacttatgagctgtgtgacattgtgggagaccagtagcctctctgagcctcagtttcctcagatttggagtttaagagcacagcagatatactcacacatcgcagtgctgctacagtgagtaaatgagaaacagccaggggaggtacttcatagggatgtctgattcacagaaagctcataagtgcaagaaatgtagttctatttattctctgttctaatgggtataaacattttgttatctaacttgaacatcataccaactcaaaggcaggtcttactagcaatgactggggctcagagaggtttggcgacttcacgaaggtcacacagctgtcagggggaaaagtcagaacttggatccaggtcttcagactctcaggtctggtgtcatcctagggggcttggtgatggccatatctttaatgtatttgtggagagtgaaaggctgtcagtgagtaagcttaagagaacaggagacttgtgtgggaaacagtcggtatccattgattagactgaatcatgtagaattgctaatttcaccattttgaactatcgaaatcactatttggtatgactcaacctcatcctttaagtacacattcatgacagtgagtggttagacagtgattcctagattagtttgggatggggcagtgccttccataggacaaggccattcctggtagagacggagggagcaggctgtccttcagctaggggcccaggggacttcctggctgctgtgtcctttagcagggccttggaggatggaaggactctcctggcccttaccacaggggctattcaggaacagcctcctgccgtggcactggagctgcggtggccctctgaagactgcagggacagcaacaggcacaaagaagtcaggctgcatgtggccccagtcgggactcagaggaggaaagggaggggttgcgggggtcaatgggtgatgtgcttcctctcccatagctgaggagtccttgcaatggccttcctgagccatcagcaggcctatggccatgtgactagggaggagaagggatatagggtaatggtcttctggggcctgctgggcctggtcaagtctgaggaggagatagagaaaacaaagcagagaccctcctcttcatctggggagaagggacctgattctaaacggagatatgtgaggctttctggggcagcgatggaaggacaaggacagaataggtgtccttgttgccccatggagaatgggcttcaggaagaatctgcctcagtcattttccagaagtgcctgagaggtgcagggcccgagtctggttaggtgacagcgggtcaagaggaggacattgtcctctctcttgtgttgctgcagatgccacaaaactgggccacggcacgatcaggcagttctggggcccccaggagggcagccttggggtgggcacagccagccctggcaggatgagcaactctgggtgggggggagtgggggatgagcagggggacatgaagatgcttggtggagcctggggtcatggctggtatctggttcctcccctgtgattccttcttggggactccaagacaggacaaggaagactggagccctccagaaacagatgggcccaggtccgtaagctgaggattcagtcccccctggattcaagcccagcatgtgcctacccagccagatgctccatgaacacagttcagggggcccgaagacagcactgttacctggagcccacatacagcctcagcaggcaaagggagactcagagaaaacatgggagggatttacagtcacatgcaggcagggaccagctcaacccttctttaatgtcatccagggagggggccagggatggaggggaggggttgaggagcgagaggcagttatttttgggtgggattcaccacttttcccatgaagaggggagacttggtattttgttcaatcattaagaagacaaagggtttgttgaacttgacctcgggggggatagacatgggtatggcctctaaaaacatggccccagcagcttcagtccctttctcgtcgatggtcagcacagccttatgcacggcctggaggggagagaagcagagacacgttgtaaggctgatcccaggcctcgagcaaggctcacgtggacacctcccaggaagcgctcactccccctggacggccctggccctgcacatcctctccctccctgtcacataggccttgctcctcctcaaggctttggctgatggggctggctcccctctgtccatcttcctgacaagcgcctctccccctgctcaggtgcacccacaactcagaacagggaagagcatcgtcactccacgtctgcctccagggctctctcctttctagtacacggcttgaagctccttgaggacacggaccctggcagtgaccttcacagtgcccagaccccaagataatgcagccattcatggaactgcagttgttcattggtcgcctttagttttccaaaataagtgtcatctttagctgaaatcattcattaattcagacaccaaatctcacagatcgaaggagtcagaaattcctttgaaacaacttagcccaaacctttctgtgtcagtatggataaatcaaggcccaatgtctagaaggtcttgggcaaagttgaaattcagggtcagtgacacaacctcaagggaggccccgaaagtgccagctgcacagcagtcccctgcctggctttgctgtttgaccacgtcccgtgtcagtgaatcacgggcatcttcaggagctcagcctgggtcttcatttgtttccctcggccccttcctcagcctcaggacagagctgcagcccccacacattcttccctacagataccagggtgcaacaaggtcgtcagggtgatctcaccttggagagcttcaggggtgcctcctctgtgaccccggagaggtcagccccattgctgaagaccttagtgatgcccagttgacccaggacgctcttcagatcataggttccagtaatggacagtttgggtaaatgtaagctggcagacctgtcgtgcagaaaagaaattcaaggcatggcacagcattcctcttgttcttctgggacccaccacagtgcaagtgttttcttttctgattatttctgccacttactcctgtgtcctccacccacactaagatgggaactcggctttggtttgttctacttttagctcttctacattgagtcaaagaatgttaacatcgaatgaatcacaaaagcttgaaatgccacctcctctgatattctaggtgtcctggaagcctgtctcatcttgccctgtagtgttgggtcacctggcccccagcctgtaacatccccagggccctacacccagagaaacacggggctggtggcagtgcccagtgacaaccgtttagtggataagagaagagtgaccacaccaggctgagtgctcctctctggttttccatggggagacaatgccaccctgagcagggtctggtgtgagcgggcagcttggctctgggctctctgatccgttaccctctcagcctctttgttctttctcaacccctggagcagagacctcaggaggtgctggcatggaacagagaaattccagcctcgattcctattatgaacccgacaccttttgtattttcatcttggttttacagtgtacaaaacgaactagatcagcagggcatgggcataatcacgaatgcacacacatacactaatgtgtggctcatgtttaagtatcacttactacaggacacccaatctaacagcaccgataaagtgacagagaaacgcaagccttctgcgaacatggcctggctgttccaattccgaaccttgcttttctgggccttgccacacaggctcttcccccgtccccccagggacattctacccttgaactccacactccactgctgcctttgccaggaagcccatctgttcctttttggttctgccagaacgtgtggtggtgctgctgtccctgccctgggcactggatattgggaagggacagtgtccacactggagtgggaagtccccagggacgagacctttacctcctcacccctgggtactgtcctcctcatggagcatggatggcgctgcctgaactcagtggtggcctcattctggaagccaagtttatacagagtagcagtgacccagggatgtggggttcaccctcctcagccctctggccagtcctgatgggcctcagtcccaacatggctaagaggtgtgggcagcttcttggtcaccctcaggttggggaatcaccttctgtcttcattttccaggaacttggtgatgatatcgtgggtgagttcattttccaggtgctgtagtttcccctcatcaggcaggaagaagatggcggtggcattgcccaggtatttcatcagcagcacccagctggacagcttcttacagtgctggatgttaaacatgcctaaacgcttcatcataggcaccttcacggtggtcacctggtccacgtggaagtcctcttcctcggtgtccttgacttcaaagggtctctcccatttgcctggagagaggggaaggtgggcatcaccaggggtgagtgaaggtttggaagagtgtagcagaataaagaaaccatgagtcccctccctgagaagccctgagcccccttgacgacacacatccctcgaggctcagcttcatcatctgtaaaaggtgctgaaactgaccatccaagctgccgaaaaagattgtgtggggataattcaaaactagaggaagatgcagaatttctacatcgtggcgatgtcaggctaagagatgccatcgtggctgtgcatttttattggaatcatatgtttatttgagggtgtcttggatattacaaataaaatgttggagcatcaggcatatttggtaccttctgtctaaggctccctgccccttgttaattggcagctcagttattcatccagggcaaacattctgcttactattcctgagagctttcctcatcctctagattggcaggggaaatgcagatgcctgagcagcctcccctctgccataccaacagagcttcaccatcgaggcatgcagagtggacaggggcctcagggacccctgatcccagctttctcattggacagaaggaggagactggggctggagagggacctgggcccccactaaggccacagcagagccaggactttagctgtgctgactgcagcctggctgctctccactgccctcctttgcctcaagagcaagggagcctcagagtggaggaagcagcccctggccttgcctcccacctcccctcccctatgctgttttcctgggacagtgggagctggcttagaatgccctggggcccccaggaccctggcattttaacccctcaggggcaggaaggcagcctgagatacagaagagtccatcacctgctgtatgccacacaccatccccacagtctttgtcatttgtttaatcctaaaaaaacctgacagcaagaatggtattttgtccatgctaagatgagaaattagcacctcaaagaggtagaatgcattgtttttgtcaaaagctaattgtgttagaggcaggatttgaacccaggtctttcagattgcaaaactgatactgattctgggacactagagtcgtgtaaagtatgttccatgaaactatccctttatgcagtgtattacaatttgttctatagttctaagcattatatattctacatatacagtatacacaaggacattaaaggctctgaaaagttctgcagagctgtcagtagttttgacagtttaatctattatttcctcaaattactcaatgatggaaaacattttagtgtttgtgtgtagaaaactgaagaatccacgctgaaaagcattgctatggcccataatgcattgccaaggagagttcaagaactgatggtttgagaatatttttgcttgtttctatgggaacagctcaggctggttgagcaaccttacctttaaagaagatgtaattcaccagagcaaaaactgtgtctctgtcaagctccttgaccaaatccacaattttcccttgagtacccttctccacgtaatcgttgatctgtttcttggcctcttcggtgtccccgaagttgacagtgaaggcttctgagtggtacaactttttaacatcctccaaaaacttatccactagcttcaggccctcgctgaggaacaggccattgccggtggtcagctggagctggctgtctggctggttgagggtacggaggagttcctggaagccttcatggatctgagcctccggaatctccgtgaggttgaaattcaggccctccaggatttcatcgtgagtgtcagccttggtccccagggagagcattgcaaaggctgtagcgatgctcactggggagaagaagatattggtgctgttggactggtgtgccagctggcggtataggctgaaggcgaactcagccaggttgggggtgatcttgttgaaggttgggtgatcctgatcatggtgggatgtatctgtcttctgggcagcatctccctggggatcctcagccagggagacagggaccaggcagcacaggcctgccagcaggaggatgccccacgagacagaagacggcattgtcctgcaagacagagatgggggggccaggccccgagtcaaggcacatgatgactcccagtgatcagggattgacaccacgtggaagtgcctagggattattaaaccagcctgtgccaagtacttgccgacatcagtaacactgaaagaatcagaagaatagcaaaatgtacgtagtgcttaccatatgccaagcactgttctccgtgctcacatgtgttaattcattgctttcttgtaacaatcccgtgaggtgctaatgctaatatccttcttttacagatgaagaaaccaaagccagagagattaggtcagctattcaatgtcactgaggaagtagcagaaccagaatcctacatctaggtcctgcacccaggctctggacagcaacacttacatctgcaatgaccctaagatgcaaatggtacagccattgttttacaaaagaagaaaatgaggcacaagaagaggaatgggcctgcccacgattatccaggaatcgggccagatcagaatcaagaatcatgtcaagctggaagcccttggagggcttctatctaatcccactatttagtggccagggaaactgctgcacagaagggaaatgcatcttgcacaatggcaacagctagagagcatggaggggctgtgattaaacctcctgggagctgttcccacccaacactcacaaggatcctcagcccttagggtttttttcccaagagacggggctgtccccacaatgctctgtggtcccagacacaagaataggctgatgctcctgcagtcagcttacctgccgtctgggtcactaatggtgtcccagttctgggctcttgctgtcaggggctttagagacgctcatctctccttgaaagcaggggtttgtgctgctttaaagtagatggaggaggtgggaagtgaaaagacacctcttttaacttcagatagacctgggatctaatctgactctgtcactttccaggtgtatgagccaggacaagtcattcatctccctggtcctcattttgcctcatacataaagtgatgtttatgtatgagaatttagtgaaataagtctcaacaccaaaccttacatcaaaaggatctgagagggcaactcttttgagggaggggttggcaggtgttgcaaattcaaaggcttcaggtgataggccagtgaggaatacatgtttcatacccggggctgagacaatagggagtggtggggcctgtggctgaaccagcgagagcaggctctgccgagcaatggtcaaagtcaacgtcatccacagcaacacagaacctgccctgccccacagtgatccttctactccagatatgcccaggcttcggaccaccagcctgcagccccctaggtagaacctgccgtcttcacagatgggaaaactgaggtcctagctgaggagaatatgcccggcagccacattgttaactactagtcacaaaaccaaaaccatcatcttaacaaaatacaaagaaaaaggtgtccttgaatttgggaaatgaaaaactggagaaaaaaagctggaaataacaaatattgagattcttcaacccccttggacttttaaaagtttccttccaataaagcaacaaatgaagtgcaaagctggtttctctccaccacctttctcctggccctcgtgcctctaagtaatccaaatggaacagaccacacattacataatacatgtttgtatttttcttcagctagctagtgttgttagaactaaagacggtgctaaaattagtgctgtatatttccatctccctttaatttctctttcacttcccaactgaactttgtgcagtccttcatggcttatggaaattcccccatcattacagggctcagtggtcaggagggagttgggcctctgcagggtggggacactaaatatgctgagtggcctcagggccagaggttgtggcttctagccctggcagggccatcactatccacttggcctttagcaagaatcctctggtcctggggcctcactctccccagttgtgcaaagtggggctgggagaagacttcactggggccctctgtacactaacataggtttttgggttttttttgagacagagtctcgctttatctgccagggtggagtgcagtggcgtgatctcggctcactgaaacctccacctcccgggttcaagaaattcttctgtctcagcttcccaaatagctgggattacaggcgtgtgccaccacgcctggctaatttttgtatttttagtagagctgaggtttcaccgtgttggccaggcaggtcttgaactcctgacctcttgatccgcctgccttggcctcccaaagtgctggggttacaggcgagagcccctgcacccagccaggattcttggttagaatggcatctgggttcaatgtagcaaaacagatggagaattcccatggctaggcatgagacaggtgccctcctagacaggggaattctgggctcaaaggaggtggagaggctggtgcagggagggtggcgagggggtgacagctgggaggagcacattcccccacacccatccatctttcctggtgtcacatcacctactctggtttcctcctttcacagtgaagagtttgaagcccagagagggtcagggccttgttgaggctatacagcaagtcagtgacaaagctggaacaagtcttggctttcccagcactcagatcatgaactgagacagctgtgtcctcagatctcagatgatgaatgtcagaattgggctgtgacattggtctcaagcatcatgttgggttcattatgcctcccaagctgttccttataacatcaggactccaaaacctgctctctcctggcccttctatcagaggcagcaccctgcactcctaaaagctagtgcctgggagggcgactggagaggagaaagtcgccatctggccaagtaccccatggtgtacggacactgaggccaagctttaaaccaaaagaatgaaggcttcatggtgacatttctgggatcggggcaggtgggagcactctttgcggggccagggacagggaagcgagccactccctgcctaatctcacaccatttctacccgggagcataaaataagggaccaagagcaacccggcagggtgcagggaagagaatctcgcctatggtcaaacaacctgttgaactgggcaataaataaacccaagtgtgaccaggccctgtcacttactggcagggggcctggggtaaatgacttcacttctttgagcactagcttcatagctgtacaatggagaaaagaatcctttggacagggatgaggaataactgacgtaatgcatgagtgggcaccaggtgaggaagccctccctgtacctgcacacaggttgagctcctgcccgagagatggtagatttcttcccggagagcctgctgcactccccaggaccatttcagcaggaaggggctcctgctcagcagtgaacagcatctgagtttggcaaattttccattaaattatccaactgtttactgcctgccagctgcctaaccctatgctaagcaaacatcagcctcagcgtcaccatcattgccacacttactaacacctggtgttttacaggcaccgtatcatctaatctgtcctcaaagcttaccctataaggtgcaaattattagccctattttatagatagaaaaattgagccccaaagagcattaaataactcactaaaaatcacagagctacttgcttacaaaactgagatgtaatcctaaatgttttgtctgggattaaacagatttcactccaaaacctgacattgaatcatctctgtgtacaaagctgaagccagaagtcttgaatcagaaaacttcagaggcagcctggctaaatgaagaggggagcatcagtctgtggctaaaattaaaggctctgaggccagattgctccacgtcaacttgctattagctgtgtgaccttggacaagttacttaacctctctgaacctcagtttcctggagatgagaaaggtggactttgtcatagagctattgtgaaattaaatacacataaaatgccaagaagtgcctgctgcgcagcaagttctcgagaataccagttcttgctgctattgctgcaggtcttttagaggcgttctataggaaactggccaccttggccttggtcatctttttgacctgtctccaaaactcagtgcaggaaaaattaaatccttccaacacttcagagatcaaggtcgggtggggtgaggggaggggacagaagtcaaaggttatcatgttttgcccaagagaacagagaggttgagcaactgtctgaagtcaccgagcatcagagaggcctcaagtccagcccaggtttcctgttccccatccagcgcctgagacccaagagaaacagtgacactagggccaggttcaagagtttggggactggagccaggtgcctgagcccgaattatggatggtgtgtgatttggggccagttattcacctctctgtccccatcttcctcatctgtaaaatgggaatcacactagtaactgccttggagggttatgaggcttaatcacgcactgagcttagccgtggcctggtgcagagcgattattcaggaatgccagcttgagccctgggtgacagtgcccctcacagcttcctgtcctccactgggacaggagggcccagaggtccacggtgcatggggaggcccattttgatgtaaggctgaggcctggcacaggtctgttcctggtcatatctggaggggatggagaatgtgagccggcgttcctccccacccctctctggaccttaacctcctcatctatagaaggggagaaagatgcatgcccaagcagtaggagaggtggtgaggcttataggagacaacagacaggagcccccgacagacagaggagctgtgcaaacagaaagaaatggctgcgctttgttgctgttgctgtatcttggctggtgtcccccatcctggggtgccaggactgcagacctagacaccctcatccacttctgcttacaggaaccagtgtatccaccaggaggtaccgaggggggaccgggcaggactgggaaacaggacacaaccctcatggctgctgttattatgaaaataggagctcagctgcagcctctccatctgccctgcacctcagcaggcggatacccactccacaacccccctcctgccccagacctgctgcctgcctgggccatggggagctcagaagcctctccagaacctctcgcagtgaaaggcatacttacgattcactgtcccaggtcagtggtggtgcctgaagctgaggagacagggccctgtcctcgtccgtatttaagcagtggatccagaggggcaacgggggaggctgctggtgaatattaaccaaggtcaccccagttatcggaggagcaaacaggggctaagtccactggctgggatctgagtcgcccgcctacgctgcccggacgctttgcctgggcagtgtacagcttccactgcacttaccgaaaggagtcattgtacctggctcagaaaccacagcgtcctgtgtccaaggtggagggggtggcgtgagtcagacagtctctgggagagtaccacttagctggccctctgctctcactgcagaatccttagtggctgttccactggtagcaagatctaccatttactgagtcaccccaaaatgcctgatgctgaagacttactgccgccctgggagatcagagtgggttagagcccatttgacagatgaggaaacaggctcagagcggagagaccgctcatccaaagttacccagtcagccttagacacaaacaccctcttgatggtcccgatggaaaaatggagcatgactgaggcagacacaaccgtcaggctggcatggggggccgtgagacagggtagaggtggggaagcacatctgtaaagaagagctgtgctgcctcaggcaggccgcttcacctctctgaaccaggaactgtttcacctgcatcccaaagagttggaagtttcattcccaagcatgcttgtgaagtgcctcgggtgaagtgcctggcacacagtaggctctttatgtgggtctgcacagccctctgcttagtctgccccccaggctgctcagagcaggaggaggttcaattttgaccagcctcaggcctgtttctgtttttgctcctggaaaaccagtgtgatccgtatacagcttggagtttctttggatacatggcccccactctggggttgttggaggcctttggagactgctgggggtggaggggaggggaggtacagggttgaggctagtggggccccacttgattgcaatccctttaaaagcctaaatcagattgcatcgcccgctgtgcaacccgcaaacctgcttgggagctggcgtacgtgccgtagatacttgcagagtgaatggatgagtgcatttttgccccttctgtcattcaccagtcccatttatgcctccaccttggggctctaccaggcgagtgacccacaggatcctccagcacacacattcagaccagggaacccacttactggctgtgaggcctcaggtgagttgtttaaccgctccgagcctcaatttccctatctgtaaaatggggatggtgacggtatgtaccttgttgagctgctgtgaggattaaaatgcaacagttcaaggaaagctcagagacgggtactgggtgtgcccagaaagcccctcctgatgctgccctccctcccccgtgtcaggggctggtgtcactggggtggggtgggccacacttgaagagctttcctccaggcagtctctcattcagttaccctgtgaagggagtaggtaccaccctcctttcaggcagcgggaaactgagctcagactcccctccccttctctctgagctcccttccctgcagctccatcccctggcttcagggcccctgtccttcccctgagctggctgaatggatattccgctgctctacatccactcacagctccagcactgggctgtggttgaggtcgcctgccctcggtagctcctgggcatttcttcccctctctgggcctttgttttcccatctgcacaatgacccccactctaagccctgctgtccctcccacctgtggaactgagtgagcagcagcagcaatgtcccacctttcctgctctcctcaagctctcctcaagctctgtctcttctggcaggcacaggagagtggcctgaaggctggcaggaggttgccgcccctccaacctggaattcctggcagcagcagcggctaggccttcctcggaggcccgaccccctcctccttcttggttcagctcaggactctgagggttgctgcgtggaggcagtgcatgccctgggcacagtgcccagttcctgcccacccaggaagtagacttcgggtggaggcagtaggctggggaggggcggggagcttggacaggaaggagccttgctcattgcccggcagacacaagactgggccctcataaactcagacagcccggcatgtcacctgttgtacctgccctttcagctctgtgacccgggacaagtcaccctctccctttgagttgccgcaagaggtacagtcacactgcccagaggattactagaaatgacaggcctcgccctcctggcacagacctggcaccaataactggcaggtttctggggccagctgcagagggaagaggactgagccacctatgaaatgcccagtgggcagccccacagttgggcaggtctgtgtgcactggggaggtgtgtgtcataggacctggctgggtgcagaagggattgcagtggggagctggggcttttggaggaggaatgaagaaagcatgggtgggagcaggtgaggcaagtaaggggctcagaatttggggtcctgctcttttggcagggctctaggctcagcccccgccctgctctggacatccatcctgggaggaagggctaggataatctggaaaaacgcaccaggacaaaatcccgggggttgtggtgggaggggtgggagtactcagtggccattcacaaggatactgtgcccccaggaaccccaggacatgagggggaaagtcttgtccacctggttacttccacaattgtctattgcagcatctgggctgatccccccagaggaaatgcatcatgggaagatcctgtgagctggtcatgagtaaggggcatctgggggaggccctgccccaccacagggccctgcctggagatgggagcctcgtggtatgggctggatagggatgtgagagtcgagatttggggtctgcagcaaggaatcgggtaagggggtgaggtgtgccagtggccctgggccaagtaaatcaagactgagtggctggtcaggagaacaacagtggacttcatgggagctgaactcattggcaaagtgcccccggagagtgctggccaccccacaaacacacacaccccatgcacaccctcactatgcaccctccttcccaggcaccagcttccttctttgagagtcagtgcaggtcactggttaaggcgtgggttcgggatctaatatctggggccaagccttagctccatcgctctttttgtgagctcttagacaagccacttaacctctctgtgcctcggtttcctcatctgtgagataggaagactctaagaagagtcacttccatcaggactgtgaagatcgaatgagataataacatttaagcacttcgggcagcctctggcatgtgatgggccccaagtcaatgctaaccaccaaaggccatgacctttggggatgtgtcctggctctgaaaaaccatatagatgggtctcaggggtctaagtgggggaacaactgctgcgtttggccccagatttggggagcagcacctgttgttgagggacacctcctcagattcaaacttccattttttccagaaaaggctgtcaatcccctctttaggggccgtgctcattttggctttccgaaggtgaagggccaggtgccttcagcatctttctgagcacctgtgacatgcagaggatgtggggtgactgcagctaggtggacttggatccgggggaggccctcagttctctgagccttggtttcctcatctataaaatagggataaaagtttctttcccacatagctcttctgaggcttagatgaggcgatgctggtggggtgtttaacacagagctctgttagcataatggacacttgtgtctgtcttcttataactcatttaatgaatgaatgaagtttgcaccattttttcacctcctccagtcacctttcaaattagccaacttgcaaaaccccagcagacacactttccttctgtgtgtaatctcctgagccacttcctgtgtgttggggaggggaggggggatttctgcattttctggaactatgtggcctactcacagcttcttctttttttttttttttttgagacagagtctcactcagtcacccaggctggagtacagtggcgcaatcttggcttactgcaaactccacctctcgaattctggaattacgagcgattctcgtgcctcagcctccagagtagctggcattacaggcatgtgctaccaattccagttaatttttgtatttttagtagtgacagggtttcaccatgttggccaggctggtctcaaactcctggcctcaagttatctgcccgcctcggcctcccaaagtgctggaattacaggtgtgagccactgtgcctggcctttactctttatccttactcagacagagaaaaataaggcaaagctatacattataaggggcaacatagttaaaagaaggaataaaaatgcatctatagcttcatccccttcttgttaaaattactaaaactcatgttttattgcagctaaccttttctgaactttattttaactttactcttttgaggttatgggccttgatggtcattacggattggaagcttttaagagactcaatgtgtcctattgaactataattatgatttgattttagatggtcaacttgtcgcattttggtcaataggaacccttttaagttatctctttatccctttgacaatctctgctgatgtttcagcaacacacacttgctttctggcaaggccaccatgttcatgttccaggtctgtcttcattttctcttgccccaagacatggcactggggtatcttccctgggagagaaagcaagcacgcagtgacagaggccttctgggaaccacaggcagggctgagcgtgcaagactcacccttgcgtggggactatgggagacccagcaggacttgagggcttattattcagaaatacatgccctgcgtgggtggcttagataacagagagcaatagggctcttaatttgcccaactccgaccttggcttcaaattgttcgatttaccctgttgactccttcatgttgattttgagcatttctatttgcttggttttaacaggcctcttgcttccgaaattttataatataaatctccaaatactccagcggtggtgtgccaccccctgaatcgcggctgagactccttgcacatgtggcctctgccaggccctgtcttaaacacttcacatgcatcacctcactctatcctgtgcagtgagtaccactgttactgccttagaacagatgaggaaactgaggcagagtgttaccctgatgctgaaacaggtacctccctctctcccttcctctctttctccctgcttgctgcttccccaacacttcctacacatccctttgtaacattagcataataggtaacagtgagcacgtggctcatgccagagccattccaagcattggttacagattaactcctcgtcctcacatcaagcctatgaagtcgatatttctgttatcccattttacagatgaggaaactgaggttcatagacgtcgagcacctagccctgggtcacagagctggcaagtggtggagggcagattctaaccaggctgtgaggcgcatgaccccaaagctcggtggcatcaccaggctgcaagtaaccggagggcagggactgtgttttttccatctctgtggctttgtactgagcacagaataggtgatcaaaggttgcttcatgaactgagttaatcaagggtcatggaaatggagcatttctttaatcagatggctgaggtgtcttgccagggtgaaagtgtgaaaacctcgcatatgctaaaaatttgtgtgaggcgtgcaacttcttaggtaaaacaaaacaaaacaaacccagttgctttactattcaagctggagtctaacactgaggagggagaggttagcaggctgccaaagcctcccagccaggacctagaacccagtgccaagcctgggcttccaccaccacccaagctgcttttccacccgcctcctctgtctgccccatgagaaaagggaaacagtccgtgggaggacaacagagcaaggactgagctgtcatgatgaaatccaccgatgaggaaggaggttgcatcatgcccctgccgtccctctttccattctccttgtggcccctcctgagctcatcagcagaatcccagccaaagcaacccatttgctgattggttaccagatgccaaggcctctgtcagaaatttgtgctcacaaacgttcatttccccagcagctctgcaaggaaggttttattatacctactttgcacgttaggattgaagagaatatataagatgacactataaagcctctcttgaatcctccagcctctccgcatctcccctgtgccaccatcccttccctgtctttatcgatttactttttatggacgtgttatttgcatgtagtaaaactgtaactcctaaatacacagctcaatacatttttacatgtgtgtgcatctgtgtaaccgccattctgagcaagacagagcaaattctcccatccacaaagtcctctttctatcaatgcctcccgaaggtaacttctgttctgacttctgtctccatagactggtttttccccttctagaagagcatgtaaatgggataatacactacctatgtttttgtgtctgtcttctttagttcaacatcatgtttctgagattgatctatgttgtcaccaatatcagcagtgcgcttatgcttcttgctgagtcctattccatcatcattgtgtgggcggaccacaattagcccatttattgacggatgtctgggtggcttccactttggtctgttatgggtgaagcttctaagagcattcatgtagaagtctttgtattttcatttcttttgggtggaatggctatttgtagagtatgataaactgtattaaaaaaaaacccttttctctccactccttgctttttttttctcttccctccttcccctttccttgctgtcttggaaggattccaggaattaagtggaaaagaagttggacatagttcaaatcccagatctgccattaaccaccaagaacccagagccagcgacttcatctcttttatctgtggaatggagatgatagtcctgacatggtggggctgcagtgaggattacagaaagtgcctggttgaataaatagtatttccttactctttcacccttgggactgtgtgcctgttgttctgatggcagacaaatagaaatttaattcagtgaaatgactgggaacaaaaaacaacgttgtttcaggaatttagtgaaaaatcaatgatttccattctacttaaactggttctcaggacctggtgtttggctctccccctcagagagcattgggcaagaagggcaaacacaagctgggtcaacatcagccctcctagcaaacaatgaggacgtgtgtgttctggacttctctgccctcttccctctacctctgttctccagcggggctacgtgggaagcagatagggaagactctgtgaagcgacttaggctcaggtactggaagctgtgtggatgggattcagggagctgaggacacacttggagaagtgccctgctctcttgggatggagccctcaggtttaccagggagggcaggacaaggcacttagggtgctgaagacaaacagtttgcacacatgtgcatacacacactaacatccccacataagacttttgggggtctccttccttattttaagggctctggaaaaaatgatggccctgacaccacctgaaatagtgtagactatggcaagattatgagatttgggagagttagagctaggctcagtttactgtggacaagttacttaactccttatggctttactgtccatatgtgtaagtggagtttatagttccgaggtcttagagttggttgctaagatgaaataaatgagtacacagagaggaccagcatagagaagacacttcataatgtcaaaggtatttgaataagagtgactccatcttgaatagggactggttagaatgaggctgagacttactgggatacattcccagattgttaagagattctaagtcacaggatgagttaggaggtcagcacaaggtcataaagagcttgccaataaaacaggttgaagtaaagaagctggccaaaacctaccaaaatcaagatggccacaagaatgacctctggttgtcttcactgccacactttcaccagcacataacagttcacaaatgccatggcaatgtcaggaatttactgtatatggtctaaaaagggaaggcatgaataacccaccccttgtttagcatatcaagaaacaccataaaaatgggcaaccagcagccctcagggctgctctgtctatggagtagccatgcttttattcctctactttcttaataagcttgttttcactttattctgtgacttaccctgaattctttcttgtgcaagatccaagaaccctctcttggggtctggatcagaacccctttctggtaacaataatgttgattccctttcttttcctttttggaaaaaaaaattgggcagtccccataccagaataggttcagagagactcctcctctttctattttcctcttctcttttggtcttttgttttggttggaagtaagagaacaaagccacgtacaatacattgtatagggtaagagtctatgcatatatagagaaactaaaggagatgcatggaaggctctgagacacaacccagtgactctcctggaatgcagatttgccagctgggacaatgacttctactttgttctttatgtttctgtgtgtttatattttcacaagaatgggttgcctttataagaaagcatgcctttaattccttttaacttaaacaaatggaaagactctattcaaatacatgacagtttctttcagggtctctaaaaaggtgacttccccgggggttctccttcacctttttggctttcctccaaatgccctaaccctcggaaggcggtctgatggagtggaaaagcttctgtgatgaagtcggacaacatggggctcaaatcctaatctgttgcttattagctgtgggaatttaggaagttatttaatctctcattgagcccaggaataaaactgggaacgtacctactttggtgtgttttggagatggctgatgtagtaacaatatacggtccaagcatatagaagctccttgaggagcagcagttttgtaactgcccaatgggttcaccttgccctctgcctagacagagccgatttatcaagatggggcaattgcaatgaagaaagagtaattcacacagagcctgctgtgcgggagactggagttttattgtttctcaaatcagtctccccaggcattcagggattggagtttttaaagataatttggcaggtaggggcttgggaagtggggagtgctgattggtcaggttggaagtagaatcataggggggtcgaagtgagtttttcttgttgtcgtctgttcctgggtggtttggcagaactggttgagccagattactggtctgggtggtgtcagctgatccatcgagtgtagggtctgtaaaatatctcaagcaccgatcttaggttttacaataagtgatgttattctcaggagcaatttggagaggttcagactctaggagccagaggctgcatgaccagtgaactgtaatatctcatctgtagctaatttgttagtcctgcaaagacaaactggttcccagggaagaaggagatcttttcaggaaagggctattatcaattttgtttcagagtcaaaaccatgaactgaattccctcccaaagttagttcggcctatgcccaggaatgaacaaggacagctaaaggttagaagcaagatggagtcggttaggtctgatttctttcactgacacaattgcctgagttataattttgcaaaggcagtttcagtctccttccctgtgtgttagttcagtctccaaggatatgacctccacaatgccgtgccatagtcactgcatgctgtcatctcactctgcagatgagcaactgaaactcagagaatttaagtgacttgttgagttgtgcccgggaaaaccagcattgttccttgttctctgtgtttacattattataggtattctctacgcattatggccatgccatattttggctttgaccctggtgcctgaagaggtcattagatctgtgtttgtccttcacttgtccttgcattttgcaccaggcgtgttttctccaagtggaatctggaggcttccctggggatgggatcccatgacctggatttcaaaccttatgacattagcctcattagcatggaaagaccctggggaatacagtatttttgtccctgaagaacatctttcagatgcaaaagcagcacttccagcatccctgtgtggatcctttgacttaatagttcatcatgttggtcatttggtcacctaaggtagaactcttctgcaactgggacttgttttctaccagagagtttggtgatccttgaggatttgcaattctcctgagctcagggcagttctgaaataggtctccaagtacagttttttaaatcctgattccacactaagtatgaaaacatgaattagtcaacaaaaatcatgttggtattttcgccctgcatcttcaagctcagcatattaaaacatcacatcaggtgcacacctgtaatctcagctatgcaggaggctgaggcaggagaattgcttgagcccaggaggcaggggggtgcagtgagccaagattgtgccacagcactccatcctggtgacagagcgagactccgtctcaaaaaaacccaaaaaaccaaaaaccaaaaaaatcaaaacccatcacatcaggaagggactacatgcctgtgagccactgggtttcttagtcggatggatctctcagagctctgggattacaaagctttaatccgaggaagttactgagtaaatatcttcatttcacaatttatattttttcatactttgtttcaacttctttcctctttcacttaaatttggcattagtaaggtccctagcagaaggccagtttgtaattttgatcacttgtctgccacactgtgcagtaagtctaattagtaaatctcttgcatatcaatatttcctgatacattttcccaaggaggctagagtactacctttgattttatgatttatgtcagccgttcccaatctttttggtaccaggaatcggtttcaaaaaagacaatttccacggatggaggttggggtgatggctttcggatgaaactgttccacctcagatcatccttagattctcataagtgtgcaacctagatcatttgcatgtgcagttcacaatagtgtttgcactcctatgggaatctaatgccacagctgatctaacaggagggcactgatctcactcactgctcccctcctgctctgcagcccggttcctaacaggccaaggaccggtactggtctgcagactggggattggagacccctgatttatatgaacctttgaaatctccatttccccttaggttcatggattagtctcatccaaaaatggtctgtaaaacattacagcaaatttcgtatgcttagcatgtgtgtgtgtacacatacacatgcaggagtttagcacttcacatttaaatgccttggatatcacatctatcctgccttcgtagctagggaaaatgagcctgcttctcagtaggggctgtagcgaactgtgcaatggaagaaaaatagcagtgacatattgttctttcaaattccttatgtctggtttgaatgccaataagcttaacaagcgacaacagccaactccagaattcccctgtttcctaggcccagccaacagttgactttgcaccttccttgactgctaacaattggaggaatgcaaatatcaaacatttgcactgagca

SEQ ID NO: 1172 - DNA, 39104 bp, Homo sapiens
ccttggataaatattatatttttatatgaaataaagcagccccaggactgacagtctaggctcagataatcccacgtgaacttgaggtggacatgtgagtcctggggaacccggcggcctcttcatcatgggagactgccctgcgtgttctggtatgtctggcattgctaaccctcaatccttaaatgctagtagtactccccccaaacgtttgtgaaaggcagaagtgtcccaacaagtttccagagtgttccttttgggcagtacctgctctgttaataggcagttctttaagaggtgaaagtgagggtgtagaggggccaggctggactcacaccacgcacaggagtcagcctttgcctgcccatccaggtcgagctctgcagctgcgggcttgtggattcccaaaaagcaggggctgtttcctccaggcctgggaaggtgtctgctttgctaaatgtctgagcggagccagcgagtgtgcaggtcttagggcacagggtttctttctttttttttttttttttgagacggagtctctgtctgtcacccaggcactgtctgtctcagctcactgagacctccacctcccaggttcaaacagttctcctgcctcagcctcccgagtagctgggattacaggcgcctgccaccacgctaatttttctatttttagtagagacggggtttcaccatattggccaggctggtctcaaactcctgacctcgtggtcctcctgccttggcctcccaaagtactggaattacaggtgtgagccaccgtgcctggccagggcacagggtttcagaaatggatccttataaaggaaggcagcggagtatattgggaagattgtgaaggcttcagccaggccattgcctcctgccctggtgtgaatctgaggtcctctgctcccggttcctagctgctgggatgtaagttaacctcaccgagccagcctttcttcctctgttaagtggccagaactcagactctgtcctatgaatatctctgcagcaccgaggaaccaggaagggggtggacgattttgctcctaaggctgtgagccctggaccccagggtgtggctcagaagtccccctccttcagggaggacattattcctgtacagctcccaacaagggagctgcccactctttgacctttagccctccagttagatgggaaagtgagaaaactcaatgcatagcactgtagcctgagctcttttaccagcagcatgaccctgaacaagctacctaacctctcttagcctcagtttactaatctgtaaaatggggtgccccaggctgagctgttaggacttctgagaggatgaactgaggtggtgcctgtggagttgagtatctcgcccggtaggaaggaagtgctaaaggaatggcatttgttgcataattttagagccagattgaacctcagaagtaagtaaccctgtccccaggctttgattttataaaggaagatattcaggccccaccatgaaggcctttcctgctagagttaaagcagaatagaccaggctgtctgacttccagttgttatgaactttagcttctcacactccttggccaaaaacgattgggaaagctctgacgggaaggcctctggtgatccagataaactcataggcgatgcagaacccttcctggaactcccctcaggcaggaggcacaacttctgaaagccactcttcagggcgacatcgaggggcttctaaagcaaatttgtccagagacctacagggttaaacgtctgaaaaacaagcgttagggcagtcctatgagaccaaaagcagactccaggaaacagtgagagaactgcaagagtttactttgtgtggatcagatgaagggggtgtttgggtaggtgggtagtaaaggaaaccagactatgttaccccttgatatggtctgtctgtgtccccacccaaatcttatcttgaattgtagctcccataattcccacgtgttgttggggggtacccagtgggagatcattgaatcatagaggtggtttcccccatactgttcttgtggtagtgagtaagtctcacgagatctgatggttttataaggggatttttaaggggaaattcctttcgcttggctctcattctccctcttgcctgctgccatgtaagacctgccttgattgtgaggcctctccaaccatgtggaacggtgagtccattaaacctctttttctttataaattacccagtcttgggtatgtctttattagcagtgtgaaaataaactaacatacctctaaatatgcctttctgatataaaaattatttttgaactgaaggtaattaagaaacagcaaatggagaaatagttttctctatctttccccctttcttcctaaagacagataaaaattcatctttactggaaatgactctagactcttatcaacccagagatggcatcagaggaatatgcaaacaagccttattcctttagtttcctcccatatatttaccttccatgatttcctgcccttggaagcataaaaccacttcccttgtcccgatccatgattttcctgctaatttattgctctttactaaaggtaagtggagttctaaggcaccattttgagttacttttcatgcaggtttctcctgtgtgaagtgcatggcccatgttgtaagctgatttttctcttgtctgtcttttgttacaggagtctatcccaaaaaagaactaagatgggaagaagtcaagtttagcctccccccacagtagtacagaggtaggaaaaaaagggctttccaagtccttgcaacatacacacacacatatgcacatgcacacacaggtgcaaatttctcgctgatttccagacatccctcctgccttgaactttaaagacatctttctattgtgttatggcttatgtgatttcttctttttaaacttctaatttagaaataactttaaacttaaaaaaatttgcaaaaatcatggtctccacatctacccttcacccagcttccaaaaatatgaaaatatcatatgactataatacataaccacagtgtattagtccattttcacgccgctgataaagacatacccgagactgggaagagaaagaggtttaaatgcacttacagctccacgtggctggggaggcctcagaatcatggtgggaggcaaaaggcactgcttacctggtggcggcaagagaaaatgaggaagacgcaaaagcagaaacccccaataaaggcatcagatcttgtgagacttattcactatcacaagaacagtatggcggaaccacccccatgattcaaattatctcccactgggtcccttcccacaacatgtgggaattatgggagtacaattcaagatgagatttgggtggggatacagagccaaaccatatcattccgcctctggccctgccaaatctcatgtcctcacatttcaaaaccaatcatgccttctcaacagtcccccaaagtcttaactcatttcatcattaacccaaaagtccacaatccaaagtctcacctgagataaggcaagtcccttctgcctatgagcctgtaaaatcaaaagcaagctagttactgcctagatacaatggggttacaggtattgggtaaatacggctgttccaaatgggagaaattggcctaaacgaagtggttacagggcccatgcaagtctgaaatccagcaggtcagtcaaattttaaagctccaaaatgatctcctttgagtccaggtcacgttgatgcaaaaggtagcttcccttggtcttgggcagctctgcccctgtggctttgcagggtacagcctccctcctggctgctttcacgggctggcgttgagtgtctgtggcttttccggataaatggcgcaagctgtcggtggatctaccattcaggggtctggaggacggtggccgtcttctcacagctccactaggcagtgcccccatagagattctgtatgggggctccaacccacattttccttctgcattgccctagcagaggttctccatgagcaccccgcccctgtagcaaacttctgcctgggcatccaatcatttctgtacatgttctgaaattgaggcggaggttcccaaaccctaattcttgacttctgtgcactcgcaggctctaccacgtggcaactgccaaggcttggggcttgcacgctctgaagccacggcctgactcgacgttggcttctttcagccatggctggaatggctaggacacggggcaccacgtccctaggctgcacacagtacggggaccatgagcccagcctacaaaaccattttctcctagacctctgggcctatgatgggaggggctgccatgcagacctctgacatgccctggagacattttccccattgtcttggggattaacattctgctcctcattacttacgcaaatttctgcagccagcttaaatttctcctcggaaaatgggtttttcttttctaccacattgtcaggctgcaaattttccaaacttttttgctctgcttcccttataaaactgaatgctttgacagcacccaagtcatatcttgagtgctttgctgcttagaaatttcttctgccaggtaccctaaatcatctctctcaagttcaaagttccagaaatctctagggcaggggaaaagtgccaccaatctctttgctaaaacataacaagagtcacctttgctccagttcccaacaagttcctcatctcgatatgagaccacctcagcctggaccttattgtccatatcgctatcaagcttttggtcaaagccattcaacaagtctctaggaagttccaaactttcccacattttcctatcttctcctgaaccctccaaactgttgaaactttgcctgttacccagttccaaagtcgcttccacatttttgggtatcttttaggcagtgcaccactctactggtaccaatttactgcattagtctgttttcacgctgctgataaagacaaacctgagactgggaagaaaaagtggtttaattggacttacagttccacatgactggggaggcctcagaatcatggtgggaggtgaaagacacttcttacatagtggtggcaagagaaaatgaggaaaatgcaaaagcggaaacccctgataaatccgtcagatcttgtgagacttattcactatcatgggaacagtatggaggaaactgcccctgtgattcaaattatctctcaccaggttcctcccacaacatgtgggaattatgggagtacaatttaagatgagatttgggtggggacacagaaccaaaccatatcacatagtataatggtcaaaaccaggaaattgcagtgattctgtatattgtcattattcaagctttttttcagttgtcctaccaatatccttttttcttgtacagggtccaatccaggaacccaatgttgcattgggttgtcacatttcttcattctccttgagtatggcacagcttctcaggttttgtctttcttgacctatgaccttttgaagaatactggctagatattttgtagaacgtctttcaatttggaattttctgatattttacatgtcaactttaggttgtacgcgttgggcacaaatatggcagaggtaatatgcctttctttgtgtatcatttcagctggctggcataatttctgatgagaaatcaatccttattttgatctttgtgccctgtatgtaatatatccttttttctagctgcttttaagattttctctttatctttagttttaaggaatttgattattaaaattgatttttaattattgattattaaaagagcaccttggctggtgttctttctcctgctttgggcttgttgaatttcttggaactgtgaatttatagttttcatcatgtttagaaaataatttaaccattatttcttaaaatattttcctgtcccctaaactgcccccttctggggctccaatttcatgtggtgatgtaatggtgagggcttaggtcatgtgtagttttatgtgcactactgctgattttatagcttgttggggtgatgtgtaagaaatattcatgcagctaccattatcctacagtcaaccagaattttatgacttatagaataaattagctatttaaggatatgaatggcaagatttttggcactttgttatttgccttttaaatttgattatacttttaaaaatgtttgtgtggttgaatgtatctatcttttctttagtcatttctggatttatagcattcttagataagtctttctcattatgagattatttttaaaacattcattatatactttttattttaggatttcaattttttatataaatctttgatctatcaggaattgatcctggtgtaaggatgacagtgattctaatttacactgtctttcagctggctacccgattgtccccaaacattttaaataaatgttttaacacagtttgtttgccccatttatttgagatgcgttttttttttttttaagagaagtctcattctggtgcccaggctggagtgcagtggcgtgatctcagctcatttcaagctctgctcctgggctcaagcaattttcatgcgtcagcctgctgagtagctggggctacaggcgtgtgccatcatgcgtggctaattttttgtatttttagtagagacggggtttcaccatgttggctaggttggtctcaaactccggacgtcaactgatccacctgccttggcctcccaaagtgctgggattacaggtgtgaaccactgtgcctggcctgaaatgccacttttcgtttaaaaatgaaaattttaaaactgtattggttagcttataaaagtcaatgatgtaaaaagcatactaaaaaaacaaaaacagaaacaaaaacaaaaaaatgagtaagacgcatctacaaccatctgatctttgacaaacctgacaaaaacaagaaatggggaaaggattccctatttaataaatggtgctgggaaaactggctagccatatatagaaagctgaaactggatcccttccttacaccttatacaaaaattaattcaagatggattaaagacttaaatgttagaactaaaaccatacaaaccctagaagaaaaccgaggcaataccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggggaaaatttttgcaatctactcatctgacaaagggctaatatccagaatctacaaagaactcaaacaaatttacaagaaaaaaacaaacaaccccatcaaaaagtgggcgaaagatatgaacagacacttctcaaaagaagacatttatgcagccaacagacacatgaaaaaatgctcatcatcactggccatcagagaaatgcaaatcaaaaccacaatgagataccatctcacaccagttagaatggcaatcattaaaaagtcaggaaacaacaggtgctggagaagatgtggagaaataggaacacttgtacactgttggtgggactgtaaactagttcaaccattgtggaagacagtgtggcgattcctcaaggatctagaactagcaataccatttgacccagccatcccattactgggtatatacccaaaggactgtaaatcatgctgctataaaggcacatgcacactatgtttattgcggcactattcacaatagcaaagacttggaaccaacccaaatgtccatcaatgatagactggattaagaaaatgtggcacatatataccatggaatactatgcagccataaaaaaggatgagttcgtgtcctttgtagggacatggatgaagctggaaaccatcattctcagcaaactatcacaagaacaaaaaaacaaacaccgcatgttctcactcataggtgggaattgaacaatgagaacacttggacacaggaagaggaacatcacacactggggcctgttgtggggtggggggagggaaagcattaggagatatacctaatgtaaatgacgagttaatgggtgcagcacaccaacatggcacatgtatacatatgtaacaaacctgcatgttgtgcacatgtaccctagaacttgaagtataattaaaaaaaagaaaagaaaaagctaaaaaaaaaagaaaaaatgaataagacgaattcaatcattcaccaaacagaaacagtgttcctggcgctgtagggggtagtatcatattagcgcagtgttagggcaactgccataagatggcccaaccccagcctctacctggggttttgcttcagtgcatgttgcttttgcaataagaaaggaaaaccaatgaatgttggaactgattctgtgttactctcttttcacactgccatgaagatactacctaagaccaagtaatttataaacaaaggaggtttaattgactaatggttccacatggctggggaggcctcaggaaacttacaatcatggcggaaggggaagcagacacattttactggcagcagatgagagggacagtgtgtacaggaggaaatgtcaaacaattataaaaccatcagatctcatgagaactcactatcatgagaacagcatgggggaaactacccccatgatccaatcacctccctccctggacacatggggattacaggcttctccctccacatatgaggattataatttgagatgaaatttgggtggggacacagagccaaaccatatcacacacatctgctgagtctcctcctatctttctagagtaagactccactgttcacccacaacaggcttccagcgtcagctgctctggtgggggcccagaaatgtccaacccctgccccgccccccccgccccaggaaactttaaagactagaaaccttaaaagaccttcagtatcttagctctcatggacctggctgggattctgtccctttcccacatacctccctgcaccgccctgacccctaagacccatgacaaattaaagatgccacattcgtctgcagttgtcagggctgttaaatcaagtttagcctaatgcggcctccttacatattttaaatttggcctaaagatttctcagtacatcatgaactataacaagtagagggacgaacagaccatagcctacacttgtgccagtcaccgagttttggctgatcaaaagtagccaaataagacaaacatcaacctataaccaatccggctgtttctgttcctctcttctgttttctgtacatcactttcctttttctgtctgtaaatcttcttccaccacgtggctgcactggagtctcacagctgaggaggctgtccgatttgcgaatcattcattcctcatttatactttagatttagttcagctgaagtttgtcttttattagggaagaggggagggtttgttggccagaggagttgctcctcctgtggcagtaccaggtgttatgacctgaatgtttgtgtctccccagattgatacattaaaaccaaatcccaaagttgatggtgttagagttagagcttctgggaggtgattaggtcatgggtaaaactctcatgaatgcgattaggacccttataaaagaggccccagagagctttctctgctctttctgccttgtgaggacacagccagaagatgccacccctgaaccaggaagcgaccttccccaaaacccaacaaggctggcttctgatctcagacttccagcctccagaactgtgaaaaatgcatttctgttgttcatgagcctgtggtgctttgttatggcagcccacatggatgaagatgccaggcctggggatttgcaaacaccactttaacacagtaacctccagaacgcccctgcccttctctttaaccacaccggtcatcagagtcgcaatgacatttattaaaagatgcctaaagttagacacaactctggttggagggagaagaacttggaggagattgggggaaacctcccgctctccaaaacatttctgtgggatccctggttcccaaagtcagacagtgctgaggctctgggtgggtggtctcttacactgggttcataaccctcgccaggaaaaggctgctccaggtgaagtggtcgaagatcatgatgatgaagggctggttgaaacgcaagatgataggcttggacgtcaggtttagggtgaccccagtggagccagctgtgtccacaccctcctcattgagttgcagcacagctttatggaccacctgttaggtacagaatgaagatgggtagtgagacctgctgtgcgttctcgctttcctgactcattgctgggacccttcacatccttggttttaggaaggtaaatccagggtcagagaaggtcacttgctggattcttatccaagtggcagccccaggattacacagcccaagtctgtccacctccagaacctgggccgcacctacacttcctattcaaagggcagattgggcccatcacatggagattagaagtctcatggcttgaactgggcttcactgtccatgttgggcgcttcttaccatcctggggtagcggagggagatcttgctccctttccactctgctgggtaaatgctagggttcaagttatgcaaagtgcctatgtctgttctgtttgggaaagctgaggcagaatctaaaaatgtaaatctttgactgttgatatgtccttgttgtgatcaaaattaggaggagttctgaagtcagcaaaacgtctgcctagcttgtatcaaaagactctggtaactcataacctggctaaataagtaacaggtgatattggtgagctcacaacaccctaaggggtgggaacttccagcgactctttccagcaagcacactcaggctctggtggctctgtgagtggcacccatggctaggaagaagctgagctgggattggaacccctgcagtgtgtcttgagcagatgaggttttgagtcaacaggcctgagatcaaacatcaaactgttatttactagctctgtgactgtggggaagctgcataccctccctgagcaggagattcctcatctgagaaattgggataatacctgccttctgagaaggcagctgtgttgactcaatccactcacacagcacgcattttactgagcacatattacgtgccaggtaccacggaggccacaaagtcctgtgtcttgaggtcaggggccacacatctgagtaacgggggcatacacagggcctacacagtttgggatatatagtaggtgttcagtaaacattttctgaatgcatgaataacagaacataaagctgaaggatttatgtaattgaatggatgtaattgggtagaaggctcaatatgatcccaattagacatttaccacttttcctgtttctttttgccaggggccactcacagctctgccatgacaacttggttttcacagttcccctctgtgtggtctggtgggatgggtaggtgcctggcctgtggccctcctgtgtcgacagcttcctgtgtgatcttggggatgtcatgttttcttgctgagcctccatttacctcatggtgagacaaggggctttgactcaacctggggttctcagccagggacctagaggctcattcatgaacgaactcagtgccacttcctagtattatatttatattgtgaattttggagggggaagaaaaggtgggttcccatgacatttacctttgatgacttcagctgggcgtcctgggtgatgcgtgagaaatttgcctggttggtgaacaagtctgcaatgcccatttcctccagcacatctccgaggtcatagactccagagatggtgacctttggaatgtacaggtccacctggctgctcggggtaagcagacagagttagacattccagggctgggcctggcagaggggagagcagcacctcttctcctggccagactcttatttcctcatgcgctccctccagctcctgccctccagcctgacttgctctttgtgggtaggagaagggacagagcaggaggcaggatctgtctctgcctccatgacacaggcagctttcccacggggcctctgaattgcacattcttttcttctctgcaattccttcgagctgattccacctgggatgcagctggaccatggagcatttaagacaatagtccataatgaagcctttttagtcccaggagaacccctgctagaagcagaggactggagggagtgcccagctgggagcagtggtccctggctccagctgtgccactaatgctgtgtggcctttgccaagtccagcccctctctgtgctaatgtcctcacctgcacacaaaggtggttgaacacaggctctcccagggcaggtgggtgcgaaatctctgtgattctgcaagaatctgattcagctggcagtttctaccagatgaagcaggtggggtttctagaaaggtaagtggggtcacactaggggcagcacgggcatctacgctttttaacatgtcaaggccttagtgttatttttaaattcttcttgtgccttctccccagagggagagcagatgtctaaaacactgaaactgaggggtgtcagtgaactcgcaccggctctcttggcagatgggagggaaggcacgagaccctctcctcactgagcaaaagcagccctgagtgaggcccggaggctggcaaccatcctgcgtgaagtggaagccgcccttttctaaaggagagggagaagaaccagaggcgagtcggtgtgtaccttctccaggtgcggaaatagtaacagaaagaaaggaagggagaccaatttatcccaaacacctggtctatgttctttactttttttttctcctctctctgtctctctcacacatgcatgtgcacacacacacatacgcacctatgaagtcggaatcaacatctttaatttccaggttgagagaccaacacttaagagaggttgaggaattcccccaaagtcacacaactgggaggcaacagaactgaaaaggccaggactagttttgccatctgccgcctgctgcgttgttgacagctctctgagagcaaggtgatggggctttaagttatgtattattgattaatgttgctcacattgaagtattttcatgaaaagattatttttggtgtaaagaaagatagatagtccttcccgtcattttcagtggagtatgagctggaatgcattgtttgcatcatggtgcgttatcacccccttgtggtattacacctaaattacaggttttctttggtgggtagaaaggaggaagagatggcaaatggatccctagcatcgcccagacacaggttcacacccacgcatatatatgtgtacacactcaagcgtagttatggatggtttaagaactgtgtcctccacatagctataggggattgctcagaaacacagggctgactacatgacttccctacaggagagaagtcaaattcccagacacttccatgtgcattcacagaactggatgaacttctctagaagcacccagcatcaaatagatctctgaaggtatcattcaaaatgaaaacaatctgaaaccataaaccacaaaacctacatgttaataaagtagaggagcttcctcctagattatctactgcaaaatttttagaccacaacatttgtccaagccaaatttgtcttcattactgctggccctgcattgttggcactctgggcatggtcccctgacttcatgtcgggtctggaggccacttccccctggctgaacttccattcacactcaaagcagtttcaagggaaaacaacctgctctgcagcccttccccattcccgggcagagtcaggcattcccacctcccaaccagtggcatgttacatatctctgtctgtctctctcagaactcacattgtcgtaccactattaattccaccagaatctgttttctgctctagagtgcatgtctttaagggctctgttttgtcctattcaccactccatcccctgtgcttagctagggcatggtacatagcaagtgcttccgtttatgtgcattgaatgaatgagcgaatgaaatgcacattgaatgaatgaatgagtgagtgagtgaatgaaatgctgcctgatccaccagccttcctgagctactccagatctacattcccactctctcctcagcatcccccctgcttctgagtctgcatcagcccccctgccaccaggtttcatgctggttggcattttctgacccttctgcacagatggaacttgaatctccctgagagtgaggaccatgttctaagaacacctccttcctcctttaaggtgaggagcagggctgcgcacttgcatgacaataatttcaattactgtctagctcaggggtgcttagggggaaaatctcatttgtttgtgcatctgtccatccatccaaccatccacccatccatccgctcactcatgcatccatttacttattcattcatccattcatttactcattctccattcactcactcacccatccattcactcactcaccattctatgcactcactcaccattctatgcactcactcacttattcatccattaattcactcactcattcattcttccatccattcactcacccatccattcattcaggcattcattcattcattgctgactcacatcctcagctgaccttgcctgagtgtcaaccctgcaccagccccttgcttgggcctgaggtcagagatagagggaatccattggccgcttctcctcctggctactgcctcttcaggatatgcagcccttgctttctttctacttactcgcttattacctactttagccttgctttcttagttgtttactgatgattgattgattgaagagttagatgccctgagtaacttaagaaccattcatagattttgcattggctccatgatgtatacatttcattatcattttcattatatttctatggggtcttccaagaatctttagcagggcgtggtttcaggtaagcaagataacaaaacagataagtgtgtagctgggtggttggtgaacttactttaagaaaatgctacaaaaatatgacaatgcagagggtatgtatgaacctcacagggaaagggaacctcactctgtgaaatgccccaaagtatttcagtgttgatggacagatcaataaataagcgtgagctctagattagggaaacttacagcctttgggggcccagcagacaggaaaactgagccctggagggtgagtccagggaaggaaggatgccccagcatactccctttccacgtgccccactttctggggacacgtgcattgcagaaatcaacatgatggctggaggacttacctgctggtcaggcctgcggaccacctgttaatcgtgtcccggctcagtgcagcgatgactgtgttcatcttccccttgtccggaaggatgaagaagacagtcccattgcccacgtagttcatctgcaccagctggcaggggagctccgagtcatgaaggtaactgatggtgctcgactgcaacatcatgggcaccttcaccacagttgtctcgtccacatagaagttctcctccctggtgcttgccaggtcaaagggctgtgtccatgtgcctaggaagaggaggagacaggtctgtagggcagagaggaaaacacagttccaggtgatctcacgggcctactatccaagtgacacagtggccttctgcatgcttggaatgtccccattcaagcctcaagggtttttaggtaagatataaaaattcccagaaatttaaatcctgtttcatcctctacttcttggaatgggttgaggatgagctctgtttctgagactggcttctaaacaaggaagtagggagagaccaagagggtactggtccttggatttgggggtaggtcagactgtgccttggctccccatgcctagagtgggtcccagttctgagggctctggaagtggtgctagacctcaagtctcaaactcagagtccctggtgggaagcgagggggccatctccacccctgccagcctggccggcccagctgaggctcctgaccctgctgaatggtccttccttctaggccacgttgtcctaatgaagagtcagggtgagaagactccttcagggtcacagactcccacccccagcaggccctcaagtcccatctaccatgttccagggtgccaccatccagcttgtttttttgccttgagatggagagctcactaccttcacagatgggacttggcggtactcgtcagctctgatgggaagaaaattgctcctcagactgagccaaagcctgcctgattgtccgccaccagcaggacctcttctgttcttctgaacttattccagacaactgagtccacctgcaggaaacttacctgggctgagtgtcacagggtctctctgctctaggtgacgtctccccagtcttaaagtgatgactgaggcccttgagtccagcagatcccaggtgtcctggctgccattgaccacaagccctgaagcccttgccaggccaccatttcccagcccaggctccctaaaggtggccagaacatcactccaggtagccctttctccatcctactgtctgtgggatctatggattgctcagccaaaattcttggttctaagccagccacaaaccttttgtaatagctacttatggagacaacagggagaggctgatggatgtagagaaatcagccatggctgcggagtctagagacaccagagctatgctggtcccttcttaatgacctcactaaccttgatgtctgcagacactggccaatggtagtaaactcaccgtccgtctgtctcacggcaaatgagattatttgagggttctcaaatcatcctccaaaggaggtctaaaatcctcagaaccagagggcagttgtattttgtggctaacttacagcaaaaaaacaaagtgggtaaaatatttttcattgttaggtttttttcgtccttaacattttgctgcttgctttttatggagtatttcttttctaggagtaagcataatgtatatagtttgacacaaaacaaaatacaaaatggggttcagcctctactttaagggatctattctcaaaaagttctaggagaattggtggtagagaaagaatttattggggacgatctgagagagcaaggatggctcctctggaaaatcttttaacaatatttttaatgttattaaaaaaaaactgtcaagaaagtccgataaataacacatcaggtgctgggtgcggtggctcacacctgtaatcccagcactttgggaggccgaggcgggtggatcatgaggtcaggagatcgagaccgtcctggctaacgtggtgaaaccctgtctgtactaaaaatacaaaaaaataaaaaaattagccgggtgtcatggcaggtgcctgtagtcccagctactcaggaggctgaggcaggagaatggcatgaacccgggaggcggagcttgcagtgagccaagattctgccactgcactccagcctgggcaactgagcaagactccgtctcaaaaaaaataaaaataaataaataaataaataacacatcagggccattttacatattctacatttagtgataatacctacactaatcttgatttctgtttattatcctggcttgctagaaatatttcagagtattttgccaaaagttttaaccaaacactcacggattcgttttgttgtattatagaaaatctgtgtacaatgaggcatttcatctccatcaatgtctggtcctgcattcaggtgttccaagtttctctgattttgtaacctaaagctgtgatctcctatccacttagccccactgtggtcctgaggacactgtgaaacctcgtacagaatgacaccaggccagcacccgttccaccaacacccattccaccacatgtgctcaggcatctctcaggctcaggagggccctccctgcacctgggtttactgtgccttttccccaggttgtgttgcctgaacctctgtgcaaccactgctgagcttgttccatgcaccaagcattaaacaagggcactggaatctcccaaagagacaaagataccctgcacaagagtgcacagtctcgtgggggagatggtctatggaatttgtgggagcacacagaagagtttctgggcaaatgttcccagcctccctggccctcccatagtcaggtgttaggaaggctgcctttgcctggtcagcctctcagcctcaccatcctgcgaagagggcggcctctcctgggagttcccagccttgtgctggagagcaggaaagacccagaggcaggtagagaagaaggactcgtagagatgctaaggcagtccaggcagtaaggaggtgcgggatgggaggggaggtgggcacagtctgatgggaggtcctgagagagagctggggaggaggggaagggggcatgaggggtcctggctggggatcacatctcctctgatctgatgatcttgtcgagagacacatgttcagtagagatactggcttagtttgcttattttggctgttttacctgcattcctttgaatatgattgcttaactgaaactcaaccacctgggtgctaaacaacatgttatggcaagatgattgcccaaacaaggcatgggcaaactgttgagcatgcatatgagggcaaagtctttcctgggtgactctggggaggcttcacagaggaggtgacttttgagctaagatttgaagtgagggaagatgttttaggcagtcagataagttgcaagagggctcatgagacagaagaggcctgggctttgtggcaggcagaataacagccctccaaaatgtccacattctaatccccagaacttgagaatatgttagctttcatgtccagggggaattaaagttgtagagggaatcataattgctaatcggctggccttgagatgggcagcctattctggatcacccaggtgggccattatccagtgtaatcctgagggttcttgtaagtcaaagaggaaggcaggaaagtcagaatcagagagatgtgatgagggaagcagaggtgggaatttgcaattactggctttgaaaataagagaggcccacaggccatgtggcttctagaagctggaaaaagcctggaagtgcattcccccctagagcttccaggtttttatgaacaggaagattgaaaaactgaagcaggacctggtcagagcagtgtgtgcaggatggctttgggggcatctgggagttcccaaggggctgggtggggttctgtctagttctaggccatttttccagtccctggcccagtgcttgacagtcagcatttgtggagcatgaagcagccagactgttcatggttacaggtgtgggcctcaaaccaacctgccagaatgtaggcacattgttcaacccttctgggtgtcattttgatcttttgtaaaataatataattccacctacccagcaggattgtggtgaagatggagattcccagatgtgtatgtgctttacagaatcaaagactttgcccaagagtgtgccctggattttagcggctgttattcctggccatagtggatgggccttcagatggggatgggtgggaatacctttgaagaagatatagttgaccaggacgaggatggctgggctatccagccctgaaaacaagtcgacaattttcccctgtgtcttattcttgacatagctgttgatctgtctgctggctgttgcccagtcctggaaattcatagccaagacctctgactcatagtagtgcttgatgtctgctgagaatgactccagcaactccaggctgccatcaagaaacaaggcattgcccatggtcatttctaagctggtgtctgactttgcaaagagttggtgcaggtgctggaaaccctggtggatctcagtctcagacctctcagtgaggttgaaacccaggccctggagaagctgggcccgtgtgtggccacaggtgcccagggacagcatagctaaggccatggagatgctcacaggggagatgaaaatgttctttttgggactcaaggccactaggtgcttatacaggctgaaggcaaagtcaacgttggctgaagccaggccccggtgatggttactcatgttcacataagcagcgttaggatccatggcctggacggtccagaggccgctggtgggcagccagagaagacaggtgtacaggaggagtggcattgtccagtatagccaggccctgccaaatcagaaaagcttgttagatgctgtggcagtctctgagtcaatggggcgtagtgcaagaggaggcaggcaaaagaccccattcaagccccagttccttcctccacactggctgtgtgacctggagcacatcacagagggcgctggacttcagtttcctcatctggagatatgaataacagccgttatgatttatccagtgcctgacaggtacccaacactgatctaggtagtctggctatattcagtcatctaaccattaccaaaacactcctaaagcaagtattattaacatgattttaggcaggcagaaataggtgctcagaaaggttaaaacccacccaaaggatatgttcaaaatgctggaagaaaagcaaaacacaattaaagcattcccagaaaaacaaaagctgagtaagcttttttccacaatacctaccctgcaagaaatgagaggcattttatttcggattgaaatgaaaggacactggacagtaactttaagctgaatgaagaaataaaagacctctggtaaaggtagatgcgtgggcaattataagttatgtttttgggcacatgatgtgtagatataatttgttacatcagtaactggaaacaggaacagagctataaggaagcagagcttttgtatgctattgaagtaaagctggttatatcaaatatactatggactaaatgtattatgagcatacatattacattttggtttaatttattttctctattgtttttctattcttgattttatttatctctgctctaatctttattatttccttccttctgctatttttcagtttagtttgctctttttctagtctctaaattataaacaaagactaaaaattatttttacacattagccttctaaaatatgatccaaatatatgctgtctacaagagactcattttagatccaaaaatgtaaatagactgactgaaagtgaaaggatggaaaagttaccccatgcaaatagtaatcaaaagagagcaggggtgactacactaatattagacaaaatagattttgaattaaaaaagttccaaaagacagggcaatgacatattaataaagttttcagtacagcaagaagatataacatttttggttcttcatttcctatattactgtccttttttgtatttagtttttgtactgaaatgcttttttgtattgaaacactttaataattctattctcatccctttgtggttattatggggattacattagcatcctaaagttaacacctgaatttgaatatatgccattgtttatttgagatcttcttgtttttaatgtgtttacagctttacatttctatcatcacactgctttcactcattccataagttttggtatgttgtgtttccattttcgtttgtctttaagtattttctaattcccctggtggtatcttttttgatcctctggttgataaagagtgtgttgttttttccacaatttgtaaaatttccagttttccttctgttattgatttctaactgcatctcattgtgattgaagaagatacttagtatgatatctgtcttttaaaatctattgactcttgatctgtggcctaacatagggtctatcttggagaatgtcctatttgcacttgagaagaatgtgtattctgttgttgtagggtgttctgtataggtctgatacatctagcttttagtgtgatattcaagttctctattttcttacttattttatgtctggttgttctatccattattgagaatgagatattgaagtgtctaaattgctgtagaacgatttcacccttcaattatgtccatttttgctcaatttattttgtcccagacacactcaaaaataatgttttaccagctgctaaggtttgaatgtttgtgtccccacaaattcatatgtggaaacctattcatgggggctctaccctcataaaaggaattagtgcctacataaaagaggcctgtggcagtatttctggaagaaattggcatatgaatcagtggattgagttaaagacagccacctttaccaatatgggtgggcatttttaatctattaaaggctgaatggaacaaagaggtaggagaagggcaaattctctcttctgtccctgagctggacatctgtgtttaccagccctgaacactgggcctcctgcttcttggacctttaaactctgggacttaaaccagcagccttattaggcccttttcctattgtggagctgcaccattggctcctccggttgtcaggccttcagactcagactgaattacatggctggctttcctgggtctccagcttgcagatggcagattgtgggacttctcagcttctgtaattacataaggcaattcccataatgcctcctcttatatatatttctatatatcctatagattctgtttctctggagaaccctgactaatataatggattaaattaattttgagagcctactaataggattatatgccatacccaatttggatttatttctgtaatgcaaggatgtttcaacatacaaaaattgatcagtgtaatacatcatattaacaaaataaaagaaaaaatcacatgatcatcttaattggtgcagaaaaaagtatttgacataattcaacacaccctcgcatgataaaaacacacagcagattgagacagtcaagtgtaaagaggtgcctggagaacattcagttggcctgcacactgggagaatggggtggagctgtgggaagtttgtgccctttgcagcggggaggagcttggcctctctctcctgatccgatgtggtaatctggggattcagtcagtcagatgagggcctgttaacaggactctctcttgctttgctgagttgttttccttttcacccaataaattccattttattcacacctcaaagtgtctgtgagcctaatctttcatggccatgtgacaaggaccccgtgtttagctggactaagtagaaagtcctacaacaaaattagtaatagaagaaaactacctcaacataatcaagactacgtatttataaaaccttttatactcaatagtgaaagactgaaagcttttccccgaagatcaggaacaaaacaaggatgcttgttctcactacttttacctaatatagcactggaatttctagccagagcaattgggcaaggaaagaaaaggtatccatatttgaaaagaagaagtaaaattgtctgtgttcacagatgacatgatcttatatgttcaaaaccctaaaaattctatagaactcataaacacatttagcaaagttgcaagatataaaatcaaaacactaacatcaattgcatttcccaccactaacaaagaaaacaatttgaaaaggaaattgagaaaacaattccatttacaatagtatgataaagaataaaatagggattaatcagggaggtaagagacatacactgaaaagtacaaaacagtgctgaaggcaattaaagaggacataaataaatggaaagacatcctgcattcatggattggaagaaattgctaagatgataatactatccaatgcagtctatagattcaatgcaattcctatcaaaattccagttctgtatttcacagaaatagaaaaatttatcctaaaatttatataaaaatctcaagggacctggatagccaaaacaatactgaagaagaacaaagttgaaagtcttgcactttctgatttcaaaatttactacaaaactataataatcaaaacagtgtggtactggcataaagacatacatagagaccaatggaatagaatacagaacccagaaataagcctttcatatgtagtaaaatgattttgacaaggatgccagaccattcaatggggaaaagacagccttttcaacaagtggtgctgaaaatttggatatttacatgcaaaataatgaaattggacctttaacaccatatacaaaaattaattcaaaatagatcaatgacctaaagatgagttaaaattataaaaatcttagaaaaaaacatgggggaaaaacttcatgatgttggctttggcaatgatttcttgaatatcacaccaaagccatgggcaacaaaataaaaaataaacaaattggacttcatcaaaattgaaaactttgttcatcaaaggatactatcaataaagtaaaaatgcaactcacagaatgggaaaacatttgcaaatttcatatctgataaggaattgatatccaggatatataaagaactcctaaaacccaagaacaacaacaaaacaaataaacccagttagaaatgggcaaaggacttgagtggacatcttttcagagacaacatacaaatggccagtaagcacatgaaaagatgctcagcatcactaatcattaggaatatcaaaaccgcaatgagataccactttgtatccacagggatggctactaacagacaaacaaaacagaaaacaataagttggcacaccaggcatgatggcccgtgcctgtaatcccagctactctgaaagctgaggcaggaggaatgcttgaggccaggagtttgagaccagcctaggtaacatagcaagatttcctttaaaaaaattttttttttaatttaaatgttagcattgcatgtggggaaattggaacccttatgcattgctggtaggaatataaagtgctacaatgtgtggaaaacaatatgacagttctttaaaaattaaacaaattgtcatttgacccaacaattttgcttcgagtatatacaccaaagaactgcaagcagctagtcaaggaacttgaaaagataattgtagaccaaagtcacagcagcattattcaccatagccaaaagatgaaaacaacccaaatgtctatcaatggatgaatgaataaacaaagtctggtataaacatacaatggaatactattcaactttaaaaaggaatgaaattctgacatttcctacaacatggatgaacctggaagacattatgttatgtgaaataagccagacacaaaaggacaaatagagtctaattctacacctagagtagccgaatacctagggacagaagtaaaattgtggttaccaggggccggggcaacgggagattggggagttattgttgagtgggtatagagtttcagtctgggatgatgaaaaagttccggacatggaaggtggtgatggtggcacaacaatgtgaatgtacttttatgaactgtatgcttgtagttaaaacgttaggtattatattttcccacaatacaaatttaaggaaaaaattaaatataaatgatttaaaaagagttccataagagcaattaaaaaaaatccacccaaggttggaatcagtcggtggacactgcctgcctgcaaggttagtggtttcaggccctgtgctgtgtggagctacctgtatcacaataaatacaggatgcttacaggagaagcaggtcttactgcaccacccactgttgaaccagccattctgggtgaggggctgggaaccctcatttaaaccagtgctccaggaggttgtgttgtgttaaattaaattaaagatgggctaaagctgcctcctcatgtagcaaactgtaacctagcttaatatgtaaacaaactgcacctaacttgagagtatatgtttgtaacaagtaaccaagtctcagccaatcatagcagctgaactttcagtcaatcacagcctgccaactgctcagacatgttcaaacaaggcaaacacagagctgtaacctatcagcctatgtgtgtatgtcacttccttcttctgcctgtaaatactgcctacgttgctgggtggcactctctgaacctttactggtttagggtgctgtgtgattcatgaattgtttctttgctcaaataaactctgctacgtttaatttgtctaaagttttcttttaacaggtgcgctccgagcgtgggaaccactgttctgctctggaattccctagaggccccttccctggtgtgttccaaaagcagaatctcaagaatgacaggtgggaactcccccgcaaaacccttagttctcctgagtctcccaaaaccctccttgcgtgtctcccttatctcaccagggtggaaaacaacccctgttggctgctctagcccctagttctctgctttagataatagaggcaggtgtgacctgctccccactccccgcacccaaatgatgggctttattgaattctccatcgggtttctgacttggatttctgggtcctcgcgacaattcttttgtcgcgaaacccagaaaagatcctgggtttcgtggcagatcaagctggattggggccctagcactgccatgtatgaattaggtgatgtgggacaggctacttaaactctgcctcagtttccacagtataaaatagagctgataataacacctctagccttacccatttttctggtgtttgtctattctccagtgcctctgcacagcctcctcatctctctcaggactcagcagtagcccctacctcgtctccctgcctcctgttcaactccctccagcccttttacccatctgcagctgcatctttttaaattctcaaaaattcaagctgatcggttctgctttgaagttttcagggactccccattgcccaccacagggctgattctcactaatgtagcccagggggtctttgtgacccagtccctggtgacagttctgcctccagcctcaaatctggccctttggggtctcagccacagcaacactgggtgccaggggttcttccagcacacatcagccttttctcccactgtggggcagggcagggcatgtcacatcactatagggcaggttacagcaagacaggtcactgcagttccccagggcaggtcattttgatttttccatgtttgctgagcccagctctggactgggagcagggaacaaagatggatctgcctcagtcctgcctatgtggctccagtctgtaggtccctcatctccctgcctcatctggctcactccatcttgtcctttgagactcaggtcccaggtcaccgcctccaggaagccttgtatctgtgcttctctatggccttgccccatgacaggcagtgaaatctttgcttagctttggtcactgccatacctatctgggatctcctctcaggcacaggccctgtgcggtatgatgccaatggtaggatgggctcccctgccagctctggggagattgcatgtctcaccttctcctgcgttaattctctaagatgagggtgaaaactccatccaccccacaatattgttgtgaataccagacgtggctgttatcagtgcttggcttatgtgacctcacttaatgggtcatcctggggcccattttacagatgagaaaactgagatccagggagacagagtaactccccctgagctggaattctaagcctagatgtctgacatcggagcttgtgccatgccattctgcctatctctacagagagcaaaatgatgagtaaagcagctcttaagagtacccagccatggtcaggtgtggtggctcatgcctgtaatcccagcacttttggaagctgaggtgggcagatcatctgaggtcaggagttcgagactagccttgctaacatggcgaaacccatttctactaaaaatacaaaaacattagctgggtgtgatggtgtgtgcctgtaattccagctactcgggaggctgaggctggagaatagcttgaacccaggaggcagaggttgcagtgagccgagatcgcaccattgcactccagcttgggcaacaagagtgaaattccatcttaaaaaacaaacaaacaaacaaacaaaaaagtacccagccatataaaaatgcagagtatcaatattattcatgcatttcatgtcaagtatgccctctttgttcctcatctctgaagagactcacttagtaaatattcactgtgttctctgttttcacaaatgccctatgagccaggcacagttcttgaccttctgtagtgaaacctcatgacatgtggtacagtgcagacagttctgttctctgtgcattatctctgccccaggtcactgagtgaggagccatggtggagacaggtctgcgtgactcagaagaatacccctgcactgggccagctgagccctcccaggccctgacccgcggccagcatccttcatcggtggtgccgactggagcagatgcattgtagcttgcaggctgcgactctgtggctgttgtggctgttgtggctatctggctgggcttaggagcatcaatcatggcagtggacgagaatggttcttagctacagccctctgtgtcagccccctgcatggcaggaacccaggggacatcggaacccctgtggatgactcacagactccggggtctggaaaatcctaaccagattgcctcataacactgctggctgccctaatgttcaatgtgccctttaaaaaaacaaagcatctcaacaaaccaaacaagcgagctgcagccatggctttgctctggaggctgggcagggggagggacagagggttctcaggtgttactcacagtctgcggtgggctcaggctgtttctgctggcttggtcctgctgtcctggaccctagcatgtgtacagtaagcctgcggtggatgctgcctgttaaattttgtttgccagcttcctgggtggttaatggttagaggggccagtggccttcaccgcttggtagtcctctcccccgagtcattaaccaatgggaggctttgtcaggatagctgagtaaacacagaaatgctgcaaattaactttgctctgcgttcaattctatgaagtctttttttaataccaaaatgtggctggagttgcatcaatgtggttgccctgtgtcagttggcagagatgtcttaggtgcccttaattagcaccaaggtgcagatacttgtaaaaagaaaaataggtgtttagctccaattggggatgacttgggcaaggtcctgccttccagtggtcttagtctggtgggagagacagacatggaataatatctgccaagcgcttcctctggattatctcacgaaatcttcacaatgactctgtgaagtgggtaccattgtcactcctctttagataggaaactgagctgcatggaagttaagttaaacgcccttgagattcaaatccaaggccattcaattctaaagtctagcaccttcccctttccccacattttatttttcatcagttttctttggattacaggtgacagacatcaaatttgaactgctttaaagcaaaaaggaatgaatgagaggtccaagggtggaaaggacttcaggcatggatctacggagttctaaatcaggcatcagatctctccttctctctctctctctgtcttttttttttttttattccttcctagctctgctttcttctactttattctgtctgcattggggacaaatgtggccacagtagctctgggttatttagttctaactggttagttgatatcagaaggagagaaattctcatttttctcaatgttcataacagttccccccaaaagtctatggcgtggttgccccccttaggactgattgatcacagtgtggagaaggatgaggcattgtgaatgcctcgctagggttctttgctctctgttgggttgacagcatcattgcttccatccagagatgagggaatctcttcccaggggaaaagaggagagtagagcctacaaatgggtctgcagttttggagacaccttagttttgtagatgtttattggtcttttcaagtttcctatcctataaggcaagtttgaactttatatctaggaatttatctatttcatctagattttcaaattaaatactacagttattcattaggcctctccattattatttttacattattattttatatcagtaattcttttttctttttttgttctgtattttgtttatgtcttttctccctttgataagtcctgttacagagatctatatagctaattaatctttccaaagatccaccttttagttttgttactggttttttaaaaaattgatatttcattgatttctgtttatatctttattttttaatcacccctttaaattctctgggttttggtctgttgtgcttttttctattttcttgagataaatgcttagctttcttacattttaatatttccagtctccacataaatgtatttaaggttacaagttttcatctaaatactgagtgagctatgtcccacgcatttttgataattactattttcattgtaatttttttctaagtattttaaaatttcttttctggtttcctttaaaaccagagtgtagtttagtaatatgtcactgagtttatttagaattttaggctattctcttgttattcacttccaattttatttcactatggtcaaagaatattgtccattatgatattgaacatttggaatgttttgaggtttgtaatagccatatatggtctttttttttttttttttttcgagacggagtcttcctttgtcatccagtctggagtacggtggcgtgatctcggctcactgcaacctccgtctcctgggttcaagggattctcctgcctcagcctcccgagtagttgggactgcaggcgtgagccaccatgcccagctaatattttttatttttagtagagacagggcttcaccgtgttagccaggatggtctcaatctcctgacctcatgatccgcccgcctcggcctcccaaagtgctgggattacaggcgtgagccaccgtgcccagctcatatatggcctattttaataaacatttcatgttttctttaaaaaataatggatatctgtttgatatgtatatatacacattcatatatgtatatatgtaataacttgagcttattttatttaaatcttcatatttatgttgattatttatttaagctttcagtttctcattggggaatgttaaaatcaccaatagcaattgttcacttacttctcttggtcagttgttgcttgacttacttcaagactgtatattaaagcacatatactttcgataattatgtcctcttgtatttgtttttcttgtatctttttttttgtatagcatacttttgtcctaaatttaattttatacagtgttatgattgctttcctttcttttggttcactcttacctgatatttttcatccttttatttccaaagtctctgtgccttcttttttttttttttttttttttgagatagagtctcattctgtcgcccaggctggagtgcagtggcacgtgctcagctcactgcaggctccacctcctgggttcacgccattctcctgcctcagccccccgagtagctgggactacaggtgcccaccaccatgcctggctaattttttgtatttttagtagagatggggtttcaccttgtcagccagcatggtctcaatctcctgacctaatgatccacctgcctcggcctcctgaagtgctgggattacaggcgtgagctaccgcgcccggcctgtgccttctttttttaagagcgtctcatgtacaaaacatctttttagatttagctttttatccccaaaggagggtctttgtctgttaattggcaaaattaacctttttacatttattttaattgtcttaggattgacatattatcttattttatatttcccatttgctatatcttatttttgtttttttttttgtgaattttactgacttacattgaaaagattgagttttattccattgagttaaaatatattcattatatttttgatcttatgatggtttctctttactaaaaacactaaaaccaagtttagtttagtttgataaactaatactttgctaaaaacactaaacccaagttcctagccatcatcaaatagagacaagccatccccactgtatcttttctgaattcctgtcccaagaacccaaaagcataaaaaatgattgtctcaagctggtaaatttttggataatttatgaggcagccatagtacctagaacacattttggcacctggaagtggaaagctgcatatgaaagccaaacatgtggcaatgactttgggatcaaatcagagtcggaaagtccttataaagattgtgagtggaaacgtgatgacccacaaggaggccgttgattagggcttaaaggaaagtgagaaacaggctatagctagaggaaagagaatccttgacatgtagtggtagaaagtttagcaacattgtcacctgtgataacatgaaaattgaatatatagcaaatgaagtggtggtatagctggtgatatttctctgaagctaagaaggtctctgaagttattgtctgacttctcgatacttatagtaaaatgtgagaggatatagataagcttaacatttttgttaaatataaaagagccagcgcttattgggttaaaaataatataatttctccttcttagtctttccaggattacccaattaagaaagaatttcaaaacaaacatatatctagggtgtaactgtaaaagcctttataaatacctcagaaagttctaaggtgttgccttagcagaccattggatcagatataaggccctctaacgctattttacggtcaatgttccatacgaggtttgtagatagccaaagatatagaaaagcttatcttgaaaagattggtggttgtggcctttattatagtggagtggattataaattaattcatataaaattcacaattaagaaattagctttgtctgaaaggggcaagacagtgcaaaatgatgaaaggcctttgaactttcaaccttctacaggcaggaaacaggatacagaggctgagcctcaaacatgaggtatttttatggaaaaggaagcgtgacccaggcagaatcaagatctcaaaagacacagcaaggggccatggtgaattatccccaggagcagattgagagtgccaattgttttaaattatgtgtgtctcacaattttatgttgtgtgtggagaagtgggaggagagaacttgtctcttcccttcgcatcttcttctctcaatcttctctcttctctcttcaatcttcaatcttctctcaatcttcttcagattgagagaaactacacacttcaggaaggacgtttaaggacgctcctctgtaccgtgactgatttaagtgagggtatctggatttcaaggaggtgttgcagttggatgagactttgggagtcataggggaggtgggtgtatttttcatgtgtgagggaaaatgaattgttgaggccatagggtagactgcagtgttttttctccgacatggctgccgtccttccttctttccctctgtgagtatgctgcaccatcatcaagagatagagtctatttctcccttcttgtgaatcttggcttgttttactggctttcttgactaatagaacgtagaagtgatgtgctggaattttcaaggctagttcataagtaatctcccagcttctgtcttgggctcttggagccctgagtcaccttgtacgatgtacaagcactctgctagagagactatgtggaaaaaccctgagacagtatgtggagagataaagaaccagctaagtcctgcctcctagctatccccaccattgtgccacacatgagtgcagctgtcttggatcagtccagcccagcccagccacctagtgaatacttctgagtgatcccagttgatgctgtgtggagcagaaaaaatcactcaggcatgccctgcctgaattcctaacctgaaaactgtgagtaataatggaattgttgttcttttctttgcttttctttgtggagatggcgtctcactatgttgcccaggcaggtcttgaactactggcctcaagtgatcctcacgtgttggcctcccaaagtgctgagatttataggtgtgcgccaccttgcccagccaagattgttcttttaatccattaaattttggaagagttattacatagcagcagataattaaaaagaaattgctgggtcatatatttagctttagtagagactgtcagacaattttccaaagtaattgaaccaatttgtatttccaaacaatggtgtatgagaggcacaattgctccacatccttgcaaatcgttggtgttgtccatctttttcattttatccattctggtgggtgtgtaatggtttcacataatagttttatacctcatttctctgatgactaatgaaactgattaccttttaagttttttaccatttggatatcatctgttgagaagtaactgtttaagttagattgaagagaagtgcctgtttctgtcatattgtctttttcttgtcaattggtaagttcaacaatcatttgccagatcaataaattgcaatataagtttgtgacttatcttttcactctcttaatggaatcttttgataaacatggttcattattttaatgaggtccaaatcatctgtttattcttttacagttaatgctgcttatgttctgtttgataaatctttgctgacccaaatgtgatgaaactttctcttatgttttctttgaaaagctttattgctttatttttcacttttaggttcgttatacatctggatttgatttttgtgtatggtgtgaggtagaggtcaaatttatcttatttcatatatatgacaccatttagtgatggtgaggattgtgttgcttaaaaatgacatgtaataaaagacaaaatgtgttacctctcagaggatactaaagagacatgagatcagtaatggtgtgatttcagaaaaggaggtggtcactcttggacagcattggcaagaagctcctcccaggaaatgggtgatcttctgaaagttctcgatgacttactaaatgcagagcttggatccttaatcagagaaaacatgtgctatgtattaaggaccttattgggacaattgaagttggaatatagatggtatgttagataaaggtatcagtgctaaatttcctcaggttgataggtttactgaaaagtaatatctcaaaatcttagaaaatatacactgaagtatttaggggtacagaggtattatgtatacaatttattctcaaaatattctgaaaaaaattgtacatgcacatacatgcatgcatacatatgcgtgtgtgtatgtctcggggagagaaattatgtgtgtgttttttgtattatttttattcttgcagcttttctgtaggttaggaattacttccaaatacaaagttggaaaaagagaaaaagctaggctctggctcatgctccaccactgtcagcaggtggccttgtgaccttcctctctggggcatgctctcacctctggtggagctacagatattccgtgcttcatggggttgttgtgaggattgggtgatgcttgagcctagcacagttgcaagcacatgttaaggcatgagaatcactgctaagattgttattttatctcttcagtgactggtgcccaccaagtactggattctgcttgggaaacgccagccaagaccttttctttcatcatcaacctcttagccctttaataaagaagaatcattttttaaaataaaagaacactttttataagcaactttgagctgtttctcacatgttccctgaaccactggtctgtgcccaccaggccctggctagtgacttcaggtgagtgagacctgcttcctgctgaccaggaggctgggttgttctcttaaaggcagggctgcacctgccccagacatccttgcctggttcccaggtcaaatgctgctgcatctgggtctcatttgagaatgacttgctggtctctcaggggtcacccccagtactggagggagcatcttgctgaagccctccatgaagggccacccctctgcaatcgcaccatctgtaaatggtcacccctctgaaatcacaccatccatgaacggccatgcctctgaactcaaaccatccaggaatggctgctcctctgaaatcacaccatctgtgaatggccacccctctgaaatcacacaacccgtgaatggccacccctctgaaatcacactgaccatgaatggctacctctccaaaattacagctgtgctgctctgggttcaacttgcccaattctgctgagcacagaagctgagccaggagggttgctcagggcatcttgcccaattctgctgagcacagaagctgagccaggagggttgctcaggacatctgaacttcccaagccctctctaggatcgtgtctgtaggagggaagggcccaggccttgcttggcaagggacaggccatgtgaagccagagactacggtgaccacaacctctagaatgagtcttggctggactttccaagccccacctggctgtttatctgaggaatcatgagctgtattggcaaacagggatgccacccagtactagtggccagtgtgggggtggcagggtaggctgtgggtgctccaagggcctctgagttctctcccaaatcatggacttctgagctggacctggctgtcgctggacctggagcctggcttttggttgtggtggcccaagggaactgcctggatccctctcctgccaatctgcacttcaggggccacctgtactatccacagcctttgagccattcgtggaccaagcaggaccccaaacccctcttggcctcatcctctcagacaggcaggaacatagcctagatgtgccattcatttggccttagttcctttgggctacatgttcactgatgagttgcctacattgtctggatccccattctgctcctcttctcctccccacctgccagcccctgccctactctggtctccccgcagcatgtaagcactgagcccagtgcccggagtctggtgcagggagtagctggcattttattgaaccctcactgggtgccagctcttggagtgtggtgtagactgatctactcgatcctcaaaggaaccctgtgggttacgattgggatcacccagggtagtttagctagcgagaacatgggctctgggttaaaatccagacatctaagcataggctctggttcaaatccaggtgtctcagttaactgtgacatggctcagctgcatcatctgaggggtgcaaattctggcgcccaggtctcttcaggctgttgtgcagatttggtggggtcatatgtggcaagagctcagagctgcgcctgccatatagtaggtgctatatgcatgctagagattattgctgtttccacgtggcaggtggggaaactgtggcagaaaggggtagaagactggcctaagtcacactgccaagtacaggagtcagaatctgaacccaggcatcctagctaaagtccgtgctcttaccatggagctcttctgcctctgtctttgttcagcccttccctgcctagtcccacatctggccagtggttacggcattccagggttgatcctgaggaattctttagggcagacgctggggcccaggggctagatcagggtgttgagttggggtgtggagtggtgatgtgaatgctcctcattggtccaggtgtggcccacgagtttagtagccttaaaaagccccagaaacgtggggtagggcgggcaagctctgcagacaccatctccctcaggagaagctgggccaagtccccactctgcctgcctgccgctctctcaccaacttgctctgtgaccttggacaagttgcttgacttctctgaggctcagcttctttttttaaaaaaattatttttaattgacaaattataattgtgtattttggtggggtgctatgtgatgttatggtgcatgtacacagtgtggaatgaataaatcaagtgaattaacatatccttcacttcacatgcttattttttgtggagagaacatttgaaatttgctcttttagcaattttgaaatatacagtacattattaactatagtcaccttgttgtgcagtagatctgaaaaacttattcctcctgtctaactgatactttgtaccctttgacaaacacctccccatctcctccacttgcctgcctcttgtagctatcattctactctctttttccatgagttcaattgttatagagtccacatgtaagtgagatcctgaagtatttgtctttctgactgagtctggcttatttcacttagcataatgttcatccatgttgtcccaaataatagaattttctttcttttaaaggctgaatattattccattgtgtttgtttgtgtatgtgtatagaaatgctactgatttttgtatgttgatttaatattctgcaattttaccaaatttgtttattacttcttatagttttttggtggagtctaggcttttttacatataagatcatgccatcagcaaacagagagaacacacacacacacacacacaccagattttctttattcatttgttaatggatgattagattgattctgtatcttggctattgtgaacaatgctgcaatgaacatgaaagggaaggtatctctttgacatattgatttcatttcctttggatagatacccagaagtgggattgctggatcatatggttgttctgtttttatttttttgaggaaactccacac

SEQ ID NO: 1173 - DNA, 31708 bp, Homo sapiens
tggtcattttcacaatattgatcctacccatctatgagcacgggatgtgtttctatttatttgtgtcatctatgagtttttcagcaatgttttgtagttttctttgtagagatctttaacctccttggttaggtatattcctaaatattttatttttttgcatctattgtaaaagaggttgatttcttgatttgatccccagcttggtcactgttggtgtatagcagacttattgatttgtgtacattaattttgtatcctgaaactttgctgaattaatttatcagttccaggagatttttggaggagtctttagggttttctaggtatatgatcatttcatcaacaaacagtgacagtttgacttgctctttactgatttggatgccctttatttctttctcttgtctgattgctcctgcgaggacttccagtactatgttgaatagaagtggtgagagtgggcattcttgtcttgttccagttctcagagggaatgctttcaacttttacccattcagtattatgttagctgtgggtttgtcatagatggtttttattgcattaaggtgtgtcccttatatgccgattttgctgagggttttaatcataaagcgatgctggattttgtcaaatgctttttctgcatctattgagatgatcatgtgatttttgtttttaactctctttatgtggtgtattacatttattgacaaccatccctgcatgcctggtatgaaacccacttgatcattggattatctttttaatatgttgttggattctgttagctagcattttgttaaggattttttgcatctatgttcaccagggatattggtctgtagtttgttgttgttgttgttatgtcctttcctggttttggtattagggtgatactggcttaatagaatgatttagtgaggattccctctttctctatcttgttgaatagtatcaacaggattggtaccaatttttccttaaatgtctggtagaattcagctgtgaatccatctggtcctggacttttttttttttttggtaattttttaaattaccatttcaatctcactgcttgttattggtctgttcagggtatctaatccttcctgatttaaactaggaggattggatctttccaggaaattatccatctcctctagcttttctagtttatgcacataaaggtgttaatagtagccttgaatgatcttttgtatttctgtggtgtcggttttaaaatctttcatttcatttctaattgagcttatttggattttctctcttcttggttaatcttgctcgtggtcttctttttttattttttccaagaaccagctttttgtttcatttatcttttgctattttgttgttgttgtttcaatttcattcagttctgctctgatcttggttatttccttttttttctactgggtttttgtttggtttgtccttgtttccctagttccttgaggtgtgaccttagattatttgtgctctttcagagtttttgatgtaggcatttagggtcatgaactttcctcttagcactgcctttgctgtatcccagaggttttgataagttgtgttactattacagttcagttcaaataatgtttaaatttccatcttgatttcattgttgacccagtgatccttcaggagcaggtcattttgttttcatgtatttgcatgattttgaaggttccttttagagttgatttccagttctattccactgtggtttgagaaagtaattgatataatttcaattttcttaaattcattgatacttgttttgtggcctatcatatggtttatcttggacaatgttccatgtgctgatgcatagaatgtatattctgtggttattgggtagaatgttctgtaaacatctgttaagtccatttgttccaggatatattttaaactcattgtttctgtgttgactttctgtcttgttgacctgtgtagtgctgtcagtggaatattgaagtccctcactattattgtgttgctgtctacctcatttcttagatctagtagtaattgttttataaatttgggagctccagtgttgggtgcatatatatttaagactgtaatatttttgtgttggacaaggccttttatcattatataatgtccctctttatcttttttaactgctgttgctttaaggtttgttttgtctgatataagtatagccacttctgtttgcttttagtgtctatttgcatagaatgtctatttccacccctttaccttacatttatgtgagtccttgtgtgctaggtgagtctcttgaaggcagcagatacttggttggtgaattcttatccattctgccattctgcatcttttaagctgagcatttaggccatttccattcaacattagtattgagatgtgaggtagtattccattcatcatgctatttgctgcctgtataccttgcttttttaattgtatttttgttttataggtcctgtaggatttatgttttaaagagggtctgtttttatgtgtttccaggatttgtttcaagatttagagctccttttagcagttcttgtagtgctggcttggtagtggtgaattctttcagcatttgtttgtctgaaaaagactgtatctttccttcatgtatgaagcttagtttcactggatacaaaattcttagccgataattgttttgtttaaggaggttgaagacagagccccaatcccttctagtctgttctgtagggtttctactgagaaatctgctgttaatctgacaggttttcctgtatatcttacctgactattttgcctcacagctcttaagattctttccttcatcttggctttagataacctgaagacagtgtgcccagatgatgatctttttgtgatgaatttcccaggtgttctttgagcatcttgtatttggatgtctaggtctctagcaagaccagggaacttttccacaattattcccccaaatatgttttccaaacttttagatttctcttcttcctcaggaatgccaattattcttaggttttgtcacttaacataatctcaaacttctcggaggctttgttctttttttcttattcttttttctttgtctttgttggattgggttcctttgaaaactttgtctttgagctctgaagttctttcttctgcttctttgattctattcctgaaactttccagaacattttgcatttctctcagtgctctcctttatttcctaaagggttgatttttatttatgctattccttcactaaagatttctcccctcatttcttatgtattttttttatttccttaaattggacttcacctttctctggtggctccttgattagcttaataactgaccttctgaattctttttcaggtaaatcagggatttcttttttgtttggtggtgagctagtgtgattttttgagggtgttaaagaaccttgttttgtcatgttaccagcactgtttttctgcttccttctcatttggatagcctatgtcagagggaagatctagggctcagggctgctgttcagattcgtttgtcccatggggtgctcccttgatgtagtactctcacccctttcctagggatgtggcttcctgagagccaaactgtggtgattgttatctggatctagtcacccagcaggtctaccaggctctgggctggtactggggattgtctgcatagagtcctgtggtgtgaaccatctgcaggtctctcagccatggataccagcacctgttctggtggagatggcaggggggtgaaatggattctgtgaagatccttagtttttgttgttaatgcactatttttgtgctggttggcctcctgccagaaggtgacactttttgagagagcatcagttgtggtagtataggaagaaccaggctgtgggtagggccttagaactctcaagagtatatgccctttgtcttcagctaccagaatgggtagggaaggaccatggggggaggggggcagggctgtgtgtgtctgagctcagactctctttgggcagggcttgctatgtctgctgtggggaatgggggtgtggttcccaggtcaatggagctgttcccaggagaattatggctgcctctgctgtgtcatgcaagttgtcagggaagtgggggaaagccagcagttacaggcctcacccagctcccacacaacccaaaagaccagtctcactcccaccatgtccccccaaacagcaccaagtttgtttataggcagtgggcaggaagggctgagaacttgccccaggctaccagactcccacttatgagaacaagtagggctttcacgcctatcggcctgtggagtctgcacaccagattcaggccctcccttgagttctggccaggagacttcctgttcagttggaattgttacaaggttcagctgggggtttccttctccctgtggtcttttcccagtatttctggcagccctccccaagaacacccatgagacaactctgaaatagctttctgagggtggaaaacccacaggcttttcctgctgcttcctctacccctatattttgcttggctctctaaattgactcagctccagataaggtcagatccttctcccatgatctagaccttcaggtgccccagtgagggtgtgtgttcagtgacagacaatccacctttcccactttcacagcttgggcactcacaatatttggactgtctcttgggttctgcaggagcaacctccttccttcagagggtttgtgggttctctcggctttcctggtttattcctgcattagttctgaagcaaagggtgaagatgcgagtgttgaacctttgaaatttttttcaaaggtccacacagtgctctgtccaagtgcgagctgcaatctagtcttgccttccgtctgccacttttccccctcttttttttttcttttaggctacgttctttattggtcaccctcaccgcaagaatgtgagagaggcacagtcatccctactttgtagatgggaaactgaggctctgtgaggttaagtcacttgctcattaagtggacggatggggccacactcagaactgggatcctatcccccagtccaagccttcactaccacaccaaaccattccagtattttgttgatgcttcaaataaaatatgatctgtgtatgaataaaaagattggaaggggctgggtgcggtggctcatgcctgtaatcccagcactttgggaggccaaggcaggtggatcacttgaggccaggagttctagaccagcctggacaacatgttgaaaccccgtctctactaaaaatataaaaattagcctgacagggtggcgggtgcctgtaatttcagctacttgggatgctgaggctggataatcccttgaacctgggaagcagaagaggttgcagtgagccaagattgtgccactgcactccagcttaggtgacgaaaagaaaattggaaggaaatttcacaaacagagaaagacctttcttcttactactttgagaaacctgtgaagtgaaatcattggctcatgatcacccatgtctcccaagtaagtagaacaagcttagaattaaatgagtatttatttatgagagaatctcttcatgacaaaattgaagtgacttttaagttcttctttgcagatttttgtattctccaaatttcttacaaagagcatgcatcttattcataattaaaaacaataaaacattattgttggaaagtagaatgatttaatagtacaagtaaatctcatcctaaaataaaaggtcattgaggttggcacagtggttccaatcaaggcacttgtaaaacataaagtctcctaggaggtcgaacctgattccctaaatggggtggaggtgcaggtgcccatgggtctgcatttgccactcttgccttgagtgaaactttcatgcgatgctgtaatactcatgcttgatattctgtgactgatgattttgcatcttgaaatgatggcccaaactaacggccacagttgattatgttcatgccctctctgtgttttcatgggcatgcaagaatcattttacaaattctccaaccacaagcctcaacctctatacttcacttcctgcccaatagggatgtcccacctaaccactccccacactgcagtactaaagtctctggccacatgttcctctcgctcctgtgcctctggaccagccccggtgcttccccgtgtggccctgtgtggtggggcaggccccttcctcttgggtgctcaaagtaataaactcttctttcaaaggcagatgtctctgtctgtcaccttaccatacccagtggaaatgatttcaaaacaaaatgtgaggtacatttaaaaacaaatgcgaaggattggcatttcaaaaaacagagctgggacctcagcaagttgatagaaaatgtcccacggctgtttttgtatctgcttgccaatgcaagtctgagtgggcaccaggttgccacctaagcttgctttcactgtaaagtgccactggaagcaaggctgtcggagggatgctgacagccgtcacccactgctgactacttggggttcctcatagtttctggaaaaaactagttgtgaacagcaagtgtcattagtcacttcttcacacctactatctcctttgtgctactgtaggacatcttcttgcctactctgcaggaggctggagccatgtctgagcaggtatgttccttcctgggaaggatgcctggcttctccactgtggcctttataatggagagcctgagggaagagcattgtgtataaaacaaaccttgcttcaggcagcgttgcgggagcccttcataactggccattggtccttgttctaagccagcacaggaaggccctgtggcttaggttagttgtttttactctttgagtgtcagctcttctgtttttgttttttgtttgtttgtttgtttttgttgttttgagacagggccttgctctgttgcccaagctggagtgcagtggcagcttgttctgtttgtgaaataaagtgggagcgtgagggccagggggttaggttcccctgggacttctgccagctctccagcataactcctttctgttttgtttctttccttataaaatagcatgagaaagcctacatgaggcccctggcacatccgaggtgtgtggggcaccggggcccccagaagaggagcctttggatctgatgggagcaagggctctactgaggctgccagagatgccctcggtaatgggggtgacatagaggtgccagcacagcctgtcaggcaacgagggaaggagggacggtgggtctgactcaaaggacacgagctgcctttgctgtagtgcaaccgtggcccattgctcattgtgctgctctcaggactcagagtatggaagcgggaccattgccgttacaaacccgcagggaaggggctgagcacccggagggctgtgtgtgcacacatgacgttatcggagtcaggaaggcagccagccgcgaggagatgggaaactggtccacggcacccggggagaccttcacagcccacgcattagccctcgtcagccggtgtcccggcgctccccacaaacccagactctctccttggctaacaatggcctccaccagccgacctctttgagcctctgtgttctcatttcttccatctgccacacatgatgccacaaggtccctgctctgtctctccaacatgccactcattcctgactcacagccttcatgctcacacccctcccttgtcctatcctcactctcagtcatcctgttcaatgccttcatggcacttatcataagctcttacgatcatgtttataggtctggtttcattgttgctgtaggggggtctgtctcccccatttaggcctaacaggccaggaatcttgtctgtctgatttactcctaacatatgttaagtgttcaataaatttttgctgaataaatgaaggaaaaaaatcatgcagcctctgagatgtcatgggatgacagcccagccatcgcgagttcgctagtaaatcattttcagattaggactctgttgacagatgaattcatattttagttttattgaatgtgttattgtaattctgcaatagaggtgcctaacctgggttggcgtatttccattcctgggagccccaaggaatggaaatatggtaacccagcaacatcccatgaagctagttacctgggagaatttgtggaaaagggcactgactggggttaatgggtgttggcttgtgactggggtccctgttgatggtttggtgattgagccttggaagtggcatccctgccagcgaatccagctccactggggtcaaatgcaccctcagaacagaaagagggatgtggtttgttatttcttgtgcattagcaatgtgccatcagttaacaggccatttcccacctaggatttagtgggattttccactttccctagaaagagaataccgtctgtggctttatttgtaatcatcatcaggaaggtcctattgaaggagacagtgaagtaagaggggccatccttcgatcggactatgaacttggtggtggtagctgctgtggcctcagtgccctcttcactgacatccagcacagccttgtgggttgcctgccaagggaaaaacaaacatcagtggccctagtggagacacttttacttaactgagtaaactaaactgagtgcttttgccctggaatggtgatgtctaccttgaaaggattcaaggttcaaatgcctggcattgggtttactcaatacattgcagtgggtgttgactatggcccattggtccttacaccgggattgagatggttacaaacacagagcaggaagaccggagtgagtctcagttctgccacttatggttgcaaaattattaagatgctgcgtgcttcaggttcccgatctataaaaggtaataataactgcatatgccccgtaaggttattgtgtaaattaagagagatcatacaaagcaagtgcttgtggacttgccagcagtagtaattgctgcagttcttgcatggcagacatgggtttgatatgactaaggttagatcccttctttgtcttctagggaagagattcttaacctggagttcctggatttctaagcttcagggaggcttgagctcctgtgactacaggcattatttttcataggctcacagatacactttcctcgagaaaatgtccattatgttcatcatattccagtggggcctctcaacattttctgaaaaccaatgacaaaggtccccttcagtggccccaggatcacttctattataatccactatcaaaataaaattttaggtcagggatcagtaacccatatgtgtgcaggggctaggcaggtaaccccaattaactgacggagacttcttgtaagagcatggggtgcccacattacctggaggatactgtctggttaaaaggggcactcatagctcagctcctgtgatggctgccatgtggacacataggctcactgttgccatgtgggaattagagttagtgatttatttcaagaggatcagaaatctagacttttagatctaatatactatgctttaaaactcctctctctctctctctctctctctctctctctctctctctctctctctccttacacactgaaggccagacaacacatctacagggtgcagatgacctatgggcagccacactgtgatgcctgtgtgagggcctaaacttcagggaggaagaaagtgaggtcagatcctgagggagcacttgctctcctgcagcaggcatgggggagcacctgactgctgaggatggcttcggaacatttgtgtgaagagggataacagatgctgcatgccagagggatggtggccataggccgcaagattcggttcttctggccgcagaagaccctgacttcacctttcaggcctctgtttccttatcaacgaaataagagcatgtgattaattctgcaggtgcttccagcttggacttttttgcaaatattttcattcaactcactttagaaacctgcagggagtctctctttgcaattccagaaaaatcagcatttttgtcaaagacattttggatgcccatcttcgggaggatggtttccagattgtaggaggcagaaatggaaaatctggggatgaacacctctatccacctgtggagtagggaaaaggaaacaatgaggtcacaagcccatggtgtctgcatctctgctcctagatgccattttgggagactccgttcttcctccaaccactgctaatttctgctaaaaaggtcaacacatcctagccaagaaacccaggttgctcttgaaataagcctcccagctgagcaggtccagcactaaaaacatgcaaggagatagacgagcccccagtgaagtgggtgcagaggtgaaaaagcagtcagcaagggagtctatggcagaaaccaacaggagacgtccagtagcaatggaagctcatcaaccacccactcactgtccggaatacctcctcagcagcacttcctgatgcaagccctgctaataatgccctagagcagcaaagtccagcagaacttcctgtgatgctgggaagatcctagacctgcactctccagtacggtagccattagccatgtgtggctactgagcaacttaaacagtggcttgtgcaaatgagaaactaaaatgttaattttactacatttcagttaacttaagtgtaaattactgcaggtggcttagcggctactatattgaacagcaccacctgataatttagcacaatattttttttcctctgcaatggtttccctgaaccaagagtaaacagcccacatgtgttgaacttcttttttttaagatggagtctcactctgtcgctcaggctggagtgcaatggcacagtctctgctcactgcaacctccaccccgtgggttcaagtgtttctcctgcctcagcctcccaagtagctgggattacaggtgtacgtggccatgcccggctaatttttttgtattttagtagagacagggtttcaccgtgttgcccaggctggtcttgaactcctgagctcaggcaatccacccgcctcggcttcccaaagtgctaggattacaggcgtgagtccagcctgaacatttattatatgccagacattgtcccaggcacattcaacaacacttcccccttttaaagacggtaaagcttacttttagtgctttgcccaaggttatgtacttagtgactcacagcaacgaaagcacaaaaatattggatggacacatttcagtcctcatctgacaggtgtcttgtgacccctcatgccagggacagctctcttttccctgccactgtcctctttccctgttttctctgtgctccatctgctgctctgtactctgtccctccctccctgaaattctgtgccacctcctcttcctatccccagccccagatgcagcctgagaagagaagaaatcgctgacacaccctgcagcatctcttcatccttaactttgagtttttgccagtgctgtgtcctctaccaaagctgcccttgccaagcctctgtgtgctcatatgctacccacatgtgcagctaaaccccaccgcctccttgaagctgtccctcagtcccagctgaaagtgatctctctctgctcagaaactcctcagcacctttcctgccctcccgtggggcattgcccaatctctttcttgaattccagttacactgcagccttccttctctcttcccagactatgagcaccagggaacgctgctaaaatcattctaagatgccaaaaatatattgctaagagacagaacataaaacgtggacattccttttttatctcatgattaatctttttgctattctccatattttttgtactcaccatactaattacagaactaataataacattattagctagcatttactgaacacttactatcttctaggaattcttctaagcactttgtaagtagcaggttactttaccttttcaccaacctttggatttggtaatattgttatcctctttcttatatgtgaccaccaatgcttttgtttgctagcttttatgggatcattccatagatttcaatatcagataggcttctagagccagctctgcaagcatataacagctacatgaccttgggcaattcacttaccccttggagcctccatttcctcatctgtgtaatgagtggtactaagactcctcatcaggtgatagtgaacttcaagtgtgaacatgtatagacagccccaggctctctgtcctgcatgcagttggtgctcactgtgcagaagtgattatccaacagctgttagcacaatctctccctcatctttgaatgtgtgcatcccctgcctcagggcccaggagattgacacagatgcccaccttttctggagtgagtggctccactttctcagtgttctggctgacaaggcctgttccagttgcctcatcttgcccttgctagggaggacaaagaaggccacggcatctcccttgtaatccatctgcagcacaaagcagttcagctctgtatccaccccaaaagcgaactgctctttctggtgcatcatggggacatgcacagtgacctgctcgcccaccaggaatgggaagttctttcttgtatattcagggtgaaagggcttctcccacttggctagcacaaagagagaaaagaagtctttatgtcaaagtacaattagtgaggcaaagacagcaaactgaaatggggaattacttctagtgggtatgaggtttctttttgaggtgacaaaaaaatgctctgatattacacagcggagtagttgcccaaacttgtgaatatactaaaaagcaataaaatggtgaattttatgacatgtgaattgtatttcaattaaaaatagaattagttaaatagaacaacataaactgaaggtaacttagtaagggctcaaaccataccagttttctttccttctctttcctctttgcaggatggatggataaatgggtggatagcctggcagatggagggtggatggatagatgaatagctaatggataaatggttggctggctgggtggatagatggattaatggatgaatggatggatggatgaaccgatagagggatagatagatgaatagattagtggataggtggttggctagctagatggctagctaggtggatgaatggatgcatggatggatggatggatggatggatggatggatagatggatgaactgatggatggataaatgggtggatagtttgctggatgggtagatgaagggtggagggatgaacaggttaatggataaatggttggctgtctgggtggatagatggatgtatgcatggattcatggatgaatgacagatggataaatgggtggatagtttggtgaatgggcagatatagggtggatagatacatgaatagattaatggacaggtggttggctagctaggtggatgaatggatgcatggatggatggatgaactgatggatggacaaatggatggatagcttggtgaatgggtagatggatagatgaatacgttaatggatagatggctggctggttggttaggcgcatgcctggatggatggacagataaactagtgcatggataaatgagtgaacatgtggatgaagggagggaggaaggaagggaaggagagggacagaggaagggagggatgatacggtggcatccatgaaaactctgcctggagatgccaggcacttctatctcaagcacaacctataaagttggctttatcatcagagtatccagtcagcacagagactggcacaggtcaggcactcaacacatggtaaatcttttagagacacatgctgaggatcatagagcaagtatggggtagaggtgaaattcaaattcaagttgtttgactttaaagctgatgtgcattccctgcaatacagtgaaactgtaaagctctaacatatatctacatctatatctatatctatatgcagttatatatgaaggagacttcatatatataagggatacgaatgacaggcacatcagcttgtctacatttctacacctatgaaagtgttcacactcttggatttgcttcttaaactgggttgtcagagagttccatgtttctttctaaaactttcaaggggcagtgggacagctgctggtggcaagagatcttttctctcaagtagtctccagatttttcctgtgggtttcccactgagtcaaatgtaaacacacctcaagacacttaatctgtctacccaaagagaactaaatgagtccctactgtaactggtaaacatgagctatcctaggtcctgcagccagctaattgcaaagctaattagagctcaggccctcccatttctccaccctgcagtctagggtttgtctggcttgtgtatttcactaagcaaaaatcatcatcatcatcataaaataaataaataaaaatcaacttctcaaatccttacctttaaagaaaatgtggttcaccagaaccatggccgtcagaaggtcaaggccttggattatgtctacaaccttcccttgggtcttctttttcacatggctgttgatcctcgcctgggcaatggaggggttggagaaatctgtagaaaagacttctgcttcatacagcctcttgacattgcccaagaaatttgcctgcagctgcagctccttcttgacgaagagggcacttcccatcttcaaggtcaggtctttgctgggaacagtcagtgagtgaaccaggtgctggaagccctggtggatggcagactctggtgtgtgtgtgaggttgaagcccaggccctggagaatctgggtcttggtgactgagtgggccccaagggagagcatggccagggaagtggagacactcacaggggagaagaagatgttctgactcggggtctccaaaaccagcctgcggtataggcggaaggcaaagtcggtgttgagggaatacacctgtgaggcaggggtgctctttgtggaggaagggcgggggtatgcactgggggcattggccggggacacacagtagattggagcacagaggccaacagcaaagagtactccataaaggtaagatgccattttggaacaaaatatgtctgcaagagaagtaagaaccattgagggggtaaactgagggtccaggccctgaatcagagaccctttaacacccccacgccatcagcagcagaatgaggacagataggccagttagcagagctctctcacataatctctgagcctcacaatattcccatgatgtagatcttattattgctgttttacttgcaaatgagtaaacaggccacagagagtctgtgcaacttaccccaaatagcatggttgacttgtctgtgttctgtgtgggcttcaaagtcaggtctcaaattccaaatcccatgctttttgatgtttctgcttcatggacttattttttaagaattgagtatgtgaacccagattgcattagcagccagaagtggtttctcaccctttggaggtccctccacacattctttatccattttgtgtagatctgattattttctcaccctggctgcctgttcccagacacaggcattttactaatgtgttcatatctctcaaaaagtggaaacctggagcaaaaggctgtcctttttgctgtgctccttcaggtgccctgagcactggcagtcagttgctgatgagctgcagttctagtcacatctgtctgcttccccttcaagcctcagctgacatggctttggccccaaggagacttcagactaaatgacctgatagcaatttcaaaccccaacagggctgggcttgaatctaaccctgacattcgtggtggacaagtaacctctctggacttctctgttttgcctttgtaaaacagagatagttaccttacagagttgttcagaggactgagtgtgataaggcacaaattgtgcagcacgggacccagcacatggtgagcgctgaatacattacttttactgttgttttgttgaagtcagagagaatttgattggagcaactctatcaagtactgctcacaggtctccccagccctgcctacagcaccctcacctgttcagtttcatcagaaagatttcatttcctttaacacaactttacagaggagctccaaccctgtgcgttgaccctgagatacaacagtaagtggtcattttagagaaggaaggtgtatgaatccaatgcaaggccaggggaggtctgtgctcagccagaggggaaagcaaagcaggtgtgtgctccaataggtcacatccgtctgaaggcttttctcttctcacaaattttataatttcccccccatgacctggatgtccttccccccatcatccttttcacaagcacagtgccttcataatcccccttgcccttcatcagactttgctctttagtcatttatactacagtgtgaatggctgccaccaactcttctcctaggagcaccggcatgaagtgttactcctgattgtgaaggaaagactttacccactggaacaagaattcagtcaataagtgaacaattattttgccagaaatggagaaggaaaagataagagaacctttgccaaaagcgacaaaaatattgccacacatagtcacttgtctatgtcagaccaagcataatgtgacagccacattcccaacaatttctctgtggaaatgaaatatgtaaatgaatcacattttattataccagatataatttaacttagatggaactttataaagaacccttttactgaatgagtaattcttttgcaaacctgttcatttctctccatttccacttatgtgattggcgatttctgttgtgtagttttgtatttgcctgtttgactaaagtggaattttctttctaagttacattcgcatccatccatccacctactggactctttgccaacctgttctgaactgacctccagagctgcccccaccctgagtgccccatctctccctttctccaagaaggccattttacccatgctgccatcttccaagtcaggagactgatggccactctgcactcttcggccaccctccttccccacatcgttcttcctccccgagacatcgcaagccccagcttctctccatctctttgcttttcccttggtccaaaccctccttatctctcccctggacaatcctgaaggcttctggactcatctccctcctctggtcatgcttcctcaaaacgtttttcttaagaaacttcaccaatttgactctgcacagagacgatctactgggagatagaagtgttggggctacaatgggggacagatagccagggtcctggctcttaaagagttctctgggaaccctatgacatgtggccttgagagttgactgcttcccctctcttcggccccactgctggccagtgaatttatctgcagcctctgcagtcaacaccaatagcaacagcccagggtccacctccctcccttctcttcccactcacctaccccttgctcaggcatagcatactctgctacaaatgcccctcctggatgccaccttcctttgctaatggaaaagcccttgtttctcactctggaagactctacttagctattaccggcttgagaggccctccctggctcccctctcctgttgtgacttcatcactctctcccttctctcttctggcacttctgaaatttactcgacttctattaccaaatggattatcactgaccacacgcgtgcctttagataatctctaggttctttgaatgtgtaatttatgcatttggtccattgggttgaacatgtacgcttattatgcaggtactataggaggtgttggggctacaatgagggacagagagacagggtccttgttcttaaggagcccactgggaagacagacaattagcaaacaccactagacacaagaagtgtgtgtgtgtgatgagtaagtacaggcattgggaacacctattccataacaagaaaggcttccagtggaagtggcagctgattgaaacttgaaaaatgttagcaaggtaaaagggaaaagcagagaagagagagattcaggctgggaggaccacctgtgcaagggcccagagggaaccagagccaggcagctttgaggaacagaaaaggttctgacacagatttcagcaccacagaagccggcaggaagggctggggagcaggagagaccagctgccgagagagggggccccatgcagggatgtgcggacttggttctgtgccctggaacccactgggggatggctgcagagaacctcagcagcagagaattctcaagactatccctgcacctgtctgtgttcctcattgctctacacacctgcttcctgtcctccttcccccttcccccaccagcacggaaaagtgcccaatgtatgggctcagtagacacttggtgtgctgccctgagatggagaagcatttacaccagcctcagaactggggtggtggctgggcgcggtggctcacgcctgtaatcctagcactttcgaggcaggtggatcacctgagatcaggagttccagaccagcctggccaacgtggcaaaaccccatctctactaaaaatgcaaaagttagccaggcttggtggcgggcacctctagtcccagctactccggaggctgagacaggagaatcacttgaacccgggaggcggaagttgcagtgagtcgagatcaggccattgcactccagcctgggcaacaagagtgaaactctgtctcaaaaaaaaaaaaaaaaaaaaagcaacaacaacaaaaaaccagggaggtgaaatgaaggaggcctcctggaatataagactgaaaccctgagtttctcttatttgatgagctctgtgacagactggggctcttcaggacgccgtgtaagagtgtggcatctgcaggcttccctgtgacaagctggggtctactgtgttaacttggggtctgcaggccctctagcctcaatggtgaagtggcagcacttgatcttgacggccactcagaagtcagagcctaagcaagatcatggttcccctcctaacctcagagcagtactttctgtttagagaacagcattgtcctcgaattgcttcatcttctgaattgcgtcaaccctgatctgtaaggagggcagttctgaggaagggcgagacaacgtctgcagaacgcccagtgcggcatccagcccatggtgggcaggagaccaaagctgcatctctcttgtggctcttatgattttgtgtccctcccttggaatcagggtgaaggaataggattgtccctggctattcatgaccatgggagaggagaccaggttgaaggaagaggacatcagccacatggaggggaagcgggtgctgccaggcgccaggatgccacaagcaccaggggtctgtgcccctttctgtggaggctggcagtggggcaggtggctctcagggggcccccactgacgctgggttgtgcctcctaaagaatccgcattcccatcagcagaggtggcctattagacgcggcctccacgccccaagtcttgtttcttttgggcttgggttgagtaggggagacccacctgaagtcggggagttggctagtaaatgtcctgagtcatcgatggtactggcctccatgtgacttcaggtaagtctctgcttttcacaagacttcaggaagaggtggtctcaaaaggccctctcttctgagtctgggatctatgtctgagggcccccaggtcattgctctcttgggggaaaaccgtggccaaagctcattcagtcagctcttaaaatccaccacactccccactttgcttctccccaccctgaactcctgtcctcctgtggccaccccttctctctcccagccctgccaaggcccttgcccctcttttggctgtggcccgggtttatgtgagcgttcggccagggggcactgctcgttggggtgacagggacactctgccgtccccagggcttgcctcttctggacctctccctcccagctaccacagcctgcattccaccttccattgtctctcactcactcccatctccaagcgctcctccaccctgcagacagggtgacctttccagatgctgatctggtgtatcactcacctcacctcgaattcctcaatggctccccattgagctcagaaaaaatgctcaagcccctgacattcaagagctttatttattgggccctgactcacctccccagctgcatctttgaggacccagctgtttgcattcctcaattccaccccatcccctatcttcgtttgcctctttatccagcttgggtgtcaagggcttcattttaatctactgtgcttcacccccaggcctgtgtcttcatgtcccagccctgtggcaaggctccatgtgtggtagaacctacctgtctgctccttccctgccaagtgctgctggaagaggggttctgcaaggcagcctcgtccactgtgggttcccaaccaccagcctttatccacccggcaacatgtaactcatcagctcactctcccattttcagggaaaagcttcaccttttccatgtccttaacctttttattccagggtggaatggatgcccaccctgctacatgtgtgctacatatgcatgtgtgcctacatgtgcacacacacacacacatacacacacacacacacacacacacactgagcagacaaccttgcctcctatctcacataaaagagagatcctatgaaaaggaattgtctcaacttccctcaaagggcatcctctctgcctatccctactttcccagtcgcccctctctctcccctacacctccactccaccaataaagcagaggatcggccctcctttgaggtccagtcccccttcctgggccttagaaagtatctcttctctccatctcaggacccttccacctctcttttctgcacttaaacactccctctcaagctgatccttgctgttagtttggaaactgttcaagtcttgctcgttaagacaaagaaaccaacaacgacacaacaacaaaaacactcctttcaccctctcatttgcttctagcagctgccctatttcaatactcctccccttgtggcccaaattttcaagagctgtgtattcatggtctctgtggccttacctccaactcactcactggtccactccagcctggcttctgtatccacaaaaatgtgacccagatgctactaaaagccaactaatgtgtctaggttctcatcttatttgacttcccagctgcatttgacactgaagaccatgctctgatccagtccttccctctggctcagtgacaccacattcccgatctctctgcacctcctccttacccacctttgcaggttcctcttctcctgccctgtccttgcatggttggtgagccctgacacttgcttacttggttgtagctctctcctcactttaatctctcctctccctccagctgatctcatgccacgacacccatgacttcattactaagacatgcaaatgatatattatttttattctccagctagacatgcaaatgatatattatttttattctccagctcaatcctttcctctgatctctacatgtctaacttcctacttgatatctcctcctgatgttgcaaataaaccttacatgcaatatgaaccacagtgaactcagactccttcccaagaaccatctcccagcaacagccacaaccgaaacctcttttcaacatttctgtcactgggtccaccattcacctggttagttgagcctaggaggggcatccttgcacttccttcttcttcatgtcaacttatgcccagttttgtcaactttacctcctgaatgttgctcaagtccatccacttttctctgcctccactctagcaggccagttgggctgtcattgtgtcttgcctgggctaccacagagcttcctaacagctctctctgcataccctgtcctgctcctccaattcactctgcacatgacagctagaatagtcttttaaaactcaaacctgactgtgtcacttagtatttaaaatgtctcaattgcctcccgtttcccaaagtaaacactgaagtcttaacttgcattgcctggcctctgcgggctcctctaagttcatcacagatcatgaagccccttgcccttgacatccatgttagcccattctgctgatttttttttttatgctcacatgtgatatttgttgtttcctactcctggaatatccttccaactctcttcatctgacttttcccctaattaatttttattcattatttaggccctagtttgtgtgatttcctcaaggaaactctctttgaccactgaaataagaaaactttctcccagcagctatttttatagtaccatcaacttctcagtgaaacacttatcactgtcatagtttcacatttatttgtgtgactgaacaattcatgaatcagggatcctgtctaccttaattttgtctacttgtgcacccactctttggccaatactcacggttcagtaagtggttgctaaaagaataaatgaattgaaataaaatgaaataatccatttatctttgaagagtaatcctgactggtaataagcaaggggaactcagggtgatggaaagtcctgtagctacttaaggtaaagttacacaggtatatatgtaaagtttgagttgacttacacttttggccaaaacaaagtaactgatattggttgcaaactgttgtaaacagaaaactagacaaaatttatgacactattgagatactcgaaaaatacatataacaattcagacattagagaacaggcagggaaggtaaaaaatgagataagctctacaattgtcccaattttctgcctaaggatactttctggacgtgtggaagaaaacccaaggagggcatgggaggcttgctgagcttaggagacagacattagagtttgagaaaactgaggaagctataatttgtgcagtgaagtactagaggagagctttagaaatgttcataggggtctctttaagtccaaagctaagtactaagctctgcatgcataaagtgaaattccacatggctggtccacacacacacacacacacacacacacacacacacacacacacacacacgaaaaaataaacctactgtgaaggtataagcaaaataatttccagagttcacaaagcataggatatattaaggttatgcacccaaagtggagagacctggaacattcagtagagacccagaagtgtcacatcttggcattagggctaaactaactttgaattaaagctgcactagacccaccctaacaaagtttaaaaacatgccttgacaagctcaaacagatctgtaagtaacgtattgcctgttaaaacaaatgtcaaacactgtaaaggaagacaacaaaattgtaatattatgatgtccagcatccaattaaaaattgctagaccttctaggactaggaaaatgtgacccatgaccagaagaaaaattaagcaatataaacaggctcagacataatagagattaaggaatttgtagacaaggactttaaaacagttacttaaaatatgcttaaataataaaaatgttactgtaatgtgggaaaaatcaaacttctagagatgaaaaacttaatatctgaaatgaaaaattcactggctgggtttaacagcaaatttagtactatagaagaaaagatctgtgatcttgaaaacatatcaataggaactattcaaactgaagacagcaagctggaaaataataataataaaaaacaagtcccagtgacttgtgggacaacatcaatggtctaacatatgtgtaattggagtcctaggcaaaaaaaagtgagggacagtggagaacagaaaaatttgaagaaatagtgggcagaaatatttgtgtactttatgtgaactatacctaaataaaaatcaaaatacaataagttgaaatgaatgccaccctgctgtttcttcctctactctctatgattacacacatatctcagttggcttggactacctatctcattctctttgcctgacacactccttcccatcctgccagctccagctcaaaatcacccactgcacaaagtcttctctagatcccacagaaagtctgcccctccctttacaaacacctggagcaaaccagggcagtttatcttcttatatgtcggtctccctgattagacagtctggactttgtgaggcatcctccagagtcgggactatgatcagtaagtaatagagaggtagcagattgcatgggaaggagaaagtgggagggatgttgggaatcctgaggaccaggcactattggctcatccacacccagggacttttgtagagactcatagttggtaaaacacagagaggcagcctaaagaagtatggaacttaccaagcgtaattgggctctcattaaaatgcaaatttccaggtcccatgcagaactacctaatcagattttccagggaaagatgagaagacttgagagtggggagggctgtgtgcttcctcttcctacccttcaccccaccttctgtccttgccccagagagaagctcttcagggtttcctctagctctgaggtcctcagttcctggggcctcagggccaccttgaaagtaaagacccatttctccccaaattcataaaaccaagcctgctggagtagcaaccagccaggagtagatccccatgggcccatcaagatggagccttctcccaagtccatactcctccatggagcctctcctgctatgtccaggcctttctgggatcctcttaggactctggctacaggatctcttgcctgcctcacacattcttatgcttctgctccacttctggtttattggagatactcatactatttaaaaaatctggctacatctttatacttttctatttcaatacttgttttaatatttcacccattgtttctcctaacagtggagcagattgggtacctcaaggctactcttggagtgccatcttagctagagggtacccttcggattgtcaagaagcctccccagctgagttccacagtcctcaccatggatctgtttcaggaagtgcagctccctgccaccctttctgctgcaacattgttcatttcctagcctgcccagtgtgatcccctgacttctaggaatctgaaccaagctgagggtagagatagggaagggagatagaaccagacaggaccccaagccttgaggaattttgtctgtctgttaattagtctagggttttgttttttttttgttttttggcaaggggtcattatttcaacatcatgggacacatgagattcctgccccagcagggatcttcatcctggagagcccctttttctgccttgcccaggaatctgtgattcctctgttcacatcatggtgaagaaaacagctacggaaaagctgtctgtgctggaaggacattcaatcttcatggaagcccacccagtggactacccttcctgctctggaggcctctaaaagccaatactctatggatgcatgcccagcagatgccaagtgggttcgtgtaacctatagcattgaattctcccaagaccctgaaagatcagtattactatccccacatcatacagatgcaaaactaaggactggtccaccaagggatgtgcctaatgtcacaaaccaaataaatggcacagctgtgaatttgacctcagcctgtctaactccagggcttcctaccaatctccagccacctgacgcatttttcaaagtctttaaaataaaagaccactatatgtgacgtgtatcctggattggatcctggaacagaaaaaaaaaatattcatttaaaaagatggcgaaattcaaataaattctgtagtttagtgaatagtaagctagcaacattggttcctcagctgtgaccgacgtctcacagtcatggaagatgttagcattaggtgaagctgttgaagggtgcatggaaactcagtggactctcttcacatcttttctgtgaagctacaattattccaaaatttaaaaagaagaaagtaaagccaatcagtcaaggacataaatcaagaaaacattccaaccttggccgaggtctccagggatcagggagatgactgctctgttcacaaggtaaacaatctcagtggtttctgcccacgatgtggaatcactcagtgtcaaagtcctccctcttccagctctcttttgatcattctgagttcccccaggagtgagtctcagcttgatgccagcccatctttaccaccatctcagacttgctgactttcctttctaacaagggtgagtaaaccacaggctgggagcctgcaatctgtgacagtcttggttgaatttaatcactgaattagttttgttgtgtgcatttttactttctacttgtggcaagttgtgctagtttctatgtatgactgcaatattaatttttctatttaagcaaattttcttttcctaacatgaattgatttaaggataggccttgagcaaataacgtacaaaagagaggggaatttagtcctaatcatgaaaatggtttgggagtaaataaaatttgagaaactgagcgctaatggagagctggtttcccaaagagaaagggcaccttggctttgcacccctgtgggaacacctgagcactgatgtggtgactcagtggggtaggatacgtgttcctggctggttctgaaggggagactagaaaatggggaggaagcagaccatgtgacctcagctctgcttgaacaaggttcctgtctctcctgtccatcctggcttctccatccctggaacacagcctggcacacagaagattcccagtaagtatttattgactaaacaaatgcaagggagaatgactatacataaaactttcgagccagttctatcatttccaatatgaacatcaaagtattgcccaaaatagaagggtcttctgggggcatccagggcaacctcatcattgcacaaatgggcagtggaagcccaacaggaagaaggtatttgctccagccacacagtcagtgtctgggaaaagcagggccaagaactaggacttcccttctgtgatcattcttgccaacacaccagtctgtcacttctgttatgcgcccacatgaatgacctcagcccaggcaggcagtgctgcaggcagagtgggggcagacagcaaaccagactcctggcacccagcctatgctggaagaggtagaaagtcccctgctcggaggctgcacagaggttttctgtatcgtgtaggtcaaactggaccacaccaaggcagcctgtctctcctgggcctctgacactgggcaccctcattcttggttagggtgaatccttcctttatgcatcaagtccacctttgctgtagggaaaagaaagagagatcagactgttgctgtgtctatgtagaaagggaagacataagaaactccattttgacctgtaccctgaacaattgctttgccctgagatgctgttaatctgtaactttgccccagccttgagctcacaaaaacatgtgttgtatggaatcaaggtttaagggatctagggctgtgcaggatgtgccttgttaacaaaatgtttacaggcagtgtgcttggtaaaagtcatcgccattctccagtctcgataaaccaggggcacaatgcactgcagaaagctgcagggacctctgctctggaaagccaggtattgtccaaggtttctccccatgtgatagcctgagatatggcctcatgggatgggaaagacctgactgtcccccagcccaacacccatgaagggtctgtgctgaggaggattagtaaaagaggaaggcctcttgcagttgagatagaggaaggcctgtttctcctgcccgctcctggcaggagaaactcggtataaaactcggtataaaactcaattgtacatttgttcaattctaagataagagaaaaactgccctgcggtaggaggcgagacatgttggcagcaatgctgctttattattctttactccactgagatgtttggtggacagaaacataaatctggcctacgtgcacatccaggcatagtaccttcccttgaacttatttgtgacacagattcctttgctcacatgttctcttgctgaccttctccccactatcgccctgctctcctactgcattcctcttgctgacatagtgaaaatagtaatcaataaatactgagggaactcagagaccagtgtcggtgcaggtcctccgtatgctgagcgccggtcccctgggcccacttttctttctctatattttctctctgtgtcttatttcttttctcagtctctcatgccacctgacgagaattacccacaagtgtggaggggctggccctcttcatttgcatgggcatttcccaggctaaagcctccagaggactgtgcagcagagatctcagagaggcgaaccataaaacccactgtctcagcctcccgggaggctggctgtgacccctgccagcgccactggcaccgctagtcacccttacccactccacttaatgtctcttctcttctctcctctcctttcttttttaacggagtcttgttctgtcacccaggctggagcgcagtggtgccatcttggctcactgcaacctctgcctcctaggttcaagtgattctcctgcctcagcctcccaattagctgggattacaggtgcatgccaccatgcctggctaatttctgtatttttagtaaagacggggtttccccatattggccaggctggtatgtccttatttcttgatcacacctattgttaatttcctgcctctcccgagtaacacgagacctctgcaagggcaaggatctttctatattttattcacaaaaccctaaaacccctctttgtccccgcatggagaggacactcagtgaatatttgttgaatggatggatgaactgatgggataaataaaagccacaagtgttcgggggatttgtatttgctcctacctctgtggcagtctagctgtgggaccttgtgcaattgatgtgatcttcctaagcctccgttttctcatcagtaaaatgggatggtcacaccaaccggaagggttgtgggccagtgagatggggaaagcacttgtgtcgtgtcaggctttgataggcatctaggaagtgtcggttatgtcaaaatcaaaatccagtcattcatacactcatttattcacaaggttggtcagcccacaaatatgtgacctgggaaggcttctgagaaggagaaggggtgaaccctctctgaaagactgagtaacatgctggaaggaagtcgtgggagtgggagaggatgaggagcaaggagagcatccaggcagggtgggaagatgtagggaggtggcacacagacctacaagaaggagcaggcatggtcacatcctagtgggcaggcctgcgggactaaggcatgtgactcccctcccagaggagaggggagctttggagggggctgaccgtgtctggacaaggatgattagcagggcagtttttctttccagcaaatacgtgttgggtgtgtgctctgtggcaggtaccggcctgggtatgggggatacaaggacacaagtctgcaggcagagggacataaaacacatgggctttcctgagtcactctcaaactgcacacctgctgaagcccgccagagttcttcaattaaagaccagcatccctctgtggcccatgagttcccacctacctcttggccccgctcccaccccttcttgcttactgatctcatttcagctcctcacccgtgccactcctgacctcaggacctttgcacatgctgttctcgctgcttggtggggcctccctgggctcccaccctcatttcttcctcttttttttttctttttcaaaatagaatttatttgtgcagtgaataatacaaatgtggctatgaaagcagaacatgatatttaaaaatatttaaggtatgcaacagtcattttaaaaacagaattagttaaaaggaagatgaataaagaactcgagcttatgcctgatttctattggtatacttagaaataccaatcagtatttaacatattattaactatgctggaaaaaacacctctatatgcagttttaattcctaactacagtttaaaaacagatgagttcccagcatttggagctcctcctaaatattacatcctggggaagcctttcttgggcccccggactggacgcgacctgtgacatgcgacccccggactggacacgacccttctgtgacaccctttgcaagctctgcgatgtctccttcactgtgcccactgcagctcatgacaaacatgtgtttattggattcatggtggcttccctcactgattattaaccccaggaaggcagaaaccggtctacatatatcaacaatgagctcagagattgcagcccagaagtcatcatttaatggaggactgactgcagcccacagggggctggagggaacattcagacccacctgccatcgccatgcatggatgtaagggttttggaaggctgcttggaagaggctgcttgggagatgttggaaaggtagagaagagttcataaagaggtcctagtggcctgggtattaaagggtgaggaagagtttgttaggctggaggagggaattcccattagaggagatggtagaagcactggagggggctggtggaggaccgcagcaggggctctctactgcatgcccacgtgccaggcacaatggccatgcaagctcacgtgatcctcagaggtagataggtagatagagggtattagtctctagcttagccgctggaggtagatattatgatcctctctcaataaatgaagcggctaaggctcagaaaggtttagtgatatgcccaggtcacctggccactcggtggctttcctggcagtgtcacttccccagtgtcatatgttgcgcacctgagaccgtagctaagggtttctgtgtctttctatacccacccctcaggctggggcaggggaaatgatgtcggcaaagggctcggccgggattcccagcctttttcccacgtctgtgtccctgtgcggggtctcaaccttctccctcacccccaccctctcgaaaaggggctgcgcaccctgggctcctgggctcagccctcaccaccgtccacttgccctgcccctcccccatcacccgcaggcagccttctccaccagcctttggggactcttgccttcctgccccaaaccagaagatggggcacttgctgcatgtggctaaccctgaggccacgagaaagccacgtcacctctctgagcctcagtttccatgtctgttatagggacgcccactctggctgctctgagagcacctgtgaccagaacacaaaggacaccatgagctgcaaactgctaaacacgcccgggaaatgataagtagtgccagtcgaggctcctcagtgccaagccagccagtatcctctcctctccaaaca

SEQ ID NO: 1174 - DNA, 40159 bp, Homo sapiens
gtcctctgcccatccagccacccgcacagatctgtgtcagtccctgccccccaacactgatcccctcctcccagccctaccccagcctggcactcactggttcttctccagctcaagcaggagctcctggccttcagcctccagggccaccagccccatgtctggcttcgagacctgggcaagaaaatgtgtggagctgagatggtggcctccaggcctcctgcctgccagggagtaggtggcctgtggagccggctggggaggaagttcttggggagaacgtgggctggggagtcagcaggaccccccacatactatggagggcgtggaggaggtgagaacatacaaagatgttcccaaactcaggatgtttgcagtcctgacaacagccacttggaagggcgttggcacagcctgccaggcacaccagcatcctccctagagaccagaggtcccagaaaggtgcccctcccctggcccgccctcttctttcatgcccagaaggggcatcaaaagcaggggaagacagaggggtgctgaggacattatgggggcatcgggtagccatggtcagggcctcctcagagcctctgctacctgaggcttgtttccaaatgagctgctgctcattccctatagaattcaaatttgactcctccacttccaattttggcaaactgctccctcttccaaagttttcctgggcctccagcagcccccgtccctccggctccgacacctgcttcactggacccacgaagtaaacatggacgccattccagccaagagagcacactggctctcagctaggtgtcaggaggctggcttggacggccagccctctctccttcccccaccctcttggcgtctcccaccctgtgggaacaccccacttcccccttgtccactcagcctggctgggggcccagagttggagccggcccaggagcttcctgggaggctgctgcgccttcggaatgtttaacccccgactccttttctccaaaaatgcactggcctggggccctgtccaagggtctcagagtctttggagggagttcttccttcgcaagtggggagcagatggtccttgcctccctggccacaggccccacaaggcctccagcatgagctcatgaggctggaatgccacttgctttattggggaaaggtctgcaccgggaaaaaggccatactcgaggtccctgttcctctgcagcccctgctatctttactcttgccctcctggtaccctgccccttgatatatacccctcatcttgaaatgtgagtgtttcctgccttttggaggggacacctagcctctactctttcttctgtaccatcttggcaggcttcctgggggcaggggcccaccggtgggggaagcagagcccctttggggctctcctcttggtcacagcccaggccagacagacagggaggcccagaggcagagtgaccccagtgtgtgtccagccttcccctcctggggatggggagggcaatctcaaagctcaggccagtgccgtgcttgaccagtggaatgggggccttatgggcctaggggatcccagtgagggccctgggttgggagctgctgggtctctgggggcctctcagccttcatggcaatgctcccctgccttccctcttgctggatttggacagtagggctgaaaattccaaacaaagagggctctctaggaggggcaggggtgtagccaatggtttaaaatcgttcagaccttagtgggtctcaggctcccagcctaaagagctgtgtgaccatggacaatttccccaagctctctgggcttccgtttgcccctctgtaaaatgagcatatcaaggctactgccctcttagtttgcagcacagatattatggcacaaacagatggggcatggttattctggaagcgtgtgaagagcgggattgggaagaggctggggcagagcgtcctgcagaagaagcacatggggtggtcttacatctgggggacatcaggagagtgaccactgcccccccgataccagaagtggattccacaggagccagtgaggctgaaggttcaggccttcgtggcagggccctgagagggacagcagtgtgtccacagggtcacatgttctggtcaactttgcaaaaggttttctttttggtgcttttttttttttttttttagaggctcctgaaaagcttcaggacccacaaactctggacccatttctgcctggtgggggtgggggtggcccagatcatccagggagggagggaaagagggaggtggggtggagaaagctgaaatgacttccatgtgtgcgggctcacgagatccagatgtccaaaccccagtgccttcttctgcccacttgaggggcaggggaggcaggggcctataggagtagtgacttggtggttctggggaccccagcaaaactagaagctgtaatgtagggagagacaaaagggctgggaggttcagggcccctgtggagggcggggagacatggcactgaccggctcctccaggctgacggtgcgccagggttgtccatccaggacccagtgcggggtgactggctgcccagggatatgtcctggagtaaagacagagcacagggtgagggggacctgaggaacacaggggcatgggacaaagcagagggaggggggtagaggacatccccagggaggcactggaggccttttggggcagacttcaccttcaacacgcgtgggctcagcctggagaaggagggacgcccgtgggcatccttggatctgaggagctatcaaggaggaggaaaagagaaggctggaaagggacagctcagctggggacacgggagtcccctgacctttgtcggggggcaggcttgggctcggcgatcacaaggaagaggccaaggccgccagtgcagaggggaaggaaagagcgcggcagccttagggatttttagatgggcagcagatgcctttagggtgagagatgtacgaagagaggacacttgtgccccccccatcatctgagaaaaacaacagccagatgttgccttgcgaggtccaccttgcccagagctccctcggggactctgtcctggtggcagggttttggtaccctggcccagaaggcccctcctcatctcttcaaggggaggggacgcttctggacggagccttggtgctccctggccgggtgtgcctaagggggctctaggaggaatcccagagccaagcattactcagagggcgcctggaatgttcccctggaatgctcccagccctccactggccccaaccactctcacaggcccgccctgcaggagccaggccccaggcacccagagcctgcagcagccctccttcccccggtacccagtcccagctcccagaacagacagcctcccccctccacgcagccctggcctcagtcctgctgggctgatggctgcctgtggaagtgactcagctcctgctaggccaccccaactccttttttctcctccaccttctctcccagactacaaacatcaaagacccttcctccaagaagccctccttgattggatgagtgaattgccatcaggcagatgagggccgagaggagtctgccaccttggaaaggaggctagaggggccagtgcagggagggctctgagtggatgtgggggaggggaaggaggggaggtctctcagcccagagagcacttaactgagagtagagaaccaagctttgctgctcctaggcctctaagggtttggggaagaggtagggtgggcccgggcacaggtgtggtgtgggtgcagtgtggtgtgtgggtgctgtccacatggccttgcgcgcacgtgctggccacgggcaccctgaccccaatgagggagagaggggcagagctggagctggagctggagctccggtgaccgggtgaatgggggtggaacccgagggagccaggctggtattgggcacatagacgcccctctcccaggggtcccatcacctcccctgaccccaggatagggctcagaggggagggagcagtggaccgcctggggccctcccctggggccagaacagaccaggcccctgtacctgtttggtccccacacagtgctgtggaagccaccgcccagtctgcatagcacagcccagccccgcatgccccctccctggttgccctccctgttcccggccaggcacttgctgtgcaggactggctaatcctcccacccgcttgcagaggttgttccagccccatcttaacatctttgtttggaggggttaccccgaggagacagctgcagtcttcccagagcactgctaaacagacaccttctatctggagaggcccttctctatctcaccaaacaaggcaacaatataaacaacatacacactgccctgctgccctgggaggagggacgaggggtgagcagggtggaggccacagctagttctgcagcctgagagcaaagcagggactctgggggactcttgggcatgggggcttcctagaggacggagccccgctgagtcctaaggggtggaggagcaggagcgggtcacacggtggcctgcggatggaagctggttgtgagagcgagaatccaggaagagggggctacggctatgggctgggggctgggctgcccccgagggggagggagccatgccctctgctttgccagcggagtggcagccgggcagtgtgggcaagtccgggcccggggccagcccaagcacacttgagcgtccctgggcaggtcccacggagacccccccaaagagtccccacgccctgacctactggccgtatggtgccggggccgtgagaccctccgcgcgctgacccgagctctgagcagaacccatccccgccaccaccaccgcgcctagcctgcccctcagggcgcaccccgcccgcgtcctcaccttgaagcaccccggcgcctggcactggccagagcagcagcagtagtagcagcagcagcaacggggtcccccgagctctccggggcctccagcccatagctgtgagctcctcggcctctaggcagcggctcgcaactccggctccgcccaggctggattgcggccgacccgtgcccggtgcagcctcaggccgccgccttcggaccttcccgcccccacctcccaccgcccgccctcgctcccgcctcccctccccgccaaccccgctcggagcctggccaggggccccgacggcgcgcgccatgggggagccgggtcgccactcccggaccgccgcccctcgagggggtggagctgggcggaggagggaatccgtgcggcccctcggatgaccggcccgagccgtccctccccgtcggtctcagagggcctctactcctgagaggaggagagaaccgctgggaaggttcttggaggaccgcggcgtggtgggatgaggcggtgggcaaaggccgcctctcgctgctgaagttggccccaggagcgcgatcttccgtggtctcctggggccgatctctgtcccctccttgctacccgtcctgccccgagggtgccctggcggaggttgagtcgggtcatccacctgcactgggtgcccccaaggataggaaggttcaggcaaccggctgccgctgtcttgggggcttcattgctgggcaaaggcgatgcagcagacggagacaacctttcttccctggcggtggccagagggcagaattgcataaaagctgcagactcccaggcctgggagaccctttcggcctcagtaacatctgtttcatgttttaaacttttgttttcctactcggtgcaaatttggatgagatgttaactttttttttttttttttttttgagatggagtctccctctgtcgccaggctggagtgcagcggcgcgatcttggctcactgcaacctccgactccctggttcaagcgattctcctgcctcagcctcccgagtagctgggactacaggcgcgcgctaccacccccagctaacttttgtatttttagcagagacgaggtttcaccattttggccaggatggtctcaatctcctgatctcgtgatccacccgcctcggcctctcaaagcgctgggattacaggcatgagccaccgcgcccggccggagatgttaacttttaagcaaatcttttttttttttttttttttttgagacagagtttctctcttgttacccagactggagtgcaatggcatgatctgggctcactgcaacctctgcctcccagattcaagtgattcttctgcctcagcctcccgagtagctgggattacaggcattcgccaccacgcctggctaattttgtatttttagtagagatggggtttctccatgttggtcaggctggtctcgaactcccgacctcaggtgatctgcccgcctcggcctcccaaagcgctggaattacaggcgtgagacaccgcacccagcctacttttaagtaaatctatttgtttttgagaatttggaatgtagtaatttggttagtgaaagttcgagcagtgagagaaacctacattcacatatctcaaaatcaaaaagtacagaaagcatagggaaaagtctccgtgctcttagccctcctcaccaacaggaaaccaatatgattagtttctttcataggcttttagattattttttcacactcaagacaatacagacatatttttttctcttattaacgtttttctgcactttgattttcttttttttttttttggtcgcttaatacaccttagatatcagtgcgtttagagggtccttgttgttcttatgattattatttagagacagggtctcactctgtcacccacgctagaggacagtggcctgatcatgcctcattgcagccttgaaatcctgggctcaaggtatcctcccacctcagcctcctgagtagctggaactacaggcacacggcaccaggcccagctaaaatttttaatttttctgtagacaggggggtctcactttgtttcccaggctggtctcaaactcctggtcttggccaggcgcagtgtctcatgcctgtaatcccagcactttgggaggccgaggcgggcagatcactggaggtcaggagttcaagaccagtctggccaacatggtgaaaccccatctctactaaaaatacaaaaattagccgggcatggtggtgagtgcctgtagttccagctacttgggaggctgaggcaggaaaatcgcttgaactcagaaggtggaggttgcagcgagccgagatcatgccattgcactccagcctgggcaacaagagcgaaactccgtctcaaaaaataaaaataaaaataaaaagaactcctgatcttaagtgatcctcctgcctcagcttctcaaatcgctggaattacaggagtgagtcaccacagctgtccagctacgagattattacttattattactactttggattttcaaatcaacttcattaaggtataatttacacacaataaaatgcacttattttaagtggccagtaagatgagtttcgataagtgtatataactacataagcatcactataatgcagacacattccctcactcacagaaagagccctgtgcccttccagccaaacttgcccactcccaaccccagacagccactgatctgttgttctctgtctatagataagttttgcctgttctagaatttcatataaatggaatcatgcggcatgcactcttctgtgtctggcttccttccctctttccgatgtttttgagattcatttacactattttgcatatcaatagtttgttccttcgtattgctgaatagtgttcggtggtttgagggaaccacagtttctctactcaccagtgcaccatagggttattttccagttaggggctcttataattggaactatatttgcacagagagagagagaggaagaaagagggagagagatatttattatagcaattggctcacgtgattatggaggccaaaaagttcccgaatctgccatctgcaagctggagaacgaggaaagccagtggtgtgattcagtttgagttcaaaggcctgagaaccaggagcaccagtatggaggtggctcgagctcagaacaagttggggacaggaaagcagagcagcgccccagagcagcccctcagcgacacctcttcagtaaagcaaggctgaacacagaggggctggcttcagtgtggatgtcaggtacagaaggcagctcgaggagctactctggcgttcttgcttactggtattcttacctcgaactggccaactcctacttaaactgcaggccatggctttaatgtcctgtcattcagaggctgtcccttacccaaagccaggttagcatcccctgactgacacttctccctgcaacacgtttcagaaggccctgtagtcgtccacttccctgtctctctccccaagctcctgagctccatgtggtctgggaatatgtgtgttgctcacttcctagcacagtcagtgctaataactgactgtagaggggacacagtcgaaaagccacatggggatcagagtcatccttacacagttgacacctcccaaacccagatgagctgtgtccaagtgcaggtcagaggaattttctgccgaagtctctgagaaagggtttatttacattttgaggttgcaggggaggagatgaggccatcaaaccaaagctgaggaagagggatcctaggatgcaccgagcagctccgggggcgcctgacagcacctgggaaagatggcttctccactggcttgttggcgtcaccctccagaggggcatcaggaaatgtcctgggaaccaggcaaaccagtgagcattaacccttaggagtgcttggcatgggtgacacccaccatctgtaaacacgacttctcccaaggagtgacgcagaacaggatgtctgagggaggcactccgactccagccttcagagatcgccagggtggcacctggtgacgacaggctgatgcttgggtgccccggaaaaagtcatgtgtgtgaatgggggccccaaagccaacgcttcatccctgacagcctggtgcatttagaggggaactttttgtcccttggcaaggtgggtggaatttcaggttcatagggcaagggtattttagctttaatagatattgtcaaacagttttccaaagtcattgtacacactctgtgattctacttaagtaaagtttaaaaacaggcaaatcaaatctatggtgttcgaagtcaagacagtagttacccttgtgggggctgcaactggtacagagtgtaaggggggactgtaggatggtctatttcttgatctgggtgtgttcgcttttggaaaagtccttgagttgcatttataatgtgtgaacttttctgtatgttacactttaattgaatgtacaaaaagtctcaggaggcctcagaccactggaagcggacacaactaacccctctgagagcctccaatccaagatggacatatgtccccttggaagtatgcagaagcaggtgaagactcctaagccggatattcccaaatccccccagtagctgcagcttcagcagctgcttatggtcctccctacaccctctcttccccagacagcccccaaacatctggctgcatttgacttgctctctccctgtcccacctctggatttagtccatgttctccaccctccccactgtcagcaatgtagacaagacaaacgcttagttcacgtgcccacctactgcgtgccatgcacggggctggtcattgtgggtggcaaatgtgagcaacacacgaagcctcaaggagcagaaagggacacaaatcacttcagcgtaaggtaatttgtgataaatgtcatgtaacttgcagcccctggccccctcctacagatggtgtctaagaataaaccccactaacatgtgactcctctgttctagcccagctgtttgggttgcaagaaagagactcactccagttgcgtcataggatggagttttattgggaggacattctggacgggctcccagcaagagtctggcaatggagcatgaaaatgaatgagcctggaatgagggagggtgcggcctcggctacacaaagttcacccgcccccaactgcctcccagcgtgttagctcctgtggcaactccccacttctctctctgtttttcaacccaaatcctagagcagagggctcttcgctcctcacaccatctccaccaggctgcagggggagtcactagcccactcaagagctctctcctgttggtccctgattcgcaggggcacgtcattccttcttggtaactcattctctttaacagcccgacacagggtctccaggaaaaggacaggagctcacacagtcatgaacagagatgcatctggagcaggaataaggatgctgacaacatctgtgtctgccctccactcttgtaagggccagtaaggtagtacccagtccctgggggtagggggggtggtggtgggaatgagggcatctcttctttcaggggccaaatctggcacaaggatgtctgcttaggcaactccactgcctggcatgctctctccctaggaaaacaccaaaccttttttatttcctcagtcttagtgtgagagtgatcacctcttccaggaagcccacaaccagaatggccaggggcacaccctggccctcagtagatgggcactgagacaaaacatggcctgctggtggcattcccaacaatgtcaaaagtctcagggatgagctcacagttgggagtcctttggaagtccaattccaaatgtcctctggactcaaaataaaaactacatttcccagtctcccttgtagcttgcagtagccatgtgacaatactccagccaatgggaagtgagtggaaaagtcctgtgcagcttctgagttgcgtccaccatgggcatgggtgtgcttctacctccactcttccttcttctggctggagggcatgtggacaaagcggggccatggtgagcctcacaatcaaaggcatcattttagggatagagaaaaggaagatagaaggatcctgagccccaacatcataaaccatcgtaacagccagactagcgtgggagagaaaaataaaattctatcatgttgaagtcactgtatttggtctcttgttagagcaggctgactgatactctgttgaatacagaatgccttggtgagcctctgaggatgcaggatgctgcaatccaaccaaagtccagggtgactttcgaggagaaggatgtgaaagggcagggcttcctttgagggagaaatggagagaagggaggagatccagagaagagagagcgagatcagctcagtgctcttcagtgtcctccagggtcaacaccctcctgggcagacctctcaccacccatttttgggggggcaagaggcttggggccaggtcataaaaagtcagatgtcacagagctgttttcgtagaggcgggcaggactcaacactgcctcattcacattcataggctggagtcatcacagattctggccactttctcctccggagggcaggcaacaccactggtcagcccaggggtggggcacaggttgaggtctcacatgtggctgcatcaggatcaatgagcttcccacagagaaaaccctggtcacaggaggcctctgggagccagggcaggcccccaggcccccagcctcaggtggggtcccaagaggattggtgggagtgtgcatggctggaagtgtgacttggagccctggcctaccaggtgaatcagctgcagaagggacacaccacaggggaggagaaactgactttcacttctgcccaggtgacgggcaggcttgggagtggggaagaggcctcagaacaaaggtgggggagtcagaacatacgtgtcttggaaatggaggggatgctgccaagtccagaaagtctcccctagtcctctaagccagccgccagctgacacagggattccctctgccccgagcagaacagggctctcctatctcctgaggggctcctggttccctgcacactctccccaacctccccttggtcccaggcaccatcctctaaatgacagcagtctccagatgccagttggcactgtgggttagctgggtattatatctgcccgtgtgtgttgaatggatacctgcgtggtctctttctgaaaagccatctccaccgaattctcgcccatgctctgcttacaaacacgcctccttctgcaaggcccggagtggactcagagagcctctcccctccccacctcctgcccccattcctctcccgctccccacaggctggctccagaccacaagagcgtgggaacctcatggagagtgggtgcttcctctgtcttcctccctagcccttgctttagcacagccagggcagagaggaggaaagaaggaaactacagcaaggaggatttagggacaattctagaagggatttccaatttggaggggcagtctgggaagtaggcagcctgtgaacttaataggaggtcctaaaggacctgggggaatttggggagaagacgaggtgggctgccttaccccaatcttctggcccactcccagctccagacccacctccaggtgtagcaggcccccaggcccaacagcaggagcaggaggcccaccagcagtcccaggacccagagcagctgctggaactgatgcaggcggtgcagggctggaacacagagcgggactcagagcagccacagctgcaggcccccagtgcttccttccaaggggacccacccaagatgacaccttctaacttttgctttatcgctgaagctctccacacaagggtgccccgagcaatcagtttagagtcgacaggcaaatcatgctgcagcaggagggatacagggaaggaagcctttgggcctaagagctgggcttttgtgcagagtggcctgggagatggagccccctcccctcacctctgaccccaaagtaggtggaggtagaggcagagcccaggacatttgaggcagaacagatgtattccccttggtcgctgggcctcagcgcctcgatgtccaccctcagggcattgggggaagccaggacatggatgtgtggctctgcaggagcaccctggggctgactggaggccaccagtcgactgccaaggtggagagtcaggctggcgagcggctcgctgtccactcggcaatccaggatgccccggaggccaccctcaggctccacgaagaccatcatggtgggcgtcttgggagggtctgtggggaggaagggagtgtggtgattgcagacaatgaccacaaatttctccctccctgtacccatgcacagtgactttgctgctcctcccattaagaggcagaacctatttcctcactccttgaatctgtgactcagtttgaccaattgaagaaagaagtgatgttgtgcaacttcagagccagacctcaagaggccttgtagcttctgctctacttgttggaacacaacaatgtgggaagcccaggccagcctgctgggcacatgtggcccaactggcagccaggagcgtgcagtcatctgagaccactgggcaactgcagccacatgaggtgtgaacaacagaagaactccccagctgagcccagcccacagaattgagcagataacatgacttttgtttgaagcagtaagttttgttgtggtcaatagcaatagctgactgatacagtgtaggccttggtgaaggctggagtgggagaccaagactgatgagggcttatcgtgtgccagacacactcagcacgctttatttcttttggttttttctcttcttttcttttcttttttttttttttttcttgagacagagtctcagtctgtcacccaggctggagtgcgttgtggtgatcttggctcactgcaacctccacctcccaggctcaagtgagtctcctgcctcagcctcctgaatagctgggattacaggtgtgtgccttcatgccgtgctaattcttgtatttttagtagagacggagtttcgccatattgaccaggctagtcttgaactcctgacctcaagtgatccgcccacctcagcctctcaaagtgctgggattacaggcataagcccctgcaccagccatttatttcttatacaacttgcaggatgaggcgaatgatgtattccccattttacaaggtcacccaaccagacagcgggagagccaggattccaacccaggactcaatatccgtgaagccttcactcttggcagacagaagaggaggaagaactgaggtgggcgtgtgagatgtggggagactaaggcggaggagggggttcacactcacagagcacacggagcatgactggagcagaggcagcagccccagtggggagctcagccaggcagtggtacatcccagcttgagcacgagccacgtgggtgaaggcgagagtgggcacaggctccgcgtgcagccgccggtcattccagaaccatgcaaaggtggagttgcccacaggcccagggccacccaggaggcggcagctgaggttcagggcagcgccctcaggcacgtccaggccaggctctgccaccacgcgtgcacctgcgggcggaggatagagagatgattggggatctgtaggccttgggggctggagcctctgggtgggacctctgaggggcctctgcacattgtgggaaggtctcagtctgacttggtatagggctttccaaggtggaaccatgccccctccagtgggagctgtgccccctccaccagattaggcttctcaaggcagagctttctcagaccagacagcccgctctagtgggagctccagcccctctcgtggacttggacctgagagcatcagagcccctcctcctcccctctcttccactcaccttctacctgcaaccgcccgatggtgctgattgagcccagcaagttttgggctgtgcaaacataggtgtcatcacctgcaggcacatcttgcacctgcagccgtagggcgtttcgggccacctggacatggcctgtccctgatgccaagctgtggaccccgctgctcgtggccagcaccttgccatcatgagatagggccagctcagcaggtggctcactgtccacagtgcactgtatcacagccatggatctggccctggagtcccggaaggaggacaggacagcgtcctgaggggcatctgtgggcaggcagggcacagatggggaccttgcttaggcaccctgtactgctcattgcctagctgcctggggttggtcaggctgaggcctctggaccaatggccacttcctagaagtgacaccttcccaggagtcctgtgggcagagtgctccaggcagggcttataggactgtctctttctctagcacctatgtcctctttccccaactgcccattcctgggcccactgcagtcctttgcccactcccaccagagcccagaagcaccctccaccaccctcctcctgggcagccctggccaaggaccctctgctcacagaggacttgcagggcagcaggacgggagctgcgggtgccctgggcatcctgggcctggcaagagtaggcgcctgcatgagcccgcgtggccaccaggaatgagagtgaggcagctggaccctcctgcagccaacgaccgttgtggtaccaagtatagagtgtgggtgcgtgggcagcagggtccgcacaggtcactgtgatgggggcaccttcaggcacggcagcctccggagccaggatcacccgcacacctgtgccaaggaggccaggatcagccgggcccagccggacaccacagtgggcttccatcccagtgggcttggcctaggccctgccttaccctccagccgcagctccagggacgtgttggcctggcccagagggctgcgggcagagcagctgtagaaaccctcatccctgggctgtggccctcgcagctccaggcgcagggtgttggggacagaggctgctgtcgaggaggccaagaggcgaccggcgtggctgagggccagctgggcgggcgggcggctgtccacagtgcacagtaccagggccagctgcccgccatggctctccaggaggtaggtcaggcgcaggttgcggggcgcgtctgcagggcatgagaggcttacacggagtcacaggcagcagcctgcaggaggccagtttgcaggtggcattcaaactcaggagggccctggctccccacccctatggctcccaaccacccagtctgaggcactgctcctctgcccagacaggactcaccccagcgccccctactcttaatgctccttgcccagtgctccactagctactgggtaccgagttccccactggacacctgtcgggttccggccatgccgtgatccctgtgggcttctgtcattcctgtgagtcccaccctgcatccagccagactcacagaggacgtccaaggtgataggtctggagaggcggggtgcccgaccaggggggcccacaccgcagcggtaggaggtggcatccctgactgtgacgttgggcagggggatggagtgggcatccaggcgctgctgcccatcctggtaccatgtgtaggtgagctgggccgggtgagtggtccacacaaggcaggtcaggttcaccagctgcccctcccgcacggtagccccgggccacacctgcacattcacagctggggagagggagggcacaggacaccagtgagggtcttgaggctgtgtacagcaggccacctgtctccatgtgggtgagctactcctactgctggggagccccttggcctttgggagccttgggtggcccacctataaatgtggcttagaagtcaagcttgggaatagcccactggctcctgagtggtcccaagtagagttccacagagtcctggaaagccctgagcccctccctgaccctggctgggggcaaatggggagaccacagacctcccctcccctgctgcactttctcctgaaattccctgtttagttttatccactgggcatacttgtaaaatttggtgtttataaaaggttctcctaagaaactcaagtctggagtccaccatcgttaggaagggtgggaatggggactattcccgtgcccccaggcttctagaaccctgtcccacctcctctcctcttttaaaggacacacacacacacacacacacacacacacacacacacacactgaccttgagcgtcgaagtcagctgaggccgaggcctggcccagggtgttggaggcctcacagatatagacaccctcatcctccagcatagccccgtggatctccagacgcagtgtgttgggggccacagccacatgcagcctgggagagctgccttcgggtccccccacaccttgtagggtggaggccacaaggcgatccccgtggagcagccgcagctgggccggagggtcactgtccacacggcacaggaggaggcccagtcgtccagggcctgtgtccatcagggtagtgagtgtgacgtggcgtggggcatctacacagggtggggagtggtcaggacccagccaggggggtccctcatccagggctctgtcatgtgacacagcccaggactgggggactgcattccttcccccacacctggatgggacaaaagtccttacaggacacgtggaggctgatgggtgcagctaggctcgtggtggctgagcctggggcctgggcttggcaatgataggccccagcttgtgtcaaagttatggctgcaaagcggagcgtggccgaggtcgactcctggaggggctggccatcccgataccaacgatatgaggtcccctctgggactcctgtgtgtacctggcagctcaggaccacagcctggccctcttggagctcaggtgatggtgacacctggacccaggctcctgcaggggaaaaccaagagcaggtgagggctctccaccacacctctcacagtctgggaccatgtgcgtgtccacctaggactacacaacccaaccccatgtgctggagccgcagccccttccagaccaccgccagggcccactcagccctatgccttggcccctcctgctccccactctcctgcacaggctccatcctggcatttacctcccaccacctggtgggatggttttactgtgtcagtcatatctcgcctaccaaagcgtaagccttatgggcactggacttgtgtgacctgtaaccccagttccaggcactgtgcctgcatgtgttagctcctgacaaatgttggttcaacccataaagtactgaaaagggagggatttagatcatcccggggccattgtcctaactaggatctggactcagcatgggtgaccgagggcttggaagggaatgttagcagctatgttatcttgagcgctctcgccaggccagccctgcatccagactccaggccacaagagcacaggacctggggaccaggcaaagggcagctcctcagtggcccctgggtgtgaagcaggagaaccccaggttgcagggagtgagatggagggacagctggaatgctaagcaagaacacagaccatgcctgagaccacagctagcagggtcatgcaactggggaaaagctcctaaaactcaaaccttcaatttcttcctgcgaaataggtatgctaagtaagaaaagatacacagaaccaaggctcaaagtaaatgtcccaaaattggtgctgtcggtcaccgtggtggaagaaacactcatgttcctttgaccttcgcattatgggcattatctttcctttttcctggtttatttgtttagggagaatttttttttttttaagacagagtctcactctgtcatccaggctagagtgaagtacaattttggctcactgcaacctccatctcccaggttcaaacgattcgcctgccttagcctcccgagtaactgggattacaaatgcccaccaccacacctagctaatttttgtatttttagtagagtgttggccaggctggtcttgaactcctgacctcaagtgatccgcccgcctcagcctcccaaagtgctgggattacaggcatgagccatggtgcccggcctgagggaggatttttatagagactatatatatacacacacacaaacacacacacacacacacacacacacgtatgtgtatataaataaagaatatgaatatattatgcataagaatacacataatgtatatttgtatgtgtatatactcatacataaacatatatgcataatataaatatacatatgtatgagaatgtttactatgtaacaaaattatatgatcacaaaacaagttatttcagaaagtgctcccaccaagcaagccactctgtgaattgccattgcctcctagtggctgctgcagttattacaggtgaaaatatctagctggaggcaaagggaggccttctgctggctggaaactgcccttaccaggactgaaaaagacatatttctgcacaaaattcacagcacccagcccaaagtctgaccagagtagtccccagggcatcagagtctaccatatcttcagaagactgacactcacctcggacctggaagaagagtgaggtgttggatgatccaagaacatttgtggcctcacagcggtagctgccagagtccccaaggcccagttctcggacctctaacttcagggagttggcctcagctttagcctggaaccgaccatgggatgggacctggggacccaggctggtggccaggaggtgctccccatggaacaaggccagcaaggccagggggcggctgtccacagtgcagatgaacagagccatgtggccctggcccatgtctaggagggctgacagctttggacggtccgggggatctgcaggaacagagggagctgaggccacccagcctagctcaccacattacaactgccacactatgtcccccacctcctgccacacacacagcctaagccatgctctttcctccccaaaccccagcccggcccctgcttctccccagaccacccctccaccctccaagtccccaggctgcccatgccagtcacccacagagtacactcaggagcacgggagtggagagctgggcaccagcctcagtcaggatgcggcaggcgtaaagggcagcatcagttctggccacgggcagcagtgtcacggtctccaggggaccctgggcccacagcaccccatttcggaaccaggagaagttagcagggctgccagcagcttcccggctcacgttgcaagtcaagttggcttctgtgccctcctgaagtgtgtgtgatggtgcaatggccaggacagtggctggagagcaggcggcacagcttactgaccacccccggcccccaggagccaggggtccagccgcccagcctggaaggagcaggaaggaggccccctggggtgcccacagggttggggagaaaagcaagctagctcacagggcagcctaggagaagtgggccctggggactgtgggggccctgggcagagagggttgcagtacagggaaggaggacaaggcagcccaactgtcccagctggggagtccttcctcagagaccagctgtgttgcctatccccggcctgaacagagatcatgggaaggagcagctccgctcttcctgaatgtggaggagggcagcgaagggcccccactgctgcacagagtggttttgcctgattagatcctcctcggagcagaacagtccagagctccagcccctgcccccaggccacccattccctgcctgactcaccctggccattgaaggtggctgaggtggaggcgttgcccagggcattgctggcctcacagaggtacaagccctcctcttccagcaaagggttgtgaatctccacacgcagcaagttgggggctttggtgaccttcatgcgtggggaacagcccccacaggtgctgcagccaccccctgatggcagggaagtggccacaacacggtccttgtggagcagctgcagcctggcgggggggtcgctgtccacacggcacaaaaggaggcctcgccgtccagccccggccccagcggcatcaaggtccagcctggtggtgaatgttggttgtcgaggggggtctgcagggaggaagaacatgggcactcatcccacggatgctccagggccccacaagcctggctaggctcccagaatacactggacaaaggcagatcccgaaggctgccccaagcagctgtgcagactgtgcactgcacaagggcagccagaccagggtgggtggaactcaagctaggctcatgctcctcaagctaagctgtgccctgatgcctactgagtcttcccagaagaaggagcaccattttctagctcagacaaaggtgctgtatgggctggctgccaccttgcataagtcccatctgctgctgagcagggtgcccacctagcaatccctgggggtcatgctgtctgctcccaccctgcacccaatgccttaccacggagcctcccctcaagatctgccctgcagcttatctgtgatctccaagccagctcctgtgatactagcgaatgcatagaatggcctcttcctgaaggcttctggagacagttggccaaaagagagcaatcagccaaggcccccatgtgatctcactcagacaccagaaaactttgcagaggcagctgccctctgacagttccgggacgtggctccggcacacatgtgtcaggggaagcctctggaatcaggcccttggtcttacacggagcctccccgcttggcggatgcagaggggctgtctgtccctgtgctgaggggctttgccttggtgtctatgggagcccagcacagcctgtggggcatgtgcacaaatagaggagtgtggtgtcccagggctcacccatgaggacaaagcatggatgtggtgcccatgctgagcttgaggctgggacagaggagcccacagggctggcattggagggtaaagacatggggaggtagagaaggccccagcctcatttcctaaacttcagccccacatggaaagacccactgtggccaggtctgtgacccagccctcccgatatagaccgtggggcagggcaggacagggctggggggcctagaggaggtggggtggctggtgggtcccggcaggaggctgcaacaggtggtggctgctcacagagcacagtgagaacagctggcgaagaggggccactggcactgtggccgtcccgggcccggcagtggtatgagccggcgtcagtgctggaggccgcggggagcaggaggctgctgccgggaccctcgtgaagcagggctccattcaggtaccaggagaagcgggcatcaggtgtggggcttaggccgcttctgcagctcagtgtcactgcctgtccttccaccacctcggctgccgggctgatgaggagacgggcggctgcggggagaggaagaggctgggaagggtccctcctctcaaccccacatgctgccctatatagaaagccttccagggttctcctttccccacactactgtaggtagctctgggctttgtggtgcatcaggagggtttgccctttaatgccaaatcagatctattggtagtagatggctgcagcatggttgaagattcagagccagagcccaggcttatgtccaacacctggcttggctgggcatggtagctcatgcctgtaatcttagcactttgggagactgaggcagaaggatcgtttgaggccaggagttccagaccagcctaggcaacatagtgagactccatctcaaacaattttttttttttgagactgagtctcactctgtctcccaggctggagtgcagtggtgtgatcctggctcactgcaacctctgcctcccaggttcaagcgattctcctgcctcagcctcccaagtagctgggattacaggtgtgccaccacacccagctaatgttatacatgtagtagagatagggtttcaccatgttagccaggcagatctcgaactcccgacctctggtgatccacccgcctcagcctcccaaagtgctgggattacaggtgtgagccactgtggccagctttttttttttttttttttttttttttttgagacggagtcttgctccgtcagccaggctggagtgcagtggcgcaatctcagctcgctacaacctctgcctcccaggttcaagcaattatcctgcctcagcctccctagtagctgggaccacaggtgtgcgccaccacacccggctaatttttgtatttttagtggagacggggtttcaccacgttggccaggctgatctcaagctcctgacctcaggtgatctgcctgcctcggcctcccaaagtgctggaattacaggcatgagccaccatgcctggccacaattttttttttttaattagctgggtgtggtgacatgggccgtagtctcagctatttgggaggctgagatgggaggatggcttgagcccaggagtttgaggctgcagtgagccatgaacataccattgcactccggcctgggcaacagagcaacaccctatctcaaaaaacaaaaagaaaaacctggcttgatcaattagctaccatgccctcaggaggagggaaggacagtgcacataccgaaagttggaagaccgtacttttcttttttctttttcttttttttttttttttttttgagacagagtctcactcttgtcacccaggctggagtgcagtggcgctatcttggcccactacaacttccacctcctgggttcaagcgattctcctgccttagcctcccaggtagctgggactacaggaactcaccaccatgcccagctaatttttgtatttttagtagagatgggatttcaccatgttggccaggatggtctcgatctcttgacctcgtgatccacccacctcggcctcccaaagtgctgggattacaggagtgagccaccacgcccagccagaagaccctacttttctatttggcttcccacatctgactgctagcatagagcctgctcccagagtttcataattaaaaaacaatgaatgcttctgagggactctccaagtttagggtcagggtaggtgcaaaaggaatgatgtgacctgttgtgtttccctttttcccttgacttccaggaagctctgccgttgggtcactgcacagcccctgtcttttatgtggcgtagccagttagctcagtcctgcggttgagtccactagacttctagaaggaacagactggagcaggctcctcctcaggctccctccactctccctggctgccagtgcccatcttaccattggcatggaagtccagggtggaggttgcatttccaagggagttggtggctgagcacttgtactccccactgtcagtttcctccaggtctcggatctccaggcgcagggagttgggaccagaggtaccactgaagcgtgggctgtgatcactgtccccggaggtggaggccaggatatgacccccatgtgacagcaccagtgtggccaggggctcactgaccacagagcagtgaaggatgcccacaagtcccgcctgggtctccaggaaggctgtcaggactggagtgagaggcgggtctgtgtggagacgagaggtgggcctgtcaccctcagacaagggcattccctggataccctgatacaacccgtgacctctgcaccgctttgtcccacactgccctgtgagaagggggtgatcccaaagtgcctgagtgcctgctgaatacacttttgtccttggctgggctgggtacgtcactctgttgtcccagtcagtgttcaaggccaccctgcaagtggggataaaagccccacttcaaagatgagaaaactaatagagagacctggtgagggacagcacctcagccaggtgaccaaagtgagcatcatcagcaatgggacaagctgacacagagtgcctcctgacagggcagagcagcatgtccgcggccttcccacccagagggcatggtctcaggccattcaagtcaggcaaatgtggagtgagggacctcctcagaacagcaggcctgcactctgcaagtttcaatgtcaagaatgacaaggaaagactgaggaacagtctcagactaacggagaatgaagagacgcaacgacccaatgcaatatgtgaactgtgattgtattctggaccagaaaaaaaatggctacaaaagacagtattaggtccactggtaaaatgtgaatatagattatagcttagataacagtcttctatcagccaggtgtagtggctcatacctgtaatcccagtactttgggaggccgaggtaggtggatcacgtgaggtcaggagttcaagaccatcctggccaacatggtgaaaccctgtctctacaaaaacacaaaaattagccaggcaggatggtgggtgcctgtaatcccagctactcaggaggctgaggcaggaggagaatcgcttgagccccagaggcggacattgcagtgagccaagatagcaccattgcactccagcctgggcaacacagtgagactccatctcaaaaaaaaaaaaaagtcttctatcaatgctaattttcctgatcatgatcattgcattgtggatatgtaagagaatgatcttaggaatttagcggtaaagaagcctcatgtctgcaacttcaggaatataaatatgtaggtagatacataaataacatatgcatatgtatatagagtgtccatatatgtataagtgcacatgtccacatagagtggatgtgcatacacacaagtgcacctgtatatatgcaagtctatatccatacatttatatgtatgtatgtgcgtgtgtgtgtctgtgtagacagcgagaaagattaagcaaatgtgccaaaatgttaataaatgggaaatctaggttaaaggtatataatcattatttgtctttctctgcaacttttcataagtttaaacttccaaatataaaataggagggaactagggaggtcaaagcattgcccaggtgtgcagagctgggacatgagctcaaggccacctccaggtaagtggccttgaagttcccatgcccaggaccccaacccttccttggggctccaccatctggtcctgctctgactgtgtccagtgccaccccaccctggcctcttacggttgactaccacgctgacagggcccgagcgctcgctgccatggacgttctgcacctcacagaagtagaagccagtatcagccctagtggccaagtgcagccggagggtatgggagtgggcatcctccagcaggacatggttcttgtaccagctgtagcggagatcactgggtgcctcattgggtgtgttgcagactagtgtcactgtctggttctccaggatgggacctgctgggctcacctggacctcagccactgcaagggcagcatagggagtgctggggggtcccagccaacttccagccccagccccatacagtccccgggtctcagccaatcagcctcaatctctgcacatcctacaccacccgcctgctgctacaggggagcctcctggagtgctctgcatctctttgtcctgctcaccaggatccccctgacaccccacccttcgtgggggtattgtcacctgtctcatggtaaggcagggctgggactccacacctgcatccaggaagcactgggttatgccagttgctggccctgccctgccctgtctcccctccgtccctgaggcctgagctcctccctattctctggccaatacgcaaccttcccaagaactcactgaagatgtggaggctgatggggggtgagaccaaagagcccacgccgttctcagcttggcaggtgtagacgccagcatcgctccaggctgcctggggcaggtgcagcacaccagtcttggtttggaggcgtaccccatccttgagccacttaatggaactgactgcagggtagctgctgttcacctggcaggtgagtgtgaccagctcacctggaaggatgttcctccccgaggggctgaggaggatcttcacacccttgggggcatctgcaagtcacagtagggggtattgggtaaggtgcttggggagggcagaggatggcacacttcttcttgcccccctttaaaagctcagtcctaaggaagtatgcccagataaaacagcagtccccttcaatcctcacccagggcatgctctgtctgcccatgtccgtccctttcccgccccctgcgcctgatgcattcctatgcccattgagagctgatcatgtgacgcttggccagcgtccagcctaccccaccagctgtagttttctgcttcccaatgctgtccattgctcctgctctatttgggatgagctccacacacagggtcatgggtaccccactgctagctttagtggcctgtggaagctattggtaagggaccaactacctagtgggagggggccaaaggcagcatcaaactagctctgaaaatagttacccagtttgtaagcaagaggccaacaacacaaagaactgcatttccttaaatcttgttccaaagcctctctctgtgtattcaagtgttttattcttatttttttagaaagaggatctggctcagtcagccaagctggagtgcagaggcacaatcatagctcactgcagcctgaaactcctgggctcaagtgatcctcctgcctcagcctcccgaggaactgggactacaggtgcaagccaccacatccagctaatttttgttttttaatttttttgtagagacagggtctcactatgttgcccaggctggtctcgaactccttgcctcaagcaattctcctgccttggcctcccaaagcactggggttacaggtgtgagccactgtatccggcctcaagtgtttaatatgtgccaggcactcttctaaatccttgacctgggtcatctcctttatttgtttttgttgttgttgttgttttttgtttgagacacagtctcactctgtcacccaggctggagtgcagtggcacaatcacaactcaatacaactccacccccggggttcaagcaatcctagtgcctcagcctccttagtaactgggattacaggcatatgccaccacacccggctaatttttgtatttttagtagagacgaggtttcaccatgttggccaagctggtcttgaatccctggcctcaagtgatccacccgcctcagcctcccaaagtgatgggattacaggcataagccaccgcgcccggcccatctcctttaatttttatcataaatctgtgagacaggaaccatctattgttatcttcgtcatagactgagaaaacagagccaggcaggaaagggataaatcccacctccccagcatcctccagcacggggtaaatcccggggcacttgctgccaaccctgaagctgcatgggagctcctgttccccaaccctttgtgtctccctttctctgcccagcctggcctcaaggacaagccccttcgaagcagtaggaggtggagggaaccatttaacgaagtccttggggctcagcagtgtctctccacttgccctaccctggaggcccaggagcagcctggttttgcatcaggagcaagggttccgtttctgtgggctggagaggggctggtttctgtcaggagcaacagatgcgctcagccacaagggtgtgtccccagacaactcacacttcacttggaggtgaatctcgctctgagccctgtgattggccacggagagctggcagcgcaggatccggccgtggtcctgccaggacatggccatgtggagggtctccaggtggccgacgccggtgggctcaaacttctggctgttgaaggtgacagagcgagcagggtcctggccttgccactgcagtctgacctgctcctgcaggcatacgtagggagtggagcagttgaagtccacctctgtgccctcgagaagctccaccggggaggcaatggtgggcaccctgggctcctctgaggacagagacagcagtgctcaggacccgcttttgccacccctgagatccctcgccctggaaaccccagctgaggagagagccctggggagggggcttttaggggaaggaaagacgctttctactccagccccacttgggtgaatacaagggagaaccaggcctgggcctacgccggggctggaacagaggctgagactggctggggttagattcaggacaagggctggggctgagagccaaggggtccagaagcagcttgggaatccctcccggggggcagccaggccaccccacttatcacctgttactgtgaccaaggtgcctttcacatctgaccagcggttgacctcactgatctcgaagcggaagttgtaggaaccagagtcctcgggctgcaggtccttcagcagcaggttgcacaccctgtgctcggggttccccatgaactcggtgcggccgcggaagcgggcctccaccagcttggggtccgccgagtggctcaccacctgccgctggcccgagtagtcgtagtaccagatggccgtgatgccgtcgggcacctccacgtcggcagggaagctgaagatgcaggggataagcaggcaagaccccttcacaccctgcacgtcctggggactggagacgccccatgaggcctggcctgggggaagaacggcagggggacagaggggagggtgatacaggcctcagggtgccacagagccctgcgacctgccccagagaaggtgccccagctgggctcccaaattctgccctgccccgagaaatgcacacttagagcagcccttctcagtgccccaggggtcagtccactgcccgaggctgctcagaggtttggtagggtggctcgaagacagatggcagcttcctgcccagctcctggccactgcccgattgggccctcccttgacctcagcaaccaaacatgtgacccaggcatagtctaatctgccaagggctggacttatgaaggctggaccctggaagacaggcactaggcccgcaaagcttacctgctgggaagaatgaggccaggaggagaagcttgggcaagaagcccatagcaggttcttgtgctgctcctgttgcctaagagggtggtgcgcactgcgctggctgggctcacaggggcctccagggacacctctgggcactttagccccagcacctgctagaagtccgagcctgtgtccccacctcctctgctggccaacccaataagagggcagggctcttaaagacctctgagtcagacaccagcagagagccaggaggccacgttcccagctcaggctgtgcccaggaatgccctcacttggtggcctgcctcagaaaagcctgtgtgtcccttggccctatcccaagttctgctttcccagcccctcaaggataccaccctaaggcagatgaacagctgtttctccctcttccccacttccctgccccctccccaccacccaaaccaacaggaactggagcccagagatgcccagttactcactccaagacacccagctagaatgatggtttcttcctgaggcttgtctcctaccacctgccttactaactatagaccataatggggctttactgaacttgccgaagtgctgcctttaacagtcactcccctgctcaaaaaccttctgtggctccccattgcccgtgagatgtgaaaagtcctcatttcctgcccccagctctgtccccattccctgctctccgcagacccactctgggggcagttctgtctgctcaagggctccctagctgcccagctctatctccaccacagataatctttgcctgctgaaaccttattcaaccttcaaggagcagcatgaatttggcttccagctggaacttctcctttgaggttcctgtagctaccccagagctatctctattttccttgccttgttttttacagcttgtgagagcccatttctcaggacctagaactgaagatatgtgccccatagcagtgcggagcctaccaggcattcagcaaaccccttagtgactaagagaggggtgaggtctttaggggttcagagctgaggttcagagttggagtggggaggtggcaaggcaagtctaggtttgaaaggtagcatgagagcgctgtggaacacataccccacaaatatgagctcaatgtgtgcggagtgtaccatatccaaaaaggcaggccctcaaccatggagtgcccctggtcagggagtgtctaaggggtaccatagacctgagcccaaaaggaagagatgccagaaacacatataagtgaaactataaaactcttagaagaaaacaggtgaaaatcttcatgaccttggattaggcaatgctttcttaagtatgaaattaaaagcacgaaaaaaaaaaataggtaagttggacttcatcaaaatttaaaacttggccagacacagtggctcatgcctgtgaacccaacactttgggaggctgaggcaggaggatcactttagcccaggagttcaagacgagcctgggcaatactgcaagactctgtctctacgaaaaattaaaaaacaggcctgtggtcccagctactctggaggctgaggtgggaagatcgcttgagcccaggggaggggtcgaggctgcagtgagccatgattgcaccactgcactccagcctgggtgacagagcaagaccctgtctgaaaagaacaaacaacagctgggtgcggtggctcacgcctgtaatcccagcactttgggaggctgaggcatgcagatcacaaggtcaagagattgagaccatcctggccaacatggtgaaaccccgtctctactaaaaatacaaaattagctgggtgtggtggtgtgcacctctagtcctagctactcgggaggctgaggcaggagaatcacctgaacccaggaggcggaggtcacggtgagccaggatcacgccactgtactccagcctggtgacagagtgagactcttctgtctcaaaaaaaaaaaaaaaaaaaaaggatatgaatcaaaggacactatccagagagtgaataaaaggaggacaacccacagaatgggagaaaatatttgtaaatcatttatctgataaaggactaatatccagaatatataaagaattcctacaatgaacaacaacaaccaccaaaaaaaccatgaaatccaactccaaaaatgggcaaaacacttgaataaacatttcttcaaagaagatatataactggctgataaggacatgaaaagatgctcaacatcactaggcattaggaaatgcaaatcaaaaccaaaccacagtgagataccacttcacatccgttagaatggctattcacaaacaaacaaagcaacacagaaaacaataaatattggtgaggatgcgaagttgaaattcttgtgtattgctggtgggaatataaaatggttccgtcactgtggaaaacaattgggtcattcctcaaaaagtcaacataggattaccatatgatccagcaattccactcctaggtatatacccaaaagtactgaaaacagggactctaacagagtacaccaatgttcacggcagcactattccactaaaaggtggaaacaggtcaagtgtccatcagtgaatggatgtggataaacaaactgtggtatgtacatacaatggaatatcaatcggccataaggaggaatgaattctaacatatgtgaaccttgaaaacattatgctcagtgaaaccagccagacacaaaagggcaaatattgtagggttccaattacatgaaatatctagactacgtatattcagagactgaaagtagaataggatagaggtaaccaggggctgcagggagggggagctaatgtttaatgattgctgagtctctcagataatgaaaaagttctggaaatagtggtgatggttacacaatattgcaaatgtacctaatgtcatggggtgtacacttaaagacagttaaaacagtaaattttacattatgtatatttcaccacatacacacccatgttgccaactttgcaatcctccctggtcctaaatgctgacttggccaagtgaacgaggaggctggaagtggggacaggaaactcatgacctcccagctcccagcccatccgcctcaggggctgggctcagcagattccaatgactaccaggggtcacacctgggaagggggtgagccgaggcccagggccagtcaggctgaccaggtgggacttagcctgctgcagaaggcagaaggtgccccagcagggggcacagtacagggcgggattgggacaggaaggacaccgctccccaggggacccagccctctcgcaggctgctggagtggactgatctggccatttatggaggcccaagggctcatctccagttctctaggaagccctaggcctcctcctcttctgggaagatgcacccccagcctccacaccaggttcttggccactggagaatgatatagctggggccctgggacctggacacctcaccgtgaagaaaagcagcctgctgggcacactgggggtcagatgtgtccctggccacaggggatgtcagggtcagctctgctatggccagggcagctatcttgtcccagctcccctgttcctcccatttggggtcctgaaaagggcaatcgtgaacctgatggaagaatggtggggttctggacacagcgaccctggaacagggcgcgggggaggaccctttccaggaccactcccatcacataatgtagaggccacctatgcttagcccggccctaaccccaaaggggtcagccccaccggaatccagcctattggctcagcctgtcaccacaaaggccagcttcagcccagataactgttctggaaacagaaagagcagggaccgctcagaaaggagatctctgtccctgtttgaaagcctggagttgaggggacagtgccccgccccccgccccccgcaacttgggttgcagctgtggcctagtgagcacgcagcgccccctggtggtcgagggggaattgcgggtcccgggaaagggggcggtgtgccagcaacagggagcaggcagctctgcagccctgaaccatccctcccttgggtgactcttttggaaatcattgttccccagacaggaggttcctgaggttcatacttgggtctccaagtcttgggtgctctgaagacaggattttaaatccccactcctactattggtatgtgttgcatcagggtggcttgagctggcctggtacacagtgggcactcacgtttgctgcctgtttgagaccaagtgcctcaggaggtcttggagggttggctggggccccaagtccctgacctctgattccagaggccaagtttagctggggaagaaagggcagaggcagtttccctatggacagctaggcccgggtgtaggattcagtttctgtttcctgacaccaaggcttctccccaacttccccattgggctagagaaggaagaacacagggtgacatggccagctggaggttactggcccacagatagggagtcagggtacggatgggcaattcctggagcagattatggtcaaaatagtggaaatccccaatcacaggccaaatgtttaattctcagagccatagaatccataactaatgcttattggctttgacatgggcagtagaaatttcacacttcattccttaatctggctctaaatgcttctggctggagtgctcactctccaaactgtgctggacagcaccagaagccctcctgtggacggacgaagtggtgatggatgaagtggaattgtgctggggttagagtaaggagagattatcgttgggctgggctggggctgaggtcagggtgatgatcaggttggaattctggaagcaaattaaggctgggattggggtggacattgaggttgagtgatgggtgggggtaagggtgaaggttggagttgggtgcaggtgatggttaagatacggtggaggctgggttgagatgaggatgatagagtcggagttgtggttagggttgggatgatggatggttgggattagatgagatgagtaaatggttagggttggggtgcaagtgaggtgagggtgagataaggttggaataggggctggggctggggctgaggtagggtcagagcagggtgatggtcgggactgggattgggatgcaggttggaaggatttgggggtggtggaagggtttcagttgagtccatctttgattagtgtcttggacttgggttggtttggggtccaccactcgcacccagatggagcccccccccgacccctgcccctatcccgctcagccagtttcagcccagccccgctcctaatgctccactcaccctctgggcccagggaccagggacaggggtacctgctccacagaaggaagtggctgcggcggtgctggacctgcggagaggagaacaggaaggacggccaagagctcctggtgcagctggctccccagggctctgccggctcaagagagaaggatcccgtatcaggggctgcttcctctttcccaaagcctcagctctactgtccaacccagaggctggtcagggaggcagctgcaggccttgcgcaatgccaaaacgggaaagacctccataggggaaggccctcggcaaggccagggacttagggactccagcaagcagaagtgggaccgctgcaacgctggagcctccccaggcaaagtgagaaatggagtgggggactcccattcaccagccaaatccacaccccactctctctgagccccttagggaggctgggggaggtggaagggggcttcctgcacacagctctcctccctgacacctgagagggaggcgcgcccagcctggggtggggatgcactacacgatgcccagaccaaggcagttattctccaagccattcaggagcctccctgtaccactgagtactcttaagaacccccaagaggcagtcccgtgttgtgggggacataaggccccaatgtccaggacactcctcaggttttctctttcccctctcactgtcctgtacgttttttggtttttggcttcttgttgttggtttttttctttttgttttgtttttgcttttgagatggagtctcactctgtcgtccaggctggagtgcggtggcacaatctcagctcacggcaacctccacctcccgagttcaagtgatcatcttgcctcagcctctcgagtagctgggattacaggcatgcaccaccacatccggctaatttttgtatttttggtagagacggggtttcaccatgttgtccaggttggtcttgaactcctgaccccaagtaatctgcctgcctcggcctcccaaagttctgggattacagaggtgagccgctgcacccggccactatcctataccttcacccccaccttgggacaggaaaggaaagcccccaccacagctagttactgttacattactgcagcccatcttattgagggcctagtttgtgcaggcacttgacatgtgaagcagatgttaattgctccaagcaatcccagatacaagcaacaagactttttttggtttttgtttgtttgtttgtttttgttttttgagacagtgtcttgctctgtcgcccaggctggggtgtcctggtgcaatcttggctcactttggctcactgcagcttcgaaattctaggcttaagcaatcctcctgcttcagcctcctaagaagccgggattacaggcgcttgccactatgcacggctaattttttaagttattttgtagagacggagtctccctatgttcccaggctggtctcaaacacctgggctcaagtgactctcccacctcgacctcccaaagtgctggaactacaggcgtaagccaccactcctggccatttttttttttaatttcacaactcaaacttaattcaactcagtccctgcctacctgtactggtggggagctggccacagcaaattaggcccctgtaccctgagggcaaggccacgtgtgcaggtgtaaaaggatgtgaaaccctaaatcagggtggatccagaatcgcaggccatggtgccccaaagcagatgtctggtgacattccaccctgaaatgctcaggctacagagatattaggtctctatcactctgttcctctttatagctcctgtgtccactcctatgcttgggccatttcctctttcggccaaaacacaaagggttcatcccattacttcctccctcaacagctggtccggagacacccagctctaggcctgtggggttgtgacacatgggtaccaatccttcagtccactgggactctatacatccaccccttggcttcatggtgggaaagcatcccttgactttgaccttagtcatatgacttgctctggccaatggatgtgcacggacatgacacaaactaagtcttgaaacgtacttaagcagtttgcctttccccctgaatttctgtcattgccatgcaaggggcaggctccaactaacctgctggtccaaagaggatgacgaacacatgcagatgacctgaatcagacccatggattgaaacaaaactcagctgagcccagcctacgtccaccagaccagtcaacctgtggatgcgtgaatttattgctggatgctgctgagaattttgtggctacattagcaagatgatacaaggcctaagtcccagaacaacacacccagaacttgcttacctttccttagcatgaggagagcaaagacttgtctaccttgattagtcagggagcactgcttcctgtcatttccttgagtatacagcaaactaggtaaataaataaaaataactaggtaggctgggcacggtggctcacgcctgtaatctcagcactttaggaggccgaggtgggcagatcgcttgaggccaggagttcaagaccagcctggtcaacgtggcgaaaccctgtctctacgaaaaatacaaaaattagctgggcctggtggcaggcgcctgtagtctcagctactcaggaggctgaggcacgagaatcgattgaacccgggaggtggagattgcagtgagccgagatcacactactgcactccagcctggatgacagagcgagactctgcctcaaaatattttaaaaaatgtaatttctcagtaggtcacactgttacacattcatctaataacaattattctttttcttttttttttttttttttggagatagggtctcactgtcacccaggctggacaggctggagtgcaatggcacaatctcggctcactgcaactttgacctcctaggctcaagtgatcctcctgcctcagcctcccaagttgctgggactacaggtgagtaccaccagacgcagccaatttttgtatttttttgtagagatggggcttcaccatgttgcccaggctggtctcacactcctgagagttcccagtcaagtgatccacccaccttggcctcccaaagtgctgggattacaggtatgagccaccatacccagtgaattattctcgttccagataggaaaaccaagtcatagggaggttagagaatttgccaaagacaaaactttttggttgaaaaaaaataagttttgctacaagtatagaaaacaccaaataacggtgttttaaataaaatagaagtgtttcaccctctccctcaagtaagtgttggcatccaagatgatatgacaactccacaatcatgaaactagatccctttttattttttggctcagtcattgtcaatgggctgcttccagtcattgtccaaagtggctgcttgcgctccagccactgtatctgcattcgggaaagcaggatggaggaaaggacaaagtaggccatgccctctactttaagataactccttaaattgctgatgtggtgggtcactcctgcaataccagccactcaggaggctgaagcaggaggttcacttgaacccaggagcttgaggctgcagtgaactataattgtgtcactgcattccagcctgagtgacagagtgagatcttgtctcttaacaacaacaaaaaaggtaattctttaaattgtacactttattgctgcttatattccactagaagctagaagttagtcacatggtcttaagtctttattctaacaggtgatgtgcccgagtgaatcctgggggcccagtgctaagaagtagagggagatgaagccctgccctcctgtggagcaaccaggaccttaattcagtcattcattccttggacctacccagattccagcctcaggcccctgcccacctccttgccagtatctctgcagagcctcctgcctcccccagagggtgccagagccctctgcttcctcagccttcagacccacttgctgtgtctcaggtggggacaactcagtctatagaggcccaagggagatctttgagacccatactgtagtcagcttggggcagatgggagtcatgtagctcactggctaaaagcctaggtcctgcatagagctgggttcaaatccaggcatatccatcacctgctctacgatcccaggagtcactcaatgactcagaagctagagtcctctggaaagcttgtatgaagagttcccagggcctggaacatcaaaagagctctgagaatgttggctctgctgttgcttctcttattgggtatctgaaggccgtactctcctctctcctccacccgaggtgacctctactctcatagccacaccctggaccctcactcattcagtcacctcacccagtctgtcatctgtccctctggctctcctctcctgttcatgcatcttgtactcacccacttctgtccctgagtgtttcaaggctctggggttttcagagacactgaagggacctccctcctcaacacaaccacaaggtctaggtggaatgacccactaagggaccggctctgaagccagagacttccagggaaagtcaacaagcccaaggatgcccgttacaagaaagttaaaagacccatgtacatgtcctcccgttttattccctgctcagggtct

SEQ ID NO: 1175 - DNA, 42847 bp, Homo sapiens
gatattgatgtgatcagggagggctacacagaaaaggtggggcttgagtgggaccttgaaagatgagtgagatctggatgggaagaggaaaatgttccgggccactgcaattgttcacataaaagcatggagttgagtgtgcatgaggagtgactgtaacatattgagtgaattggcctttttagaaaataggttttctggggaagtggtacaagataagactagaaacttataataaccaacagagaacacctggcaggaagagagaagctgactgaaggggaaaaagaagatacacgattcatctctcaaaattgccttgggttggttctgtttatatattaatgtttttgcctgggatctttcctcaaaaactcttattttaccattaagcaccaaaaccaaatgaatactgaaataattatctgaaaaaagaggaagtaaaagttgggaaattatttccataacagtagggtatttccttaggtgaaaaaatttgagttatatcttttattatttttaatagtttactaaaagtaaagtccttggagggtaaaaaaataaactcttatcttcagtcattcttcttatctttgaaacttatctgataagagtattttcaacttttgagttgcaggaacaaacattcttaataaaattatatggtactttctttgatatctgatttctagctctgtttattgtctttcttttggcattaatattactattactgtgcttttaaaaacaggtcattcagatttgttacttttaagtacatagaaaaccttcgaatgaaatgtttttctagacatttcttttataagaacaggaacaagtgtatatgctttttctcattttaactgactactaatatgcagtattagcaagtcaattttgggcatttcaggaaacaataaaaaaagtaagatattcttatcctgatattttcctttttttttctatttcgtggttataaatgaaaaacatttagggagttctacttataaaggtcctcttgagttatatactctttgttaataaattgatgtagaacgtgttttctctcctttcaggaacccgttatgtgtagattttgttctgctttaaagttagtttccctttttattcttcataggaagtatacaaaggcaaaatgaagtacgtagacattaaagaaatacccagtcctttaaatcactggagtcagtcaagcaaagaccttaagacacagtctcaggcctcccagattatgtaaatctctctgagggaaaaagacttatgtgcaagaagttgtgaagtgacattgcagatagaatgtcaaaatttattactattatgtagacaatattagaagaattcagagaagatgagaggccaatgagcagcacaagtcattcttgacatctattcacagaggtaatagggcaaattttacatatatgaaaagcgtgagaggtgctcttcagagctagagaaacttgagtctggactgatgcgcgtaaactacctgggacagtgggggtcatttagacatggtggacaaaagttggagtcaggttatgagcagatttgaagtctaggttgaaatgtatgggggcagacatcccctgtgataaattcagtatctaaggcatgttatatggtacaacatttatccattaaataattctttcatttattcattgaacaaatagtacttgacccctaatattcactgaacatgtagtcaagtgtggggtgtataaggctttagagaaaggagagactggaataagagaaaccaagatgctgatgtagttgtccagatacgagaaaatgataactattactagaataaagtaatgaaaacaaagaggaaggactggatttaggagactttttgaactaggattagaccaatcattttaactggttggctatcgggcataaaggaaaggaaagagtagaagacagcttcagattttcagtgggctgactgagagaatcctattgatagaaagaatggaattaagtaagtggatccaattttagtgtgaagaggacaggtatcaccttaaaatagtagggtcttgtatgcaattagagatataggactgaagcttaaattaaagatcaggattggaaatagatattcgagtcatgaacagtataaagttaaggccaatacatctaatttaataaggcaaattacttattttctatgcttgatatcacagaggcaagaaataaatatcacacatgttcacaactgctaggagagatcacagaaagatgaagagaagacttacaaggggcagaaaaatgggaggaaaatgggagcagccaagtgtcacatgtgttgaggttttcaatattaattttgatagacttcttattaacaaatactgttgattgtctactatgagctgggtactattttagtcagtacatttataagactgagtataaaagtccctggctttatggaggccacctgtcggtggggtgagtgcaagagaggttgaaatactataacattgtgtgatacaatacacaggcattttaactaaatgacatagatatgaagattcatactatgagtgtaacccccaaatagtataaaatatattttaaaatggaacatttttcctcttaggtttatgattcagtaatctcaatgataataaaatagacccataaaataaagataagttgaaatgtggaatgaacagaacctgaggtgtatgacttatgcccatcaccatcatatataatacagcttctttccaagtctatacagtgttcaagtccttgaaagagggagtcggtaaagggacagggcaggactaggcacttgagatgtgtttgttactctggggaatgaagctgctgagcaggccttttctgcattgttagaaaagtgtgtaataaacaaagggaagaagcttcagtaagctggacaacacacacgagtgataatcagaaggtctctcctttgcaaatacacatcttgcttttgcaaggatagtgttgtatctcatggaaagctgtgtaaatatcaggatcctgtttatactagttagacacatgaaacatgcttgcacatgctcacatacatacacacaaacacagtcacacagttggctcttgggtaactgtcatcctttctcgtaagtttttccatggaattgatgataattcaggtaacggttaagtatggccctacataaatgcttgcttgtttagccaggaaacatttggtatgaacagcaaggtgtgactgtgaaggggttgctgatatgtatgtgtggagtcaatgtatgtttcgtgagttaagagatgatttgttgcagggctaatgatattttgaaagacaagaataagatacaacactatccttggaaaagcaagatgtgtatttacaaaggcgagaccttctgattatcactcgtgtgtgttgtccagcttactgaagcttcttccctttgtttattacacacttttctagcaatgcagaaaaggcctactcagcagcttcattcctcagagtaaagaaagaagctgtattatatatgatggtgatgggtgtaagtcatacacctcaggttctgttcattccacatttccacaagaataagaatgcctttgctaggtggcatggaaaaggaataaagacattttgaaacttttaaacacctatatgataggtctctgatatagtcattaaaatcatcattaatttactgaatagtcatcaaactataactatttatgaggtttggagagggtttgaaagaaaactaacaaaataagcctttgcaaagtgccaaatgatagtgcagaaaataaaaatgatgggagtttagaaagggtggagaataatgatataaccaaatatgaaaaataattgacagtatcttaaccaatatggtagtgcgtgtcatgtaagataaagtgaatcctgtagagatagcagttcatgctggacgagtgattttattctcacctccttggccctagggaggtgagagattcttttgaagggaggctggatttagcggcaactttaagcacaggaccttattgagtatcaataagatacgtcctgggggaggtatcagtgtttggcttgagggaatttctcagttcaacagtagacttttcaggcgaagaagaaagaaatcaaatatcctagtacgagcagagaggcgagagctgaaaatgttggaagagacaacatatgggggatctcgtgaccaaaggcagcaaagccctgcaatgctggtgattcattcatggtcctttatatcataagaattaacacccaggctataaagttaattatattatatcacttgagcatttgggagaacataatttgacacagcacattaaaaatccctggcataatgaatatattactctaggattctagcaaggtctaacgaataaatatttaaagtttaagtacattcccatgaactcagtctagattcacttgataaactagataagcttacagttaatgaatttgttctggttgactgagttaataatgagtgcttaaaactcgcctaatgcatatttactcaaaagtcttaggatggtatgagtgatgattctatgtgcagttggaagcccaatgtaataaatatgtattcaaaagctttaaaaaccatcactacacattagaattacataatttttattttgttttctgccctctatccccacctaattgctatatggcaggactttatttttattactgcaaataaatagtgtaattatcctttaaagaaatttgtaatggtctggtggagaattaataaaaatcattataattgcactgtgtacaaatgaaatatttttaacacatagcttggcagtaactatttggaaatttaacaagtaatttttattctctatctctgcaacttctatgtttattacttttaaatttaagtctatggggaagattcttttggcttggaaatgagcaacgttttaaatattccgattcagagccaatatgaatataagtaggcaataagtttcctttgtgataatgagagatatggcaaatcaaatgttatagtcattgtctttatggaactttccaccttattgtgccccaagccaaatgctgtatggagagactgccttgatattcctgttagccttttaagttttctgttgttcaccatcactgattcctcaggcatttttgtgagtaccttatacctaaggcaattccagtgacagggatcctcaggtctataaattaggaatccttccagctgcaagtgataacatatctgggtaacaacagattaagtaagtaggtgtttgttttgcttaggtgtcaagtttacaggctggcagctattggctttgcttcagtggctcaacactgctagagctggttctgtgctgttctatagtcgctgttgcagtaccaggcaaccctttgtctttaaggcagcaggaggtgggagaagggtcaatgacaggtgtctctattacctcgatagcaacatcaacaaaaaattaccaaaggctttgctagaatcttcctgaagagatttctgcttctatgtaattgtctagaaaggtgtcacatggctacctagctgcaaatgaaggttgacatgtgagtttttagttgaggtgggaatcggagagggggttggaaatgagtgctgggttaaccagacaatagtatctgctacacctgaaaagcctgtgccttactggtgaggggcagagattcttagggccagtgggaaggaagaaggtacaaatggcagaaactgcaagaccaatggagaggttcatttctctccactccatccatactcaccagacctgtacattgaccccggggaagccatgttaacccttgaagccacttttaatatttctttctcttgattttgttgtctcatatatcatatgatagtaaaggaaaatattgaaaaagcaacctcatggtctcatttccttaaaaaaccctttaatgtttcccctcctttttattccctatcatttgcaaggattgcaatataaatataattaattaccaatttgcttttttcacttaacgtgatttcataacccttttccttctctgtctcattttgttcttaatgaatgtctgtattgtcttcactgactcctttaaaggattgacattagtgatacagcttagaagacttagccttatgtttcttatgccatgaggcatgaaagagtcattatgtcccagtagcaaaaggacagaatcatatttgttatttttcaaagctattcttttaaaattcttctgatttgagaacagtaaccacaatgacttaagaattgacttatattgtataaatcaatcaagcagctgaaaaccctgctggtttgacatgtaagtaatctttgtacttaaacatcctaaactactatttttaattttaaataatgatactgtctctcttattacttacatgtatatttgttggcgtgtacttattcccagcaaaggcaatgatgatttcttagaattaatttttctctaccagctttataacaccgaacaggtttttaaatgtaccacttagcaaattaatagaaggtcaaaccactggaatttagaaaaaaaagaaacttgattatataactccaaacaatttttaaaactgatgtatactttatacattcttagttgatatttaacatttgttatcataaggttaaataattacaagttcaatttctgacaaaagctgaaaatacaatttggtaaaaatgaaaatttaaaattaaagtgatacatcacttttaaatatatccattgaaatctacacacctcatagatatttattactgatttttaaaaaatgagaagttttgccttcgtttttgagaattttacattgtttttcttttgacttgaacttatgtaatcctttttccattatagaattttattctaatgtgatgtatttatgagaattttgacactgtgtatttttggataaatattatgtacttgagtgctgtggtcaacagaacagaatatacagctaaacttctggagttcaagtttcaccctttgccagctaagtgacattgggaaagttacttaatcattctgtgcctaagttccctcaattgtaaaagtgggagaaatattacatatcccacagagtgattgtgaggactaaatgagttcacatgtgtaaagaacttagacgaaagcctggaatgcaatatacactgtcctgttatcgttagactgagacacagcaacaactattttgtgcctcttttttatgggtttaagtgcttataaaccttgtttacataaaaaggaagatgataacgagaggatttttggtatatattgtccctcaaatttccaagttacacgcaaaaacaataccacatagtggtctatcagcaaaacttttttaaaatacaaggattaacaacttgatgggatcctcttccagttttcttgaaagtaaagaattggaattacccatctttcaaaatgtttcttgaactgaagtcatttgccatctcaatttctggaaagtgtgctaccaaaggcattgcaagatgtatctaagagctctagactctgttattcttccacttacagtctccacatttaactctattctcacaaaagggtggagaagataaaaatattagatacatttcctgctacatcttgggcaaaaaaatatttgatcagctttattataataacatttacatagaataagagtcactaatttcaaaagtacagttctgtgaatttggacaaatgtataaagttgtggatccaccaccaaagttatgatatagaacatttctgtcacttccacatggtacatcatatctttttgcagtaattgcctccccagatgcttgatgcctgattggctttctgtcaccctttcacttctggttaccttgggtaaatacctaggagggagactgctgggtcccatggttagtgtaggtttatgagaagctgcaacacgttttcgaaggtggttgtaccgcttagcaatctacattcttgtcaacacttgttattgtcagcacttttttctttttagttattttattgagcatgcagtggtaccttattgtggttttaatttggatttatctaatattgtcgtgttgagtatcttctcatgaatgtacctcccattgccatgtgcttatttgcttttagtaccattttttgctgaagtgtctattcaaattcttctgcttatttttcagttgggttccttgacttcttattattgagtttcaagagttctttatatattttagatcaattattttataatgtgcttttcatatgttttaaatatattttttaaaccttagagctgcagatcgagctcatgtaatttacaagaaatgtcttttatatttcttaattagcagagaaaccagtcaattacatcagactttttgtcagaaaaatttttttgacttctcttttcaatcttaacaatatagcgacatgggcctctgtgttgaccatttcacatctgaattccaacttaagaaagatagataaggctcagacatttgttatagtttggtatctcttggaggaaaaaaaaccctgtgtcctctttcaatgtctctaaccagtgctcctttgtttgctctcacagttttactctcaagggtgatggcttttgtgggtaaatattgggatggaagtgctggcatgttaatggaaaattgtcttctcccctagaccactttataatatttatatattcaaaatgttccaacacaagcccaaatacttcatttctaaatcatgaaatacatacctatacaaatattccaacatgggcccacatacttcatttctaaatcattaaatacatatctatacgattgggaaagataagcttttctcagataccaatattttgaattgtttgcttggtgttaaaaagtgttcctacccttgaccaatgtaccatagtaagattaggcctgagaataaggcctgaccatgagagaggaggtggacatggagaacccaggacaactcaaacactgggcatttcaggcagggcagtttggggaaggtatacatctggaagttgaagaaatggaaacttactccctaaccatgcctgcataccctttgaacaatttcatgaactcccaggggtaaccacaccacagtttgaagacggttgttctaaacttatgtggtttttgaaaaggtgaaggattgagaagcaatgggataccaaatattccaaggagataaattgtttcctactggaagagagtgagagtttcctagattgaaaagagaatgatgtctttgaggaggagtcaaatgaggttgatgacctgaatttcttcaagtctcatttatgagagattttaatgcaagagctccataattctttgtgtgtgtatgtgtatattatacatatgacatatatataatatatgtcatatgtataatatatgtgacatatataatattatatatatgtcatatgtataatatacatatatcatttatcaccattttgtaggaggtgaaagctttatttgtaagttcgtgaaatacttttattattttaaataggctatcattgtgtatgtgtgtaaatatacacacacgtgtatatatatgtatatacatcaccatttcgtagaagatggtggcttcatttgtaagttcatgaaatactttcattattattttaaatcagctatcattgtcaaactatttttaagagtatttaattaatgttccccctgtatgattttctggaggaaaatcccagtcagtatcagtgggagaccgaattatgagagtgtttaattaagagtttctttcaggcacctttcaaagaacaatttaatatctgagaaactccaccttatttgtatctctagaactgagcagtgagaaaatcttgacacaagtcacaaagattcaactagaccaaacattacaaaaatcattttcatttatttaagcctttaaaataaaatattcatttaatatgatactcagaggcaataaaatacataatttaatcgacttttcaaattcatttaaaaatagagagctatcattttagaaagctcagctatttttcttcccactagcaaattagggaaaaagactcaagtcacaagttaccgcatcatgtaagaaagccaagtcctatcttgctcacctgtcttgctcaacagggaggaaaaacctgcttgctgcagctgctggcatccaggcccttgattttgggtgtgttgaaattacaagaggagttctcagggtccctttagtgtacctgtctattttctgattgatgggaaatgtgtaggaggtacttagccgctagactgtaaatcttcctttccaccattgggagcatattctctgacactctctaagaaggaagtctgtaccccctctcctccactatctcttaaaattatttagtccattttgtatttgtctaatgatggaaaaatatgaagtacttattcaactgtaaatggaaatcttgcataaaaagatcaatgttatgaatttgaaaagcagaatccctcacccctctactggaagagctaagttgagttcctgttcccataatgcttgggtgcaccagcagaatctgaactcagaacatgcaaatgcaaaaagccctttcagccaaaacacttgaaatagactctatgaggcagtgaaaatacccaatgcaaaatggaacaaaaccactaaggaccgagtggttaagattgtgtattctgattgctgcagaatgagggaaaggaaattaaattcgatcttataattgaaagtccaacacttgatgagttattttcccctggcagccgtaaacccctgctaccgtatatcagatagtcctggcttcccttggctacacctacttacagcattgaaacaactttcctggctggtggggcccttctgacttttgggccctgggacacgttctctgtttcaaatactgtttaatactcatttcctgatcactctcggacttgattcttcttatactacttactcctgcacatctaattgactctagttaagcatttcaaccaggtttctgttacttgtgttttctatgtattttatactatctcccattgaattaattcctccactagagtcttggtgtttctctcaatacttctgtctttgcacctcctgccacctccctgaccatggtgcttactgtgggtggtccctgtcaactgactagctgtcatattagctatgtggatccactgcacacaggaaaaccttgaggaagtccctctcccagatttgaagagctctttgccaaatacacaccgtttgaaagaattatgtttttccttggaagatctagtgggtatcactggacccctgaggtagagcaatagatgtacgatatccctgctgagttaagagcctgcatccaatatggttattgaattctattttgtaataatttcctctcatttctgcttttggactgccactggagaaggcaactttttaaaaatacagaagtcagatatttgcccatgttatattacaaagttatataaatatataggttgcaaagcttttaaaataatgattaaaatgtcagtgaaagatgttcatgtcaatttttataatcataaacactgaagaaaatcgtgaccactgtaataataataattcattacatctactttaacatacagaaagtcaggttgtcatctatgggctaggaaattctgcataagaattcagttttggtgttaaagatgttttcattctcggtgttccctatgtcaggtttagtctgagaatattttgggggaatatttcaatgacaatatatctatatgagtatacatacatatataaaacatatacatatatataggaaacaatatttgtcccattaaagaattgggccaccagtcacttggtactgaaaccaatacatgaattccaatgaaattccaattttcactttaactcttttctgccaactgtcctaccaaaacaaataattaaatatagttacggtttaagaacgtaatttggaactcgtctgttttgtccacttgatgtctacttttcgtcaggttgaaatcctccatttgccttataaaacgatgactctggctccgttccattttctttgctctctggaatttctgccttgttttttccatgacatttcttgtatgccacataaactagaaaacaatacacagacagttaagtaaattttataataataaactgcaaaattactttgcatagagattataacctatgattcacatggcagatcacattttctgtagactggaggctgcttagagaaagaaatcaccattcttagttctatggctactcatggcgagagggatgactgcacttcaggaagacctagcataaatctttaggagacatttgctcagggcagccacaagcttcttcaggcattcagccctgcacgtggtactcaacaatgataagaacaatagggaggatttattctgtaccgccatatcccagttaatgtgctagttcttaataaatatacacatggtgcagtgcaacctccaggacatgggtttgatggtcctctgtagaaggacttgaactagaacaacgttcccattccctccctgccttcattcaatctttcccccggagagaagagactcggctgatgggtgatcagcattcctcttttctgtggagctgctggtctctgatagcaagcatttctcagcttatttttaatgtcagctcatcagggtaggctctgccctgcgaggcaagacctgcagtgtctatgcatgtgtgagtacatgtctgcacatgtgtgaggcagtggaggaaagggtggtttcaacaagcccatttggttgcagattcaagtcatgttttccaattaagttttatccatagttaaagtgctattctgttatctgaatatctgatttttcttctacttctcaattggtcacaaaggcaagaggaggacagaaaatactccttataggacccctcgaattctaatacctcacatataaaatggccataataatattagctacctcatagggcaattgtgaacattaaatgagataaaattaaatgcctaacatggtctgtgaagaatagtaaatgctcaataaatgttaacgttcattatgatacacagctgagagagataatgacttgcttcaaagatcttattaactcaagatcaatatttcctttagattggtccctgaacttctagtcatatattattttcaaagccactgaaccacactattgaatttaattgagcttgtggtcaatttgaagatccgccacttattataaactgttttgagctgagagtccctcagcttaaacttatgccaatgatttcatttaaccaaactatacctcttgtttatccctttttctttccctcccttctctccctgccttcctccctccctccctccctctctccctcccccatccttccttttttccctttttctttcttcccctcctctcctttttccaaaaaaaaatttagaatcctagccttaccaccaaaatatgtttccaggtattgtatacacttaacaaagattcctcccttatttttatacatactgatgtaactgggaaatttcaagaccgagttgagtgctcccttttcctcattccttcaacttaattttttattaatcaacctctttggggttagtgttcaactagtgcattacttaattgttctatcaaccagtccactttctctggcttatctagtagacatcattaagtaattatttggaaaaatcccactgtgtgccaaattgggcagatcaaacaacgttattatacagaaaacaaggtaattaggcctggactcctgcttcctggagcagtgataaatccatggaatgttttcagtggattcagagtattctgttctggaaaggaagcctctgctttgagaatgacattcaagacagtagtgcagaggagatcagcatcacagggcaagttgaagagctgatgaagctaagcagaaaagtaaagcaaaaccatatttttagtagagatggggtttcaccgtgttagccaggatggtctcgatctcctgacctcatgatctgcccgcctcggaaccccgtctctactaaaaatacaaaaacaaaattagcctgtcatggtggcgggcacctgtagtcccagctacttgggaggctgaggtgggagaatggcgtgaacccaggaggcagagcttgcagtgagcagagatcacaccactgcaatcctgcctggacgacagagtgaggggctgtctcaaaaaaaaaagaaaaaaaaagaaaagaaaagaaaaaaagaaaagagagagagagagaaaagcaaaaccaaacaaaaccaaactatatctctggacattttgtgacctaacatttacattagttttgttgcgtgccttcactttatattcctcattacaatgtcatgaggctttaaaaactagcttttttattaaaaaaaatagaatgtaaaaatagaggttaaatattatcagcccttggaaaggaaaatgtagaaagaattttcaactaggtgaaggccagtgggcggtggggcctgatgggaaacgctgggagcttcatgccacaggacaggagaagtaagaattacttaaactacacctagtactttacataaggaacatttttgcttcaaccacttcaattatatgggtatttaaaatatatatatacatgcatatacacatatgcacacacacatcttccttgtaagttagcctggtaaattttctttgtataccagttttctgataaatatcctatatttataaagcatatcaagacaatgttttgaaaaagatcaccaaatcctgagttcctgggcgaatgccagaaggcgcacaataaaatggtcccaacaggttcctctgccttccttattactgaggaaaagaaagtcattggagagaatcggcctccattacttttcactcaaaaataatctttgctagaatcttttggtaaaactaccatcttttcatcagcaattggaaagtcatgataatatgacggtggctttttcctctcatatatttgtacaattcaccaccaggaacggggagttttaaaaaaatgttgttttagcaactccaggatttttcaaagattatcatgaaatgggattggcatgattccttacatcctaagaatattgcggcaaaggcgagctggaaaatgctgtagatgagcgggaaggtgaatacgacattgagctcctcaggagtgaaggagagctgaacgatggtggaacatagctgcgtgttctgcatccccgtttcaaaagcaaccgttcggcacctaaagaagatgttaagagagcacatgttttagtagttttgttattgtgaaacatgaaaagcagatataataataagtacatatatatgcattatgtctctgcttttaatgcatgtatttaagataggcttattcaatatataactttctatggaataagtgtaatacttattaatgtatattatacatcatctcacctattgtatataatataaataaatatatttaatatgtgcatatgaagagttggctcatttaccacagtgttaggtaagtggccaagagggttcatttcacccttttcaattatgattttggtaacagtgtagagcacagggcagcagctcagaaaatgctcaagatatggtatttgttgtcgctgttttattgtttaatttgttttgtttaggctgggctaaacaggtggctcacaccagtaatctcagcactttgggaggctgaagtgggaggatttcttgagcccaggtgtccaggagttcaagaccagactgggccacataatgagaccctgtttctaaaacaacaaaacaaaacaaaaaaattagccaggcaaggtggtgtgggcttgtagtcccagctcctcgggaggctaaggcaggaggatcacttgagccaaggcttcagtgagctatgattgtgccactggactccagcctgggcgacagaatgagaccctgtctcataaaaataaaaaattgttgtgtttaaatcttgacagaaagtctataaggtagaaattattgtccccattctacagatgataaaactcagagaaagagtgaatgctgggcctgaggtcccccgggcagtgtgtggtcggattggaaggcaagcccaggtctgcctgactcaaacactgcgctcttcttgctgcccatacccactcctctctttcccaacttcatacatgcatctgtccctacacctgtgttctctctgcctgtggattcgatggattagtcaaaaagaattgtttttgcccggtaccaaatccagaagtgtgaaacccattttaatattcggcgcctttggaggatgagctcaccctgctgccagctggaggaacgcttgtctattccaaggcagcccaactgctttcattaatgtcattccactcagagaataagaatacttagcaatggaagagccccatctgccttgtaagccgaatggtccagaagactttgagcaaaaaagaggcagtcagtattttctttctggggacttgcatgacttcagaatgaatgggcctatttagaatgacatattcagaaataggatgaatgtgattgatgaagggctaaggattttgatcctgtcttcagtgtttgcagctgttatggattgattatgtctccctttcccccaaattcatatgttgaagtcctaacactccgcacctcaggatgtgacattatgtgggaacagggtcattgcagatataattagttaagatgagttcattagaggaggcccttatccaatgactggtgtccttatcaaaaggggagccaggccacagagaggtgcactgaggaaagacacaggaagaagatggatgtctgcaagccacgaggaaggccagtaagggatccctccatcatagcccttagaaagaatcaattcagtgacaccttcattttcacttctagtctctgaaaccatgagacaataagtgtctgttgtttaagccactcagtttgtggttctgtcttatggcacctctagcaaaggaatacaacagatattacagattaaaattcccaatgtgatttactaaatgccatacctgtaccagggtagaccagcaattctagccagaagaaaccccagggagtaacccgccacaggaaatattgttcctataatccacagtttgggagcaatgatccaggcgctttggtacaatattcctccaaccacagctatgagcacaatgaggatggcgcccgcgatggacccaatctgaaaaaaaaaggaataagtgaacccagcaatcatgagtcaaagcaaatccaagtatgtttgtcagagacaaaacctcagcagtctccttgtccctgggggaagtgatgataaagttgtctttctatgtactccaagccaggaggctgcaatcagcccactggaaatactgacgcttgtcccatgctttaagctttaagaacacaataggacatgtagcaaccatttgcaattagtctgaagattttctgacttgaaaattatccttgtcagaacaaaaagacaacccatttcgatgacagcctggaagatttggcttccagattcaactactcctattctgtttccttcagtaaatcaggaactttctgaactgtagtttctttatttgtaattggggataaaatgtcgccccagcttccctttatgattgttacgataatgagaaaatgggtatagaactctatacaactttaaaaaaggtataagcaaatgaaaaccactgttgttattttttttctccttttcacatttaaaacaaaatttggagattataaacattttttgtcaagagaagcaaggaatacaatggacttactttgccccgagcagcagaatctatctatattatctacatacatatccagatcatctagctagaatatagttagtgaatgggattgccaggcaatgaaatggccatatgcatacagacataagaaagatatgttctattttctaagaaagccatttagatatattgtataacacaaactcacataacagagataacagtaatatgccctgaggacagaatagagtaaacccaagaggtgatagttcagtggagtgtcttaaagaatgggtagaaatttttcctgtgactgcaataaagaagggcatgctaggctgggcgcagtgtctcatacctgtaatcccagcactttggaaggatcacttgagcacaggagttcaagaacagcattagcaacatagtgagatcccacctctctctctacacacatataaagaaggacattctaaaggagaagactgcatggctaatgacttcaggcccccactcaacagtaatcatataatgagaatgaaaccatttcatggatggaaaaccctatggttttgattgtcacagtggaatatttaatggtgtgaactgggatacttactttaagtatgatctttgctttttggggccatttgtgattaacaaacattccaatggaaacaggaacaacgagagaaaccagagatgtacctaaagatgacagaagggcaatgtgatcagcagaacaggtgacacaggaaagagaaaaacagaagaacaagcagcctgaagaaagattaggtggtatttcagtcttccttcttgaatacacaaaacagaatacagaattacacacacacacatgcacacacacactcactcaacttcttcacccactccagtaaataatttaatattattggtagataattgataatatcaatgctgtaaattctttcactaaattctgcattaattttttagagtttcttattttgccagcatacattagttttaatttgtcagaatcttggcttctttagtctttggatctttatatctctaggaaaaatagctcaccaaggtgtgtgtgtgtgtgtgtgtgtgtgtgtgtgtgtgtgtgtgtgtgtatggcatacaaagatgacattttacatttgtctgctagttcatggtagtagaaataaaaaataattttaaaatattttaaaatgaaagaaaatgtccaaaattagctcaagatcaccaggtattctgacatctgacttttggttaaaactagctttagctattcaaatttacagcagagaggtgagaacaaaagttgagaaagcgtgctttaaattttccatgagataatatatttgacgaactctcatgtaattatagttctttgcagtaacatgctcacctggccagataaaagagtcatacttcaatttcaccatgttaaatttactgctgtttttgcgacatgtggtttgtttctccatgttatttaacactcatttgtccaatagctgatttcatataatttagcaccaacaacttctaacttttcataggttgtttctttttcaaacatccttttaaagcagtataagaaagtgatattgaacggtgaaattctgagagtggatgttgcttagtattgattaactaggtagattgaactaggactagaaaacagattctggaatccaaggctatagatattaatttaaagtgaatgcaataatgatgaaaacataatttccttgtagtcttctagccctcctggcaatataagggtcagtgatgacttttgcccagaaattacttagcagaattaaataatgactaagggtactaagagtaggaaaaaaaaagataaatgagggggagtaaggagggaataatggaaaaaaagatgtgaaagagtggcgttgacacacgtactgctgagatgccccagaaaaaccccccttgggtatccttgcatcctgctgttttgggagtgatatggtttggctctctgtccccacccatatctcatgttgaattataatccccagttggaggattacaactaaaggacgggtctgttggaggaggggcctggtgggaggtgattgaattgtggggggcagacttcccccttgttgttcttgtgatagtgagttctcatgtgatctggttgtctataagtgtgcacacctccttctttgctctcttcctctgctccagccatgtagaagctgcctgcttccccttccccttctgccatgattgtacgtttcctgaggcctcccctgccatgcttcctgtacagtctgtggaactgtgagccaactaaacttcttttctttataaattatccagtctcaggtaattctttatagcaatgagagaacagatgaatacaagaaggaaactccctctcctgggtctttagaccattgcctaagtttttgaagtttgtaggtcttaaaaccatctggatatatgacttgtttgtgatgtggtagcttaaatctagctgcaagtcctgtgcttggaatgttagtgtggttaggttttggtcctatattttaatgtgctgaatctgtttggcccctcctgctaagagtattcatctttttgaggcagcccaagccaacgggataacacataagcagcaccacctgctgaaatccatggcagaattgcttttctttcctgaccagatgaggccagatgaagtttttcagggacctggggttgactgggaaagggactctgtctttctttacacccacagtgtgtggcttctgcttgtagaggtggatgttgtaactttggtctccagtgggctggtgatcttgctcttttctttccccatgctctgtttgttttacgtatgcctcatatgcccatgttctctctgtaaagtgcctgtctatgtagatgaaaaagcatccactcatggttacacattgaatccataacttggtctttaatcaagtttacacagtagatatcagaggaaagaaaggtagaaagaagaatgagaatgaaagagagtggtggtgaatggattcatgtggtgggactgggagccagatagatttggaactgaacctttctgtattcccaaactgtgggaactgtgcaaatcattgaacccctctgagcttttgtttcctcatttgtaaaatgggtggagttatgtctgccttacagtgctgttgtgagaattaaatgatgaaatggctataaacttcttggcacaagacacttaaaaatgtggggtagagaggagtaagtacaacaatttgcagcagtggttttattttagtggtaccagctgcatggtctgcctcctctcgatccagatgtcagcatctgagggggctcacaggtgtttactgaatcactggagcatgaagttgtaccaaacacgtctgcccatagagctgtgtagagaatagactgtgggctattccagcttcctggtgaccttgggcaaataatcaccctgagccacaatttagaaagcagtgataacatcttgtgaagcagtcagttcatttattttctatgttaaagaactagaaaaaccaacagcaaaaaggtgagcttggaggcctgggcaaacatggtgagcagggttaatatctgtagaaagtaaaaagtttcctcttcaaagtgtcccttgttgttaaaggaaaataataataataataaacattagaaataataatttcttttaaagactaactttcttcaagcccccttactttgtgctagtaactctttgttaagccctattctatgtagctgttagatataaaggaataagtacattctatgtccttgtactttaaccaagatatttatgctgaacatgctcacaggtacattccagcttgcagcctatgccccttccttatttggaaatattattacttttctaagtcctttcacaagcaacgtcctcttttcctttgttgtctattgcctatacctatttagaaaagttttaaattattagccagtcaggttttagcttagattgtgatgtctggctccagccaatggagacaggacacagtagcagggacaagctgcataagggatacgaattacttccctccattgttcaggtgtgctgtcaccattgtgccatctgtgaggagcactctttctgcagaaagtaaaattgccttgctgagaaaactttttgtctgaatgctcatttttccttgtggtactgaggaacaagtattctgtttctgaataaatattttacatataacaatatctttgtttttcaaacttctctctttttccgttttcttttctcttttcctatttttcttttcttttcactcttgacctcttatgatgaccttttcctccattgaagtgctaattgatttttcattttctccttatttcaaaatttattcacatcacagaatatggtataagtcattcacactgcagttagaattattcagtatttccatgagtcatttctcagaagggaatgtatatcaaaaggagaatattttatggcttaaattattaaattattacagtgagtattgtggaatcaaaattcctcactcagcagacaggttctttgagagggatataatggtcaccactcacgtaaactatggtttttagctctatggaaggcgtccgctgacagagcagccagagagtcaagcagcatgaaggcaaaagcaggtggtagtggagggtcaccctaaagtctcttgtcaggaggttatatatgatattaaggttctctcctggagtctgaagaatcttgtatatcaaaagcccatactgaatagggcatgtcaaggaggacaattttttttttggtctaatggtaatggtaagagtaggagagagagaagaggctacaaacattgtaatacagatcatccccaattagtattcacaaagtttattctaattcagttgtatattccctcaatcaccctaaatcacagaagcagtctttctcagaaatggaaggcatttcagcccagcttcctatcccaataggagtcccttttacaagcatccaggtggcttatcatttagcctttgcttggatgctttcttcaatgggaaacccacacctttctgaggcagctcattgggatttttttccaaggtcagtggggaaaaaaacccaggtatttggggcatatagtgtacctggtgattgttactgatttactattttgcccacatcttgtcttttgttcgtgatagttctgtgggaaatgcctattcctggtataccaggaactctcttgttcttcctttgaccctcatccctaagttacaacaataacttaatctcccactataatttgtttccccagaaacagaaaataaggtttttgggatgagggtgaaatgagacagagtcattactagtaaatttgactcctggagcatgactttgccattaaatcaacttttgggtcaaggtgtggctcacagtcgagtgttagaaacagtgtgtttcgtctagcagttttctgttgtaacactctggattgcttactcagtgctctattttgaaaccattatgtgattttaaaaaatttcttcaggctgggcgtggtggctcatgcatgttatcccactttgggaggctgaggccggcagatcacttgaggtcaggagtttgagaccagcctgaccaacatggagaaaccccgtccctattaaaaatacaaaaattagccaggcgtggtagtgcatgcttgtaattccagctactagggaggctgaggcaggagaattgcttgaacccagggggtgaaatttgcagtgagccgagatcacgcccctgcactccaggctgggtggcagagtgagactccatctcaaaaaaaaaaaaaatttcttcaattcaagtgtctggatgcaaaatcctatgaccattaactagtgacactctgggttaaggaataggtgcaagctcccatgtccccaaagcttaagcctcctcagtccagactgagggctggggagggggctcctttccctggtgattcaaattgaagaaaagacaggttctcccataaggtcaaggtttggaatttacattctgccatcactctccaaacgcaggggtgactttataatgaaatcaggcaaaaactcctactagggcaataacggtcaggtgtgagcctggtctgagagcctagcagggggtaagcagagagtttgagggtaacagtcaacagtcttacagatggatgacttacctatgttatcatagggaattacgatgctcccagagtcgacccacattttggtatagataaggaggcacagcggcatcattccgagggcaagcagtgtggagcatgtggtcatgctgacgctgaaaggcaatgggcagattgatacatccacctgtggtgttctagggaagatgctgttttatttttattttttaatttaacttttattttaagtttaggggtatatgtgcatgtttgttatataggtcaacttgtgtcatgggggtttgttgtacagattatttcattgcctaggtattaagcctagtacccattagttatgtttcctgatcctctctttcctcccaccctccaccctctaataggccccagtgtctgtgttcccctctatgtgtccatgcgttctcatcatttagctcccacttataagtgagaacatgcagtatttggttttctgtccttgtgttactttgctaaggataatggcctccagctccatccatgttcctgcaaaagacttgatctagtccatttttatggctgcatagtattccatggtgtgtatgtaccacattttctttatccagtctatcattgatgggcaattaggttgattccatatgtatgccattgtaaatagtgctgcggtggacatatgtgtgcatgtgtctttataatagaacgatttgtattcttttgggtatatacccagtaatgggattgatgggttgagtgtatttctgtttttaggtctttgaggaattgccacactgctttccgcaatggatgaactaatttacactcccaccaacagaagataagtattcctttttctctgtaacctcgccagcatctgttaatttttgcctttttaataatagccattctgactgatgtgatatggcatttcattgtggttttgatttgcatttctctaatgatcagtgatgttgaactttttttcatatgattgttggctgcatgtgtgacttcttttgagaagcatccgttcatgtcatttgcccactttttaatgggtttgttcattgttttcttggaatctaattaaactaaagagcttctgcacagcaaaggaaactataagcagagtagacaaacaacctcccgaatgggagaaaatttttattttcgattcatgataagaaagtcctgcaagaatctgtctcaacctgtagcatcgtctggtgtgatgaacagtaatatacatgtgcctatgtgcctgagtgtattcagggcctggccttgagcaaaatgggccatatttggtgtctttccactttgccttgtgccgtccttccctccccttttattcttaagggtcagaaacagtattaaacgatgggttaaagtcatcattaaataatgtataaggttcgctgggtgtgccatccttcaaacattcaatcaaagaacagcaaacacatttaaagcagctgacaccaccaaggctgcatgtgtctgaccatgctgagatggaatgggcctccctgggcccctggaatagaatgcatgtccgagggaggaggcctcgctgtgttgccataaagcagaaaaattactgcccaagtgaccctagcttgggacaagaagcggaagctgacttaaaaatcaaaagaaagcatgcaagcggcagggtagacataaattcttagcactgagtaagttattggcaatttggcaaatgtgtgttcagaagaactagtgtctggtatcatccctgctcagagtgtttgcattttaataagagggtctggctgagtaggctatctacatggagacattaatgccaaatgatgctatctctagtactaggacagtgggtcaaagaaagatttttggggagtgagtcttccgggtcctcttcaaagggatctgtacacagcgtacattctctgcctttaaagcctgagctctaaagccacacactgtctgggctgaaagcaggcggtgccacttagtgtgttaatttgagtaatttagttgacttctctttaccagtttccttatctaaaatggctgtaaggatagaatgagccaatggtgtccggcacttagaccaatgcaaagcactctattaagagctggttgctactaccattttttttttttttttttttttaaatagggtctctctctgtcacccaggccagagtacagggtcaccaacttggctcactgaagcctgggctcaagtgatctttgcacctcagcctcccgagtagctgggaatacaggcatgagccaccatgccaggctaatttttaaattttttgtagagatggggtttcaccatgttgtccaggctggtctcaaactcctgggctcaggtgatccgctcgcctaggccttccaaagtgctgggattacaggcgggagccaccgcaccctgcatctctctgctgtgatcatttatgttaccatgtttttgtatcttgtgttccaccaaatagaatcgggaaacttagagaaatgagaaatttctctgaaaggcccttctctcaacaggtcgtcattgaggttgtcaagagtagtaatttcttaagggtattatgggtgtacttgaaagaaaatgttaaatatttatattacctgccccccaaaacaacaacaacaacaacacactatactaagaaaggagctaacaatgagaaattttgtttcaaggcacagttaaatttgcacagtttggcaaaatacagggtgggacaaagttcatcagagagcttaacttctctaataatatatttatttttaaccagaatgacctcatttaaaataggcttaaataatttagataaaaatacttgttttagtagagctaaaatattacaacagtaacaaataatgtggatgtatttaaaactttaagcagttcaatctattctggttataggtaaatttaggcatgaaatagatgctaaggcagaattgtacaccagacaaacaagttaatttgttattaatagtactttgtcctacttataatgaaagtactggagtttgaaggtaatttttttctctgttccttcctctcttctttcagtgttctctttttttttattttattttaaaaaatatattagaatggatttaaagttgtccctataataaaatcacttttttttctgtgcatccaatatttttttctagagtgtggtgggaatctggtggggaagtgaggaggatttattaactgggttccagtgaagagaagtctgagaatttttgttttaaaatgtgagaaaatgtttaagaaggaagtctttttctgtctttgtttttttttcaaagatccttgcaaaacctttaattctgaatattgctaagacaatctatgacgttgtatcataattttgagtttggtgagagcagtttcttaaggatcgtgatgagggacaaaagagggtttggagaaggaaaggtttagacttgtgagcagcactgacgaagagaccttgcagatgaacagacgaataggtagctggaagttgatgctatttgaatgaatataagaacaaaatcaaaccactcaaaatgagatttaaaacaattcacagataacgaattttaagaaataatatagaagcctaaattagcaaaagaaaatattatcttacacgaaaaaatctgaagttctataaaaggcatgtatataaaaaatacatacactgccttgaatttatattagactgacagaaaagagtcaagtataagaaaaataaaaaaaaaatcttggtcttaattttgacttcagctctattaactgccagggagattttcttttgtgtgtatggaaataaaagaaagaataaatgtaaatttagtgaatgttgaggaattcagtgaaatcagtgttaagcaatgtaaaagattgtaatcatattagaagtaaaataccaagtttgaaggctctaacgtagcgtatataggcagtgctagaaactggagaagtgaaaagtgatagaagcagtgtagagaaagcttatgagcctgcaaagtggtagtgggtagacctgggtgattccaattctgactcaggcatacattgactcaatgaccttggtcaaggttatgaatcttaacttcattatctgccaaatgcagaaaataatagtactaactttagaggattcttgggaggatgaaatataccaacttattttgagtacttagcactgtgcatggcatatactagtgtttaataaatattagctagtaaaatcagtgctactggagagaaacaatgtttggttacttttagggagaataaaggaaaaagccgaatggttttgggttaggtctcccagagtagagaagagaaggacatttatggggttgacataggaaggattgattgctgtgaatttgtggtaagctacagggtgagatttcttgaatatctaaaatatcaatgaatgctgcactggaagctgaaaaatctaacagcatttgcccaaagaacaaaggatgtggtaggaaagtctgtaaaataataaaaaggaatgtagaaagtaggtggcagggaaggaactgggggcaactgggagaaggatgcataagaatggattccccaaagaggaagccaaagaaaggaaatgagaagtccttgcatggtgtcgctgaggccattaagaaggatgaagacaccggatatttgcctgtgtctggggagagagcagacaaaaaggagataggatgtttctgtgtcctctcaactatgggttttggccacaagcagattcacctgaaaagtcaccatctcttctccctgatgctttttgtgcatgtgatgtccatggcacagctgcaacttaggtgaaaatatatgtgcaccaatcagattcacaaactccaggctgggagtggtcagagaaggagctgaaatagtacttgctggattccaatgatcaaggactattgtctattttttttttgtttttcaaagtcactagagattgcaaaatgcggtggctttccaggttcataagagatgacagagtgagagagaaatgttttggtttcttctcccaagaaccataaccaagagagttaaaaccaggtggaatggttttgctggcattgtgtggcattagctcaattagtgtagctgcctgttaacataaacagtcatgtcttcatgccattgctggagttcaagtggagatggagaaggtaaaattctaagtgtacacaactggaaatataaatgttagataggattgtatctaagtaaattatcaggagactttagttatccagttcttaatccagaagaataaaaagttttggaaaactgttacgcaatagctcaggttttacccttttaattaatttgtattaaagaaatattggaatattgttttcctaacacacaatgcataatgtcatcatcttacatagcagtataatttaacctcttctcaatgattaagaccgatcatgataaacatgattatcggttgttctaaaataccgtgacatcttcttgtgtttgtagaagagtaagtgatacagagaccagagactggaataagtgctacagaaaccagagagaataattgataattaagagagaatatgtgatagagagaataagtgatagaggataaatgatagagagatggctgtgtgttgtcagtgtctgctttgctttgcaggcatttgatcttctcttttgcccttcctaacactctgcttccttccccgcttcttatttctgggaaatagcacaacagaactttaaaataaaaatagttaagtcggtcccgcatgaggagcatttatgagattaagtgaaatttattttgggtgtgcagtgtcttttattgggtcttgttgagctctggataggtgaggttgctccatgttgcgttacagggcttattttgacttgctggaaggattcatttgcacggatttagctggaggtttctaccaaagcttcatattctacttttagttcttattaaaaaaaataatttataggaattgttatgctaggtggacaggattacataatcatctcctgtttcaagagaaataagatttccttaaaaccacagaaaaatgtaacttggagcttttaggttagatcttactgtttttagctcacagaagagaattcatttcaacaacctaatagtccagtaccacacacgttttttttctgtcttataaaagggttccatatgtggtattacattgaggtacaaaactcctctgcactaaaagttacaaatattatgagaaagctgtttattgggggtcaaggcccaatgttccaagtagttcacttttctcagtgtaacaggtgctggcatttagaattctcacttctgtgtacctgtgtccaggtcaaactaaattgaggtctaaaaagaccttattgctatatcgtggttcacagattaactaaacctgaatagcacttgccatcctatgttgttttatagggctttccttaaaaaaaaaaaagcaattgcaaggtggatatcatgtgttttcttatgtgaaagactaaaccatatgaaggtatagggtttgtatgacttttctaaagcttctggagaaaccagcaccagttgaaatgagacagcaggttcctaattgatcactgggtactctatcaatccagtgtttacaattctacactttgtgcttctctcctctgccaatagtagctggggatgaacagagctaattgcctactgtacagtatttaataagcacacgttgcattagcacctggatggtttgcagaaggaaatgcatacctttcaagggaaatgaggaattgtgagctaaggaaaaagacatttgtctattcaacttttagcattaaatttctcaatctagtcacattaatgcttcatcttatttctattagtttttttttccagtgctagttcagactggcacgggatgaaatgggcaaacattgcaatttagattactctgtaggaagtggagaaaacgttttctgtttattttgtagtaaggtaagcataattttaaaaaagctgctataggctttttcccccacttttaatgccagtagaggtgaagcaaatttacaaattcttccttaggttttataccaggaaaatgtttgcccaaagaactggctatatttgatggagttgaccactgtctcactacaggttctaatgtttgacaaacagttttattttatgattgcacccagagctcctcatcattacaaagaaagtgtattttgctttttttttcctgctaccaacaggataaacctcctcagctgcagcttgtggtttggaaaagattacttttttaaaaaagctttgaatcttttcctagagatcaacagcaattatgcaactccctgttaactgagttagatttaaaaacacaaacacaaaatataaatcccccaattccaatagctaagcagctgtgctagaaggcacgggaatgcatttattctctcctgtttgattccttagtcatactttagatgcgtggcaaatcagttggacattcagaatgccataggcttctggaaggattactccaaggtgattgcagtagttagaggtatagataatcttacctcaggtccatgtcgccatcgacccaataggccaagatattggaggcagttcctccagggcagcatcctataatgagcaccactacggcctggagcgggaggatgtcaaaggccaccgacaggatgaatcctgtgaggggcatgattccaaactgacagaggaagccaacacaaatgccccacggccgctttatgtgccctagaaatttcttgatttccacgttgcatcccatggagaacatcaccaaggccaacaggatggtcagcaccgtacttaggaccacacttaggatgttattgaaattgctctcaggtaccacacaggatgcaccagagcaaactgttgcattgtccacacagctgttcggatcattcattgctgggtctgctgctggaaaggccaagtccacagaagcgctggtccctgggccctggctctgctgctggttgagttaagcaacgtttacttctaccccatcaaacttttaaacccctcctaaaaatatgtcacttggtgtctcttttgaaagccaccttagggaagtaataaaaaacaataaagctaggatgtcagtttcaagaggtagcattacaacacagagcacgttgtgaatcacaaaagtccagcaaaattattggtcaagacagagagttacgattaatcatttattggcatgataatgaaccatgccatataaaaagagccacgttaatgtttaatgtcctcgagggtttgttggataatttcagttaagtgacttttaaaatcaactctgaatagtacagaatcttatagggattgagccataggaaccatgccatataaaaagagctgtgttaatgtttcatgccatgaaggtttgttggataatttcagttaagtgacacttaaaatcaactctgaatagtacagaatcttatagggactgagccataggaacacatattgttctcccatttccctttcaatagaagggtttagggccctgaatagttgagtgccctgtgcctaattatgttgcaaatcaggtgtcagactctgaactgggacccagatctccatccaatttccactcccagtagttttgctactgtatcagtgtttcctggaattgctttgtagtgtccataaagtatatggaaatttaagaaacttctagggtcttggtgcaaatctgagagagtaacatttgggaagatagaatgttttctgtgtttcctggtggaaaggagtctgacttgcacagccaccctcaactacttacacatgcaattatgtgtgcgttgtcatagtaacagagtactttatagatggagacaatacaattatttagagggatgaacctcagagaattaggtcaaagtgacaggatctctttgtgcttggagtcataaattgaaattcgatttttttttttttggcagggggattccaagagagatttttgtaaatgtcaaatagtcgacctcatgctgggcagaacgctgtatttcagtatacagggaagataaagaaagaggtagagaagagattgtcctgttttcaggagtttataacccagttattgagttaggacacagagtaataataaaattgaatattccgatcatgattcacaatttgtaggacaaattctaatttattattcaacttaatcatcttaaattaagtaggattagcactcccattttacagatgacgacttaagggttgaggaaattgagtgctttagataaggttaaagggaaatgagagaacaacgtgttttcctatggctggtatctggaaatactggaaccgagcgttctgattatgtgaagaaagtggtcggtttggcttgctggggattggagtaatatcttagaacagagcttctcaaaactcagtgtgaacaggattcccctgggggccttgttaaaatgcaaattctgattctggaagtctagggagagttttctttctagcaagcttgtagttgatggcgatgacactgatctggggtcacacttttagtatcatggcttcagaatagcagagtgacaacagttgtacccatattggtgacaacggaacttaccggtcacaactgaaagcagcttttgcagagaaactcaatatgggaaaattaacctttttcataactggagtaaatgtgagctgtggctagcagaatgggccactgagcagaagagctaatagagtgaaatgcccaaaccacaggtgggggtgcctaggcattgagctactgggaaaaacctgagccatttccttccagggcaaccgtgatttgtacttgttgatgtggctatctgagtggtcacgtcctgcctgcctttctagcacaagtgggggctgccattgtccctgacctggctgcctgccaattcctgggagagccttctgtctttcccacctccttccccaccccaacagctaaatgataaaccaggtaatatccaaagaggcctcccctcccactcctaggtgtatcatgacttggccctaccctgctggctgctccaagcatttcctgggactgacctctggcctacttctgtcgggagctggccctccccagggcagatgagccaagtgcactccctgctgccacacctgagcatctgcacctagccgctcacacctgggcacctgcacctgagcacctgtggctggctcttcccccaactcccaaaggtgggtgaggcagatgcccatgcagtggtgatcagtttacggtctctcttttctgatttctcttaacctcaaacattaggtgaaaggcagaaagctagcctaggattgaacggcaaatagcctcttcaccaggtctgatctgcaaaggaaaatttgagccctgcaggcgggaaggatttggattctgaaatttctcttaaagttggaaggctgcagtgcaaggcccaatgcacagggctcaagacaagcatatttagacaccctcctttgaactcaaatgggtttcccagggcaggcctcctgttttgggccatggctgcttctgggttggccaggtgtgatccatacttaggctttttgctcacagtgctggaagcagggaagaaaagtgaagggagcagaaagcaggttcagaacaaagctcttctcaaatttcagatgactttctaaggagattttaggctcccaggggcagaatgctttgcatatagacaacttgcaaatgagcagtctgtttgactagacagagtgctacagttctgcttaaaaaaaagtgccaatgcatttctaatttcacattgtttttacataaatttgcacattaggcttgagaggttttatattcaagtatcggaatgattcacaattaattagtacccttaacttcagctatattcaaatccagacactgaaagtatctaaatatataaaaatcattctcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattttactgggtatatacccaaaggactataaatcatgctgctataaagacacatacacacgtaagtttatggcagcactattcacaatagcaaagacttggaaccagcccaaatgtccaacaatgatagactggattaagaaaatgtggcacatatacaccatggaatactatgcagccatacaaaatgatgagttcatgtcctttgtagggacgtggatgaaattggaaatcatcattctcagtaaactatcgcaagaacaaaaaaccaaacaccgcatattctcactcataggtgggaattgaacaatgagatcacatggacacaggaaggggaacatcacactctggggactgttgtggggtggggggaggggggagggatagctttaggagatatacctaatgctaaatgacgagttaatgggtgcagcacaccagcatggcacatgtatacatatgtaactaacctgcacattgtgcacatgtaccctaaaacttaaagtaaaataataataaaattaaaaaaaataaaaaatcattctctttaattgtaatacggaattggaaacagatgcacacctgagaggggtagtcaggaggctggagcttcattttcgtcgtcatccttctcagtcttttctgctacattttgtcacaccctgggctcacatgcaggccaccctcaagaaaccaggagccggttcctgcttctggccgcctgggcgcagacatgagaatttgacatctgaggcttcccttttgttcctgtgtatcaatttgaggaggccagggttcaatagctttctagcatgtttgccctgaggttcacatgataaaagatgagcttcctatcttctattgtgtttcatcacaaatggctctattcagatcaatggccctcttggatttgattgactctgttaagtactttcctgtgactgaagttatctccctctctctcctctctagttcctttctacagattgatcttttatgaaacctgaaagtcccacaattagagctctttggagttaccactgaccctctttaaggcaacaagtaccttggggagaatgccccgtgaatgactagctattcattcttgagtctttagagggaaaaggcagcatagtattgaggagaagaaagtaggatagaagaacctggaatctactggatggaaaatgcactaggcttggaatcagaactgggttctagatctgcttcttttgaaaatactgtgcagactattcaggtttttatgaatgaatgtgaatccttattaaacatctgtaggatggtcccaccactttggaaaatgattatagctaaatgtccatatgccctccgacccagccattccagtcctaggtttcaatctaaagaaatctataaattaagttccccaagagacatgaactagaatgttcacagtgactccattcataatagcgtcaaactggaatctatccaaatgtccatcaagggtagaataggtaaatatattgtggtatattcacacgatggacttctatacatcagctggatgagtaatctactaccacaaatctaatgttgagtgaaagaaaccagaaactaaagaacacatacaaaaacaggcaaagcaaatctatggtgttagaagttaggatagtcgttaccttggcagtatggaagatcagagactaggaggggtcacaagtaccaatacttcaatataaagtaaacaaaaacaaaaacaaaaatcaacctgacacatttgataagaagagattggggagtggtctgtgcccatgcctagagaaggcaggaaatgacactaaacttgagaagaagtcaggagagaataaaggctgggagtagagatgggaggagaagttggggggtagggctaggaggtgggtaggtggatggctagttcactttcatcgttttagcaagggttggctctgttaattatcctgtatcttactcattttgtgttgttgtcagtcaaacattttctaagtatctgaaaacattaagttttctgaacctataattaaatactttttggtgaatcagtcctagataaaccttcaagcaaatcctcttcgtagacagcaactattgcatgctttctggttcactagtaacaagtaatcttaaagtagaaaattaatcgatgtattttgctaatagctcctgttgtctcttgcaagcatggcaaacattttgttactcacattttttgtctttgcttttataacgtggatgaatagcaaattcctgtaaatccatgaccttgcggtggctgattatattattgctgtcagttaattgcttcctacttctctgtaatgggattctatagccacagctgttgaaattgacttgcagtgcttccctgttgaaggaatagccaattttttttggctttttttgcagggtggggggacagaatctcgctctgtcgcccagaccggagtgcagtggtgtgatcacagctcactgtagcctccatcgcccaggctcaagcagttctcccacctcaccctctctactagttgggaccacaggcatgtgttaccatgtctgactaacttttaagttttttgtaaagatgggtgggggtgggatggggtcagggggtgggctggagggagtctcactatgttgcccagagtggtctcaaactcccgggctcgagcaatcctccagtctcggcttcctaatgttctgggattacaggcatgggccaccacacctgcccagaatagccaattgttaagtgttagtgttgagccacgggattgctttggccaagtaagcagtaatgatagtgatgggtatgctacctccaagcagaaactcctaaaatcatgcaccacattttccccactctttcccctttgtgtgggaatggcaatcccagctaaaagctcttccctcatctgttcctagaataagaagacacatggaacagagccatggaaccacagacacacaaggttgtgctataaacaacagggagcttggggacttttgtcatataatataaaatagtaaaaactgactgttacttatctgctgtgattttcaagctaataagattagcattttccatgagttactataattaccaattataggttgattgtgtccccacaaaattcatgaatcggaagccttaatccctggtacctcagaatgtaataatatttggagataaggtccttaaagtgatggttaagttgcaatttggccattagggtggtgtcctcagaaaaagagggaatttggacacgttgagtcacaccgggaatgcctgccaatctatctctggtggtgctttttgtcttaaagtaaattttatcaggtttaaaaaatataactgtgctagtctgttctcctgctgctgataaagacatatctaagactgggtaatttataaaggaaagaggtttaatggactcacagctccacatggctgggggtgcctcacaatcatggcataagagcaagggacgtcttacatggtggcaggcaagagaccatgtacggggaactcccatttataaaaccatcagatctcatgagacttattcactattaccagaataggataggggaaactgcccgcatgattcaataatctctacctggcaccacccttgacacatggtgattattataattcaagatgagatttgggtggggacacagggccaaaccatatcaatgactacagcagatttctctttgttgtgcttgtgtggcatatctttttgtatcctttcatttgtaatctttctttttctttaaatttaagatgtgtgtttttttaatagcaatgtagagtttatttattctgaaaattcctttcacttacatttaatatgatttattctatatttgggtttaaatctttagttttaccaaatactttctatttgaatacatattttatattccctttttctttcttgccttgtttttaatttattattttctatcacatttgtcctatgtgttacattgggagttttaaacactgttgctattattattttactggtggcattacacattacaccattcctcctttacttttcaagccatagtttttgtatttttgtctcattctcagataatgcaagaacccctatggacacatgtcattaatgccatgaattttatgtctccctagctttaattaagaaaaataccattattttcatttacaagtcaatattcattacatttatccaaatacttcttattttgttgctctttatttttttttgcatttctgaacaactgttttttttcttcctgaagacaacacttagcattttctttagggaggggcttctagcagcaacttttttttcagttatgatttgctatctctgttcttccaggatattttaactaagtatgaaattatattttaggagtgatttactttcagcactttgaagctataattacattttattctgaattccattgtgtctgttgagtgattatccataaggcttattattgttcctttgaaagtaacttatcctttttctcccctctggctgattttaatattttctctttgtctttggttttcagcattttatacaatgtacttacatatacttttatttttatttatcttgcctgagcttcataatgattttaaatatattactcaatatctcgtctcaattttggcaagctgtcagccactatcttagcaaatattacttcttttttttctcagacacaaattgtacatactttaggctttctcactgtgccttctgagttgttcactctttcttatgtatcaactataatattttttccatcctttattttgaatctattcttctggcctataacaattcaccaattcaccaattctcttttcattcagctgtatttattctgctgctaagctgatctatatgtttctaatttcaattattataccttttatttccagaattttcagttttttaagttgtctagttctctgacgaaaattttgtttgtgatcttcttgaacacagtaagcagacttccttaaaaatatagactctccagtatctggaaccaccatggatctgattccattgccttttttttttttcatactgggtttcatttatgttggcctgtctccttgaggattttaagaaattatgtaccagactccaatcactgtcttctattcctaaaacattgtcagctgtgcagctaattctctctgttgtctcttctagtattccaagaaccatcctttgggaaaaatggcctccgccgtttgtttaacctccttggatctctatttcctatcttattagctctctattatcttcaagcagattatttttaaggtttttatacctattttcgactcatgaaaatgttggtcaaaaatgcttcctctgctttaacttgggtacttttattttgatgaattatcaaatgtttctttttagtgttacttttcttttgtccttttattgattgacattcatatgtgaatttatttctgtcaatgagttagtcagtccgaatttgcaattaatgtggaagctttattttgagaaaaatgtggtattaagtcatactagtaagcaccatctcaaaccttaccacgtagtttattgctggctgctgcctgtctttgatttttaccattgtattttgttttatgctcaaatagtcaccaaatattgtaggtatgactgtacttagaatttattttagttcattccccttacttaatagaagtgggggttctattgcgtatcttgatgaatattctatttcttcttttcaaactattcttttctcatctttaaagataatctcttccatgaagcctgatttcagccagccaactgacaggaaagaggggccagggatggaaacttctcactcttattatgagctgattgtttaatcttcatactgtgtggtcttccagtaaacttgcctctaaaatatgttgatatgtacaaactaccacaagaaaatttaatcctcagggttctaagaagagacattagagatgtaaagaggagtatgatatgaaactaaatgcaataaagaacaaacattttaatttttatacatcaattgcattaaatattgtcactattgacaactcctctggtatttgggacatattgattgaacttaattatagaatgagtgaagctgatgatactatgtgggaaagccttgtaaaacatctgagcctcatctctactaaaaatacaaaaattagccaggcatggtggcacacgtctgtagccccagctactcagggggctgaggcaggagagtttcatgaggtcaggaggcggaggttgcagtgagctgagatcgtgccactgcactccagcctgagtgacagagcaagactctgtctcaaaaaacaaacaaacaaaaatctgagttctggtaaaatgtatattttgaaaaataaatgggtgtcaattcccatcaagcatcgtaagtccccacaatttactcacatatgtgcttgattttcctgtggcatatctcatttccacaaacagaatatctcattgatttgaaagttattaatcagaacacccttctctgttactaagtgctgaaaaggaagagcagagcttctcagatgtggtcgaaactccaaaaatctccactacatcttgaaggatattactctggaattttggactgtctgcaaagttgctgcagccccaataaatgttcaaaaatttaactacaatttattccatctgtttcattgagggttttcttaacatttgataattactgaagagaacattttgaatttttgctgcatgtgtggtagaataattctttgaatattattattattatttttgctgtaagaatttctttttattccaagcagttggtcactttttgggtttcgattactcaggaagtggtagacggattgcatagctaagcaggaaccaggatagggtctccctatgtcttagcttctggtgtgctggtacagaatggttggagtttatcaactttccgatgactgattccttaagtcaactcacaagacagtgatatttgaaccaaaatgccaaataattattaattgcaatggagaaaatttatttctggtggtctctattcgcatacctcctttgcagtgtcagggtaccttaggggtactcagaattttgcttgctaaaaagaacaaagggagaaaggtaatcttaaaatctgttttttttttccaggctaggtaaaatccagagagctctccctgccttccagatttcccaactctagtaagctttagagagaaccgcatttctgtccctgatttagtcttgctctcttctgaatacttgataaacagagaggaatttctttgatt

SEQ ID NO: 1176 - DNA, 88853 bp, Homo sapiens
gcaaattctggcaacacctctctgacattgacactaccattatccccatatttcagagagaggactgaggctcagaattctaagaacttgcccattatcacacaggtcctaagagctccctacttagggacttaaatccaaatcttggactctgcgacctccgttctcaccaccgttctgtgctattccctgagaggcagcgcaggtccttgcgtcgcagatggggctgcctgtctccaaggccttccctgctcctatgacagtggaggtgtgaaggggattggaagtgtcctcgagttctttctgaagaaacacatcaggcaaataacagatttataaaggtgagctgaggggcggtggggagagagagagggagagacagaaaacatgctcttcttagcaattccaccttgatatgattacagactggaagtctatacctagactagttaaccaggaaggcagatgggaacttggatttcctacttcccaactgtggtttctgtttcaatcacagactactgcagtcacctctctgttggaaacaaacattgactctctgcttcctcccaaggtgcaggcactctcagaattcgagagaacagaggcacaggaaagccatcatcaagcttgggtttgtctctgtcacttacagagttgtaggatctcgagcaagttattgaaccacagtgtgcctcagtttcctcatctgtggcatgaggatgctgatatgcttacctccaagggctgctcagggtattaaatgaataaaatgctcaaagcccttagaacaggccatgctgaaagtagcaaatatctttctcttgtctcccacatttcatctgtcagagaatcctgttggctccatcaacctccaaagtatatccagaatcccaccacttctcaccaccacactgccacctacctagccagagccaccctcctggaaggtcacttgggaacctgcatggacacttggcccctttcagtttattctttttttttttttttttttttttgagacggagtctcgctctgtcgcccaggctggagtgcagtggtgcgatcgtggctcaccactgctccgaactccttggctcaaggaatcctcctacctcagcttcctgaggagctgggatcacagatgtgtgccaccatacctggctaatgtttaaattttttgtagagatgcggtctccctatgtttcccaggctggtctccaacttctaggctccaagtaatccacctgcctcagcctcccaagtacccaagtggctgggactacagacgcgccaccacgcccagatcactttattcttaagacagtagctagaggggtcctgccacacagcagtcacgtgacttctaggctcaaaaccctctgtagacatctcaaaagcccaggctttcaccctggcctgcccaacatgaaagacacaccctttctctccgccctcagcaactcgctcccctcactcccctgatcctgtgtgctgacctctcgctctccctccttccccctccccacatcctgtatgccggcctctcgctcccctcactcccctgatcctgtgtgctgggctctggctctccctcactccccctgatcctgtgtgctggcctctcaaagacaccaggcatgccccgcctccggcctttgcacggctgcccctctgccaggcactctctgccctcaccttgttgaagtggctgctcacatgccaccatcccaggaagcgccctctgaccatccttttcagtcacaacctctgtccctctgctctatttttttttttttagatccatggcacccaacacctcctactataccacatcattttccataatttccttattcagcccatttgttgcttatggttcatcggctgctgcgagaatgcgagtgtgcacagaggcaggggtctggcttctttttgttctgggaggtatcccacctgcctggcatgtgtctgcccttggtgcatgctcggtaagcatgggtagaacaactagcacagggcaagggctcacccaggggcctttcttggcaccacaagggccttaccccaaccctgggaagcgggcactgtctttattttacaaatggtgacgttgacgcctccagcggcctgcccaagctcacagctcaaggaagggaagaaccaggagcatgatgtgtttccaccctcgccctgcagtctcgctgcagccccaccctcccgaaagcacgcgttcacccaggctgcagggtctctccctgtgtccgcttcttgccagcacctgcctgctgcccgacccctcccgcctgcaggcaatttgcccgtctccacttgccagaggcacctcccaggccacaccacagaaagcctgcacactccgatttacctccatgtcccgtgttggtcactgctgtggtttgggagccaccgccctctgctactgacttggtgccttcctggacctccctagtgggctcatctgtttcatctttctgtacactcattagggaagatgggcacacacacacaagcacccacgcacgcacgcacgcacgcacactctctcgctcctgctgtaggtccttagcaactaacgactagttgtgcctgttagtagctgggtgggacttattccagatcctttccaggtttgtaaatcaaatcaaggacctgagtcagactccggacttactgaagttcaaccttcctgaagacgaaaacaggctgagcagcatggatggcaaggccgtctctgccccaaggcaccagctggcggacaggatctcggttccatctaccagccactgcaaagcagggacatgtgtgtcaaccgggccctgggacaggtggtctgggcctcccctctcttccctgtggtgatggggacagggaactttgtaggagaaacctacgaaatggaaactgtgaagggaaatgctttttttttttttttttttttaatgagatggagtttcactcttgttgaccagcctggagggcagtggggcgatctcggctcactgtaacctccacctcctgggttcaagtgattctcttgccccagcctcctgagtatctgggattacaggtgcctgccaccatgcctggctaatttttgtatttttagtagagatggggttttgccatgttggccaggctggtctcgaactcctggccttgggtgatcagcccaccttggcctcccaaagcgctgggactacaggcatgggccaccgtgtccagctgggaaatgctttccttgactcagtgctaggagtaggatggccccaagcacaaagggctgcttagtcaatcctctgactgccagaaggtacaaagctcttagagcctgacatggtttggatgtgtgtcccctccaaatctcaggttaactgtgatccccagtgctggaggtggggcccagtgggaggtgtttgggtcatgggggtgggtccctcctgaatgattttgtgccatccccttggtgatgagttgtcgctccgttagttcacataagaccgggttgtttaaaagtctgggatccccccactctctctcattcccactcttgccatgtgatgggcctgcttcggctctgccttccgccgtggttgtaagcttccaggggcctcgctagaagccaagcagaggttggtgccatgcctgtacagcctgctgaacggtgagccaaataaaactcttttctttataaattactcagtctcaagtattcctttataataacacaaaagcggactatgaataatacagggccccacgctggcctccagaacattcagcccttagaaatgcatggctttttgttccaggcgcgccagaacagcaccccaccagattcgcttcccgtggcttttgagtcttaaacatatctacggcgtctaggagcctcattagaacaaaccagacattacatcaaatgaaaaccccagtggttctgaatcaccagatgttagcaggaggcgagatgaaaagccacagtcctctcgcagcagctgctggaggtggctgtgtccttgctgatggacctggaggtggctgtgtccttgctgatggacctggaggtggctgtatccttgctgatagacccgagatacctggagacccaggctcactccctgctcactgcctcagatcagggctggagacagaaacccggacacacaggaccctcttgagaaagcccaggagccctcaacatcacaggacacaggcaagtggaaggagaatggctttttcgtttctcacactctggtggcctctggggtgagggggagtggggagttagtgtggaatgcggacagagttcctgttttgcaaaatgaaaaaagttctggagatggatggtggccatgatgaaaaagttctggagatggatggtggccatgatgaaaaagttctggagatggatggtggccatggtcctccagcaatgaggatgttcttcatgccactcaactgcagacttaaaaactggttcaaatggtaatgttaccttatctttattttgtcataattttattttttgagacattctcactttgttgcccaggctgcagcacagtgacacaatcctggctcactacaaccttcgtctctcgggttcaagcgattctcctgcctcagcctcctgagtagctgggattacaggcgcccaccaccaggcttggctcattttttgtatttttagtagagacggggtttcaccatgttgggcaggctggtctcgaactcctgacctcaggtgatctgcccgcctcagcctcccaaagtgctgggattacaggcgtgagccaccacacctggtctgtattttgccataattttaaaataaataaatggaggagcctgccccttcttgctgccctgtgctgtaggcccatggacttccatgctcgcctttcctctccttcgctgtttctggccactcctttttctgtggcttttactccctctgcccctaagccggctgcccctccaggtgagatgctggcctactgtgtggtgagtttcagagctaatcaccaccgccttgttgggggggtcacccaccgggacacccataggcaatagggcactcacaaaccgggcccatgggggagggggttccaacatccttacaggaggccctgactccactaagaggataaatgtgctgagactccactaagaggataaatgtgctgaatcttttctgtttagccgtttgagagcagggtttttcagcctctcctttctacacacttaagcccctcttaaccaccgaggccaggcctaggggttcatccttcccttcaagcggacagttcactctccgaagcccttcagtgcccactttgccttcccttgccccctttacatggcctcagccatcacaagtttgctttctgttatatgaacatagtgttgtggttaacagggctttctctttgcccagacatgcctgggttcaaatcctggctcagcaagcagccagatatatggccttggaccagttacttaaatttcacgttctccagtttccttgtatccaaaataggaataacaaaaccttccttagttttgttataaggataaaaacagaattaatccatactgcccattgaacattggcagtgagaggcggctctgtgcaatgactggcagctgggctctggagcaggactgggatggcctggggcagggtacttggtttcactgtgcctattttctcctctgtggaatgggaatgggtaacggtaatctacattacaaggctgtggcaaggattgcatgtttgtaaatttcattcaatagagtgcttggcatgctgtctgcacatactcagtgttcagtaaatactcaccacttttgttagcaagtgaggtggccatttagaaacgaggtggccaggcacagtgactcacacctgtaatcccagcactttgggaggtcgaggcaggcagatcacctgaggcaggcagaccacctgagtcaggagtttgagaccagcctggccaacatagtgaaacccccgtctctactaaaaataccaaaattagccaggcatggtggtaggtgactgtaattccagctacttgggaggctgatgctggagaatcgcttgaacctgggaggcggaggttgcagtgagccgagatcatgccattgcactccagcctgggcaacaagagcgaaactccgactcaaaaaaacaaagaagctaccaggccagactcggtggctcacgcctataattccagcactttgagaggccaaggcaggtggattgcttgagctaagcagttcgagaccatctggggcaacatggtgaaactctgtctctacaaaaattggcagggcatggtggtttgcacctatagtcccagctacttgcagggctgaggcgggaggatagcttgagcccaggaagcagaggttgcagtgagccaagatggtgccactgcactccagcctgcatgatagagctagacctggtctttaaaaaaaaaaaaaaaaaaactaccaaaaatattccagaatgcatgacaaaaatcaatgtctaaaatagtcaacaaaaatcaaacctggacatacattaactaaagtaattttataacatctaaaagagatatcaaaataaatattttagtgccctgaaaaaaagaaagaacattcacaaaacgaaaaacataattggctgggcatggtggctcaaacctgtaatcctagcactttgggaggctgaggcaggcagatcacttgaggtcaggagtttgagaacagcctggctaacatggtgaaaccccatctctactaaaaatacacaaattagtcaggcgtggtggcacacacctataatcccagctactcaggaggctgaggcagcagaatcgcttgaagccaggaggtggaggttgcagtgagccaagatcgtgccactgccctctagcctgggcaacagagtgagactctgtctcaaaaaaaaaaaaaaaattatggaacacatggaaacaacaagaatagtgcaacatgaaaaatattcatatatgcattgtaaatacttctcaaggtatgctggcttttaggagtaagaaacgaagtcctgctatgtccaattaaagcatttccatcccaggggcttctttagctcctcccaacccatgctgaattgtattttaatagtcagacaatgatcaagtcagtgtactattttggttatacattggtcatcatggaatttagagaaaggcacaaaacacgaaaaaaaatgagttgcaggaaaagtacagaagagcagaggttagtgatgtggcctctgcattcccctccaccacccccatccatgacatttgcaattgcatgaggtcttgcaaagagggcacccatgttggcctctgtccatcttgattatgcttggaagtggtgaaatgagagccagagggaggattactctgaaaagtcaaccctgatgggcaaaatgcccaagctcccctctgtgctctctgcatgtccatcaaaggttgaagaagagcctgtaggcatcatttccacccatatgcagagcacactacatgttagttactcacacgcaaagaacactatgtgttaatatcagacttggttgaggggcatgacaacgaccttcattcaaatatatgaatgcctgttgtgtgccaggcacccttaaacaaaggatttatttttttatttttatttttatttttcttgagacggggtctcactctgttgcccaggctggagtgcagtgatgcgatctcggctcactgcaacctccgcctcccgggttcaagtgattctgctgcctcagcctcccgagtagctgggattacaggtatgtgccacatgcctggctaattttcgtatttttagtagagatggggtttcaccatgttggccagtctggtctcaaattcctgacctcaagtgatccacccgcctcggcctcccaaagtgctgggattacaggcgtgagccactggacccagccaaacaaaggatttttaaggcctcacattgtctgcctggtattctctttatttcacaggagaggaaatgattaaaaagatcaaaacctgcccaaacttatactgcaactataagagtggagcactagggctgggtgctgtggcttatgcctgtaatcccagcactttggaagtcttaagcccaggagttcgagaccagccagtgagaccctgcctttacaaaaaaaattaaaaacttagctgggtgtggtggcacaagcctgtagtcctagctacttgggaggttgaggtgagaggatcccgtgaacctaggagttcaaggttgcagtgagttatgatcgtgccactgcactccagcctggataacagagtaaaaacttgtctcttaaaaaaaaaattaaaaattaaaaaacaaatagaggattactatgttctggagactgaacagtgaacaagatatacagaagagcttttggtctaggaaaagctagatagtgatgatccactgaggtctgtgcaacttgaaaatgtgaagctgtgttatgggagctcagagcagggccacagcctagcatgggagggagggaggacaggaaaactcttggaggacatggcatgaaaatgaagagggcttagccaggtggaggggttgggggtggtggaaattaagtatcttggggtattctttttcttgccttttgacttgggaatgagaatgtgatgtgttccaggaaggagcagcagctccatgctggcaggatcagagtgcatggagagaaaggaagtgtgtccagagggaaaaagagcctcatggcccctagttaaggaattaggactcgatcccaaggctagaaaaagtgttaagatttgataatcacattatgtttctcactctggactttgagtctccccttcaatgcagcccctatggtgcaatggcgagcttgtatataagcattttagaggccaaatgcgaactcttccttctaatgcaggaaccagtttcaatcatcagagttgcgcactagtttgtctaagaactgtggcttgtttgtgtaggagtgccaaggtagactcattctggacctgatacctgggatggctaaatgataaacatctctaggataaattaggcattaggtgtttaaaatgttttagaagaatttttacgccagcaggaaatgtttgtgagtatcgagaaaaacactaggagatggtacacaaatgtgcacataggacggtcctagtaatataagtctctcctatctatctatctaatctatctatcatctacctgcctacctacctacctacatttatctatctatctatcatctatctaccaacctacctgtatctatccatcatctatcgatctatctatcttcttctttttttttttttttgagatggagtcttgctctgtcgcccaggctggagtgcagtggtgtgattccagctcactgcaagctccgcctcccaggttcacgccattctcctgcctcagcctccccagtagctgggactacaggcgtctgccaccacacccagctaattttttatatttttagtagagatggggtttcaccgtgttagccaggatggtcttgatctcctgacctcatgatccacccgcctctacctcccaaagtgctgggattacaggcgtgagccactgtgcccggcctatctatctatcttctatctacctacctacctttatctgtttgtctgtctatctatctatcgatcatctacctacctacctttatctgttcatctatctatctaatctatctatctatcatctatctatctgcctatctacctttctttatctgtttgtctgcctatgtatcaatcaaccaatcaatcaatcatccctggggaaaacaggaccaggaagaaattttaatgagcaggtgctgcttttataatcagataggatgttaaagatttcttaccctacccagagatacatgaacacttaggcttaagaacagaaatttatttcacaccattgaaacttcaaaaaaatcattactggccttcacctgagctgtctttcgagttatccataatttaaacacaggtagggactagaaaaacaaaataacaaaaacccaaaggtaaagttatcagttaataccagctggtccttatcacagccatttcaaacctgtacgttcacttttggccttggctcctgcctcctttagaatagttttcgtaagagtattagaaatgaacagtatggaataggaaactttgttaccatttcaaaattaagctagtccaaaataacatcatttgtgtgatagggaagatgaccaatgtggggtgggctcacagtactctaagacagtgtgtgtacgtgtggcttaaataagcctttcaaacagaagacttcttccagagttttagattcactgctggctgcttagaaaatagcgttcacggccgggcgcggtagctcaagcctgtaatcccagcactttggcaggccgaggtgggcagatcaccaggtcaagagatcgagaccatcctggccaacatggtgaaaccccatctctactaaaaatacaaaaatagctgggcgtggtggtgcatgccgctaatcccagccactcgggaggctgaggcaggagaattacttgaacctgggaggcggaggttgcagtgagctgagatcgtgccattgcactccagcctggacaacaagagcaaaactctgtctcaaaaaaaaaaaaaaaaaaaaaaagaaaagaaaaagaaaaaagaaaatagcattcatggtttagttcccaattctgaagtcttcctcatcaggggccatccaatggagtgtcctgctacctgggggcagaggtcagggcatctgcgggcccagtccatcctccacttgcctcctgaccttcacatctgtttctgtgaattggcccctgacatgaaatatgggttactcttttccagtctgtttttcttttcatcctcatcaaattgagcttcgatctccgctgggttgatgtaagtatagaaccgagccatgatggcaaaaattacacagacgaccagaagcaacgcggcaaatagaatgtactcggcccactttgaagaaatcagagttggagcaggaaaaagaacaaaaataaaacaggtcatactgatgaatatatggtgcgtacatgttcttgctacatgcagatggagagtgctttgaaattaaattatggaaaattggtaagcaaccaatacagatacagtaagcccagcttttctggaatgcccaagatagatagatgctaatatagacaacatgttttgaacagcactaaggtacagaaacaacagactttgggaagatgagagaaaatttctgaaatactgaagccttaagacatgtggctggacctggaaggatggggaccaagagaacagcaagcagtccccacaagggaaaaatgaatatgctgaactccagcaagttaagagccccacgttcctccttggaaacacctggagctcataagcacacagcattagcacatctgctgctgggacctggtgcaggaagtcatgaaacggatgggataacagctcccttatgaggcagacatgctacagtgcagaaggaaagagtgtaagtatcagtagagccctcatttaattttagctggaaaatttataaccaactctaggatggctttaacttcaggtgttatgaaagttccaggataacatgtgtctgctttgcagctgctaagctgcattcactgaagctaggagagatgtttcccttgatagtaaaacacataagggcaacttcaagttaacccattccagctattttggttgtcaatttccagctgcgttaacaacaagtgggaataagaagaatcatcaggccaggtgcagtggctcacacctcccagcactttggggggccaaggtgggcagatagcgaggtcaagagatcgagaccatcctggccaacatggtgaaacactgtctctactaaaaatacaaacattagccgggtgtggtggtgggtgcctgtaggctcagctactctggaggctgaggcagaagaatcacttgaacccgagaggcggaggttgcagtgagccaagattgcgccactgcactccagctgggcaatagagtgagactccgtctcaaaaaaaaaaaaaaagaagaagaagaagaaacagcagacactttgccataaggctatttgggaacagccctggctggtctggcagtttaatccagctattagcctagatgaccacacagagcacacagatggctagggaaggccaccatgatgaccatgaacaggaaagacagaggtatgtgcaatctcctctcccacgccatacctgtttgctgaactggcctgcccctgccacgatgagcacaatgatgttgccaacagccacggtcagcagccatcctgcctgaagcaccgacttcatgttggaaggagcctgaggaagcaaagcaaagtgagtcctgctccaggtctcaccctccgagcaggagaacacagctcaccgatgggcgtttcgtgaagcagatcaccctaacaatgcacacgaaaagtcaggtggcctcaatgtaaaaaggatcatcacttaagtaacaagacacccaaacatgcacagacgagtagacaagaattcctgtgtttcacgctccacatccttgcaaagctgtccccttagttaaatggacacatctacggaggagctgatcctatttctacaggagagcttccaagcaaagccacccagcctggcatagtcttcccctcaaatgcaggctgccctgggctgcaagcttgcccttctgtggctttcctgccacatctccaaaatctcttcaaacacctgtcacctgtattacagttatctcctttattagactgtgaggttatcacagaaagtgattttctgactcatcttggcctctttactataaaaattgatggtactaggcattgtgggctataatgcctataactatagctctgacaacacagttcaataattaagctctaatttgggtatcaataaaacctagctcattagtctaacacacttaaaagcaataattcttttaaactttttctttttcttcttttttttttttttttgagatggtgtcttgctctgttgcgcatgctggagtgcagtggtgtgatcacagctcactgctgcctcggactcctgggtttaagcaatcctcctgcctcagcctcccaagtagctgggaccacaagcgtgctctaccatgctcagctaatgtgtttttttaattttttttaatttttaaagctagaccttatttgttatgtttactgggagctataaagagacctcaaccaaacctatcatgaggacatagacctgtaattgagctgttttatgaatggttggttacatttggttgtttcagaaaggagaatctgctgaccttcatcactctggtagcagtcagtaataaatactgggcgctaaatgtctagggtatgactgtggggctatggacacatgtgaacacgtgctcttgcaaagttcaagacagtaataattcttattcactaaggacaacacttggtgacctcagagaccttgctgtagggaagataccataatgctttctagactttttaaaaaatatagttatcccagatttaaattaagtcccatcagcattttctgcaggcaggggtattgcagatgggtggtaaatacaacaaacaagaaacctgagaatatgagaattccaatcccgtgacagagaagaccacttcgccacaggtgagaagaaaatactgcgggatttgcagagccatgttaactgtgttggctgaaatatcttcaaacaccttcacttcagggcagctgtcattctgcagcagtaaggcaaaagcagaagaagttgagatagcttctaaaataaaaactgttcgaacaggtaaattgagtttgaccttctaggattacatcatatgatttgtcaagtacgtacacattttaaacataaggcaacactgcattttacacttgcaatgggatttgaagacacgttcaggaggatttttcttttagataagagagtaggttggaagtcattttaaaacactgccctctctttgaactatgagttctttaagtccatgttaatagtctagaaggaggcatcagatattggttaacataaattattatccaggggaagtcagtctgtttagattctaatgattaagtcatcaataagttaaagaattagccaagcaaattaattctaagcccatttaaaatacagatcctaatatcactctagttaaatcatattatgtcctaagtgtttgtgagtcttcatatcaatcgagtatgagcagatcttctgatacaatgaaacgagttactaaccttcctttggactatataggtataagcactaccaaattcaaggtagaaagtattgaaattaggttgacattgtggcggaatctctgttgagcttattgtgaagccttttctatcaaaataaagaataatattggttaacattcttggcattaaaaatttcaatgcattttttaaagaaaaattcttgaacctttgagtgaagcattcagtctcggtacttacatgccagaaggaaaaaactggtatgtgctggcattgtagctgctgatgtttgcataaactttcccactcattgtgatggtgatgagctcgttaaaagtatttacaaatctgaaacagaaaaccatctgtcttgtaactgaactagagaataatatattctaggtcacagtacatgcacctgaagttgggcaatactccctattttgaaggagtttaagatgttttcagaatatttctagagaataaagacaaaaagtgaaaaactctgggtttatccctgctcacccactcatgagaacacacctaaaagaatgtatttaacagtgtttatatgtgctggttactgctctaagtactttgtaaatctaacctagttcaatacattaggaatattaagcagggactgaagtagatactgagcctcttcccttcaagaaggtagccgtgcctttgtgttccttgtttcagaaactttatttatttatttagagatggagtctcgctctgtcacccaggctggagtgcagtggtgcaatctcggctcactgcaacctctgcctcccaggttcaagcgattttcctgcctcagcctcccgcgtagttgggactacaggcatgcaccaccacacccggctcatttttgtatttttagtagaggtggggtttcgccatgttggccaggctggtcttgaactcatgacctcagacgatctgcccacctcggcctcccaaagtgctgggattgcaggtgggagccactgcgcctggccagaaactttagcgctcaagtagtgaaagaccaaaaccagatgctgcccagttcctaaaagatagaccccagttcctaaacgacacccccttctttagggggttgaggaggaaagcccacctacttcctacctctaggagcctcaggtggggaagggcacccgggactggagaggaagaagtgggccagcccagtaacaagagacggttttttcagtcttttttagagatgaggtcttgctctgttgcccaggctagagtgcagtgatacaatcacagttcaatgcagcctcgaactgtgggcctcaagtgatcctcccaccttagcttcctgagtagctgggactacaggtgtgtgccacaatgcctggctaatttttatttttatttttgtagagacaagggtctggctgtgttgcccaggctggtctcaaactcctggcctcaagagatcctccctccacagcctcccaaagcactgggattatgggtatgagtcattataccaggctgagagacagctttaaggaatccccttcagagggtggaggcctgtgtggtcctggagtgacagtggtcagcatcctgctggaatacagctttgaatggatacccaataagaccgacttccaggtccaaggcttcctatctctacaaagtcccgtgaggctacgcttcatatggaagcaggtgaattgtttgccttcataggaccatacagatggtgaacagcacggatggctgattacagacccctttcatagctgttccaggctatagacgaccctgaaactctcatacaaccctagtgaccaggacggtgttgctcaaaataagaccagttgacttttcctaccaaacacatgagtgaaggcctagagcagattatccagggtagagaacaataagtcttactagtgtacacctcagcagtgtaaagaataatttaacctttccatggctaaaatgtggggccaagtttcatcagttttgtggcaacaaataatactgatcaaattttaggtgctgggagaaaatggctatgaattaaactcaggtcctgaagtcccgaggccttctacttggtgtcatttgatagctgattaatatggaaaatggaacctgagacagatccacacgggccttagctagaattcccactgctctagactgtaagagctgcttttatcaaagatgaagatcacccacacaaaagagagcatgtgggcagagtgaagccgaggaagcagaacgttgggcctgaggcctggctttataacttatcagccatcagactctgaatgaaaccatccctaaggctagaggattctgagctgcctggcctatgtcttagggctggtgcgacaagaaatgaaaacacagtccgagtaacttaatgatggggatggggtctgggaaatgcgtccggaggcgattcagtggtgatgggaacctcacagcgggcacttacccacacctagacggtgccacccaccacacacccaggctgcatgggtgtggcctttggctccgaggctacaaacctgtgcaacgttggctgcactgaatactggaggcaactgtgacacaatggtaaggatttgcacatctaaacatgtctaaatactcccattcgttcctccctggccccctggcagccattcatctgctttctgtctccatggctctgcctgccacttgatgtcaatggaatcattctatgcaggtctctgtgaccagcttcatccctcttagcatattgtctttcacattcgttcatatcgtggcatgtatccgtactccattccttttttgtttttttttgagatggattctcaccctgttgcccaggctggagtgcagtggtgcgatctcggctcactgcaacctccgcctcccaggttcaagtgattctcctgcctcagactcccaaatagctgggactacaggcccccgccaccgcacctggctaattttttgtatttttagtagagaggggatgtgttagccagcatggtctcaatctcctgacctcatgacctgcccacctcggcctcccaaaaagtgttgggattacaggcgtgagccatcacacccggccacttcattcttttttatgactaacattccatcatatggatataccaccttttatcagctgatggacattggatttatttgtacgctttctctattgtgaataatgctgcaatgaacatgcatgcacaagtttttgtgtggacatgttttcatctcttctgggtgacacctcacatgtcacatttggcaggcttccaaatcaaccacctgaggaaggtctcacaatacatggcgtatagcctgtctgtgagtaaagagtgactccctccaatcttattgtgttgatatctgattaatacgtagcccactaacactgaaaaggatgcagatttgcttctgaatcatgacgttttactgactttcttgtggtaaaacattttagcccatatgttgtcatctgtagccagtgatcataacctctgtattataacctccaatgaaaatggaaagcttgagcggggcacggtggctcacgcttgtaatcccagcactttgggaggccgaggtgggcagatcatctgaggtcggaagtttgagaccagcctgaccaacatggagaaatcccgtctctactaaaaatacaaaattagctggacatggtggtgcatgcctataatctcagctactcgggaggctgaggcaggagaatcgcttgaacccaggaggtggaggttgcggtgagccgagatcgcaccattgtactccagcctaggcaacaagagcgaaactccatctcaaaaagaaaaaaaaagaaaatggaaagctctaatatgaggagtccccctctcttctcctaaactttttttttttttttttttttttttttttttttttaagacaaggcctcactctgtcacccaggctggagtgcagtggtgcaatcatggctcactgcagccttgaactcctgggctcaaacaatcctctcacctcagcctcctaagtagctaggactgcaggagtgcatcaccatgcctggctaatttttaaattcttatatttgcagagagggagttttgctttattgcccaggttggtcttgaactcctggcctcaagtaattctcctgcctccacctcccaaagtgctgggattacagccatgagccactaaacccggtcttcctaaactttcttataagagtcttccaacttgcagtagactctgggacatgccctactttgctgatgtctctttccaggttgatcctcacatttggcttccaataaatcaaattatttctgcctcaacacccgtaattttggtcaacatggttatatacccaggagtgaaactgctgagttttgtagtaaaactctatgtttaacatttcaaagaactgtttttcaaagtggctgtaccattttagatttaccaccagcaatgaataagggtactaatttttatttatttgtttgtttgtttgaagacggagtctcactttgtcacccaggctgcagtgcagtggcaccaacatggcttattgcagcctcgacctcccggggctcaggtgatcctcccacctcagcttcccgagtagctgggacacaccaccatgcctggctaatttttgtctttttttgtagggacagggttttgccatattgctcaggctggtcttgaaatcctgggttcaagcactcagcccaccttgacctctcaaagtgctgggattataggcatgagccaccatgcccagccaaggggtccagtttacccgcatccttaacaacacttgttattgtctacgtttttttttttttttttttttttttttgagacggagtttcaatcttgttgcccaggctggagagccatggcacagtctcagctcactgcaacctccgcctcccgggttcaagcgattctcctgcctcagcctcccaagtagctgggattacaggcacctgccaccatgcccagctaatttttgtatttttagtagagatggggtttcaccatgttggctaggctggtctcgaattcctggcctcaggtgacctgctcacattggcctcccaaagtgctgggattacaggcgtgagccactgcgactggcctattgcctatctttttgatcagaacctagaaggtaggcagtggtatctcattgtggttttaacttaaatttccctaaaaacttggagcatatattcatatgcttattgactggatatcttctttgaagaaatatctatttaaatactgtgcccattttaaaaattgggttgtctttttagtactgagttgtgagagttctttatgtattctggatataagtcccttatcagatatatgatttgtaaatattttctctcattctgtgggttgtcctttcaattcttgatgacaccatttgcagcacaaaagttttcaatttttatgaagcccaaattctttttcctttttttgtcacttgtggttttggttttcttctataaatttcattgttttggttatgtgaaaggaagtagaacctcaggaccccaaaatcactatgccaaagggaaagcgaagcttgggaacagagtcacacaatactggcttccctttgttctcagatagctgtaattttacaaccctgtgtcacagtctcacagtaagccagcttccacaatgatagaaggccacatatctccccaggtggcctccctcaccaattgcttaccccctaaatctttcaggatttaagtctttgatccattgagttaatttctgtggagaggatcaacttcagtcttttgcatgtggatatccagtggtcctagcacccatggttgaaagcttcacaatatatagatgaaatctttttaaagcatcaaattatggtcaattatgccccaccgatactcccttcttgaagtatctttttcagtatgacagtcatgaaaaacaagcattgaaatgaactgaacttaaagccagacctttgcatagctgttttcaaatcttacattgagatttttagaaatgaacaaagtatatttcaaccacattatctacactaatgatttctgtaccactaatgaataaaaatatttgtaaaatattggtttaagaaaacttttctcatcccctttatatttattttttgcattatttatgaagtacattaatttgatgcagtttatatatataatttataaaggataccatactcatacatagtgggtgcatgctcaaaatattttcattacatgtgacaaaaagttttaaagaaatcactgccctagagaaacttcatacatgtggacaaagaaacaggtaagaatgtgaattttggcattgtttggcaaaatcagaatcatctaaatgtctttgactagaaggaatgaataaataaattgcagtatatccatgtaatagaatactatacagtggttaagtgaatggataaaagatgcattggctgggcatggtggctcatgcctgtaatcccagcactttgggaagctgaggcgggtggatcacgagatcaggagattgagaccatctgggccaacatggtgaaaccctgtctctactaaaatacaaaaaaagattagctgggtgtggtggcatgcacctgtagtcccagctactcaggaggctgaggcaggggaaccgcttgaacctgggaggtgcagcgagccaagatcacaccactgcactccaaccggggtgacagagtgagactccgtctcaaaaaaaaaaaaaaaaaaaaagagatgcatatatcaatatggctaaatactaaaataaaatattttctaacattatttataacattgcagaatgacatgcatgcaggacactcactttcctatttagtgtaaaaatgtgcttaacaacgtgttgtttatagacatatacatacggaacaatgtataacatttaaaaagtgcatgagaaagatcactatcaaactctcaaccagttattttttattttttagatacagggtctcactattttgtccaggctggcttcgaactcctgagctcaagtaatgctcccgcctcagccttccgagtagctaggaccacaagcatgcactgctatgccagacccagttttttttgtttgtttgtttaagacagaagtcccactctgtcgcccaggctggagtgcaatggtgcaatcttggctcactgcaacctccgtgccccaggttcaagtgattctcttgcctcagcctcccgagtagttgggattacaggcacacaccatgcccagctaatgttcttatattttttagtagagatggggtttcaccatgttggccaggctggtctcaaactcctgaccccaggtgatctgcccacctcagcctcccaaaatgctgggattacaggcttgagccaccgagccctgcccaagcccaatttttggctgatgcattgccactttattcaaaaggttctcctgaagttaatcacttaagtcttgcagcttactgataccacatagtcaaaggattccattttgcttaaaatagtatatactcttcctttaattcacatattgctcagaagtctgacttcctgagattctccgttgttctatttctctgttattttctgacaccagttttctagaacttctccttttttgtgttttttccctagagcctcactgaaataataaaacctttgatccattaaagatttgatgttaccaattaaaattaaaaggaaaaaagcttccagttcatcttttaccacatgggtggggtagtcaagtgttgctaatctcgtgggtctgtcttcttttctaagatctctttgaagacaatttttttaaatggagctttgggactgggcacggtggctcgcaactgtaatcccagcactttgggaggctgaggtgggcggatcacttgaggtcaggagttcgagaccagcctggccaatatggtgaaaccccgtctctactaaaaatatgaaaattagctgggcgtggtggcatgtgcctgtaatcccagctactcggaaggctgaggcaggataattgcttgaacccgggggcggaggctgcagtgagccaagatggcaccagtgcactccagcctggatgacagagtgagattccctctcaaaacaaaacaacaacaacaaaaaaaaacccaacaacaaaaaaagaagctttaacaacaccaaaacaagaaaggatcccccaatatcaattgctcaaagtttccaaggttaggaaacattcctgaagaaagtaaagcaacggaaaccacattctgaggcgaaagggaaactccagaggtgcttccagctcagaatcaaatacaaagaccaggacaggaccgggtgaccactgtcagtgtgtttccttccagatcagccatggcagctgtgtatgagcacgtgtgggggacaggaatgatcccagagaggtgggagaaggggtgaggggctgaatggtgtcgctctcaaattcacaggctggaactctaatccccagtacctcagagagggactgtatttggagagatttttaaagggtttcctcctttaaaggtgattaggatgggtcttaatccaatgtgacaagtgttctcatatgaagagatgattaggacacagccacacacagagaaagggccatgtgaggacctagagggaaggtggcatttacaagccgaggagacaggcctcaggagaaaccagcccttctggcatcctgatcttacacttccagcctctggagctgtgagaaaattaatttcttttctttttttttctttttgagagggagtcttgctctgtcacccaggctggagtgcagtgccgcgatcttggctcactgcaacctctgcctcctgggttcgagtgatgctcctgcctcagtctccccagtagctgggattacaggcacgcaccaccacgcccggctaatttttgtatttttagtagagacggagtttcaccatgttggccaggctgatcttgaactcccgacctcctgatctgcctgcctcgccttcccaaagtgctgcgattacaggtgtgagccattgctcctggcctgagaaaataaatttctatgtacataagctactcagcctgtactattttgtcatggcagccctactgacctcatggagaaggaaacaaagaagaggaacgaaggaacaaaaaaaaaatggaagaccctcttgctggcaagatgaatacaattatagccatgtttagttacactgcagagaaatttggcaacaccaaagagaaagaagacactgaaagcttgatgagcagaaatggaaatcaaccacaaagactggctgatgctttttttttttttttttttttaaatcttttagtcaagcctccaaagttatggaagaaaatggtgtctagccaatgatccaagtgtgagaatataaaaaggcaatttcaggcaagcaacaacttggaattgacctcgttttctcttgacaagatatttggccatacgctgccgcaaaagtagaaagaaggctgagaaagatgacataaaatccaagaaagaaaggcattaacctggcacacagtgaaaaattctaccaggatagtggttcagcaggacgacagagccagtgctcctgttagctcaaagaatgtgctgaagagttggtttttcaggaggaaaagtggattcccagaataatagtataattaggaagctggtaaccttggagactgggtaaaggcttatgtttttgttaacaagaggccaactaggttacggggaaaaaaaatagaagctgtgcaagaaagccttggtgaaatgaaagcaatcaagatgggcaccgctgagcaattcatcaatgtaataggagagtccaacgcacctggatagtcaagacattttcagttgagggatacattttcaaggatataaagtaacattttctcttgcagactgatcacactttattatgttgtaaataatatttatagggtcatattgtaaatcctgtttatggatctattatttagactcagcctagcacagggaaaacagaaacataaatctaataaatattaacaatgtgaagcaaacaggaggtgagatgaaaagtaaaagtccatttcaccaccatttgtattagtaagttgttttttggttttgttttgttttgcttttttggagacagggtctcactctgttgtccaggctggagtgcagtggcaaaaccttggctcactgcagcctccgcctccacaaatgttcaagcatttcttctgcctcggcctcccgagtagctgggattacaggcacatgcaccatgcctaatttttgtatttttagtagagacagggtttcaccatgttgaccaggctggtcttgaactcctgacctcaggtgatccacctacctcagcctcccaaagtgctgggattacaggcatgagccaccatgcccagcctacattcgtaagttaatagacattgtcccaaaatatacttaatatattttttgtatacttttgtatattaatagtatacaaaatatactattactgtgtgttttattgccaactagtaaaagctaaaatcaggaattatcaaagttgtagctacaggggactggagactggggttgaacgttgaggtgaacaggatacctactctcattccccccagtttattcttattaaatatttatttatagtaaattggcttttggggtgcacagtgctatataaattttaacattatcttgatttataaatactgtcacgatcagaatacgtagaccccaaaattgtgctaccccatagtcaaacctttcctccactcctaacccacgccaatcactaatgtgttctgtgtccctggagtttttggctttctgcgaatgtcatgtaaatggaattatacaattattctgtcaatgccactcttttgggggagtgggactgggcaagagaacaatttccatttttaaccacagagctatggcagaaggaaccagtgagctgtccctctgttccccttctccacatctccaatcacaggtgtgagaaaaggaactccagcccagggtgggaccagcccctccccacaccctcaatgtttaagaaataaaagtgtgtaattttttgaggctggcttcttccacagcacaatgcatttgaaatgcattcacatcgttgtatcaagtttgttcccttttttgctgagtggtgggtgtttatgcatcctccattgaaggacatttgagtgatttcccatcttcagtgattataaccagagcttctataaacattcatgtgtgggcttttatgtgaacacaagtttccagttctctagggtaaatatctaggagtgggatggctgggtcacatggtgagtgtttacctgtataagaaactgccaaactgtttttcagaggggctacagcatcttgtcctccaaccagcgatgcaggggagttccaggtgccccatatcctcaccaacacttggtattgtcaaggttaaaacaattattacagccacctgataggtgtgttgtaactcattgtggtcttcatttatatttcccttaataagaccaatgctattgttcatgtgcttatttgtcatgtgtgtatatctcctttggtgacatagctgttcaaatcttttgcgtttttaattgggttatataaaattaaatttaaattaagattatacagatttgctgtgaaagaagccagcctcaaaaagttgcacactgtataattctatttacattgagcttttagagtactttacatattttggatacaagttctttgtcaaatacatgatttctaaatattttctcccagtttatagtgaatctttttattctcttcagagtgatattggctgggtacatgtattcaaatttgtattcaaatcttagtgtaggcccgcacagtggctcatgcctgtaatcccagcaattcgggagtctggggtgggaggattgcttcagctcaggagtttgagaccagcatgggcaacatagtgagaccccatctctaccaaaagtgaaaattagctgggtgtggtggtacatgcctgtagtcccagctacttgggaggctgaggcagaaggatcacttgagcccaggaggatgaggctgcagtgagctgtgactacaccactgcattctagcctgggcaatagagcaagaccctgtctcaaaaaaaaaaaaaaaaaaaaaaagggtgacatcgacagaacaaacatttttagttttggtgaactctatcaagtttttcttctatagattgtgtttttgatgtcatatctaagaacccaaagtcacaagagtttatgtttcttgtataaattttatagttttacattttacttgtagatctagaatcaattttgagttttcatataagatgtgtaagaatttaatataatttttatgtatgaattgtgtataagatctgaggtttaggtcaagttcatttattacatatgaatgttcaaatgtttcaacactgattgttgaaaatacttcccttaatccattgaactgtctttgcacttttgacaaaaatcagttggttgggtctggattattcattcatgtatgggtctatttctttgccaataccattttgtcttgattgctgtaactttatagtaagtttgaaaactagtggtagtaagactcttccaacttaattctttttcaaaattatttgagctattctagttcctttgcctttccatatacattttagaagcagcttttttataaaagcaaataaaaataatgctacgattttgataggaatggcaataaacctacaggtcagcttggggaaaaatgacatctttactatattaaatcttctgatcaatgaatacagctgtctctccatttagttagcttttcactgatttctttcataagcaattttgtagttttcaccactcaaatcctgcacattttgttagatttatatctaagtatttcatattctgtggggggagatagtatacatgaaatagttgtaaaatttcagattccaactcttcattgctagtacattgaacagtgatggattttgtttttgtcctgtgtcctgtgacttttctaaattcacttattgattctgtgagcttcttttggtacagtcctggggactttctatataaacaattgtcatctataaagtagaaatttatttatttatatatatatattgatttattttgagacaaggtctcattctgtcacccaggctggagttcagtggcaggatcatggctcactgcagcctcaacctccccaagctcaggtgatcctcccacctcagccccctgagtggctgggattacaggcacacaccaccatactcagctaatttttttttttttttttttttgagacagagtcttgctctgtgggctaggctggagtgcagcagcacgatctcagctcactgcaacccccgtctaccaggttcaagcaattctcctgcctcagcctcccgagtagctgggattacaggcatgtgccaccacatctggctattttttttaaaaatttttattagatacagggtttcaccatgttgtccaggctggtcttgaactcctgggctcaagagatccacctgcctcagtctcccaaagtgctgggattacaggtgtgagccaccacacccggccaattggaaatatttttatttcttcctttctaatctagatgcttttacttctttttcttgtgtctttgctcttgcaaccagaggatgtttaatagaagtgcggagagtggaaaaatcttaccttgttcctgatcttagtggagagcttttagactttcgccatgaagcataatatcagctcaagcttttgtagatgtcctttttcagggtaaggaagttcccttctattcccagtttgttgagagtttttgtcatgaatggatgctgaattttatcaaatgctttttttaatcaattgataagatgacgtacaatttcctcttgagtttactaagatgatgggttatatggattgatttttttggggaatattcagccagccttacattgctgggacaaaccctataatctcattttatatccttgttacatttggactttactatgggtatgcattactttcataagaatctgataaaacttaaattttaaagaaatatacatacctgattccattttcccctttttctggcttctggttaagaccatcctttacctgagagagaaaacagtaatgtaaaaatattttcaaaataatattcattagaatgagttcagatgaatatttcagtctttgagaaggtggtattgacacttatcctaggacctaaggacatggttacattagaagggctctggaggccgggcacagtagctcacacctgtaatcccagcactttgggaggctaaggcaggaggatcacttgagcttaggagtttgagaccagcctgtgagacacagtgagaccttgtctctcttagaaattagccaggtgtggtgatgcacacttgtagttgtagctgctcaggaagctgacgtgggagggagaatcatttgttgaaaattattcttgggtctgggaggtcgaggctgcagtgagctgtgaccatgccactgcactccagatggtgcaacagggggagatcctgtctcaaaaaaaaaaaaaaaaaaaaaaaaaagaaaagaaaaagagggtttctgggccaggcatggtggttcatgcctgaaatcccagagctttggaaggatctcttggggccaagagtttgagaccagccaggcagcatagtgagatcctgttgaaagtgaaaggaagaaagagaaagaatgaaagaatggatggacggacagaaggaaggaaggaagggagggagggagggagggaaggaaggaaaggaaggagaaaagagaagaaaagagaagagagaaaaggaaggaaggaagaagaaagaagaagggctccatttcttcagccttgattttctttaaagctaacatgagcctctacaatttttgatcattggttgccggtgcttccacagaacactactgtccaaaactttagaacaagccactcagcagctccctaattaagcaaatgaccaagagtcttaattccatattgcagttccgtagaagctcactgaaatgcactttacagaatgcccacaactctacaactctttcatttagctcaactatacctttgtagctgctgctgctgctttttttttttttttttttttttttttttttttttgagacagggtcttgttctgtcacccaggctggagcacattggcatgaacatggctcactgcagcctctacctcctgggctcaagcaatcctcgcaccccagccacccaagtagctgggacgacaggcatgcaccaccacactcagctaatttttaaaatttttgtagagacaggggtctcactgcgttgtccaggctaggtttcacagctttttatgtgcgaatgacatatttagatctctgtattttctcatcaaatattttgtatgcatagtattttattgcttttacctggtaggcttattatactttttcagagactgctctaattttctgactatttagtgcaaatttttaaattcagtgcaattaattatatattttaaattatctgaaaaagtccctgagaattcacatatgtactctgtgtgacttctgtacacacacgcatgcacatctgtgcacagaccccatacaatgtccagaagttgtctttttagaaatttcaattaatattaacttttactatccaccagtcatacttttattggaagtctgacaggtgttcttgaagtcttgtgttccagaagaaggaagaaattgaggatgatctaatataacactatatgggagtaaaacaaagtcacaccataaaaattttggcctccagtatcacaaatagcaaagagtcagctgtaggtcttcacacacttaccacctggtagtgattgggggcccacactagaagcgtgtggcgttggccctgcttgaagtcgtcagttacagcagtgactggtgatccaggagaagaaatgtttatccttgtcagtttgtttacatcaaaagtcataaatgcatttgtctatagagggagggaaagaggcatagttaatatcacagagtctcggcactatgcaactgaacgctggaagagcagttatctgatattctgcatttccaggttcatgttcatagataccaaaaaaatgcctgtggggagttggcctttatttgcctcagcttcccacccacccttacagacaccgtcatgaggtttttggtaccaccacaggaaccatacttttcaccaagcatcttacttttattttgcttttatcaaaaataaatactatgagaataatttctactgttaggcaaagaacagcaccagagcaaaagcaacagccctggtaaaaatcaatactgggctgctccaagcattaggaatcgggctttttgtttttaccttcaagattattagtttcacaaggtctaaggttgtggtgctcaaccatggctaaacaggaacgagactggctaaatctcaacatctctggggctagggctgggcgcggtggttcatgcctgtaatcccagcactttgggaggctgaggcaggccaatctcttgaggacgggagtttgagaccagcctggccaacatggcaaaatcctggctctattaaaaatacaaaaattagttgggtgtggtggttcatgcctgtaatcccagctatttaggtggctaaggcatgagaatcgcttaaacccaggaggcagaggttacagtgagccaagatagcgccactgcactcaagcctgggcgacagagtgaggctctgtatttaagaaaaaaaaaaaaaaaaagggatctctggggctgggacccaggtatcaaaattttcaaagctctccgggtgattctgacatgggctggaggttgagtaccacgaatccagaacaagggtgatctagagcagggttttccatccttggcactgtgaacatttgggtcacgtaatctttgttatggagagctgtatgtcagcatccctggcttctacatgagatgccagcagcatactcccagttgctacaacaaaaaatgtctccagagatggctaaatgtcccctagcatcaaaatctcccccagtttagatccttgatctggtggttccaggctccagcagcagcagcattcctgagagctagttaaatgcagcatttcaggcctgctgattaaaaatctgcattttggctgggtatggtggctcacacctgtaatcccaacactttgggaggctgaggtgggtgaatcacctgaggtcaggagttcaagaccagcctggccaacatggcaaaaccctgtctctactaaaaatacaaaaattagctgggtgtggtggcacacacctgtaatcccagctactcaggaggctaaggcagaagaaatgcttgaacgtttgtggaggcagaggctgcagttagccaagattttgccactgcactccagcctgggtgacagagcaagactccatctaaaaaaaaaaaaaaaaaaattctgcattttaaccagctccctgggcaatctgcatacacaacaaacaacatagtgtggagcacactggtttagaatatagccaacatgagatcaagatccttagttcacttctgggctggccttggcatttatacaaggaccaagaaaaacagcttctctaaatcctattataacagggtcagaagatgaaaaagaaggcagcaatttccttctacttacttgagacattgggccaagtgtcaccatctctccaggaagagatatattcatggtattgtttcctatattcaaaactttaatttggacttcgtttcctttggggaagactggaagagttttctgagcaaaataaaagaaaattggcagtgaggtcttcaatacaacatggaaagtcatcttaaccctgacaagggggtgctttcctccagctgggaaaagctgcgctggctgaaacacgccaggtgtctcccactaagctgccaatcacagacctcgtggcacccacagaaatgacttttgcacggaatactgaagtgatatggtttggctgggtccccacccaaatctcatcttgaattgtagatcccataattcccgggtgttgtgggagggaatcagtgggagataactgaatcgtgggggtggcttcccccgtactgttcttgtggtagtgagtaagactcacaagatcagatggttttataagggaaaacccctttcgcttggctctctttctctttttgcctgcagccatgcaagatgtgcctttcaccttctgccatgactgtgacgcttccccagccatgtggaactgtgagtccattaaatctctttttctttgtaaattacccagtcttgggtacgtctttatcagcagcatgagaatggactaatacgtgaacgagtcagaaagatgctgctcttatcttatctagccacttccaggtcaagggctgccaagatacgaagccaaatatctgatggctctgagtcactataacctaaacaaatatccttcttgtcatgacacctgagatctaccgtcacccgactccagtgttctactgtaagtctggaagcccagtccccagccctagacgcagcagtgtacacatctcacaaatgcctgatgctctcctgcctccatacctttgttcagagtttttgtcttttttctacaatgccctctttcaaaacccagtgtcactgaagcaagccatgtccaccttagcccacaattcatcttccacaaagctagctatgtccaagaggagcgtgagtacagccatgttcatggcggcactgtttgcaatagccaaaaggtgcaggtaacccaagtgcctgtcgggggtgaatggatgaacaatgtggtgtatacacacaatgggtttagtattcagtttacaaaggaaggaaattctgacacagtctacaacaggaggaaccttgaagacaatatactaagtgaaattagccagtcacaaaaggacaaataccatataatgccactcataggaagtgctagagtagtcagattcatagactcagaaagtagaatgggggttgatggggctagggaaaggggaaatgggagttgtttaatgggtacagaatttcagttttgtaagatgaagagttctgaaggttgactgcacaacaatggaaaggtacttaacgctactgaactgtacacttaaaaatggttaatatgtgaccgggcatgggggctcatgcctgtaatgccaggactttgggaggctgaggtgggaggattgattaccagcctgagcaacacagggggaccctggctttacaaaaaaattttaataaattagtcgagtgtggtggtgcatgcctacagtcctagctactcaggaggctgaggtgggaggatcgcttgagcccaggtgtggctgcagtgagcatgatcgcaccactgcactccagcagcctaggcgacagagtgagaccctgtttaaaaaaaaaaaaaaaaaaaaaaaaaaaaaagaatacggtaaatgttatgttatatatatatatatttactgcaattagttttttttaaatttaaagatattaaaagagctgctctgcctgtggagtagccagtctttattcctctactttcttaataaacttgctttcacttaaaaatataaacaaagatattaaaagggtgggggagggaaggaacgagagaaagacagagagagagaggcaaagagagggaggaagtggtggggaatggtggggagagggaagagacccttacccaccacataaccctgtttctaggaactgatctcagactaccagcattagtctagtttagcccactgcgagtccaatagatgtgtggattaactgagaaaccaatcctttttagaaacactagaattcaaaatacattctcacatcaaaaagaccatttacacacatttgaagtgatgcttgtttgtaagtgatgaacttcttttaaccagattccctgggagttcagattgtgaaggaacacattctgtaaacttcttttccattataaaaactgtattataaatgcaagctacttatgtaagcctttttcccctgctgaagcccacccactgtaccctcacacccatggtgcctcccactgcccacagctccagggctcagtttacagagaaagaccttggcctcccctaatccccttcatgctgaagaaagaagattctgaacgctccacctaaatccaccaggaaaggacatgggagaaccaggggacaactcacatcgatttccacctgcacgatggcagccaccacaaaggccatggaggccaggaccatgccaactgccatcttcttcaaggagctgatggcacaagagaagagtgactctcaaccagtttcacatagatgagctaagctaaacccccacccccaccatccccccaacaaaactaaattccttccaaaaacatgggcttgaaagcacctctccccatcttggtcatggattcatgaggattcaaggaggataagtggaatatagcttcttgtttgcatatttacttttttttttttttttttgagacagagtctctttctgtcaccccggctggagtgcagtggcacaatctcagctcactgcaacctctgcctcctagcttcaagcaattctcatgcctcagcctccagagtagctgggattacaggtgagtgccaccacacccagcttatttttcgtatttttagtagagatgggaatttgccatgttggccaggctggtctcgaactcctgacctcaaatggtctgcctgccttggcctcccaaagtgctggaattacaggcgtgagccactgtgcctggcctgtatatttacattaatttctagaaactatggttcaggtgatactccagattacaatgaccattcctatcatctgcgtagagaagaaagccttgattaaaggccttttcaggctgtcaatcacagcatttttattttaaagaacattttcagaaacatcagcacacgaacatttgttttcttcattcttcaaaaccctatcctctaggcgaggttgcgggaagggctgcaggctgagcgcagcccatctgcaaagccctgggaccaagggagcctcaaccaacccaacccacccgtcacctacgtgaaattgaagccacattttgcaatgagagggtacagcacagcatcgaagatcgggaccatgatcacgatcaggatggcgttcacggtctgcagaggaagtggaggagaaatgttaagcttgtctcaaagacgactctgatccctgaaagcaacttacatgtcttctacctgcatctgatcgggctgaatttcaagagctccctaaaaagagaggaaaacaatctcagtgaaaaatgtcatgaaagggaagaagaaaggggacaaagaaactaaaacaaaggagtcaaacttacgattttcccggacatagttgttgcctgcagtgtccacctggagcccttaaaaatgaatacatttgctgtattatttggggatgtgggtttttaaaattttacaagtcaatggtgagtcttttccaaatcaggaatgaggtctgacatgttatgggatttaaagttgttttaaacatcaagttaatctcccagctctattataatactaggtcaaaagaaaccagttgcatttctagcgtacgagtgaacacaatacggagtgctccaacccctcctgaagctgcacaaagcagtaccctgagatgaagctatccctaggaaatacaaaaatgcatttctgaggctcgttggaaagcatggcatcgtctgcaaggtaaaagtagctgtgcgtgttgcagatggtccatattcactgccatccaagattcacaaatattattgttaacagccattttgacagtctaggctggctgcacctagatctccatcaagagagtggtggatttatacctgggcagcccctttacagtcaacctatttcacagtgaaagaggacacaggactgtacaggtaaatatgattatgtctatggaagactaaacatgtaaatgcttccgtatgaatccatcaactccactagaaagacatcatagaaagtcaggaaattggccaggtgcagtggctcacacctataattccagcactttgggaggccgaggcgcgtggatcacctgaggttaggagttggagaccggcctggtcaacacagcagaaccccgtctctactaaaaattagccagatgtggtggcaggtgcctgtcatctcagctgctcaggaggcagaggcaggagaatcgcttgaacttgggaagtggaggtggcagtgagccaagatagtgccactgtactccagcttgggcaacagagtgagactcttgactcaaaaaaaaaaaaaaaaaaaaaaaagaaatctacccctgtttgagttcttcatacaggccagtcactgagtaccttatggatgttctcacactggaccctcacagccttgcggagggtgattagcaccctttggaaaatgttaagggttattacagtgactcaagtctcacagctaccaggtgaggagtgtgtttccagtgaccggctcctgtccgcatgcagcactgcctcccgggtctgtctgacacatctcaatctcctacttaaaatgaggagatgaatgtgtacactcacatttctcccaagcaatggcttatccctatcaccatcctccctgctcaaaccacatgtgttcatatatatttttttaactccatttcctaagagaaacaatagctattttttcattctgtaaaccaggattgatctttaaaaacaaacactttccaattgctttggttactgagccccatgcactgagttgtctaacacgattgtgaaaaattcctgggtatgtgtcttagggctgtggtagaaagagacaacaggtcacctgccaggttgtaggtccctgcttggagaggagtcatttttcaccccaggatggtacttctagcccaagcattccatcttacagtggaagagatcaagtccctctccatttatgtatgggctccataaaaggcaatgtaacttgttaccacgctgtattggtaggaaaacaaactcttgactctcagttttgattggaagagtgctggatgaaatctttcccaaggctacttgacttgacctcatgtaattgtcttcattgttagcaacagaaatgtggatagaactacctagaattgcttttggttttgttttgttttgttttgttttttacaataaactcaatgtgatctaacaattaaacaagtgaaatataaataagaaactggaggagaactttttagatgtgaaatatgaagtgagccttggtacctggcagtgcgggatgtacgcttgctccgtgaagaagagcacaagcagagtttcacattacctgctggtcaaacaaggcccagaacattgggagtggaatatacaggaacatcaccctcgtaaccatcttaatttgggagatgagccgctcctgtagttggagtggggaagggacaaatcagccacaccctgtgtcctgtgccactcacggcttacaggtgctgctgatttcagtggagacacagatatttgcatctagaggcaagctgggaggtgattaatccaaaacatactgccgcagttttctttagaaaatcgaaaatgtctaaactatttaaaatatgagtgaaaacatctatttaggaggtaaattacgtgaatttactaaatgtaaatcccaccaccgccgtcaccacctcttgactctcctatattcaaactaaggttatgtgatcccaattacatataattaatgccagattataccaaatgaaaaactatgaaaaggtaatattatttccagatctatttatcaagttctttcaattaaaaaaatgcactcatgcatagttttatttaatatgctgtaaaggttaggaaggtatcactgaccattttgtccatgtaaccttaatctgaattgagatttttcagtgttcacttcctgggggaatcagggtcattgtagcaatgaccgttacttacatcgtatttctctttagcccagtccagccagtgctccctcttgggaaatgccttactccgatgcctaaatctatttttgatggcaaactgaaggaaggaagaaaaatcgaatttcaaaacaggaccaacaactttgtcagggaagcacatttcaattaaactacctttaggagaaaaatatacgtgtgagaaaagcaaaatatacaattgtatctactagtatatgagtacttatttctattaatagtctctgtccaactaagagcgtttgagttggggtgaacagaattaagctgtgtccactttactctccagatcctctagagaagcacgcccaatagaaatacaacacgtgtttgcaatttaagttttctagtagccagcttaaaaagtgaaacaggtgaaattcattgtacatacatttgtataacatgataaaccccactatgattttaataggtaatcaatatttaaaaattaataagaatttttaccttcttcttccatattgtcttcaaaatccagagaatattttacacttatgacataatctcagtttatttgtttgtttgtttttgagacaaggtcttgctctgtcgcctaggctgaaatacagtggcactgtcttggctcactggagccttgacctcccagactcaaatgatcctctcagctcggcctcccaagtagctgggaccacgggtatgtaccaccatgcctggctaatgttttaattttttttttaatggagacagggttttgccattttgtccagactggtctcaaattcctgagctcaggcgatccactcgcctcagcctcccaaagtgctggagtggcattagccaccatgcctggccagcatatctcaatttggatgctagatttttattagaaatacttgatctgtatttaggttttataaagtttgtgtttgaaaaaccagatttacacactaagttgtttcaaacatacttaaaatccttccaataactgaactattagtttttaagagtaagaacacactacagagaaatacatttattaaaaaattaaggctatagggaaacatattttaagatataataacacaggtcagaaaaatacgatggcccacccatcataaaattaggggccactaagattccttgttagtgttgtttaggaaaaaggcctttgggaagagcaaagtgcatttgcaaagacacagcaagaggtgaggctggtggaggctggaggcatgagcgtgatcgaaaggcagtaagttggccaggcgcagtggctcacacctgtaatcccagcacttcaggaggctgaggtgggcggatcacttgagaccaggagttcaagaccatcctagccaacatagcaaaaccctgtctctactaaaaatacaaaaattagctgggcgtggtagtgtacgtctatagtctctgctatttgggaggctgaggctgaggcaggagaattgcttgaatctgggagacggaggttgcagtgagccgagatcgtgctactacactctagcctgggtgtcagagtgagactctgtctcaaaaaggaaaaaaaaaaaaaaaagaaaagtaagtcaaagctacaggctgactttaggatacttcgcaatatagttctcatgaccctaaatagcttgaagttgttcttctggagtttgaactaagttgtcaatgacttgttaaggaaggacttggatgggtaattggtaaggtcccctctttgcttggaaaaagctttttggtgggaacagttctaatgtgagaagaaaacagtacagctgtccttgaagggatttttttgacagggagagggcacatttatttcaaaaagtgaaatacaacacaatacaacaatctaatagtacaatacaattgaaatataatacaataatcccagcactttgggaggctgaggcgggcggatcacctgaggtcaggggtttgagaccagcctggccaacatggcaaaccctgtctctacagaaatagaaaacttagccaggtgtggtggtgtgtgcttatagtcccagctacttggtaggccgaggcaggagaatcgcttgaactgggaggcagaggttgcagtgagctgagagtgcaccactgccctccagcctgggcgacagagcaagactccatctcaaaaaaaaaaaaaaaaaaagaaatgaaatataatacaataatctaacgcaataaggccaggtaagataaagtaagtgatctaaaattatcttaaggctgccttttcatccataagattcacacatgtgatttttttttaataaatgacacatttacctccagttatacaacatatacagtatgttcactaaaaaaatggggagtgtataaggaaaaaaatcatttgattccattatctaaggattctactctcaacatttatttcccacccataaatgtatgtgtatatgcatatcctatggaggtacttatggaagaaaccatattctgcacattcctattactacatattccttaaaaacaagactgctcccggctgcatgctatgccagagatgaactgtaagttcagcactgtcttcctatttgcagcaatttgtgggcttacatttttgctattataagtattacaatgataatctttgtacatgagtctgtgttcactttttaaatatttttttcttactctagttttgttttgagacagagtctccctctgtcgcccaggctggagtgcaatggcacaatctcggctcactgcaacctctgcctcccaggttcaagcaattctcctgcctcaccctccagagtagctgggattacaggcacccgccaccatgcctggctaatttttgtatttttagtatagacagggttttgccatgttggccaggctggcctcgaagtcctgatcaagtgatccgcccgcctaggcctcccaaagtgctgggactacgggcatgagccacagtgcctagcctattttcttactcttaattcttgaaagcagcatgactgacttgaagcaactgaacacctgagactcttgctacacattgccaaattgagcctccccatttttgattcactgctccctgacaaacctcaagcactgttctgccatttcgacagatgaagagtcactttgatttgcttttctttgaccattgatcttattttataagctcaagagccatttctattcttcccttattaagttctgtttgtgtctttttgcatttagaagaagctacaatttactgaaacagttaagaacactaaaaatatatttaaaggaaagtcaaagcttaaattttaatttaaagaaagtagaaggttctgaggtggttaaatagccttgagaaagagcagctgagatacttacaccgatgcacttggccactttacccatgatgttgccctgtggcttgaacttcttgtacatcccactgccaaggacaaacacaactagatagggcagaagaagacatgtcagcaaagcatgtgaccgagcgccctgtggcctagagagatgcgcctttatttgaattataactttgttttgggataatgggattacttatggaatgggtttaccttccaacctcacagtttagaaagtgcttttaactctcacaatccacaaaaacctctgagtaacgttaggtttgtcttctaatatgcaacctgtaagcctaatatcatctacttcccatagcttaaggtagctcacgtacactcacacagctatttaagcacaagttctatctctatttaaagggagacaaaaggaatcagtactttcatataacacattaaagtactattctactaagacaataaatggggccaggcgcggtggctcaagcctgcaatcccagtactttgagaggccgaggtgggcggatcacttgaggtcaggagtttgagaccagcctgaccaacatggtgaaaacccgtctctactaaaaacacaaaaattagctgggtgtggtgatgggcacctgtaatcccagctactcgggaggctgaggcaggagaattgcttgaacccaggaggtggaggctgcagtgaaatgagatcgtgtcactgcactccagtctcggtgacagagtgaaactccatatcaaaataataaaaataaaaataaatggagctgtaatcttctgaatgcaatgggaagagaaacctttttctttctctttttaatattcaggaaaaaagaattaatcttaatcatatgtggcagaaattttttctgtggtcactgtacagaagcagttaaaattaattgcatctgcagctacagttttacaaaagttagaagcaccttttcaatgaggtcattcttccacggacctttttggcaagtcatattgtgaaaataacttagaaaaaaaccattctagggctgagtgtggcagctcatgtctgtaatcccagcattttgggaggccaaggcaggaggatcacttgagaccagtagttcaagagcagcctgggcaacataatgagatcctatctctatcatcttattaaaaaatttttaaaaatttaaagcattgttgcaagtatatctgaaaacatagtccatatactaggatttctgattatccaataccacagttcaataatttaaaaacaccgatagcttgaattctacttatttttctcaattaagagggtctgagatttttgacaggtgctagctccaagtatgtgcctataatatagatgttctttatagctgataaaagagatgtttacttatattcttgcccaatgtcaacatttctgaatgcagacatggatggtaaagatgtccaagagattgagtctatgttttcttttaccactaatatttaatctttaagcttctgattaactgaaacctaattcaagcgtaggaatttctagaggcagtgttgacacatcggatttggcctgttctcaattcctccagaagaaaaagcataatcgttgatagaggaatgacttgtacagatgagataacaatgtacctaacgtgcttaatacagtgtctggtgtaaagcaagacttttggaaatgctctctgtctcctgccaagaattagagaggaggaggtatcaatgagcctgctaggggacggtggcagtatgggaagaaccatggaagaaaagagacattaaaaagaggagaatactgagctctcacctaaatgaaaggggaaagctaaattgctacactgtgagcaaaagagattgaaaacggtcctattccatgtactactaagatctgaaaacaaaaattggagagagagacgtgattgtcagctgagcaaagctgatgacaacctcatttgagtgggagaaggggctctgaagagttgaggtggccgctgggctgttttctttttgcaccgttcttggccacctttcacatccaagcatcccatgtagaaaacgccacctttcctaaaagccaatgccaagaactaatgtgccaatgaatgcctcgaatagacatatatgttctgtccagtgggaaagaattctagtagaaacatatggggggcggggggaggtgatactagtttggtgcaaaagttattgcggtttttgccattacttttaatggcaagagctgcaattactttggcaccaacctaatcaattatggaaatgtagatgttcattggagtgtttcagtggcaactgaaccaggttgccatttcttcaagcaagttatagatacgtacatgttgacaagaacaaaagcttttagccttgggttcagctaatccagcagattctatcaccttcatctttttttttttttttttttttttttttttttttttttgagacagggtcttgctctatcatccaggttgcagtgttatggtgcaatcatggctcactgcagcctcgacctcccaggctcaagcaatccttccacttaagcttccagaggagctgggactacaggtataagccacagcacccagctaattaaaaaaacaagcaaaacaaataaacaaaaacaacaacaaaaaaaccagctaggtgttgtgtctcatgcctgtaatcccagcactttgggaggctgaggtgggtggatcacctgaggtcaggtgctcgagaccagcctggccagcatggtgaaaccctgttgctactaacaataaaaaatatgtggtggccggtgcctgtaatctcaactacttgggaggcagagccaggagaatcgcttgaacccaggaggcggaggttgcagtgagctgaaatcacaccattgcactccagcctgggcgacaagagcaagactctgtctttttgtttgtttgttttagaggtagggtctctctctgttgcctaggctggacttgaactccaggctggtcttaaactcaagggatccccctgccttggcctcccaaagtgctgggattacgggcatgagtgaccatgctgggcctctctcaccttcatcttaatctgcctaaatagtattacacctttcaatgaccaactcagttggttccttttcctgtaattctttttttgatcctattccctcggaattgatgtgccaatcctactttctttgaatacttagagcatgtttaacatctgatgccaattcttctcactactttttgttgccacttgttacatgcactttaaaaaattagtcacaatcattcacgtagggcctgacctggtcctaggcttctattaattcaaccgatttccacttactcagggctacagccatgagagcagcaggaaccccaaaggccagtgggtaacaagcttgtttactgtgaattccacattgttgaactggggagaaatgacaagattaaaattgttatggcattggtaatgagcatatagttcccatttgtaaagatccctcactgataattacgtattgctttcacatactgttctagacatatccatttgcctcactgacataattgccagctaagtaaagcagcagtgaagcaggaggagcaggagatggaaaccagttctaatctcagcccctaaatagatgggtgttcccagcttggccaaaatcagcggccccctcttggttctgtggattttctttacgggggagataaagatgacctggatacactaacttgattatatgggactcagtaaatcaaaagtacactggaaaatcaatactatctgttcctgaattcatgccaatcaggtagcaattcgatgacctagggcaggggttggcacacttttctgtgaagggcccagcagtaaatatttcaggctttgtgaaccattggtctctgtcaactacttaaccccacctttgcaggggaaatcaactgtagacaatacatcaatgaatggtcttgcccagatttctggattcggcccatgggccactgtttggcaacctctgaccaacagccattttagctttgaaatcccaggatttatatatatatttataataaataaataaaaattattttaaaagtaagcctttgtaagaagtcacggagattcctggaaatcctttctatggaatgctggcgcctccaggcatgatctgctgctatcagggttttgctttggttcagctatctcacaattcgggagagaaagaagttaactagcagaagtgacactcatgcaaatgtttcctgttcatggcaaaaaataattttccccctataaagaatagaaatttgttagtcaaatctttatttgaactgattaattatcaactaattaacaagttacataaaatttttgtcacatattcactttatatttgtaagagagtcatgaacttccttttaaaaaattatcctttaacagattctataatttaaacatgcaccctctagtagaacatagaggtaggagaggtgagcgaacaggacacacgaataaaagctgttacatttttatacaaaacaagttggaaaaaaacaaaaaataaaacaagttggaatggggtttaattgtctgtcatcttcaaaccactatgctgtggaagaatacataaatccccctgaaatctttatttcataatctaatctgattcaaatgtggacaggatggtcttgttagtttgtcaccagtaacaccacatattcccttccacatgggaaattcacaaactctctatggagcattagcaagcacaaacctctgatagttactgacactgtcccattctctttatctgagcagttcttttggaaatacttgagatgatgggaaagcaaagaaaaaaactttgccttagccaggcgtggtggctcacacctgtaatcccagcactttgggaggccaaggcaggcagatcacgagggcaggagatcgagaccatcctggctaacatggtgaaatcccatctctactaaaaatacaaaaaatattatccgggcatggtggcaggcgcctgttgtcccagctactcaggaggctgaggcaggagaattgcttgaacccaggaggtggaggttgcagtgagccaagatcacgccactgcgctccagcgtgggtgacagagcaagactccttctaaaaacaaaacaaaacaaacaaaaaatcaatacaattttgcccagtaaactcttcctaagtcacagaaatatcactggggagcaaagcttgaaggctaaaatggcagctacggccaccagcttggcttccaaggcacctctcttgcctcttacctcttaccacgagcatgactttgcatgaataacagtttaggaagatggatgcccatgctaaggatggcttagactctccagtggtcactgggataagggatttaaataagacaaaaaggaggtgaaactcacagggaaggaagcacttactccagattccaacgtgcatcccagcatgtagctgacagctagaaaacagggcagaagggaagaacagaacaaaacgaagaagacacggacttggccttactaaaaaaagaccaacagaagttcctttcaggtatctcttacctctgagcatgggtgtgatgattgtggaaagcaaacttccagcattaatagccaagtaaaagatggaaaaaaatctgtttctttgtttctcctgcaatgaaaaggagaaagtaagatgactttggctatcaatccactgagcacagggagctgatgatctcattttactactaacttagttttggttggtatcttactttctaatgtacttaaaaagaatccgatgtagaacagactttgtgcccgtggcctctgactcctggatgtgtagttcattcacgtgggctctggggaggcccctacccttacctggccctcttcaaactgatctccaccaaacgcagacacacagggtttgattcctccagtcccgagagctatcagggccaggccgatcaaggacagcaccctgggaaagacagggtgttagggccaacatggcagatcctcgcaagtagaaggcctctcttttccccagtttccctcagtgggcctggcatagtgacacacatagagaagaagacaatctcgcgagaagccagctcacaggaatgcagcgtgatagtcaaatgcaaacttgaactcatgggccttcaaactcctgcccccatctaataatttaccatccggaaaacataaaacagtagcttgcgagctgagcaaagccttaggtttggggttcttttgtagctttattgtttccagtaaaagagaggataaatgaaatgttattgaacaaatataagcattgtgcctggtacagtcataaccgactcataatagtcattaagtaacattggaaaacatgatttcattgcaaagcggaatatcaggttaggtagtatgatctcagtttgtttacaaggtacagaaaactggaaggaaatagactaaaagatttattgtcatgtctagatggtgggattaagggttatttaatttactcttgtattttctaggttattgctaagtattttaactcctgagttgaaaaaaaattcatagcatttattgaccctcactttgtagttttattaaatttacaggtaggtactacaaatttctggttttataggcatgtatcccatatcttcttggttgctaatgttgcttttaaacacttaaaaaattttatgagacagataaagtcaaggaaaatattgcacaggtaaagaattctttaaaaatcatgcttcctgaaccaatcttcctgaattggctggccaaatcacccctttaatcttgtctgcctcttaatacaacttgcatttaatgttgtcaatctaagcattttaaaagacaacaaaaacacggccaactgaatattatatacaatttactcttgtgagaattttaggtgtgctccaatacgaactccatgaaatgaaaaatgaaaagctaatatttcttgagcactgatcacttgtcaggcagtgttctaggtgctttacttggattaacccacaacagtcctacacgaagtaggtactattacaaccaaggaaactgaggcatagaggttaagaaacttgctcaagctcacacaactaggaaagggcacagccagaatctggctccaaagtccatgttcttaactgatattacagattagaaaactgaggctcagagaagaacacctccccaaggccacagagctgctctgtgggagggctcacagccactccctccaccgacacagttccctctgggcaccaagagtgttgcatcaagagatccagtctggacagcagtctgatcaactgataagccagcagtgtggggattgccgatactaatttgagtttctattcttctttcccagctcattagatagtttacttatagatcaaggaactgaagcacaaaaacaggaaactaaataaatctctacaactagtctactaggccagactgcagtgaagcaagattaatccagcacatgagcatttatcaataacacctgccatccagagcccagcacaaatggctggaacaaatatttatgaaacgggattattgaaaaataggcagaagtgtggtacaagacagaaaacccaaggtcctggagtcctgaggacacctggcggtgtgaaggatcaaggtctgtgggactttatatccctccagggtaggtcaagaccaacatgaatcccctgcgcactgactgtacttcacatgggatatgatggcgcatgacagctgagcctcagagtgagcaatgcctctagacaactgttagggtggtgacatcctgaagacccagctcaatctatttgacagccttctccatgctgcccaagggggaggaaaaacctccttatgctctcagtgaagttcaaggaaaaagacgaagacttaaggcatcaaatgcgcacaaggtgggagggtgatgggggcagcagtgagcaccaactcacacgtgcacaggaaggctgtcgggggtgccatcatggttgtggtctgtgaggtcattaatggagcttactgaggtgactgcttgtccaattgtgtagacaatggagagcgacacaatggtcctgtgtttccaaagattaagagaatccgagttaattgcacaatagccatccacttttgactccaccacaaaagaccccctccttgaaagctttcaagagcccaatcctgaatacacttatttctcaaacttgagtaacactgttaactctcaggaactcacatgggcaaaaagaatagaacaaagttttgggctaggcatggtggctcatgcctgtaatcccagcactttgggaggccaaagcaggaggactgcttgagctcaggagttcgacaccagcctgggcaacatagcaagaccccatctcaacaaaaaaataaaaaattagtcaggtgtggtggtgcatgcctgtggtcctagctgctcaggaggctgaggtgggaggatcacttgagtccaggaggttgaagctgcagtgagccaggattgcactactgcactccagactgagtgacagagcgagaccctgtctcttaaaaaaaaattaacaaaattttggccagagggccaggagaggggaaagatccgcctcctgggttaacaccattctcctgccttggcctcccgagtagctaggactacaggggcccgccaccatgcccggctaattttttgtattttttagtagagacgggggtttcaccacgttagccaggatggtctcgatctcctgaccttgtgatccacctgccttggcctcccaaagtgctgggattacaggtgtgagccaccgcacccagcctatatttttaaacagtaagaattacttatattctgattggtaatgatatttggacaggaagtagacctttggtaatttttgtagaattctttagaggtagtgattcttctttcttctgtccatgctacagtttggttatctgtctcctgcaaacctcaagctgaaatgtgatcccagtgttggaagtggggcctggtgggaggtgtgtgggacactggggcagatccctcatgaatggcttggtgctgtcctcatggtcatgagtgagttcctgcaagagctagttgttgaaaagagcctgacacttccctcctctctctctctcgcttcccctctggctatgtgatctctgcacatgccagctctccttcaccttcctccatgaatggaagcagcctgagactttcatcagatgcttggtcttccagccagcagaatcatcaaccaaatatacctttttcctttataaattccccagcctcaggtattcctttatagcaacacaagtggactaagacagcccacgtcattcctttggcctggaagagcctctacttccttcttcattaagtcccaggaaaactttcctgacaacatcccactgggtgtgctcgtggagcccttcctggagggctgggtgacttctctctttagtgacctcacaccatgtgacctcaagcagcgtgagcccctcagcagccaagggggtattttagagagtttcttcatatccccagaccttaactccatgcctcacacatcactaataatagacagtatccctgctactgtgtcaagatgtgacaaagatgctacatttgtttgcattagggaaaaacaaaaacctatagatgctgcttgcagtcactaaatgtcaggcactgtttcaggctctagggacaggatactgagcagaaacagcgctgtaaatgctctcctaagggtttgtttctgtttttaatttgtttttgagacagggtcttgttctgtcatccaggctggggtgcagtgatgtgatcacagctcactgcagccttgacctctggggctcaagcggatcctcccacctcagcctcccagctagctggggccacaggtgtatgccactatgccttgctaatttctttatttttggtagagatgggtctcactatgttgcccaggctggtttcaaactcctgcctcagcctctcaaagtgctgggattacaggtatgaaccataccacacctggcctctcctaagagtttctgttctttgattcatcattcccagattccaccattcccaactacaaaacctacatttactttttcgcttgtttgtgaacaagaaatttccagccactcacttgaactttcccagccacgagtcggcgataagagctccgagaattggcgtcaggtagcacagagccacaaacgtatggtagatggcggtggacaggttatcatcccagctgatgaaatttgtgaagtacagaatcaggattgcttttgcagagggcaggtggaagaggagggggaaacaaagttaggactggttatggccactcccgctcttccctgaagggtgagaaacggccaatacagttacctcgcattccatagtaggaaaatctttcgcaaaactcattgaccacgatgaagaagatgctcaggggataaccaaagaaactctgacaaaaaagaaacaagcacaggattgaaatacaccccccactggtccatagccacaaaggagcaccagtggcatgaaaggcagccaacgcagattcagtaacttaccggtgactgtctagagcaggaaactagcatttaatcattttattccctacactaatccttccacatagagacagcaatgaaataaagcatccagtggtattgttagtctgaggaggattatccacagcatttcctcaggagaggacatctcacatggaaatccgggatcataccctcactggttccagatgtacagatctgttaggtgaatgaacccttaggggtaaaacagatgataaaatttacaagatgaagatatgtagagaaggaaaaagggtactcacgtgtgatttggacattcctaaaagaaaaacagaatcccaatattaaagtcaagccattacaatagtttttgctgtgtctaaactcagagcctctgactttttagggtggtcagaggggccattcaccaaacagctccagccctccctgggatcccggccccagactcatgcttcttatctgaggtggggcctggcatctgtattttcttttaagaagctcctcaggcaattctcgtatgcagtcaaaattgagaagcagcagctcagagaatcaggcctaaaccatttcctcctgaaacacttcaaaggccgcccatcgggataaaatccacacattctagcatgttcttcaatatctgacaagtgttttggtggggatgaaatttctgtaatataaaatgcttctgagtgcctgacacactgtgcacactcaaccgccacctcctatggcttgggccctgcctgccaggctcaccccatgatttaagtcttgccaccgatattcccttcccaaatcatctctgatgtgcctacatcaccatactgtaatgatgggcagtttatatttttgcttcccttctggaccaggttctgaaagcagaagaatcatgtgccatccatcacaccaacatccccactttcaacgtcctgtacaatacctaccactggtagggggttatgtcacaagaatgaatgagaagagcaggaagaaacagcctgagaatacaagggagctggtgcacgtcaagtccagtggactctcccatgtgcatcctaggagcgcctcatccccatcccgtcagcacctgctcttctgtctccccggaattttggcaagagctgagctgtgcccttgtctctagtctttacacctcctcactctgctcctacacaaacacattgccctgtgttcatccgtgtctatcacatactaccctgtttcccacaggacatccatccccttccccctcactcaccccgatttccttatattagagttctttgttgccagggctccctgaacatgctccacctccattaggaatctaggaatcggtgaccccatagcagtgggtctcacactggagtgtgcctcagaatcaccagagggcttgcaagaacagatggctgggccccattcctggagttgttgattctgtaggcctgagatggacacttgagcttgcatttctaacaagctcccaggtgtgggtgctgccactggtccaggcagtgtgctttgggaatcactacactggaaaattattctttagactgttcttttcccagtgtttgttcttggcagctttgtcaaaaatgagttggctataaatggatgcatttattcctgggttctcttttctgttccattggtctatgtgtctgtttccatgctgatttggttactacagctttgtagtatattttgacatcaggtggtacctctggccctattctttttgctcaggatgactttggcttttcgaggccttttgttgttgtatatgaattttaggatttttttctatttctatgaaagttgtcgttggatcttgtcatttgcagcaatacagatgaaactggaggacatcaggttaagtgaaataagccaggcacagaaagatagatatcacatattctcactcatatgtaggagctaaaaaattgatctcatggaggtagtagtgggtagaatggtggttaccagaggatgggaagggtaggtgaaggtgggaggatgaagcaaggttagtggatacaaaaacacagttctgtagaaggaataagagctggtgtttggtagcacaacacggtgactacagttaacaaaaatttattgtatatttcaaaatagaggctgggcgcggtggctcacacctgtaatcccagcactttgggaggctgaggtaggcggatcgcttcaggtcaggagttcaagaccagcctggccaacatggtgaacccccatctctactaaaaacacaaaaattagctgggcatggtggcacacgcctgtaatcccagttacttgggaggctgaggcaggagaattgctaggacctgggaggtggaggttgcaatgagtcaagatcacaccactgcactccagcctaggccacagagtaaggctctgtaaaaaaaaaaaaaaaaaaaaaaaaaaaaacaacaagccccaaaacaaaaaacaaacagaatagatagcagatctggaatgttctcaacacaaagaaatgatcaaggtttgaggtgacggatattccaaatacccagatttgatattaactgtaaaatattgtattaatattaatattaaatccagatttgatattaactgtaaaatattgtattaatattaatattgtgtacctctattaaaaatcatatgtaccccataaatatatataattattatgtatccataacaactttttaaatccttaaagccctatggcaaccccagtgtttcgagcagcagcagagctgcccatatgaaaagcagctcaactggaaggcaaggcctgcctctgtggctggtatttgagaagactgacttctctctgcacctgagatttgcatctctaacaagagtcaaggtgatgtcaatgatgctggtctggggactacacttggaggaccacatgcaggctgtgatgtcctgctgcctaatggctctacataagagagttttatcacttccctggttccaaacgccagaaagaccacgccagctatccagagcagacaccgaatacaggagccatacagcatgcggaagcctccaccacagcaccctcctccatctcccacatcgtttccctctggggcccttccttgcagatttactgccttatattttcattatgtgcaagttcaaagccctatcccacaataaacaaagccacaaccctggcagaggaactcccttcccgaccctgaccacggggccctccaggcttcaccacctcttcctgggcaggcgccttccctcctgatctgtcagcctgtgctggtgttatttccactcctgcagctcggcgtggccccaggggcctcctaccagatggtcttgcatttttgcccacttaagagcattttagggccgggcgtggtagctcacacctccatccgaggtgggcagatcacttgaggtcaggagttggagaccagcctggccaacatggtgaaaccctgtctctactaaaaatacaaaaattagctgggcgtggtggtgcatgccagctactcaggaggctgaggcagaagaatcgcttgagcttgggaggcggaggatgcagtgagctgaaatcgcaccactgcactccagcctgggcaactgagcgagactccgtctcaaaaaagaaaaaaaggaagggaggggaagggaaggggaagggaaggggaaggggaggggaaggggaggggaaggggaggggaaggggaggggaaggggaggggaaggggcattttagatgctctttttagtccttgtcctaagggggaaatacactgtactggtttcacaggaccccagttcccaactcttcctgcctattagagttctggacagagattcctccgcacgaataacctggtttcctgccgagtgagacctgtcgtgggatggggctgcttccagggcaatacaccaagagcgagggccatggagtcagccctgcggccgagtttcatgctgggacctgccagctgcatggcgggtgagcccatctgtttcgggccagccgaacaaccaaatgaggatgacctccgccctgcggggttgctggaagagtcctgcgaaccccacagccctcagtgcatcgttacgggggagacgcgactgcctcagggtcctcagcgcctccgcgccgcttcccacagaggggaaattcagtgtttgtgggacacgtttcctaaggccccgtttatcagtcacagagcacagtgctcagatccagctctgcatggtgggtcccgtgggcccttccaggaccgtccttcttcttcagctcccaggctgacctgcaaggagctcatccatgtcccgggtctcgacctagctcccaggtcctttggccaacagggagccctgggaagatcagagggagggaagaaacgttggggtatttgtttttctggtgccctccctgcaaggtcacctcggaccgtcacttcaagtgacagtcacggcttctctgacgtcagcccttcccacacaactctttccttccaggtttcagtagcggttccttcccctcatcttgcaggccagggggcaacagggaggctgctgcaggcccaggtgccacactaccatttgttgtgcccgtccacagcggcatctttctgtgaccaagccctcctgtgctgagcatggcctctgtgtcctgggaggtccgtggtgaggcagcgcacctgctgtggacttgggctgtctttcacaccaggcagggaaagcgccagtgtccggcgaataggaagggctggtcgggcaagcgtgtgttttgcaagctcggtgcaaaccagcctgaaggtgcaaagcgtcattgctgtagtgccgtgcgttcttgaggacacggcaacagcacgttatgcttcgcctacttagactttgggtaatatggccttaccattgcctcccaaagccaacgagagaggtgaagtcacagaaaggtccctgttatccttggccctcttcagggaagcaggagcgagctctgaaaacccaaatcacccaaatccagcagagagagcccggggcttcatcacaaaccttccttccctgtgttcccagggcttcatcacaaaccttcctttcctgtgttccccggatttttatttgcagggaaagacttcatctttccagagtcgtccttttgtctttgctcaatattttgtacctgttatttgcttaatagtggtaaagtttttctctactccaacccactacagttacagaaaagaggtcattcagaaagcttaggtcttaacaatcattatacacctaactaaattatgggaaaggcaatcccttgaagtgtaaatctgagactcagtacccagccattaccaagaaggcattttgttttctgaaagtgtgtattccaagaactgcttttattattacagggcagaggttgctaaactctttgacagaatccagagctatctactgggtgtaacactgcagtcagcatttcttatcttaatgtacctgtgtcaacaggattgctatcttagaaagctcaaatgcagaagtggtgtttacatcgagacttcagaccgaactcaagtatcaactctcacaagattctgtttactttggtgcagtcctgtttacgttggttccctgctagtaaacctcagaggcatatttgagtagcctaatgtttctagtattactctggggtcccttgtgttgaactatgatcagagccaaacccagcttagaatctggacttcccataggactgttccttagcacccaacacattgcaatcactgaataaacacaggctcttcttgctattctaggcccagaagtggttttgctttctttttgctaaataatttgatgaaataagtgtatattatacatttatatgattactgacttgggggttgggggggacagggaacacaggagaaaacaagagactcccctcttccgcacgactcaataaaatctcccatccatatgaatatttcctactatttatataaagcatgctccatattttgaaccatttcaggatggaaactctaactttgaagtcttattacctaaaaattaataactccctcagcaactgaaggctgccgagagtgcatctctaggagttggacttcggaagttggaaggaatgaggcattttgctgaggtctaagagagaaggcctccctttcaggcagagagataactgtttcctaccattaccaagagtgaaactgaaggaatactgtaagtttcacatactgctttgaggacgtgtttctgaactttcaaggtgtggtggtcagaatggtggtcccctagagatgtccatgtcgtaatctctgggattcagggatacgttccctcccatggcaaaagggtcttgcagatgtgattaagttaggggccttgagataaagagtttatcttagattatccagacagacccaatataatcacaagagtcctaaaatcagtcagaaaaggtgaaaagcaggggagtgactgcaattgttgggggaggggtccccaagtcagggaatgtggtggcctggagaagctggaaaagacaagtagggttctccccgagagcctttcaaggtagcactgccgacaccttgattttagcccggtaaaattcattttggacttctgacctccagaactacaagaagacacctgtgtgaagccactaagcttgtggtttttttgttacagcagtaattagaaactaatacacataggtttgccccaaactctgtaaatacaggtctttataatcactacttacatataagtaagactcaaattcctgccacattttatttgttggtaaaatgctctctttattaattttttcctaaactatatttttctacttggagcttagaagtgcatacctggcacctggcttttaaactggatttggcagaatctaagctctggtgcttcctctgaaaatggtttcctaagccaagggtaaaggagtaaagtagacaaagttggtcccacaaaagccccaggaagccaatggtccctgcaagaacacagcttggccttgctaatggcaaaagtggtttttcagttaaggagagaattttctcagtattgcccctgcatctagccagtggaaagacatgggcttttgggaatcaggagatcgaacctcagtgtagagatattcctcctagccatgtggccttgatcaaggtgcttaccctctgggcttccatttcttcatctgcgatatagtttgcatgtatgtccccaccaaaatctcatattgaaatgtaatccccaaagctggaggtggggcctggtgggaggtgattgaatcacaggggtctagcaccatccctcttggtactgtcctcaccacagtgagtgagttcttgtgagatctggtcgttttattttattttattttttgagatggagtctcacgctgttacccaggctggagagcagtggtgcaatctcagctcactgcaacctccgcctcccgggttcaagcaattctcctgcatcggcctcctgagtagctgggattacaggtgtgtgccaccatgcctggctaatttttgtatttttagtagagacggggtttcaccatgttggccaggctggtcttgaactctggcctcaagtgatccactcacttcaacttcccaaagtgctgggattataggcatgagccactgcacccagccttagatctggttatttgaaagtatgtatcatcgatatagctcccctttccaagatggccaaataggaacagctctggtctgcaggtctcagcgtgatcaacacagaagatggctgatttctgcatttccaactgagatgaacctggttcatctcactgggactggttggacagtgggtgcagccacggagggcaagctgaagcagagtggagcatcgccttacctggtaagcacaaggggtcgggtcaggggatttccctttcctagccaagggaagactgtaccaggaaaagtgggacactcctgccttaatactgcacttttccaacggtcttagcaaatggcacaccaggagattaaatagacgcaataaaaaatgataaagggtatatcaccactgatcccacagaaatacaaactaccatcagagaatactataaacacctctatgcaaataaactagaaaatctagaagaaatgcataaattcctggacacatacaccctcccaagactaaaccaggaagacattgaatccctgaatagaccaataacaggctctgaaattgaggcaataattaatagcctacaaaccaaaaaaagtccaggaccagatggattcacagccgaatttaaaggtacaaagaggagctggtaccattccttctgaaactattccaatcaatagaaaaagagggaatcctccataactcattttatgaggccagcatcatcctgataccaaagtctggcagagacacaacaaataaagagaattttagaccaatatccctgatgaacatcactgcaaaaatcctcaataaaataaaatactggcaaaccgaatccagcagcacatcaaaaagcttatccaccatgatcaagttggcttcatccatgggttgcaaggctggttcaacatatgcaaatcaataaacgtaatccatcacataaacagaaccaaagacaaaaaccacatgactatctcaatagatgaagaaaagactttgacgaaattcaacagccttcatgctaaaaactctcaataaactaggtattgatgggacgtatctcaaaataataagagctatttatgacaaacccacagccaatatcatactgaatgggcaacaactggaagcagtccctttgaaaacttgcacaagacagggatgccctctctcaccactcctattcaacatagagttggaagttctggccagggcaatcaggcaagagaaagaaataaagggtattcaattaggaaaagaattgaatagtcaaattgtccctgtttgcagatgacatgactttatatttagaaaaacccaaagtctcagcccaaaatctccttaagctgataagcaacttcagcaaagtctcaggatacaaaatcaatgtgcaaaaatcacaagcattcctatacaccaataacagacaaacagagagccaaatcataagtgaactcccattcacaattgcttcaaagagaataaaatacctaggaatccaacttacaagggatgtaaaggacctctttaaggagaaccacaaaccactgctcaatgaaataaaggaggacacacacaaatggaagaacattctatgctcatgcacaggaagaattaatatcatgaaaatggacatactgcccaaggtaatttatagattcaatgccatccccatcaagctaccaatgactttcttcacagaattggaaaaaactactttaaagttcatatgaaaccaaaaaagagccctctttgccaagacaatcccaagcaaaaagaacaaagctggaggcatcacgctacctgacttcaaactatactagaaggctacagtaaccaaaacagcatggtactggtaccaaaacagatatatagatcaatggaacagaacagagccctcagtaataacaccacacatctgcaatcatctgatctttgacaaacctgacaaaaacaagaaaggggaaaggattccctatttaataagtggtgctgggaaaactggctagccatatgtagaaagctgaaactggatcccttccttacaccttatacaaaaattaattcaagatggattaaagacttaaatgttagacctaaaaccataaaagctccagaagaaaacctaggcaataccattcaggacataggcatgggcaagaacttcacgagtaaaacaccaaaagcaatgacaaaaaaagccaaaatagacaaatgggatctaattaaactaaagagctcctgcacagcaaaagaaactgccatcggagtgaacaggtaaccaacagaatgggagaaaatgtttgcaatctactcgtctgacaaagggctaatatctagaatatacaaagaacttaaataaatttataagaaaaaaatcaaacaaccccatcaaaaagtgggcaaaggatatgaacagacacttctcaaaagaagacatttatgcagccaacacacacataaaaaaacgctcatcatcactggtcatcagagaaatgcaaatcaaaaccacaatgagataccacctcacaccagttagaatggcgatcattaaaaagtcaggaaaccacaggtgctggagaggatgtggagaaataggaacacttttacactgttggtgggagtgtaaactagttcaaccattgtggaagacagtgtggcaattcctcaaggatctagaactagaaataccatttgacccagccatcccattactgggtatatacccaaaggattataaatcatgctactataaagacacatgcacacgtatgtttattgtggcactattcacaatagcaaagacttggaaccaacccaaatgtccatcaatgatagactggattaagaaaatgtggcatatatacaccatggaatactattcagccatgaaaaaggatgagttcatgttctttgtagggacatggttgaagctggaagccatcattctgaagcatctgtcgcaaggacagaaaaccaaacacctcatgttctcactcataggtgggaattgaacaatgagaacacttggacacagggtggggaacatcacacactggggcctgtcatggagtggggagtttggggaggtatagcattaggagaaatacctaatgtaaatgacgggttaatgggtgcagcaaaccaacatggcacatgtatacatatgtaacaaacctgcacattgtgaatatgtgaacactagaacttaaagtataataataaaaaaaggaaataaaatatgtagcagcctccccctcccctcacgcctgcttttgccatgtgacatgcctgctccctcttcaccttctgccatgatttgaagcttccagaggcctcaccagaatcagatgctgccatgcttcctgtacagcctgcagaaccgtgagccaattatatctcttttcattataaattacccaggtgtttccttatagcaatacaagaatggcctaacacagaaaaatggtactgaggaatgggtcattgctataaagatacctgaaaatgtagaagagctttggaacgggcataggtcagaagaatgtggagggctcagaagaagacaggaagatgagggaaagtttggaacttcttagaaactgtctaaatggttgtgatcaaaatgcaaatagtgacatggactgtgaaggtcaggctgaagaggtctcaggtggaaatgaggaacttattgggaactagagcaaaggtcacttttgttatgtcttagcaaagaacttggctgcattgtgtccatgccctaggaatttgtggaagtttgaatttaagagcaatgacctaggatatctggtagaagaaatttctaagcagcaaaggattcaagatgtgacctggctgcttctaacaacctatgctcataggtgggagcaaataaaatgacttaaagctagaacttatatttaaaggggaagtagagtgtaaaagttgggaaaatttatagcctggctatgtggcagagaaagaaaatgctttttcagcagaggaattcaagcaggctgtggagcaaccacttgccagagatatttgcataactaagaaggagtcaagtgctaacactcaagacaatggggtaaaggcctctaaggaatttcagagaccttcctggcatctcctcccatcacagggcccagaggcctagaagggaagaatggtttcatgggccagcccagggccccacagccctatgcagcctcaggacactgcttcttacatcccagccacttaggctccagccttggctcaaagggcccaagatacagcccaggctgctgcttcagagggtgcaagccataagacttggtggtttccacatggtgttaagcctgcaggcgcacagactgcaaaagtgagggaggcttgggagtctctgcatagatttcagaggatatatggaaaagcctggatgtccaggcagaagcctgctgcaggggcggagcactcacagagaacctctgctagggcagtatggaggggaaaggtggggttggagcccccacacagagtccccattgaggcattgcctagtggagctgtgagaagaaggccatcatcctccagaccctaggatggtagatccaccaacatcttgcactctcagcatataaaagccacaggcactcaacaacatgtgagagcaacctctggagctgaacactgcaaagccacaggggcagagctgcccaaagccctggcaccccacttcttggatcaatgtgccctggatgtgggacatagaattacaggaaactatttgggagctttaagatttagtgcctgccctgctggattttggacctgggtggggcctgtagccccttgcttgtggatgatttctccctttggaatgggaatgtttacccaatgcctatactcccattgtatcttagagtaacttgtttttgattgtgcaggctcataggtggaaaggacttgccttgcctcagatgagactttggacttggacttctgcattatcgctggaatgagttaagactttgggggattattgggaaggcatgcttgtattttgaaatgtgagagggacaagaaatttggggaggccagggggaatgatacagtttgaatgcatgtccctgcccaaatctcatattgaaatataatgctcaattgttggaggtgggacctgggggaggacactggatcatggggacagtttctcatgaatggtttagcaccctctcccttgatactgtcctcacaatagtgagttctcatgagatctggttgtttaaaagtatgtagcacctccctgctcactccttgctcctactccagccatgtgacatgcctgctcccccttcaccttccaacatgattgagccctccccagaagtgagcagatgccagcaccatgcttcctgtacagcctgcagagccataagccaattaaaccttctttctttataaattacccggtttcatgtatttctttatactactgcaagaacaaactgacacaatctaccactttctctgaaagttagttaataagattgaatctacaatgaataaaataaggttttttattcacttcatctcaggaagacaacttggcagattcttaattgagtatggatggacatttagaatggactgacttaaaatacgacaagaatttaccatgggggacccctggcagaggtgaggaggtagccatcaaagaagaaagagccccctccagggtcaattacattgacccaaagtagaagtgccgatgatgtcacgctggaagtcagaccatggggatgaggatggtgtggaccagagcaaagcggtcttctcaaatacaagccatcatgacaagccttatattgtctttcaaactgctttttgggtggaggttgctatagtgtgcaccaggcaggagctagggagagtgaaggtcctgtcactccgaagccatgctagtgagctgatgcagaaacatgcctggggcagggaggtgcttgctaggcacggcccctgtccagggtcacccgctgtgctccgcactccacctggactgtccaccgtccacaccagcaacctgagcttcccccagtggagaaccttgctcccaaaccttgcgtgctctctccttcctgcaggtgaagccctactcctaggcccggcattcaaggccccccagggtctgactgtggctccatcctcctccaccccagctgtccatccacatgactcgttttctgtctccacttgggccctttcagaactccatgtgctatgtggtctccctctgcctcctcggcttcccaaatcctctctcctttctcagggctctttagaccctttacagctgccctggcagagcaaggggttgtacttcagaaaaacgtcacagagcctcctgtagcataggttgtctctcacttctttttaagaaaataaagcatgtgccacttcaaaaagcagcagtgggacctgcaccaggcttcactgtcactgccctgaggacaggggtggggtggtgggaaagaggaaggatatgggtgcctggtgtcacacacttggtttgatgtcttttccaaaatggatgaactttgatcgagcaatgaaaagtgtttttctttccttaaatgggctcttctagcatcagagtcaggttagctttagaagaaattcagcgcctataacccaaagcccttgtttctggagtggctcttgttgaggctgtttcttgcccagcttgatgcttttttttcttcttggatttgaatgttttgccacctttcccaccctcggggactctgcttgtccacccagcattctggtgtggattagaaaagtgtgggcttctaggccggatgcagcccagtggggcctggcctgacaagtgagcgagggccactcaatccaatcagaaaaagtgtccctgatggctgcactgctggtgactggagcatgggctgcattccataccaggggtcctcctgctgggaccgccatgaaggcatagccggcacccaggctgtgcccatcctcaactgctcttcatagaaatagcctccttttcaggagcaggcacggtggctcacacctgtaatcccagcattttgggaggccaaggcggagggatcacttgagtccaggagcttgagaccagcctggccagcatggtgaaaccccatctctactaaacatacaaaaattagctacactcctgcaatcccagtactttgggaggtcgaggcaggtggatcacttgaggccaggaatttcagaccagcctggccaacatggtgagagcccgtctctactaaatatacaaaatgtagccacatgcctgtaatcccagctactcaagaggctgaggcccgagaattgcttgaacccaggaggtggaggttgcagtgagctgagatcatactaccgcactccagcctgggtgacagagggagactccgtctcaaaaaaaaaaaaaaaaaaaaaggcctccttttccacggctactttcttccccactaggaagctgctgcagttcctctaatccataaacaaacagggccataaacacagaacatgctgatgtgtggtttttgaatgccatttgctcaaagcaaatgaggtatcagactccaagaatgaagaaatctcactaacccctaacggcaggaaactaacttagaaaccatgtggggaaactggtgctgaagggagactgtgggtttatcaagtgactgggtgtgttgccatgtggacagcagcctagccctgcggaccttgcacgtgggccactgggccaaggcttgactgcagctgacctgagtctcagcagacgcctggtggtcctcccagaacacaagagaatgggaaggccgtgaggggctccacctccctcaggacccccgaggattctggtgaggcggtgggggagctttctgcccagcaccctcacaagagagacatggaacacaaaaccactcagccgcagcctggccccggctccttggcaatgagccacctcctacctgtcgccagcccctgctgctacagggctgcttttcccgcctacatgggtcatgagctgccttgcctgtacctcttccatgcaaagtctgtcgccatctgtcgtgtgctggacagcctgccttcaccttcctttaagacagttcctccctcagcttgggtgtccatggctccagcctggggacagctcctggtcagtgtaggagtttgccagggctgtcttacagagtgcctcaaaccgcgtggcttacaacatggaaatgtggcctttcacagttctggaggccggaagtctgagatggaggtcggcagggttgggtccttcagaggacgcaagggagaatctgtcctgggcctgtctcctggtgctttgaggcccagctttggtgttccccgtcttgtaagaacatcacctccacctctgccaccatactcacgtggcgcttgccctgtgtatgagtctatgtccaaatctcctctttttactcatttttattattgttgctatttttgagataaggtctcactctgttgcccaggctgcagtgcagtggcacgatcatagctcactgcagccttgaactcctgggctcaagggatcctcccgcctgagcctcttgggcagctgggaccacaggcgtgtgcagccatgtcggctaagttttaaaatttttgtagagacaaggtctgctatgttacccaggctggtctcaaacttcttgtctcaagtgatcctcccacctgggcctcccaaagtgctgagattacgggcacgagccaccatgtccagtccagatttcctctttttgtgaggacactgctcatattgaattaggggccaccctaccctggtatgacgtcatcatagtgaattacatctgcaacgactctattcccaaataaggtcacgctccaaggtattggggctttgggcttcaacatatgcattttgggggataaataatttgcccacaatagtcacaacttactgatttaggttcagatatcctcctagcttttaaaaaggtttccacacacaactatctaaaatcataggctgaagaggcctgaaatgaccaacctctcgtggttttataaattacctacaactttcagcatcttgttcctgtaactacaggcatgaatctttgaacgccattcctgtcctccttcaggaagaaatgatctctctgggacccaggatccagccacctttggacatgctgacagacagttgatttccaacctgctctcagcttcagggaaaggtgagccagaccacagagtgctccagggttcacatgcagcaaagctgtttggcaaaacaggaaagatctcaggacagtcctaagtcctgcctcaggtagaggccgggtagtcaggtgagatgattttcctggctgttagtacagcaacccttgctctccaagttagcttcctgatctacacctggatatttttagtctagaagaacacctttccttcagaactaagagtgagactctctttaaatgccagactgccgagggtaaataaacaaatatatgctcaggttaaagagaagagagacccttcctcagagcagactctagaaggagaaaagaggagagaacacaaagggaagcagataccagcctccgggacagcatcagctccccacacccagcaggcaacagaaacggtggccctaataatattgtatattgtcacaggagaaaatgactctaaagatacataaatgtcgctaaattaaaaggaaacaagcctgggcaatgtggcaagaccccacctctacaaaaaataacaaaaattagccaggcatagtggcacgtgcctgtagtcccagctacttgggaggctcaggcaggaggattgcttaagccagggaggtcaaggctgcagtgacctgtgattgtgtcactgcactccagcctaggtgacagagtgagactctgtctcaaaaaaaaaaaaaaaaaaaaaaagaaccaatctcttggtcttttggagggttgtttttcaaggcaatgaggttgaagaccctaacttatacacacacagactttttttttttttaatggtaaatcatgactagaaaaaaatgctttacaatcatggttaagtatgacgttagggtataaaacagaatgcaagttttctgcccacatgatagattaaaagtaatggcaaagccgggtgcggtggctcacgcctgtaatcccagcactttgggaggccgaggcgggcagatcatgaggttaggaaatcaagatcagcctggccaaggtagcaaaaccccctctctacacaagatacaaaaattagccgggcgtggtggcatgtgcctgtaatcccagctactcgggaggctgaggcaggagaatcatttgaacctgggaggcagaggttgcagtgagccgagatcgcgccactgcactccagcctgggcgacagagcaagattccatctcaaaaaaaaaaaaaaaaaaaaaaaaggcaaaaaccgcaattacttttgcaccaacctaatatttgggttgcacatggctctttcctatcataagaatatctgtaagaaagttctagacatagaatgctgttaaaatattgtgtgtattttaaatttcattagatattctctaacaattctccataaaaatgtcaggtgacttatttttttcagtcttctaattttagaattagcatgcatagcagaaacagctatatttttcaaaaaccagaaaagtgaaacactgcacatgaagactgcctggaaactttatctgcaggtccacagtaccgcatcaacagaatgggaacgtcgtttttagaactagaggtaaatcgcctgtgtctcctagatcactttggggcctgttttctacgtaccaactctcttactaagtggaccgtttacagttgaccagaaactatgaccagaaaacccatctgtcttgctgggggaaggaactggtcaccagacatagcatccgagctgaggaccatggtggagttatctttacactacaaatgttttctacctaaagtcatctataagccatggacatagttcagagagaatactttctgttaccatgtcggggtgtcgaatagtgtcctgcccatccccccacaaattcacatccttctcaatctcagaacttgaccttatttggaaataggatcattacagctgtaattagctaagaccaggtcatactgggacaaggcggtccctcatccaatgtgagtagagtgctcctaagaagaggaaaagtgacacagagacagatgggctggcagagacggcaggggtgtgtccgcaagccaaggaatgccaaagaccaccagccacaccagaagcaagagaaaggcctggatcggcttcacccccagagccttcggagggagtgtggccctgctgaccccttgactctgggctcccagcctccaggactgtgagagaagacttttctgttgtttcaaattccccagtttgtggtgcttttgttacagacaccatagcaaacaagtacaccatgtgagtttaggtgtcttgatgtatttttgttttttttttaacttgtaacattatttatttaccattttaacttcgattttaggggtacatgtgcaggtttgttatataggtaactcgtgactcagggttttgatgctcagattatttttccacctaggtactaagcctaatacctaatagttggttttttccaaacagctctctcctcctaccctctaccctcaagtaggccccagtatgtgttgttcccctctgtgtctttgtgttctcatcatttcgctgctgcttatacgtgggaaaatgcagtgtttgattttctgttcctgttagtttgctgaggataatggcctccggctccatccatgttcctataaaggacatgatcttgttgtttttttattgctgcgtagtattccgtggtgtatatgtaccacattttctttagtctatcattgacaggtatctaggttgcttctatgtctttgctattgtgaatagtgcttcagtgaacatatgtgtgcatgtgtctttatggtagaatgatttatatttttttgggtatataccccgtaatgggactgctgggtcaaatggtagttcttggaggagttgtcacaatgcttttcacaatagttagactaatttacactcccaccagcagtgtataagcattcccttttctctgcaaggtgttttgatttaatggaaaaaaaggaaaaacgtttatttcctcaagaacatctcaaatgtataaacatctgccatgtcctaatagagcttataataaaatcttgtcactaggggcagattgtagaagttctaaatgcctagtttgagaacttttaacgagccttcttatggaagtacattttgtgaattttctatttgttaatctgatctctgaaccaaaattccctctggacatggacctgttgttccatatccccacatcatacctggaggactctaaaccctctctccaatgagagacccctttccgcagcccggtgaggagctttgagcagtttccagtctaggaaccaggagaggaactagaccttcctccttcttaagcctctgtggaagaccctgtccctgtgccccgtggctgtggcacttcccaacggctgagcctgtgctttaactgtgttctcatagctgccctcatcctaaaccccaaaaaccagaggggccgagagaagaggtgtggccccccccaccccggctgacacagcctcctttgtatcacatccatgaggtgaacccagggtccagtgtcctccgcaatagacttccagcttctgaaaccaagggacaaaggtacaaaagagtgactccctggttcttggtgttgcaaccccgggatgatgagtcaaccgtgctcgctcagctgagaatactgctctttctctcactgtcctcaaggaagaatgtggaaaggttcctcaggcctgacccttgtttttatttccttatcggctcacctgggacacctacccactttctcatcctgcaaagcatagaatcaagacgcaactgtgtctgagagcttctgcctccaccatgggaacacacctggctgggaagtcttagctccaaagttctacaccaggcccccagtcatcagcagctccaccatggggaatagagtagcagtcccattttctagggaggattcctggtagctcaactagcccattgagtaagccctgtttgttcttcatggaatggttcagtaactcaaagggcagtagaaaaaaattattaatcaaaaaaacccagcctggcacagtggctcaggcctgtaatcccagcactttgggaggccaaggcaggcgggtcacctgaggtaaggagtttgagaccatcctggccaacgtggtgaaaccccgtctctactaaaaatacaaaagttagccaggtgtgatggtgcgcacctgtgatcccagctactctggaggctgagacaggagaattgcttgaactcaggaggcagaagttgctgtgagccgagattgtgccactgcactccagcctggttgacagagcagactgcatctcaaaaaacaaatgaacaaacaaaaaaacccaagggaatcgaaaatggaataatcttactcaggacattttgtaagagacgtgaaagaccatgcaaacatttagcattccatccaaactgggcaaacctaaagtaggcaaaccctcctgctcagacaaacactcctagttgctgctttcactggtctcatagtacctcattttcctcaactctaactcggagtggaagagtgttgtttacgggcttatgttcctgccccctgaggatataatttcttcaggcaggattatttttatcctcacatggttaagtaaatacctgcatagatatgcaattcaggtgcatcctggccagcccagctgaaccacattcatttctcactcctattcatttctactctctttacttctttgtttttgtcttgttgttgcttcagacacagtttctctgttgcccaggctggagcacagtggagcaatcttagctcactgcaacctccacctcctgggctcaagtgatcctctggcctcagcctcccgagtagctgggactagaggtgcgcaccgccatgcccagctaatatttttgtattttttttgtggagacggggttttgccatgttgcgcagactgatttcaaactcctgagctcaaatgatccgcctgtctcagcctctccaaacgctgagattacaggcgtaagccgcagtgcccagctatccctacgttaagacggcaccggcagactaattctcaagttctacctgctaatttacccaatgcttcatcatcacggacatgtacccacatggacaagccagggcccagactgtactagaccttcccacagcctaattttagggcacagtggcaacatgttcacatgggcaggggtcaaaaaaaagaacccaggggatctttagagtcgtggttctcaaagcgtgggcctgggagcagcagcatcacaccacgtgggaacgtggtcaaatgtcagtgcatgagctctaccctgcacctgagactctaggcaagaggcccagcgagccccactgctggaacaagccctcactcagataagcctgatgcatgttcaagtttgaaaaacgctgacttagagcaatattagcccaaaagaacccaatgttagaagttctcttttcttgctgctggctaggaggaggtgagttcccccgaaggtcatatgccaaaggcttccttcagtgtgggaccacctctatagcttgcagcagggacaccagctgccctggtacttcaatattgttcttcggttgactcaagagttgacaggaggaggagagaatgtggagggacgcaccaggtgtgagggaccttcacagcccatccatcattttaagctcaggcagctgacttggaaaaacctatcagaatcacaaacaaggccagccaggaggctgagatctggtggggcaggaagagaataaagtatcctactttaagtgagtgagtatctccaatcaacctggaggtcttggcagatagaggcaggtgcttgctgcattgaacctgaagccttgtacctaattttcagagtccatttagcatagtcttgctaagctttggataagggagtgaggtggggtgggaggaaagagatcaaatagtcaaaaccttcagcaaaagcacccccagccctatgatcctacgaaggcttcggaggctgctttttcttactgacgcttcttcccagcatataagaagttttctgctattcagagactgaattcaacctgacagcccttgggaaaagaacatctctccaccccaggctctgagaaccacacagataccttggctaggatccccaaactatggctcatgggctacatctggcccactgcctgtttttgtgtggctcacaagctaagaagaatgtaagcttacatttttaagtgattgtaaaaagttttttaagattttgtggcacatgaaaattacataaaattcaaatgtctcagtacataatgaagttttatagaaactgctctgctcatttgttgattgtgtacggctgctctagaactgcagagttgagaagttgccacagagaccacctggcccccaggacccgaagcatttcctacctggggctttccagaagagactgtcgaccactgctttaaaacaaaggaggtgccgttcatgagcccaacaagacactcagccaggtttggctgtgcattgccacacccaaagcaacatttttttttttttgagacggagtttcactcttgtcgtccaggctggagtgcaatggcacgatcttggctcactgcaacctctgcctcccgggttcaagtgattctcctgcctcagcctccctagtagctgggacaacaggcacatgccaccatgcccagctaatttttgtatttttagtagagacggggtttcaccatgttggccaggatgatcttgatctcttgaacttatgatccgcccgcctcggcctcccaaagttctgggattacaggtgtgagccaccgcgcccagccccaaagcaacttctatttattctgttaactgttgtggattctccttgcctctgttactaagtctaataaatgccttaatggtatgattctgagtctcatccaatccctcactttcctattcattcagaacttctgctcctggattctcaaggaatgaaaaagcacctgccgtgaaaatttgctccaattacagtgggacaaagtcagaggcaggaggtacaggcttctctaaggaccacgtcctttttgtcccctgcctcgttcgccaactgcttcaagtgtcccctcagtcactgagggatctgaagcaattctggcatgacctaagtaccaaagatctgttctttttttttttttttgagacggagtcttactctgtcgcggaggctggagtgcggtggcaccacgttggctcactgcaaccttcgtctcctgggttcaagcaattctcctgcctcagccttccgagtagctgggattacaggcacccgccactatgcccagctagtttttatatatttttagtagagacgggggtcttaccatgttggccaggttggtctcgaactcctgacctcaggtgatccacctgccctggcctcccaaagtgctgggattacaagcgtgagccactgcgcccggccaagatctgttcttaagagaagttactactactttttttccccataacaaccattaaacaatttttttttcatttactaactaacccttgatattgaaaagttaggacttcagtaaaaatcaaatcggtttttgcatatcaacttttttgttgctattcacatgctatgtcaatctcagttgcaaacagagaggaccagttgcagactagaacgcatcaattcatttggaaaggaggcttcaaatctaactctgtattccttcaccaataaccaggcagctgcctctaacagctctcgggattggatctgctggaaatgctaaacacgggtcataaattccaactcaacaaggatgctgctcaggtatttggtatttgatgatcaacagaaatagttcagagcacctcccagcaaagttgcatagagtgacaggtgggacttgtttgagggcgggacccagaactgcagcccaggaatctgcctgcagagctgagctcggccacagtctccgccagagagggaagttgcaggtctttctggaacaggcacaactggctacaattagaagtccaaagtgtgaaccactcactgcttctccttaggaaccaccacatgctgtgtccggcaggcattctgagagccagaggacggctgcaccctggggctgggcactgacacacatcactccaccaggaccactgaggcagccaccgaccgacattcctgtctacaggctcagatccccctcaacaacgtggccacatcttctgcaaaatgctggccgggggcatccatggcacaactttgggaagctgactgggcttcctcatctttaagaaagcagcgggctgggctgctcccagcagctctggctctgcttccgttcattctctctgggtctgccttagttccagggtgattaattcggaagcggggcaggagtcaagttgcctcctagctgttttgctgacgctccagccccatcaagagccagctcctcaccttctgtaaggcacagaaggtgcctcaaattaagccaggggacagtgcagagggttaagagggggccacaaagagaggccccatctcctcttgggccagggttccctgcggaactccagggtcacctcgccagccagaggcaagacaagtgcaaaggcagccacaaggcttccgccagttagacggtgtttctgccgcccctgccgtcacccgctgggtcccgtcccgctccaagcgcactcccggcccgcagggtgggaatacgaggattacagtgccccacgggcgggcgggccaggatcgcaacctcggcggagtcggcgcctctgggcacctctggcttccgcgccccggccgcacggtgaccacccgggaggggatcccgggcgccccgcaacctcccggcccccgtgggccttcgggtcgccccgcttcccgccgccgcgtacccttcgcgcctcccggccctcggtgccggcccccgccccgcgtagctccgagtctttagcccggccggccccccacccgccgagcgtacccatggcggcggctcccagggctcctgcgacctgccggcgggacgtgctcctggcaggtgctactcctccgacctgacgtccaggcccggccccgttgccccaggtacagccccagctctgcgaggcggggccgccggctccacccggggggcggtgctgcggggagcagaggtccgtgctcccgagccgtcgcgcgtggacaccagccccggcccaggtgcgggtgggccccgacgggagcgcgtggcaggccgggggagagccagtctaaacgcggattcccaggccccaccccccggccagctgactcaggaggtcggggctggggccccagaatgtgcatttctaagaagtctaaggggaggttgatgctgctggatccagaacgacactttggaaaccactgtgggaggaacgcacgcttctgggtggggaggcaaaacacggtgggacagtggtcagctgtgtgtgtgtgtgtgtgtgtgagagagaatgtgtgtgtgggtgtgagtgaggattgtgtgtgagtgtgtgtgtgtgaatgaggattgagtgtgagcatgtgtgagaatatgtatatagtttgcatgtgagaatgtatgtgtgatgtgtgtgtgagagtgtgtgtgagagtgtgtgtgtggctttattttgagattcaacctttgaaagcatttctgggggattctacatttcctttctttaagaatcatcctttctttaagaggacacaaccaaatggaagaatattctatgctcatggataggaggaatcaatatcgtgaaaatagtcatactgctcaaggtaatttatagattcaatgctatgcccatcaagctaccaatgcctttcttcgcagaattggaaaaaactactttaaagttcatacggaaccaaaaaagagcccccatagccaagacaatcctaagcaaaaagaacaaagctggaggcatcatgctacctgacttcaaactatactacaaggctacagtaagcaaaacagcatggcactggtaccaaaacagatatatagaccaatggaacagaacagaggcctcagaaataacaccacacatctacaactatctgatctttgacaaacctgacaaaaacaagccatgggaaatggattccctatttaataaatggtgctgggaaaactggctagccatatgtagaaagctgaaactgaatcccttccttacaccttatacaaaaattaattcaagatggattaaagacttaaatgtaagacctaaaatcataaaaaccctagaagaaaacctaggcaataccattcaggacataggcatgggcaaggacttcatgtctaaaacaccaagagcaatggcaacaaaagccaaaatagacaaatgggacctaattaaactaaaaagcttctgcacagcaaaagaaactaccatcagagtgaacaggcaacctacagaatgggagaaaatgtttgcaatctacccatctgacaaaggactaatatctagaatctacaaagaacttaaacaaatttacaagaaaaaaatcaaacaaccccatcaaaaagtgggcaaaggatatgaacagacccttctcaaaagaagacatttatgcagccaacagacacacgaaaaaatgctcatcatcactggtcatcagagaaatgcaaatcaaaaccacaatcagataccatctcatgccagttagaatggcgatcattaaaaagtcaggaaacaacaaatgctggagaggatatggaggaataggaacacttttacactgttggtgggagtggaaattagttcaaccattgtggaagacagtgtggcaattcctcaaggatctagaactagaaataccatttgactcagcgatcccattactgggtatacacccaaaggattataaatcatgctactataaagacacgtgcacacatatgtttactgaggcactattcacaatagcaatgtcttggaaaccagctcaaatgtccatcagtgatagatcggattaagaaattgtggcacatatacaccatggaatactatgcagccataaaaaaggatgagttcacgtgctttgcagggacatggatgaagctagaaaccatcattctcagcaaactatcacagggacagaaaaccaaatactgcatgttctcactcatgggtaggagttgaacaataagaacacatggacacagggcgagcaacataacacaccagggcctgtcagggggtggggggctgggggagggatagcattgggagaaatacctaatataaatgatgagttgatgggtgcagcaggccaacatggcatgtgtatacctatgtagcaaacctgctcgttctgcacatgtaccctagaacttaaagtataatttacaaaaaagaatcacaaaacaaaaataataacacagtgattgtctccagattattgttctgttttcttgcctgatctcaggaggttttgcaaacacagaaaggaacattaaaaaggggaatgaaggtgagtttccacagcctttttgttttaatcatgctgaaatacaatgtaaaactatctgaagtgcacagttcagtggcatgaagtacattctcattgttgtcccaccattcccaccatccagctccagaacttcttcatcttcccaaatggaaacactggacccattaagcaatactccccatccacccttgcccccaggccctgacacccaccgttcttctttttgtctccataaatctgacaactctgtcgtccagggaagaaatctccagtgtttgtccttttgtgtctggcttctttcactttgggtaatgccctccaggctcatccatggtatgaagtacatcagccttccttccttctgaagttgaggaatattctgttgtgtgtctacaacacacttggtttatccactcacctgactctattatctcttgagtcttagcattctcccagccagcctttctggaagactgtggtgcctagggagaaacagagactgctattccatggaggtgactgagcctgcccttccccggctttcttcactgccgctgaagagtaagaaactcttcaattagttgcagcattgatacacacaaggtagcggtcaatgttacctccagaaatgggggctgcaagtcacaggacctcattaggtagaaaaatgcagcctcggctgaaggaaaggaaaactttctctggaaggtttggaagcacactcacagttgctaccctgcgagatatcccgggcgtagaaaggtggagcttgtgatggtttgtttaggtcaaagttttctctgcagggtggtatttctgtggctgagctcatgaaccctggaatccggacttctgtaaacacactcttggtctaggccagcggttcttaaactgtgatccctggaccagcagcatcagcatcacctaggaacttgagagaaatgcagattctcaggccccgccccagagctactgaatcagaacgtctgcagtgggtgcagcaacttctcagtagttgcgagacaaatgctgtttcttccacaggcttatttaatccttcattcaggcattatttatttatcacctcccagtgccaactaccatgctagtgacggcattgggcagagtgggtggccagcgcagagacaggcctgcgcccacagagctcacattcttatccgttacagcacggccagaagaggcaaggtactcaagatggagaagcctaaatgaagaacaaaaaccaagggggtcaaggagacaggctctgcagatcctgaatagctcagccaatccctggagacctgtgtcttgctgtgctgctccctggcaggctgtgtagggggtaatagtgtaaaccaaaagtaaatttctaaggccccccgaccatctgaatggacttcctcctctgcccgggcactcttaaaatttaacctgagagactgctccaggccatgatgggaagtggggattggacgtgcctccttgtacctcttgggcatggcactaacatcaacgcagaccttaagtctaataaaaaacatttacaatatattctctctgaagcctgctacctggaggcttcacctgcatgataaaactttggtctccatcacctcttattgcaacccggacattttctgtccattgatctcagctctttagataaattcagccaattgtcaaccagaaaattttaaatctacctataatccaaaagcacacctccccccatcccctactgcttcaagtttgtcctgcctttctggactgaaccaatgtacctcttaaatgtatttgattgatgtctcatgtctctaaaatgtgtaacaccaagctacaccgggattacctgggacacatgttctcaggatctcccaagggctgtgtcaggggccttggtcactcacatttggctcataataaatctcttcaaatattttacggagtttgactcttttcgtcagcagtagactcggtttttataccctccatatgggcaacacagtctatgtattctattcgtttcctgtggctgccgtaacaaactgccacagacttggaggcttatgaaaacacaagtgtgttctttcacagttctggaggtcagaaatccaaaatcaaggtatcagcagcatgctccctccagaggctctgggggggaccctttcttgtctcttccagcttctggtggctccatgtgacctggggttcgtggcagcatcacttccatctcagcccctgtctctacatggcttctgccctgtgtcctgtctccttctcctcccttgtaagggaacttgtcattggagctggggcccaccctagtccaggatgagttcatctccatatccttcacttgcttccatatgcaaagaccctttttccaaaagaggcccgggttccaggcaggcaccatgagcccactatactccccaaagggacccaagtctggaattggagtgtacagaattggcaggctggtcctggagacacagaagtgttgcttggcttccgagaattttccttaggcaaatgttgtaacaatgagatcagcactcagtggtagcagtcagggttgttcaaaactaggcctgtccttgttttcttactgacacatttaaatgatacaaaggtatactagtaatctattctaggaagaacatggccttgaaaaggtggcttgcaaactttttggagtaacagagcgtcatttcctccagttctgttcctcagattgcttggctgtaaagaccttttcattccatctcagagagaaattgagtagatgtcaaatatacagcaattagagttgctatggagatgctgatgtttaaggaagggacttgaggaataaacaataagagtgaatcccatagccattatttgagaagagagagagtctgggaaatggaatgagatggtggggaggaggtaggaggggaataaacacgtgaagtttacctggaaagtaggagaaggaggaagaccagtaagcaactcaaattcattcaaaggcacttgggaaccaagagctggtggacaaaattcacatgttgtggcacatgaacccccaaggcctcagaatattaagggactagccccaggaacatgggattggggggcttccaagccgtgatgtcctatttacagcatctagaagacaaagtgatccatagtaaataagtacattaccatgagcaccaaactaatctaaattaaaacagactttccttgcaaatctaattctcaatcttgattgcctgtagtgtcagtagtaatgatcaatattgattacacacttgctgtatatagatcctgtgatcaatctcatttaattccttcctcactataatgctatgggtattattatcggggagcatttttttctttttatttatttttttattatgaaaagtttcaaacatacatgaaaaggaagaagagaatatggccgggcgtggtggctcatgcctgtaatcttagcattgggaagccaaggaaggaggatcatttgagcccagaagtttgagaccagctgggcaacttaggagaccttgtctctacataaagtacacacaaaaagttactgggcatggtggaggtcaaggctgccgtgagccgtgactgtgccattgcactccagcctgggtgacagagtgagacctcatctctaaaagaaaaaatacaaaaagaaatacagacacaaatgtcctatttattcacttcaggtttaattatacaataccagaacatatctgacaacctgctttagtcaagtcctatacatttaaaatactataggtgatggagttggcagttattttgaataaatatacatcttgacaccttattactcatgcacaattactctatgtttatcttctagaattacaagacatgatctctccaaatgccacagctgacaaagattttagaaaattcaggtatttctataacacactgcttaatttgcctttcaaattttctttttttctttcttttttttttttttttttttttttttttttttgagacagagtctcactctgttgcccaagctggagtgcagtgacacaatctcagctcactgcaacacctcagctcaccgcaacctccgccttctgggttcaagtgattctccagcctcagtctcccaggtagctgggattacagatgtgcaccaccacacctggctaatttttgcattcttagtagagatggggtttcaccatgttggccaggctggtctcaaactcctgaccttaggcgatctgcctgcctcggcctcccaaagtgctgcaattacaggcatgagccactagacctggccatctttcaaatattctaccactcatatgtatattaaataactggcaaaaatcatgagtttttttttgtttttttttttttgagaaaaggtgttcgttttctactggtactggaataaattatcacaaacttagtggctaagacaacacaacttgctgacagttctggaaggcagaagtccagaaagggtcttacggggctaaactcatggtgttggcaatctgcgtcctttctggaggccctgggtagaactattgcctggtcttctccagcttctagaggccgccggcatgcctgattgtgtagccttctcctccatcttcaaagccagcagcatagaattttccaacatcttccttgctctctgcttctttcgccatcgcatcttcctctctgatcctgactttcctacctccctgtcaatgaggcagaaatttaaagaaaaataaatactgcatttattcactccaaggaaagtaagggttaagtgaaaaacacaagttttcctctactgcaggcaaggctatagacaggtcgtggtgacccggcctgcagaaatgagctccacaaacccccaaagcaaggttaagagaagaacaacaacgccgggtgcagtggctcatgcctataatcccagcactttgggaggccgacgtgggcggatcacgaggtcaggagatcgagaccatcctggctaacacggtgaaaccccacctctactaaaaatacaaaaaaattagctgggcgtggtggcgggcacctgtagtcccagctactcaggaggctgaggcaggagaatggcgtgaacccaggaggcagagcttgcagtgagccgagattgcaccactgcactccagcctgggtgacagggtgagactccaactcaaaaaaaaaaaaaaaaagaacaacaacaaattcctttactttctctcctgtactgaactattagttatgactatgtttgccaatgcttgtatttagtaagatttgcaaagttcctgtttgtttgtttggttggtttttttgacacagctgcaaggccactaggtatgtaaggccataagttatgccaagttagcagttatgctatagattatgtgacctgtcaatgtaaaatgtactgtctttgttttgctcttgtatgctagcctattcaagctaaactctgtctttgttcaatgctcagctttttagatgtgaatccactgagccagtgtgtaccttaaaataaacatcctcctgttttcccatattggtctctctagtcctcagtttatcacaacattttggtgagccagccaggagtggagatggcaggtttgctgtctcctttgccagtggggctgaagccctgggtcaagggaaacttgtgaccccaggcactgccaggagaacttcagcctggaggggaaatcagctcttctgtgaccaggcatccccacccagcagtgcaatggaacctgagaggggctaccagatgattactaggaacagtgtgctactggaccgcggtaaggttttggggcccaaggcaggacccttcccataaggacagaaggggagcctgatcacctcccatggtgtaactagtagtctgacccagagaggttgggggcagcaagagtggctcgccaattcggatgaaactcacaccccaaccaacataggatgcaagagtggctcgccaagtcagttaggaaaagaaaactggaggtggcgagagtggctcaccaccacagttagggacacaggaactgggagtggggaggtgtgtgtgtgtgtgaaagagattgttccgggaggaaccaatgtggggagtgacgtggggagtcgtagatctcttagcatggacagtgtgctccgagcaaagtgtggggccgacctggactagtggcaaaccgcatacagctaataggagctgccccacagctcagaattgtggtgggaataaagacctctccaaagctaagcagcgtctgaaaactcccataataggaaatggtctggtcagtccataacaaaaggaagagtgagtgagctgtgccataagaggaggaaaacgggaggacagtcatcaaaacctaccccgttagagtgcatgttacagaactttaagaaaggttatgcaggggattatagagttaagctaactgcccagaggttgagaactctctgtgaattagaatggccttctttggtgttggatggtcaaccgaaggaattatagacagggaaataattggccatgtatttaaggtggtgacaggggtcagaggacagcctgggcatccagatcaatttcgttatattgactcatggttaatatagcacagacaagaccggcatggatccagccctgtttagcagcttattgcaaaacacttgtggcccgaactgagccaaaaatgaaagtaagagcagcttctctggcagacacagagttaaagggaaagtcccagagggagcaagaaaggccagtcttataggagccacgagagggagaagagattcctcctccatatgtcccagcctacccccctttaccaaggccaacagcccccaaggaactaaattcaggagctagcacgccccaagtctcaacccaaaggtaaggatcggagcctcaagaggccagggaaggaaattaagatagtcaaggaggccgtctcagatctggctgtgctcgagctatgcaaatgcctctcagggaggcgcgaggactcatttattatgatgaccaaggccaagtccagggggcgggcaaccgactttcatctatcagccctttacaaccactgatctcttaaactggaaacaccatactccctcctatatggagaagcctcaagctcttatagatttgatgcactccatctttctgacacacaatccaacctggccagactgcaggcagcttcttctcacattgtttaacactgaggagcgtcagagagtaacacaggcagctctccactggctagaagcccgcgcaccggcagacgcagtgaatgctcaggcatatgcccagaccaagatcccaactaggacctggaagatgcaacccagcttcagcgtttgcagaggtaccgagaggcacttctgcaagggctaagtgatggtagagaaaaggcaatcaatataagaaagatctcagaggtgcttcagggaagtgatgagagccctagccagttttatgaaagactctgtgaggcataccagct

SEQ ID NO: 1177 - DNA, 58346 bp, Homo sapiens
actacaggcatgcaccaccatgcccagctaatttttgtatttttagtggagacggggtttcaccatgttggccaggtctatctccaactcctgacctcaggtgatccacctgcctcagcctcccaaagtgctgggattacagacatgagccatcatgcctggcccaagaaaaagactgaaaacagtggtgaagtgggggagatcctataacttgagtcagaatagttatctcagctttctaaagacggccacatctcttctacctgctcattccacaacctgtattggttctgaaaattatgggaggagacatgaacatgctgattatgaagaatttctgccgccacagctgtgagcagatagagtgaaggcgaactaatctgtgattcaacccaggtgaaggcaaagcctgtgagcagtgagtgggtggatgtgatttccaaaagaaaccccttggctcaaagtggcaggggctggagaccaggatggactgagagacagccagagttgagttgaggggtgagtagggttcgctaccataatttctggaaagtgcttcaggtgtggagcgtcaacaagagtgggaattcccacatcagctcccacacctttgtatggcaagcatactatgcatgccacaagcagttcggccagggctccgccccagctactcgctaagaagagttgtcatgccagttacagaaagacagcccttaactctagcctcttcttgcaagcatgacaagcacaggcccacaggcccataggccaaactctcttctgcagtgaaggagctcaaaactggttccttccaatgtccttatgagcaaattaaaactgtgaggaatttcccccccattttcctttaaatgagctggaaagatttgaataaagactcttgtaagctctggtaactactatatgaaaaggtttaaaaggaaataacttggggaagtaaacaatagcccgtgaaagatcgaaatgctttttagacattgttggaatgaaaatgttgggtgaaaactgataagaacattagcaaaagtaagctgactgaataccaaattacacacaaggagatgccaataataatagtcaacttgtgccacagaacgcaagacataggaattgaaggtgatgtaagatatggggctgggggaaaaaaaaggcagattcatgagaaaaaagaaaaagtgaaaggaaggacacctcagtcccatccaccatgccctgaaggtagccaatagccccatcaccacccaggtggaaagatttattatgtggaaaacttaaagcccagagggtacaaagtgaggactcgccacggaggcaggggagcggggccacacttaacaccatgagagtgacctggctgagagtctgctccccaccctgagcccccattagtcactttgttccaagaaggttgactctacccatcctcaccaccacgaggaagtctccactggaggaattacgagagaagtcctacagacactgatatcggggagttctccaataaaagagccaacacctaccagtcaccctaagagttcacaagccccagtctttcatgtagacttccagaagccttacaatgcacgcaagatatttgaagaaagtctccatagtgaaacagctcaaaacaagcaaagattggaactgagggctggacgcagtggctcatgcctctaatcccagcactttgggaggccaaggcgggtgggtcatgaggttaggagttcaggaacagcctggccaacatgatgaaaccccgtgtctactaaaaaaaaaatgcaaaaattagccaggcctggtggcaggcaactgtaatccgagccactcgggaggtgaggcagagaattccttgaatctggaggcagaggttgcagtgagctgagatcacgccactgcactccagcctgggcgacagagcgagactccatctcaaaaaaaaaaaaaaaaagaaaaaaagattggaactgaggaaacataaatgcagggagaaaaaatagcttgacccgccctcagagagagaaaaaatatctcaaccataaaatgagattaggaggccatgagaaaactcagagagctgttgtaaattaaattatgatagatgaaaaaaaattctgaagaacagctgaatgtagaactgagacagtctcttagagagtggaataaaataagttaaaatgatagaataggaggaaaagggaagattaatcaatccaacatccaaccaataggatttctgaaagaaagcaaagatatagcacaatcaaagatatagcacaataaaattcccagaacagacaatatgagtttccagattgagaggccccactgggtgtgcagcacagtgaataaaaaagaccccaacaaatactcattattgtgaaatttctaaagacctggaataagatcccagtagctaaaagcaaccacagatctcattcaaaacacggagaatcaaatggcacagggcttctcaacagcaatgctgagactagatgaaagaacagcattggaaatatgagggaaaataatattcagctcagaattctgcacccaggcaattatcaatcaagcaggacattttcacacacatctgatgtctcaaattatatgccacccttgcagctatctgaggaattattggaggacatactccaacagaagatgaaaatgcaccaagaacaagaaagtgaattcaggaaactggagtccagtttaggagagcaacacaagaaaacccagcccaaagcccatgcaggtggctctgagaatgaatccagaggacacagggctggaaacaaaacgtaccgacagatgacctgctatgatcagaaacaaatagtcaggggtcttcataaatcagttagtggacttgagaacaatgggtgagagtaatctggaaaatgaagtaaacaaaggaacttcagaaacaacaaagcagacttcatcagcttcaacaacagcaaaatatagagcaaggaagtgaaatcagacaccatccctgcagataccacattctgcaacaagcattgctaatatggtcattatagagcaaatacctattaagtgactaaatcatgaaataattaagcttgaaggttgaaggacaggaagaggccagtaaagatattcaatctccatctaccattaaattaagacggtaggttatgtcaaaaaaaaaaaaaaatggcaaatcaagaaagaactgagtaagcagattttgtagatgcaaaaaagtaaaaataataaaatagataaaagtgtgaaagtggaggacaggattcaggagttggaaaagatgacacaaaagcctgctgttttctgtcatatgcttgaggcattattactttttaacgacgtaattttaacacttattagaaagttacattaagacatgaaataatagcagaaagactgacagataggtgaatagaactgaactgagaatccagaaataaattttcacatttacagtcaattgactttcagaaaggatgcaagtaaacgcaatggggaaagaatcgtcttttcactaagtcgttctgcgacaactggatatctacgcgtaaaagaatgaaattgggcctctacctcccaccatataaaaaataaatacaaatggatcaaatatgaaaatgtaagagctaaacctaaaaactcttagaggaaagcgtaagtgtacatattcatgaccatggggtaggcaatgggttgttagacgtcatgccagaagcataagcaataagaaaaaataaacacatggactttatcaaaattaaaatcgtgtgtgctccaaaggtcaccatcaagaaagtaaaaagacaacacacagaatgggagaaaatatgtgtaaaccacatatctgataaggaatttgtatgtagaatatgtatttttaaattcttacaattcaataataaaaagacaacctttgttatttttttatttgtttgttttgagatggagtctcactctgtcacccacgctggagtgcagtggcacaatctcggctcactgcaacctccacctcctgggttcaagcgattctcctgtctcagcctcccgagtagctgggactacaggcacgtgccaccacacctggctaatatttgtattactagtagagagggggtttcaccacgttggccaggctggtcttgaactcctgacctcgtgatccacctgccttggcctcccaaagtgctgggattacaggcgtgagccaccgagcccggccaagacaaccattttttttttttttaatggacaaaggctctgaatagacatttccacaaagaaaatgtatacatggtcaataagtacatgaaaagatgctcaacattattggtcatcagaaaaattcaaatcaaaaccacaagcgaccatttcacaccccctaggatggatataattaaaaagacagacaataacaaatgttggcaaggatgtggagaaattggaaccttcatccaccgactgtggaaatatgaaatccactgactgtggaaatatgaaagctactttggaaaacagtctggcagttcctcagagttttaacatcaagttatcacaggaccgaacaattttactcctaggtatatacccaggagaaatgagaacatatgcccacacaacaacttatacataaatgtttagagcagcattattcacaacagctgaaaggtgaacatgacgcaaatgcccatgagctgatgaatgaaataagatgaataaataaggtgtaatatattcatataatgggacatcgtttaataataaaaagaaaagaggtagtgatacataccacaatatagatgaacctttaatttttttttaatttttacttaatcccagatgtgatagtatactgataaatcttgaaaacatgcttagtgaaacaagccagtctcaaaagaccacatattgtatgattccatttatgtcaagtgtctggaataggcagatctatagagaaagaaagattagtggtttcctgggactggagggtgttgttgaaagaaaattcagggatgattaatgggcacagaatttctttctgggctgatgaaaatataaaatttatggtggtgatggctgcacagtcctgtgaatatacttaaagccactgaatagtatactttaaatggatgaacggtatggcatgtgaattgtatctcaataaagctgttaccaaaaaaaatggattttggctggtggcagtggatcattcctgtaatcccattactttgggaggccaagatgggaggatctcttgagcccaggagatcaacgccagcctgggcaacatagtgagacccatctcatcagtttcctcttctgtaggataagagaattgaactcactgataatagaaagtagcacttaaacaagttttgtggggtttttgtttttgtttttgtttctgttttttttgagacagtctcactctgtcaccaaggctggagttcagtggtgtgatcttggctccctgcaacctccacctcccaggttcaagtgattctcctgcctcaacctcctgagtagctgggattactgatgtgtgccaccaaagtcaggtaatttttttgtatttttagtagagatggggtttcttccatgttggccaggttggtctcgaactcctgacctcagatgatccgccctcctcagcctcccaaagtgctgggattacagatgtgagccactgcatctggccttaaataggggtttatggttgataaagtgtgttctttgtctacttcttattacctcattcatcttaattacactcctgttacaactgtgtcattgttattctcacgttacaaataacaaagttttcactgtcacattgtttctatgttgtggagattccccagagggctttggtttgcaacactgtaacactgctcccccacccgctccctgtcattccatgaatatcatggcagacctactttgagcaccaggccacctgcacgttgagtcacacctgaacacacaaaacttcctgctttcctgtgacgatttgctcagcaacctgttgtgacctgcaccatggtcggctgcccctcagcacaccctaattctacctaataggtataattgctggctgggtgcagtggctcacgcctgtaatcccagcgctttgggaggccaaggccggtggattgactgagctcaggtgtttgagaccagcctggccaatatggtgaaaccctgtctctcttaaaaatacaaaaaatcagccgggcgtggtggcacatgcctgtaatcccagctaccccttgggacactgatgcaggagaattgcttgaacctgagaggcagaggttgcagtgagccgagatcgtactactgcaccccagcctgggcaacacagcaagacactgtctcaaaaaaaaaaaaaaaagaaggaaaggaaaggaaaggagaggagaggagaggagaggagaggagaggaaaggaaaggaaaaagaaaagaagaaaaattgtcaattactgacctggggtcaatagccaaaacaagcaatgtatgatccccaaactgcactcttctcccttatgatttccagagaccacataatgactcgatttggatgacaaatcctaaaagaccttgaccacgctcatgcctctgctaacactgtactcatcattctccagaagaagaaagaaaaaaggggaagaagaagcagggaggaggagaggaggacaagggggggaggaggaggaggaagaagagggggaggaggaggaggggggagggggagaagggacagcaggggaggagaggagcgaggagaggaggaggaagaagataaggagaaggaggacaacaaggagggcaaggaggaggggaggggatcacaacacactttgcttctaataatttcttgaaagcaacaaatgaaacctgaaatgacgtttgtgtttctggggtgatgctggttctcacctttgtctgacctctcagctttgtctttggctcctcgctcaggtcctgcccctgagctcacagaaagccaccccaaaatgagccagtggcagatggagccacagaaagccagagctacagaagttgatgccaaagcccagagacgtgaaatgacttgtcccaggtcacacagctagttaatgtcagagctaggctaggacctcaggattatgtctctttattcctgatttggtcctccctcaaccaccttgtgacttgaccatttctctcttcagcacctcccagaaacagcagagagcgctttgtaccaaagccaccatgctccattcctgccttgttgcagagaaagttctcctgtcccatacacgaaattgtaggggtgagctcagcagaactgaattgtgtaacgcagcagccctggggtgtcaaagcttgccaagaatcaaccacacatccagggaaggtgtgtggaagggctgcaccgccctttcttcaagtaagcctcagaggactgactcgtacaagcattacagagctacctccaggagtagggagcaatgttactaggaaatttattttaagcctgggcaacaaagcaagaccctgtgtctacaaaataataataataataataataaataataataataataataaataatttaaaaaataaataaactgagtgtgatggcatgcacctgtagtcccagctactcaaaaggctgagatgggaggattgtttgagcccaggaggtggaggctgcagtgagccatgattgcaccactgcaccccagtctgggtgacagagcaagaccttgtctctaaaatttttttaaaaattattttatgtagctaaggctttatcttggaaaaatcaattccatacataagaacacagtgggtgggtagcggggaagtatttcctaatattcaccctagagttagccctctagtgattttagagttcctccagtggtgttctgagactgtggccatcacaaatgggcctccttaaaggtgtaggctactttaataacatccccttgaatttgggtccctccccataagaactttcctgtcacttgccacactgctgttcctgccacccattcatcatcctgtgtgatctctgcattccttcagcctccatagttacctccttaatttaaggtgctgtagctcccaccctaatgtggaactgccacacttttcctgcttttgtactttggaaaggatgtgtcttctggtttgcttctaatgctctgataaactccaacattttcctggcttattgagcaccatagctcgttagttgcactgtcttctttgctacatggtaattggtggttgaaagcccgtctttctacaaagatttttatagtctctgcacctcctccctttcatgagggaaaaacgcatctcttcaactgtcccacagtggagtggagtgccattttatgatactttcatagaaaacttcttgtggctcatccttgctgggtggcattttcattgttacaagaaattcatctgacctgtgaatatgggaaatttaccgtgcattctcttctttatattagtggccttctttataaggccactaataaagactaattccatttcctatttttgtggaattcttctttttatactcttccatatatacgctatatatatgatctttaacctacctctgatctataattttaaaaagtgtcctgacttactttacagtgtttggtgttgacttcttattttttgagtcagggtctcagtctattgcccaggttgaagtgcatttgcacgatcatggcccagtgcagcctccacctcccgggctcaagtgattctcctgcctcagccctttgagaagctgagaccacaggaacgtaccaccatgcctagctaatttttaaattttttgtagagaaggagtttcgccatgctgcccgggctggtcttgaactcctgagctcgagtgaccctcttgccttggcctcccaaagtgctgggattacagacatgagccactgtgcccggcctggtgttaacccttgacaagaattgttttaaaagtctcaaattgtgtccactggcttccctttatccacatctttgcatattgttcaaacaatgttagctggcaagccaggaatcagtttctctgacaaaaaattgttcccattttttaaatgtgttcatttctgtagcaagcccagtctttattataagccctgccccaggtggatgtcagagtcagcaggctgtcattgccagagctccacatcccgccccaccccactgccacctgtgtaaggtatcccaatggtcattcattcactctgcatgtgtacttacagtttatatattttgacaaacaattttataatttcacctttgagctccttcaaagtctgagaaagatgtcatcctgaccaaagatgattataacacatctggttttggaaatcaggtagtctagttaatgccagccccctaaaaacatatccataagtcaggtatctatcatttgcatggtgaagattcattgaaaggttcagcttgaatgtgctctttgattcagggtttgtgttggagcctcagactcctacagagcagtgcaaaaatcagaccctggtgtcattccaggtaaagtctgaaaaccccaatctgatattcaggcatcccaaaagcctgtctgtgtgggtctctccatcctgcttcttacctctgtctctgccattatttcccacccagcctatgagcatcccacctgttcatacttgaacacagaatgtatactaacttgcagcattaatcatgttttacactgttcacaccctgtttgcccaaacagatggggagctacttagggggatgccatgtctcccacctctttgaaatcccatcacccaataagtatttcaaaaaggtaggaaagtgtgataatatttatagtatttgctctatttgcccatacactctcttgtgctataaaacaacatctagtttaccaggtctgaattaggcaataatgtatttattagcaagtatgaacaatgtcacattacacccctcctgttaggaaatctacaatcaggagggatttcaaggcagtttcttttaacttcttcccatgaaatcttgggtctaatcagttattttttctgtctttcttctacttttatttctaagagtctaagaggttcagaaaaggtaggaacacacaggggaggtcaggagaatgtcaataactccagcagaagagaaatgggctcctgtttctgaaagataatgaaaatagaagacacttttcactgagggtaaagcccttttagcagctctagatttagccacagaaaaatcactcactttattaaaaaaaaaaataaatgaaaaaaaacaaaacaaaactcttcaagctggcatttggcagcaagacaatgctgagaacattttctcaactcggctgggaaaacccgggaaagaacacgttgaggaaaagagggtaacactcttccgatctgttgggactatgccagagaaaatcaggcaacagattaaagaggcttgtcagtcaccccactggtttcaggggcacattactcactaccacctctatgcaatgagtcaccccttgcagaacccgtcacagctcaagtttaatcaacctcacagcagcgggaaggtgcatcactctgtcttcccataaaagatgggccactgcggcaccaaggcatagaggaagagctacaagttacacaggtgagaagagtatcagggacagtgtccatgggaggggaggaaagaagattcccaggcagaggtatgtgaagcccactgagccgtgggctcagccatggtgatctggtcccagggaaagaggtggtcactgaggcatcatgaattcaaggagcaccttctgctgctactcctcatggtcaggctcctcatcactgtcctcccccagaggaaattccttcgtgggcttctgggttgcatacatccgggtctccatggggcagtcctgactcagaatagcctgcagagagaggcaagaagagaagccactgcacattattatcatttttttttttttgagacggagtctcgctctgttgcccaggctggagtgcagtggcgcaatctcggctcactgcaagctccgcctcccgggttcatgccgttctcctgcctcagcctccagagtagctggaactacaggcgcccatcaccacgccaggctaattttttgtatttttagcagagacggggtttcaccatgttagccagaatggtctcgatctcctgacctcgtgatgcgcccgcctcagcctcctaaagtgctgggattacaggcgtgagccaccgcgcccggccaaccaccgcacatcttttttttaccaatctcctcattccgtcctcccactagttcttccaaggctggcattgctaagtactcaagaaacatgcataggaccctctgcatgtacatgcaccagcctcccggggtacctagtatatcaacccttgtcaggacaagtatctcatttgcttttaactgaatttaacagtggtagtgaaagttacagcaggaagccaaatggaatcaccaccactccctatcacaccttcatgtcttcttttgttcccttgagcagcctctgtcggtatcccaaacccatcaggccctcaggatgtttgtgctgcagtaagaggaaagtgctttattaaagaaaatcctatggtatggatctcttccctggggtttttgtacttttaaaaacgtgacctgctgaccaacatggataaaccccatctctactaaaaatacaaaaaattagccagacatggtggtacatgcctgtaatcccagctacttgggatgccaaggcaggagaatctcttgaacccgggaggcagaggttgtggtgagccgagatcacactattacactccaccctgggcaacaagagtgaaactccatcaaaaaaaaaaaaaaaaagtgacctggtaaggataatgttgcactagagtgaatgagtggatgaacggatgtgccaatggaattctgcccacttatgagggagttaacttggtaactcacatcttgctagtaactagcaagctaagaacagtaactacaggatgtctttgatggtcctctgcccccatttcccttctctactgaagacccttcctgatagccccagaaagagggaagtggttacttagagaagggaaattaaggaagtgcacaaaagaaatatgaagatgaaaggggattgggaaacatggcaaagcagagagagtatcaacagagcaatagagggaggaaataacagcccaggatgaaagggaatgagagagatgatggaaagaaacagaagtgaatttctcttttaacagtcggtgctccttacaagcttctcttcctttgccggggggctccgcaggtagtagcagagtggagcatagacgatgttgatgaccccagtgatgaccatgagccagggaaaaccgatggcctttacaatggcaccaccggtggatggacctgggagggatacatcaaagtcataagtgtctatggagcctccatatggagcatcctccacgtaggacactatgctaggggcagtgggtgacccagaggatgtctcagcgtcaaagatctccagaaccctaggaggatagcttcctggctgcacttccagctggtaaagagtagacaggggaaagtggggcaccaggtcctgccaacatacctatagcaaagcccatgcaaaaagccacatcagcgatggcgtagacactcccatacaccgaggtgtggcgtagatccaccaggtgccccatgatgggcatcatagaagaatccaccatgcctgtggccagagcaaacaggacacagtcagccccacccacagttagtaccaccccgcctctcctcctccatttagtccatttgctttgtctgctgtcttctgcctcggactaacacctgttccaggtgggaattacgagctcatctctccacaaccctgccagctgccctcctgatccttctgcctctgcacctacctcctctgatgagaaaagggggaggaaaggcatcagacccaaagccaacatgcaggggcttattgttttctttgagggcacttcttacctatggcaaggccaagccctgcattggggccaatgagaccaaaaatattgtgagccagaggaacctgcatggggaaggaggaagagtcatcaggactccagatgggtcaggtgggagcaaggttcaaagagttttcacatgaaatgcatttattcagagtgcactattggccacatacatcatcctcctgcactctcagactttctcatggaaaagaatctatacctccattttaaggatatgaaaacttgaccagcgctgttgtgtttatttattgctctatccagagttacagatctaatgagtggcaagatcaagtttggacctcagacttggctccattatgctctaacgagggtcttcctctgttccatggatactttctccccttcctctacccctcttcacctaaacatacactcctggtctcattcttcatggaataaagttgcctctgttttccattatggacatcactgaaaggtttcatttagacttctaacttggtagctgttggaaaaagaagatagagaagaggccccaacaaccagttagctgtaagctagagggggcaggtggtgtggcttgggtcccctgtcaggaagcttgtgagactcattcccattgccctcccaatcccccaacaaaaaccccttcttccctctttttcaggttccttacctccctctctgggtacctgccattcaaacctgctaccccaggacactcaccccttaagggtttagcataccgtttagatgctgctggctgataacaatttttagggttcatgcctcaagaaatgtttataaattatcaatagtattggctgagattcactatgggctcaccatgtgccagacactgtggtttatttggattaccttgacaaccctgtggacaccatcagaaccctctctacatagatgaggatgctgagcacacggagatgaagtaacctgctcaaagtcacatgcatagaaagtggcaaaacctgccatggaacccggatcccatgctcctgctcaggacctccagctggtcttgagcacagtttacagtgccttgtagccctgttcttctctccctcaggcctaggaggtttgtgtgtttctcatccccactggggagaggaggaaatgaaggctttgagaacttgagggggattcttggaaatggaaaagtccttctttctttcttcttctatcaagcctctggtgccagagactgggacatagatgatggttccctggggatttatgaggctctgtcagggtgggatgagtaaatgaagtcataaaacgcaccattttgccatccccagaaatggataccaacatgtatcacttcatatgcccacatgtacagcctcagacctccggctccagctgccctacagccctcttcctctcctttcccacttcccctcaaaggaaagccactgcagctggtggcctcttcccccgtgctaaattcctgcctattcagaaacagtctttctgacagtccttgccaagccatctctgctcatcttaaaggaaattagtctttaaatgtctgtgtctttctctctctctctctccctctctctctctctctctctctctctctgtctgtctgtctctcgctctctctctccttcccctcccccaggtcttcttatacttacacagagcaagctggtacctactaccagcatcccgattagggaacacagccacctggaagaaaaaagccatcatcaaacaccactaggggagagctcccctccacctgtaccccatcaccgccatgctgacctgtcccaccagccctaatcccagcaaccccttaggacctgaggacagcatccctacatgaccagtttgtacccaaatgagctctctccctgccctttccttgtctcccctggctccatccctttttctatagaaaggcagaggaggtgccgtgggacacactcttccttcccttacaggaggaatcagctgactcaggaggcacttgttccttagaagtagccctcaaacttaactcatgctgttgcccagctcagactgcctcctacctgtcctattttatttggtccttgaggtctgtctcaaaaaacacagaaagtaccaaacttctttccttctctgatgtcctatggcagtgcttctaaaatcttgatgctaaactccaaagataaaattaaagctgtccttattgtagtgaagggacagaatggagactcatagctcttggcccccaacccttcctcctcagtggcctctggggtgcctctatagaactccttaggattccacagaacataatttgaaaactactttcccaaagtactgcatttttcatagctgttctctgttgtggttattttatctcctcaactggacagcaaatggatggaaagtaaggggtgcccctcatgtatccactgcctcttctataacaatcagctcagagctcaggacaatccattctccataccaccctcaccactcactcactgcccatcctcccagtgggaagtttttatcggtgtgtactcatcctaaactttcaaccgtatggaagctgttcatcattccaagatcaggaacgggcgctcttccatcttacatttctactgttcgtcccagatcccgaggctacataccgacccatcttgttggccaacacaccaaagaggttggtgccaatgaggtaggacacactggcaggcaagaaagctagacctgtggaaggacacagatccttaccttaggacatgtccaatttactctaaaatgccttgtctcgtacaagacactgaagtccacccctgtaaccttccaagatccccaaaccactttgttttatgatctggggacctttgtgcaaacccacagtagttgccataggacccccacacctctcctttcttcaggagcaaggctttgtttagcctcagtacttttctttttgttttctttctttttttgagacagggcctcactctgtcacccaggctggagtgcagtggtacaatctcagcccactgcagcctcgacctcctgggatcaagtgatcctcccagctcagcctcccaagtggctgggattacagatgaacaccaccacacctagttgtttttttttgttttttttttgtttgtttgtttgtttgtttgttttgtagagatggagtctcgtcatgttgcccaggctggtcatgaaatcctgcctgccttggcctcccaaagtgctgggattacagatgtgagcccccacacctggcctagcctcagtacatttaatgtgcttccagctccccacttagattcctaatgaatggccctgatgagccgttctcatgtataaaatacccttgattatcagcgtgagaatgtgagcttcagaggtggtgtggttgggtgccacatacccatacataattcctgggaagtgaattcctgccttgctacttaccagcccttctatttctctgagagggatcttggattaattactaaacctttctgagccttggtttccacatctggaaaaagcaaagctatgattatatcataccgggttacaatgtggagcaaattaggtaatgcatgcaaaagtattttgtaaattgaagtcctgaacacatggctttttgtgacagtagagggaagtgttcaggaaacatgggctttggagccacacaaagctccaaattttgcattcaaaccatggcttgatgacttgttagctctgtgactttggacaatttacttaacctgtctgagtctcttccattcattcattcattcattcattcattttaacaaactttgaccatgtgtcaggtattctgggggctgggaatacagcggtgaataagacaaacaaaattctagccctcagctagcttacactccaggggagggagacatacaatgaacaagtaaacaaatacacaaaaaagataattttgaaaagtgttgagttatgtgcatgaaatttaatgtggtgatatagcagagcaactcagaagggctatctgggatttcagggttggggaaggcttctttggggaagtgacattcaaactgagaccttaataaccaaaagagagcacttcaagcagaaaataaaaagcacctaatggaaattaagatgtcttaaagaaatcatttagtttgctctaagaatagaaaggatatctgtgtgcctgaaatataagaggaaagtggagggtgagaaaatgaaggtcctagaaatgaatctggttattccaagggcaatggaagctttggaaggaaatgacataattggatttatattttctaaaatcccctagaagaatgggttcatgggacaagagtggaagtcagactatttgcagaatccaagagaaaagtgatggtgcctcagattagaagtcatggtggagagaagtgaacaaaatggtaggttttggaggtaagttggtgacattttctgtttgattgggtaaagacatagcgggagtgaggaggggaagtgagaaatcagggataacctaggtttttgtcttaatcgattgggtagctggagatagggaagactggttgaagtgcaagagcatggggggaacgtgagaggtttgaagtgactggtagatattcaagcagagctgtcaggcagttagatacttaaagccatgcaaatggatgggattgcctatgaaagaacaaataaagaatagagatccaaggactgagccttgggggactcctatctttagacattagcaaagaaggcagagatagcacaggagatgaggagtagccaatgaagtaggtgaggggagatggaatcgagaagaggagtctggcctttgatcagggctgggatgctccaaccataattaaagagaagactgggaatgtgggttcagatgcaggatattgggtacacttagtgatggaaacacgacagttccattctcattgcttccattttatcatagcttctgttttctcaatgagtaggaggcaaagtcaaccactgagaatgatgatggtgaagggacgggagtgcatatggggctaaaatgaagaaatataaaatagtcattttggaaaagaagaaggaggacataactaggggcttagagaaagattgttggacaatgtgaaacccactttaggtttgtggccataaatataaggtgagaccaacagcgtggttgtgcgttttttttgcagccccatgccatggctcagttacagacaaggagtaggcaacaagatagcttagctagagtgaagtttttggcaagtgacaagcccagagggagtgaggagtttcagaagagtgacatccatcatgagccattgaatccaagttgaggaaagaaagaagtgaggacaggctgggcgctgtggctcacgcctgtaatcccagcactttgggaggcagaggcgggtggatcacaaggtcaggagatcaagaccatcctagctaacacagtgaaaccccatctctactaaaaaatacaaaaaattagctgggcatggtggcaggtacctgtagtcccagctactcaggaggctgaggcaggagaatggcatgaacctgagaggcggagcttgcagtgagccactgcactccagcctgggcgacagagcaagactctgtctcaaaaaaaaaaagaaagaagtgaggacaggagtagtgatggaagaaaaattactcaggacagtgaattggtgatcccagtttggtccaaaattgttgatatgggactattagaacacctgagaagggaatatgtaagatgagaactggattgtttggaattgagatttcagaggaaatataattaatactgacatcaaggtgatattgcttgatatttgtcctcttgaaatttcacgttataacttcatctccagtggtaaaggtggggctgagtgggaggtgtttgggtcatgggaatgaatccctcgtgaatggcgtggtgctgtccccatcctcacggtaatgagtgacttcttgctctgtaagttcacacaagagctggttgttaaaagagctgggcctcctgaggccctcaccagaggcagatgctggtgccaggcttcttgtacagcatgtagaaccataagccaaataaacctcttttctttataaattacccagcctcagatattcctttatagccatgcaaaatgaactaatacacaaagtgagggcataaataggattaaattggttaaggtgagaaggaggaaaggatcattgcaaaagagtagattaaaaaattaggaggccaagatccacagttatccacctggatattgaagtcaccaaaaatggtgacaggagtagaggtgaaaagaacatggaccagatgttgacagctttaatgaatgaggagggacaactaagaggtcactagatgtttgcaacaaacaagggttcggtggtgtaatctaacgacatgacattcaaaggagctgagatctttgaaggagaatagagaagaaatgactcggaagcaacaaaggagagcaaggtgtggaacatgaacttccatctagatgttgcaggaaaacaatgttcacagaaaacatctgggtctcagtagggcaagaagatgaaagacatgttcagagaaaaggatgagggcataggatgcttgctgatgacaagtccaggatttgaaagagcactgggaaatttggtaagatcaagaaatctctgagggcaaccccctttgggagctctgttttcactctattagatcttgcaactgtacactcttctggtccgtgtttgttctggctcgagctgagctttcattcgccgtccaccacggctgagcgctgccatcacagacccaccattgacttccacccctccagatctggcagggtgtccactgcacttctgatccagcaaggcacccattgccactcctgattgggctaaaagcttgccattgttcctgcacacctaagtgcccaggttcatcctaatccagctgaacactagtcactgcattccacggttctcttctgtgacccacggcttctaatagagctataacactcaccacatggcccaaggttccattccttggaatctgtgaggccaagaaccccaggtcagagaacaaaaggctcgctgccatcttaggagcagcccgccccatcttgggagctctaagaacaaagaccctccagtaacatctggtggcctgtacagggcttctccaaagtggtgagtaatattggatcacttttgcttgctattctgtcctatccttccttagaatcagaggaaaataccgagcacctgtcagccagttacaaacgattagcgtggctgctggacttaagactcagctgggaggctttctgggaaaaggctttctaacaacacccaatccttctaggatgggagcattggtctgcctggaaccagcttctgctttcacaattttcttgggggaagccgaaggccgactagaggcagaaagctgtcatcccaaactccgggcattgatcagtcaagatcatgatgcaaccagaagtctctactctatagttgcccatgtgtgcacccctacctcttcttctgacccatacctcctgggttccaaccatgactttcttgaaagtgtagccccagaattctccttacctctgaatctacttcctccaatccctgcctcctaggtactaatgcttcagactttcacttcctctcccaagtattagagcaagttgtatctccaaaggggatctaaggaagctctacactgtgtccttaggcaccaaggctatgaacccacggagtcttgcccctggtgtccctcccaatttaggtatacagctctcaacatgggcagttatgtgggacccgttccccaccacccttgcaagggccacaagtttgtaaatggctaggaggattgctctgccattgtgtaagtactctcctctctcaatttctatccaacttacccaccctgtgcaatacaatctccaagcctcagctccttggcgagggccttagaactgatgacccagtactttaacactggaactgggcctgcgacaacataatagatcagtatcaaagtgaattgagtaaattaaagggatgccccaaatgcattcaatctgtagtggcaactgctttgctaacagaaggaagtagaaaaataacttttagaggaaacctcattgtgagcacacctcaccagttcagaactatcctaagtcaaaaaaaaaaaaaaaagtagcttactaactcaaaaatcttaaagtatggggctagtctgttaaaaaaaaaaaaagatgacttaacattaaccactgaaaattcccttaacccagccaatttcctaacaggggattttaatcttaattaccatacgaaggtctgaccagactcaggaggtacccccttaaggacaggaagatagatggttcctcccgggtgactgagggaaaaaaccgtaatgggtattcagtaattgataaggaaactcttgtagaagcagagttgggaaaattgcctaataattggtctgctcaaaggtgtgagctgtttgcattcagccaagccttaaagtacttacaaaaccagtaagcccatctttttctccttgctcttcttcttttaggaaaaaggcacacaggataaacaggatccatctctcatatttcttacccaaaaggacttaatccggggcaacaaaaagtttaagatcaataattagggtgtattcctacaaaggaaaaggacaaatgccctagtgggcaaaaactctatctcaatcctgactcaaagggttacctacaccctctctgaaatgaatttgcataagaattgttgtttatgggaatgcatcttgatggggcaactgggttgcgcagcccagctcaagaactcacccctgatcgcaaaggcaatgttgggcacgctggtaatggaccaccataatccagcagcctggactcctttctttgtggtcaagaaaggcgggaaaacaggtgcaggactgctacatcggtgagcgtaactaatccggtaagcagatgtccctgggtggttacacaccctggaaaggaataagcattaggaccatagaggacactctaggactaatgctcatcggaaaatgactaggggtgctggcatcctcatgttcttttttcagatgggaaacgttttccccaaggcaaaaacgcccctaagatgtattctggagagatataatgttactgctagatcagacactaaccccaaatgaaagaagggcagctataattgcagcctgagagtttggcgatctctggtatctcagtcaggtcaatgatagggtgacaacagaggaaagagaacgattccccacaggccagtaggcagttcctagtgtagactctcattatgatgcagaatcacaacatggagattggtgccgcagacatttgctaacttgcgtgctagaaggactaaggaaaactaggaagaaggctatgaattactcagtgatatccattataacacagggaaaggaagaaaatcctactgcctttctggagacactaagggaggcattgaggaagcatacctctctgtcacctgactctattgaaggccaactaatcttaaaagataagtttatcactcagtcagctgcagatattagaaacaaacttcaaaagtccactttaggcccagagcaaaacttagaaaccctactgaacttggcaacctcagttttttataatagagatcaggaggagcaggtggaatgggacgaacgggagaaaaagaaggccacccctttagccatgtccctcggcaagtggactttggaggctctggaatatggaaagcctgggcaaatcaaatgcctaatagggcttgcttctagtgcagtctacaaggacgctttaaaaaagattgtccgaatagaaataagccaccccctcatctatgccccttatgtcaagagaatcactggaaggcccactgtcccaggggacgaaggtcctctgagtcagaagccactaacagatgatccagcagcaggactgagggtgcccagggcaagtgccagcccatgtcatcaccctcacagagccctgggtatgcttgacctttgagggccaggaggttaactgtctcctagacactggtgcagccttctcagtcttactctcctgtccctgacaactgtcctccagatctgtcactatctgagaggtcctaggacaggcagtcactagatacttctcccagccactaagttgtgactggagaactttgctcttttcacatgcctttctaattatgcctgaaggccccacttctttgttaaggagagacattctcgcaaaagcaggggccattatacacctgaacatacagaaggaacacctgtttgttgtgccctgcttgaggagggaattaatcctgaagtctgggcaacagaaggacaatatggaggagcgaagaatgcccgtcccgttcaagttaaactaaaggattccacctcctttccctaccaaaggcagtacccccttagacctgaggcccaacaaggactccaaaagattgttaaggacctaaaagcccaaggccttgtaaaactatgcaacagcccctgcagtactccaattttaggagtccagaaacccaacggacagtggaggttagtgcaagatctcaggattatcagtgaggctattgtccctctataccaagctgtacctaacccttatactctgctttcccaaataccagaggaagcagagtgactcacagtcctggaccttaaggatgcctttttctacatccctgtacatcctgactctcaattcttgtatgcctttgaagaccctctgtacccatacttgcctggtaagcctatttaataccaccctcactaggctcgatggaaccttggccaaaatcctactaactgttggatgtacctcccgctgcactttaggctatacatttcaatctctgtatcttaacctcctggttaagtttgtctcttccagaattgaagctgtaaaactataaatggttcttcaaatggagccccagatgcagtctgtgactaagatctactacagacccctggactggcctgctagcccatgctccaatgttgatgacatcgaaagcacccctctcaaggaactttcaactgcatgacccctactatgccccagttcggcaggaagcagttagagcggtcatcagccaacctccccaacagcacttgggttttcctgttgagagggggtactaacagacaggactagctggatttcctaggccaattaagaattcctaagcctagctggggaaggtgaccacacccacctttaaacaaggggctagtaactcagctcacacctgaccaatcacatagtaaagagagctcactaaaataccaattaggctaaaagcaggaggtaaagaaataatcaaataatctatcacctgagagcacagagggagggacaatgatcgggatataaaccccaggcattccagccagcagtggcaattccctttgggccgcctcccattatatggtagctctgttttcactctattaaatcttgcagctgccaaaaaaaaaaaaaaaaaaaaaaaaaaaaagaaagaaaaagaaaagaaaagaaatctctgaaatatggggataatcataatttctaccagacaggccagttgtgaggtttaaacaaaatagtgcatatcaaacattttgcatcgtgcctgtcgcagagtaagggccctacaagcactggtcttgattattatcatcataactcgtgagtggcatgtcaggacttgagtccaggccatctcactctaactccaagtgtttccactatgccacacccccagcgtggtagcacagatggctctggtataaggaactgtttgagatcagcagagtgagtttgtctggatctcaccagcccttttaatccctctctatacctagaaaaaaacagtgcaggctaacaaaaaataccatggcaattacaattaaattaaaagtcaacaatcaaccatttattggctgacaacttgtttgcttttaatattctcttctatggagtagaagtaagcacaccttagtgtatttgtgtaggctatcctggacaggtggcaatctgttgcaaactgtacccattcgtttatatttaattgcttaaaaaaattaaaactactcaattgtttatctagtatgtggaagtaagcacctctaggaagcctacagcctcctagatacacctccttgacatcattttaaatggtgtaaaatttccttaattagatttttctcaatccacgttgctcgttctttaggacctgattatagcttacattttagcagtattttgtgcaaaataggtgctccagaatatgtatttatagatacatgacccctgcatgaaaaacatctgtttttcacagtgaatctctaaggggtgagggattacacattttgtgactatcaaaatggtttaaagtaaaattgtacaaataattttttatttactgatagtatcctgtattccacgcactgggctaatccatttaggattccagatgaaaatgactctgaaaaatacctacttttttacaaattaaaaaactgaagttggtcttagtctgttttatttttgctgctgtaacatattaccacagattgggtaattcttaaagaaaaaagatgtatttggatcacaatgctggaagctgggaatcgcaagtgcatggcaccagcatctgcttggccatctggtgagggacttcttgttgggtcataatacagccgaagggtatcacatggagaaagggcatttgagagagaaaagaaaaaggggccaaactccccccttttgtgactaacccactcctatgataattgctttaatctattcataaaggtggtgcccctaggactttatcacctactaaaggttccacttctcaacactgttgcattggggattaagtttccaacacacaaattttggaggacatagcattctacccccggcctccaaaattcatgtccttgtcacaatgcaaaatgcattcaatccatcccaatagtttcagaagtcttaagtggttccagtgtaaactcaaaagtccaaaatccagagtcttgtctaaattagttatgggtgagattcaaggtacgattaatcctgaggcaaattccctccagctgtgagcgtgtgaaatcaaaacaaattatacttggccctttgtatttgcaggtttcacatccttggattcaactaatcgcagatcaaaaatatatgaggaaaaaaaataaaaataacagtacaagataaaaataatacaaaaaagaaaataatacagtataacaactatttatatagcatttccattgcattaggtgttacaagtcattgagaaatgattatagtacatggaagtacgtgtgtagattatatgcaaatacgatgccattctatgtaagggacttgaacatcctttgagtttggtatccgtgaggagtcctagaaccactctcctatgcacaccaagggataatttacctactttcaaaaataatggtggaacaaagatagaacaggcattcttatttcaaaaggaagcaacagggaagaagaaaggggtaacaggtcccacgaaagtccaaagcccaaaacagaaaacaatattatgtcttaaagctggagaataattgcctttgactccatgtccaaaatcctgggcacactggagtggagtttggacccctaaggcatcaggcagccccatgtctgtggtctttccgggctgagtctacccagcagcaatcatgggttggagtcttgtgcttgcaggccaccatgctggtgcccctacagttccgtgatcttggaagtggctgtgcatggcatcttttgaaatttaggtggaagaagtcatgcacccatagctcttgcattctgcgcacgtgcaaaatttgcaccacatagacaccaccaaggcttaccacttgcaccctccagagtgggaggccaggccacatctgggcccacttgagccatggctggcacagttgaggggcactgcactgaaacgcagagagcagagtcccaaggtggtcctgggcagtgagcccatggagggtgtcccaggcttattcccaaaccattctgccctcctacatctctgggccagtaatgggaagcacagcttcgaaggtctctaaaatgcctttgggtctttctcccacagtcttaataagtggtgcctggctcacttttatccacactaatcactttaggttgcttggccacagtcttggtgtgctctcctaaagatgccttttctttctttccaaggccaggcagcaaattttccaagtctttctgttttgtttctcttttaaccataaatttcacctttaaatcatttctttgctttcacatgtcactatatatgcagttaaaacagccacaaagcagcctgaagctttgctgcttagatatttcttctgccagatatcctagtttattgcctctaagttcttcattccatgaagtcctaggttatggatacaagtctgccaagttttttgtaactgtataacaaggatggcctttactctagtgtccaataccttgttcctcatttctatctgagacctcgtcagaatgaccttcactgtccatatttctatcaacattctggtcacaacctcttaaccaatgtctaaaaagattcagactttctctatagctctcctcttcttctgagccctcaccagaatcacccttaatgccttaaccacagcaatacaggctctttctagcctgctcctccaaattattgcagcctctaccaattttccagttccaaagctgcttccatattttcaagtatttgttatagcagcagcccggtttctcattacccattttctgtcttagtccattttctgctgctataatataacagaataccagagtgcatgatttatcaatgaaagagatttatttggctcagggttctggaggttaagaagttcaaaggcaagcctctagtgtctgtttggccacctggggagtgcctggttgctggatcataacatggccaaagggggtcacatggagagagagcacacatgagagagatgtaaagggagctgaactccccttttattatgacaaactcactcccatgataatggccttaatccattcatgagggtgctcccatgatctcatcatctctcaaaggtcccacttctcaagactgttgcactggggattcaatttgcaacatataaattttgggggacacattcacaccatatcagaggtcaaagaggttaaataacttatccgaggtcacaatcagtaagtgacgtggtcagcattcaaacccaggtggacctgggctatttcctccccttggtgatgctacctagtatatggtgggccacatagcaagcactcagaggcagactacacattactttcaaaagcatggactcctttggctcccaacacctttgagggatgctcttcatgtacagcagcgattttctaggtgtgatcactgaccagctatattagcatcacctgcagacttactagggatgaaaacttgttttgactaaattgcctactgtctcccagcaatcagagttttaacaagctctctaggtgattctgatgtagttgttggacaacctttgatgtcagactttacagaccagatagcattgagaaagctgtaaaagatggtggcaactgagtgactggtaactgagtaattggtaactggcaactgagaatggtccctaggctgctggggaggagctgctctgtgttgtagctgctcactagtatcgagaccctgagtggtcagagccttagggcaggcgatgaattatctgcactgaataccgactaactcaattaatcgtcatggtcaaaagcacttgcaacccataaaaattcaatttggcactaggagtgcagctgggagtcttgcttagaattgcccccccaaaattagatttagtgctttttattgcatgctgaactatatcatgttcttatcagcttcccctctggccccgtaagcctctcctccctgcagtgatggagcaatttgcacgtagccttccctgtcctctttcctcagggttcctgggaagggctagatcctcctctccaagctcctctctaagtcgctgcatgaacaaaggaagctggaaccctctctcctgggcccatagcttttcctaagtgagtgctacatacacccctttttagaggtaaaaaagataaccaaagggtagtcttgaggatgaggagctgaagggaggagaatgtggatggtaatggtgcacattaatattgtacagggtacaaagcattttcacctcatatgtcatttattcatccaatttctcttgaactagatagtattttgatgctcattttagcaatgagaaaagtgatgctcagagggtttaaggcatctgcacaagttttcacagaaaatcaaaggagctgaaaccaaaacctgaatctttggactggaaatcattaatcatcctactacacagctaggtatgtgacctctccatagcccctttcatcctctctcaccctcccctttctcagactgcttctctgagggaccacacaccctcttgggcttgattcatgggtgtggacgtgggaggtcattctacaaaggaagcatgttgtccctgtgtgacattgaacgaaaggactcatggcacccacctcctcctgccaggccctgagcgggggtgctgaggtcacttacccagctgccacttgggggagcacatggtctgcatcatccagatgggcagtgtgggctccaggatggccacccccatgttggcaaagcagatggaccctggggagactgttctgtgagcagccgtggctgcttgaagcccagacactccccgcccaatgggaggtcatcgccagcttacctgcagccaccaggatgtaagggtctttgagaagcataaagaggggagtccccttggcactctgagaacatggataacaaaaaatgtccatttgtacagtgcatacatctctcctattttcacagaatctgagaaagtacaattatgggcttagagaccatctacagtatctcctttactgcagagaccaggaaccccagtacagggagagaaagtgacttgtctgatgccacagaggaagctggaggcaggacccctcctgtgtgaaaggtaggcactgtaatagtcacagatagagaagcaacatattccagccatggttcctgcgttcacgtgaccatcaacaaggtcagagtggattggtagcaaggtcagggttggacaatagatgtctggactcctggtttccactagatctccctggtactaatatttgtcctgggagaaccacaggcagagcaccgaatcccaaaagcaagcacagaagccataactcagaaagcctctcaagctttctgaattcttcattctgatcattttgagccacactgaactaaggtagaagaagcagggttaaaatacagcctaaacatccaggacccactctcgtcaggacacactctcatctaaacttggtcgccccaccctctttccaagcatcccagcagtgcctcagccatcattattgcctttgcctaaactacacgttctgagcttctccatagttccatgttctacccactctttaaagtcaagcttaaatggctccttcttttctagagagctccctgactcagtagctggggcttctctctcttccagacatcctgaacactatgtcctaatccttcatggtgtttactactttctatcttgtaatagattggatcattttggtatgataaccctctctgcacacacacaatagtggattgataaatttagagatcctaaaactaaagagatcattcgcttacccaattattattcgaagtaaagaaactgatgtaaatcattaaaatatacatttaaaagtacaataaaccctttgacccaacagtcccacttctaggaattgactctaaagattaatgacaacattataaacatgcagtcatgcaaattacagcactatttataactataaaatactgaaaactacctaaacataggagatggaataaaatatggcgcacacactattgtgtacacatacaaaattgtgtgtgggtgtgtgtgtgtctatatatatatatatatatatatatatatatatatatatatacaccaccaggtggaaaataataaggaaagattctgtgaactagtagagtaattttcaggacatattattgagaaaaaaaggagaacgcaaaaaaaagaatacatagtgtgctgcctttcatataatagaaaagggaaaaataagaaaacacataagcgatttattttgaggaaaaaacactaagacacaggaaagacaaaccagaaggcattaaaattggttacctatgagtggtaggggtgggagagggggagggttagaaagactggagggattgacactttctgagtacaccttttggaataattttgacttttaggtggtaatgtcctatatattaaaaaaataaattatattagtgttatgggctgaatggagtccccccaccttagtcaaattagtatgttgaagtcctaacctaatatgactgtgtttggagacagtatcttcagggaggtaattaaggttaaatgaggtcataagagtgggggctctaatctgaaaaactgttttccttataaaaagaggaagggacatcagggctctcttcctctgtgcatgcacactgagtaaaggccatgtgaggacgcactgagaaggtggctgtctgcaagccaggaagagaggcctcaccagaaaccaaccctcaacagtaccttgaccatggacgttcagcctccagagtcgtgagaaaataaatatgtgttgtttaagctacccaatctgtagtattttgttctggcatcttgaacagactaagataattagccagaatggagaaaaaaaactaaaactaaatgccaaaaaaaaaaaaccccacaaatggatgcaaatgaatttcaaatgtatcatgcattacataatcacactaaaggtggaaaaaagaactaatggaagtacggtaatttctagatacagtatttggctatattcattaagtctaagggaaaaagaactgaaaagtcttgaatatttcttggtagctttgttttttataatggcatgggtaagtattatagaattatacaagtaagtaaattttttaatctatttgtaaaataggtgtttcacctatttgtataatagggggagacaaatttcttactttgaaagaagaatacatgtatggaatggggcaagcagggaaaaatcccgtggagttgggctggaagtggaggtctcagtacaaacttgtgtgtgtgtattagctctgtcatcaagatggcagggaaacaaggtgaccccaatggcaaagagcacattgagtccccatagttttttgttttttttgttttttttgtttttttgagacagagtcttgctctgtagcccagactggagtgcagtggcatgatcttggctcactgcaagctcctcctcctgggttcatgccattctcctgcctcagcctcctgagtagctgggactacaggcacccaccgccacgcctggctcatttttttgtatttttagtagagacgggatttcactgtgttagccaggatggtctcaatctcctgacctcatgatccgcctgcctcggcctcccaaactgctgggattacaggcgtgaaccaccgtgcccggccccatagtttggtttctaaacaccattccctactaacaagaacctgggctccttggggaaatgaattcagggctgaggcagggaaagtacaagatgaacgtaggacatatttttgtatcgaaaagtaaaacattactcaaaaaacaatgaaggtatgttaaaatgacacagcaacaagttaatgggctttgacttgtcaaatctaggacaatttgagcatcaaaataattaaggacgggaggccaggagttcaaggccagcctgggcaacacaggcagacccggtctctataaaaagttaagctgggtgtggtggcatgcctgtgtagtctcagctactcaagaagctgaggcaagagggtcacttgaacccaagagttggaggctacagtgagccatgatcacacctctacactccagcctcagtcacagaaagaggccctgtctccaaaaaaaaattaaacaagtaaatagagtgatgaactacaaaaataggactccatgattctacactgataatatcagataaataaatgttttttaagttttttgtgaacataatcacatgtacataaaattattatatacctatttggtataaatatttataaatatatacatataaagagagtaagaaaggaatggctattgcttttttgttttttagagtattttttttgagacagagtcttactttgtcacccaggctggagtgcagtggcttactgcaacctccgcctcctaggttcaagggattctattgcctcagcctcctgagtagctgggattacggtgtgcaccaccatgcccagctaatttttttgtacttttagcagagacagggttttgccatgttggccaggctggtctcaaactcctggtctcaagtgatccgcctgccttggaggaatggctattccttacagcaaagtgccaactgatgatttggatgaattggtgaactagaaaaaccagtattttgtaaacattatagtaaagattgggtcagtcaagaatcatcaatggataacaaatctaggcagaaaggaaatttaaggaggagtaggagatttatatgactttacaacatctcccacatgttatatattagttacaaggtgaagaagtaattactacacaagagacccagacaacaccttgacccagtgatcaaaatggacatcaccactgagaggcgacgggcattaaatacctccagacatgaaactcagaaggctacggtatcatgaagaaacatcagacaaaccaaatttaggaataccctatagataattgtcacaaatgtcaatgtcatgaaagataaaggctgagaacttttccagattaaaagaggctagagaggtgtgatgcataaatgtcttacacagtcatggactgggctttgcattagagaaaaaaagacttccatggaagacattatcggaataattgacacaatcagagtaggcacggcaaattagactaaagtattatatccatgttaaatttcctgaatttgatagctccattgacattacataaaaaaaaatcctgttcttagggaaaatgctctaaagtatcaaggggtaagggaacgatacaatcaatctactgtcaactggctcaaaacattagtaataataataataatgtatatttgttagaaagagagagaatgggctgggtgcggtggctcatgcctacaatcccagcactttgggaggctgaggcggatggatcacttgagctcaggagttcgagaccagcctggccaacatggtgaaatcctgtctctactaaaaacataaaaattagctgggcatggtggtgcgtgcttgtaatcccagctacttgggaggctgacacaggagaatcatttgaacctaggaggcagaggttgcagtgagccgagatcgccccactgtactccagcctgggtgacagagcaagactccgtctcaaaaaagtagatatttatgggtgcctcactttcctggaatctcaagctggatttacttgctgagtaattcaccactgctgcacagttaataataaacagtggctgaaccacctggatgagtgtccctacgcctgggccagggctggaggggtgctgggcccaagcatatgccaggcctgggagcctgtgcagagggtatttggtgctccttgccctgaggagtcctggatgggtggtggttatgacttccctctccaggacccagacatcctactcctaaagccagtctgtaaagagcagagcatctcaggagactgcgggaggctcctagttgctctgggggaattggcactctaaaagtattgattatgtcatagtttcaaattctttcagatgcttctctgttcaccctcgatttcattatctgtagagtgaggctaaaaattgtacttatttcatggaatgtgtaagatgcagcatagatggcgcactaagctgagctcctggtgcgtgaaaagccctgaagaatgatgaggtgttagtgtcatgacttccggaataccttgacaagctgtggaatgcaaagtcaaggcctttagatcaaacatttttacacttgatgcactttcttactttttttccttcgtggtgggatatggattttccagagctgtttttggcttagagtcaaacaagtaccaactctgatatttattaactgtgacagaatgacagttagggatattcacacaggatgtcttttattgcagaagatgttgtctaggtggcccccacagccttcatctctgagatgatgttacagctccaaatactcagtccccaatgtcattatctcctagctataattacatgtgtgtgtgcacatatatatatatatatggagatctccagatatacatgaatatatatatacataccccatatatgtgtcgaatatatagatagatagatagatagattctctatggcttctttgattatgcacaaggttcttccaccatctttgtccaacatcaagccaaatacgtcactatcccccacactacctgaaacgtaaccctatcctggaatccaaacacagttctcactttcgctgaccctattcctcttcacttttcttcttatggtttggcaggcatgcctgggttcctgcattcagccatcctgtataactgttagaaatggagctttgtgtctgcttacctcaggagagactttggaaggctgtaggatgcaaagctggagtgctaagaaacaaagaaggtgagacagttcagcgtgtctactgattagctgggggctccaataacagctgtagtgctaccaccctattatgcataaatttaactccctgagtttcttctttcttttctacaacggggcagtccttgatccatcaaaacatgtccaaaccgcccattcttagtgaagactgacactacaacataatgcattcccaacctgacctgggctgtcacctgctggaggctctgatggtgacttacctccatccagtagtgccaggaaggccaggatgaggaagggtgcagacttcccaacaaactcgtacattacacttccaaagggagctcccactggagaggcataggagacacagattccagaggtgagggtgagtcctttgcagtgagaattatccatatttaccccgtgagcatttgcagaaggcctgctaggggctaagctccacctgaggctctgggaattcagagatggagacatgatccctgtccccatcaagcccactttctagtggaggaagtgtgtgtgtgtgtgtgtgtgtgcgcgcgcgtgtgtgtatgtatgtgtgtgtgtgtgtagggagggacacagataattaaagcatggtgaaagtttgacagtaaaatgttgcatgcaatgaaagcacagtcaatgtctcaggaatttcaggcagccacgagggctttgccaagtgtagagtatctggaggggaagaagcttgtgtgaagaacacagaggtgtcagaaaagagtgtgtagttggagaagaaaaagaagaaagcgggtgttagcagagtatgaatatttgcgaggagaaaagtagagccttgcatatgcaggaaccttgtatatgcagatgagtcatgtacttggccttgcggcctatggagaaacatcaggtgagaaacatcacctgctctgggctcaggaagattgttcaggcagcatcgtggtggaaggagggagtacacaagagggaggatgctgccagattctaacccagaagtgacaaggagccaggagtggctgttgaggatctaacaagcttgttcatttgggagcttattcatttgggacatgataaaggatttcaagatgcacagggtttagcttgggcatttgggttgatggatactagcaaataacagggattctgtttcctctgcttcccatggggctagagggtggggcataggccggggaagaaatttcaggtgttttgttttcgatgagcttgtaagctcctagagggcaggaactatgcctggggcttcccaccctacagtactggcactgtgcttggcatgtaataagtgaaagcatgtagcttgtcaattaagttgtatgagggaggagcctcaaagaaagggtagttttatcgtttggggcttgggtttccaagcccagaaaatcggagtctgtatcctggctgtggcgtttcctagctgtgtgatgttggatggtgttttcgccattcttattttcatctctataatggggaaaatcattcctcctttcattcctggtggtgaggaataaaagagattatgcgtgtaacagatttagcagagcatctggcagcagccatgctctggtgctgtgtgcatgggaaccgaggcgaagcagtggcctctaaatcggggaggctcacttcctccaacaggctgggcttccggacctttctccgacgtttatgtgtttcccagcttcttaaggagaaggaaatttaaccttttctcagtgatatttctaaaggagttgaaataggatgaggccaacaagggaaggaaaatactcgtcttctacacctcgggaacacctgcttcctagagtcccaccctcccgaacccagagctccagctggtgccacttacccagcaaccccaaggccaggccccccagagcagttcccatggctcgtcctctctcatggtcatcagtgtagacactggccagcattccaagacctgcgcagagagttacagatgcagctggccccctggggggcttctatccgcctctcagagcccttggtcccaccctgttatctcttcagtgacaatcttagctagagtttcagtttgaggggttttacaaaacttaacccgtagtatttttcaagtactaccctccctagtcccccaagcccccacattgtccactcctgttcagaatattgttgatagtgcaagccctctggaaggataacacagaaaatccattgtctgattataccatgtttcataacattttatcatttcctagcacatttcccaaaatgaggggttacagagcagatcagggaaaggaaaatctaggcacacagagaccattctatttaacaggggtgcccagggaagagcaggaaagcactgcagacctggaagaaagtgtgggctagtgctgtacggcagctggaccctctggccttcatagctatgggtaaaatggcataaaatgccaacttcataagattgcattagatattatattcaccagtactttgaaaactgtgctggtgttaccagtagtactaacatgattattcctataaagtactaagagggggacagaaaaaggaccatagagtggcactaaatgaaagcctgcccttcttcatagcttcactggaggcttgctctgacctgagctagctgcatctgaatattagcagaggaagttatgtcaggctcagagatctatggaccctgttagaaactctgtaattcctttctttttttttttttttttttgagttagggtctagctctgtcacccaggctgaagtgcagaggcacaatcatggctcactgcagccttgaccacccaagctcaagccatcctcccactttagcctcccaagtagctgggaccacaggtgcacaccaccatgcctggctaacttattctctcttttttttaatagaaatagggctctcactatgttgcccaggctgcccgggttggtctcagactcctagaatcaagctatcctcctgccttggcttcccaaagtgcaggggttacaggtgtgagccactgtgcccagcccaattcccttatttctgaatcacaatttctacctatccaggtgacattttccttaatttctccatgtaaatataggatctgaggtagtaagagatgtgtgtgtgtgcatgcctgcatgtgtgtgtgcatgatgagttgccagtgttacctgcaacagatgaaaatgaagatccaatgccttgaagggttcgggccacaaagagtagagtataggtcccagaaaaagcaaacactgggcagagagaatagcaagataactgcagttagcaaattgcctttgcttccccagccgccagagaacatgcccgtgatactgcagatatgagtcttgatgcatatgtttttaataaagcatgatgactgttccctgttttttgagttgtcttttcaatctcccactcctcagttttgctatttaaatggcaagaaaactgagaaaccacagaagtataaaccgagtcaccacacagcagatggaaggctgagtctgtacatctcttgccaagaacccaacattctgtccactgaaatgagggatgtccatgaagctcagtgtcctaggctggaaactggttcttagatcatactcctggatcgtccatgtgcaaaatccagatctggtctttaccattgctgggtcccacaggatcatctggagtacagtgacagtaagtaggtgcttcgaggattataggaattgggtagaaaataatatcttgtgatacaatcagatccttttttatatcttatattgaacgatcttttaaccagacaaaatcagcaggtattaaattatactgaatgcgcagctctgctagactctgtagcaaatgcaaaataaaaataacatctagttattgtccgtgaagagaggcagtgtgttgaagatggacacccaggaaactgagatccaacaggaatatgtcatccaaaacaataagagaaatatggctctgtcctgccaggctcccagacagtcagacctaatggttatctccccttgctccctgaacatctccattatcctattcttttttcaaggttctgagatctcatattgttcaaacacacacgctttatgaacaatttgtgcagttaacgcaatcctcacagggtcctgagtcgacatacatcctcagtttacgaagaccatgggattaagagattaaagtaaagacaggcataggaaattataagagtattgataattggggaagtgataaatgtccatgaaatcttcacaattttatgttcagagattgcagtaaagacaagtgtgagaaattataaaagtattaatttggggaactaataaatgtccatgaaatcttcatgatttatgttcttctgtcatggcttcagcaggtccttccattcagggtccctgacttcccgcaacacaaaactaaatcagagggtgctggtggtcagggtagttaagtccagacatgtctcacctccaattccagaaaaatgtctcctagggtaagaataatctcctcgaagtgtctgaatcagaagaattgtaatccctttgcccattcattacagatgtctttggttgtgtttttaatcttctcccattacttcccggcagacatgatcacaccgaacttctccttgtctcccaaagatgcacattcttggtctcttctttcctggccaccagcatcttttctcagactttgttatttccagtcttttctgtctactctcccaatgtcctttgagaatagagtgacccactcatcttggtctgcccagaacttccttgtttttaaaactgaaactcaaaataccccacaaaaacaggaagtcttacatcctgggaagcccctcactacagtgtggacatgggttgtttgtccccaccaaatctcatgttgaaatttgatccccggtgttggagatggggcccagtggaaggtgtttgggttatggggaaggatccctcatgaatactttaatgtcttcctttggtggtgagtgagttctcactctacagttctctcaagagctgctggttaaaaaaaggctggcacctccctctcctctctctttcttcctctctcatctctgcacagccagctccccttcaccttccaccatgagtggaagctccctgaggcccgcaccagaagcagatgctggtgtcatgcttcttgtagagcctgcagaaccatgagccaacaaacctctttctaatataaatgacccagcctcaggtactcctttatagcaatgctaaatggactaagacacccctcaattctaggcaaaccaggagagttggtcattctatttaggaataccaaagcaattatttttttcactttggaccctttacatgggccaccatttcactcttgattacattaggcatggctcctagttggggggtggagggtttaagggtagtaacgggcatcaacaatctcttttaagtattttttagaacattggacaaggataccctaaacatcaaatgtattttcttttggttagaattaggccaactccatatagcaacacagctatcctatggaaataataattatttaacatatatagtttggtataagttaaacaataattacttaacatatacagtttactttaaaagtaaagcttttaacacatgaattcttggcagagaatcaggcaaggatatcatgctaaaacgtctcagatccactagcacaccgcattgtcttacttctcagtgtgtgtctcatgtctccccaggcaaccatcatatacacttctgatagctggaatcatgtcttttcattctttatgtgactatggccatctgggcattatacatgcactgcataaagttgtttggaataaatcttaagcctcatttgatgaaatagggcacctggcatcttattatttttaaatttgctgtctaacttaggctgaactgctagaagttccatgaacagtgctaatttgaatttcttcattttcttcaagtccactaaaatttcacaaacaagacgtagttctcagagacaacctcacatctcaagttcttgcagtttgcagccttccagcccagaatgcaacaaattcttgttaaatattgggttgctaggaatcaagttctgtgctgggaaagaagaaaagttgaggaagaggaagacagaaagtagacaaggaacagaaaggtaataagaaaaatgagaggcatgttctcactcataggtgggaattgaacagagaacacatggacaccggaaggggaacttcacacaccggggcctgtcatggagtcgggggagaggggagggatagcattaggagatatacctaatgtaaatgatgagttaatgggtgcagtactccaacatggcacatgtatacatacgtaacaaacctgcacgttgtgcacgtgtaccctagaacttaaagtataattaaaaagaaaagaaaagaaaagaaaaacgcgagggagaaggaggtgtgttgttggagagcagaggttcagcagggccatcgggaaccaaggctggatccacaggctgccttcccctgccttaacctgctaacgctaacccttttcattccttcttcctttacttctcagcatcaatttccagacttacttttctcatgtactgtgtttatcccatctccattttattagaaacatttagctgatcctggatagagtatttgtctttctctttcttgtttctttagcaaatttacttttctaagcttaacctttaaagcccttaactgaaaagcagtaggctttttggaattttccagatgttattgtccaatttccatttttttgtgagttgcccttttccatggcataacaaaataatatcattgcttctcatagatggaaagtttgtattaaacttgctcaagggattactgatgcatataacacacacacacacacacacacacacacaccccgtagcatacatattcaaacagctctcattatgtccagctgaagtgaagtgaataaaatatctgttcttctatagcagaatagaccaattccaactagactgaattgtcactactgttctagtccacataccaaaaacagcagagcatttaaaccaatattccagtctgcttagtcagatgcctaattacattctaggttaccctgctatctacaccgcattcacttgataaaatcaaaggtaatcagtgaagggaagaaaagaggaagcaaattacttactaactgtggagagaaacatgataacaaagccagcaaacatggggatatgatatccaatcctaaaagggaattgaaaaaaaaaaagatacaattccaacaggcactcacatacatggactacatttttaaatgtaagtgggagcagaaatgcagctatttgggtgtatggtaaaacatgcctctgaatgtagtgtggagatgaaatagggcatgtggatgagtatgagcaaacaaacaaacatgcagatatgaccatagatcagggccaaaattctcatttccagaaatgatagcctaggtggagtgtatatctcttgaaaatatcagaataatcgtcaatacaactcctgggaagccagtgctctagattacaacaggactgtcccattcatacccttttcccattcaagccatgctccaggtcactgatagaacatcacagcacactgctgttcatggttctcttcttggtactcaatactcaatatatcactaagaaaatctgatcccataacatttcatcagtaacatgttattctttgagtaacgagctttccgaatagctgactcccctgaggaatcatacaagtgagtatttcttctttttcccttccaaccccctttctatacttttctagtcctcctactcctgtgtaccctgcggggcactgcacccagtgagatacctgttggtgagagggcccacgaatgggttgaccagaagttgcatcacagcctttgaagcaaacagaaccccgacccgggtaatctcttcctccaagaaacctgtgccttgcaagcagttgtttttatgagctgagatggcttcagtggctggaggtgggatggtgctggcagtgtcattcatccatgctattccactaggtacgctttcttcaacagccacggtgttgttgttgaagaaggagaagatggtggaaaaggcaggagaggcgagggcatgtggggaacttccggcatggccgaggtgcagagaagagttgacttctttgaactccatgtcatataggaaggtgggcacaattggcactgaaagtcaaagaggacaggtgatgggggctaaggaccgatgtcatcttaccactgaaactcaaggggctaaggacagatgtcaattctactgaaagtcaaggaggacaggtgatgggggctaaggacagatgtcatcttaccactactaggatcaggggactatgatgaggttcagccttatgcccaaggctggtatctggagtggcatggttaaaacctactaaaagactgtgcctgcccaagttatcctattagctaaagtagctaaattctgaccttatacagttagtcctcattgttcatggtttccacattggctaactctcctactcacttagattgacatgtaaccccccaaaccaacacacactgagctaccacgacatttcacagacatgtccagctctcacacagacctggccacaggaggggatgggaggaggaagggcagggtggtcagaggagcctcagctctgggacccctggacagggtttgaatcccaactctggcacctgctagtggagaggccttgggcaagtcacttaacacttctgaacttctttttctcttttataaagaaaacacgatgtaccacgatgtttaagatttaagattataattgtgtgtgtgtgtgtgtgtgtgtgtgtgtgtgtgtttccctgggagcaatgattcagtattcactaattcagtgtttgcagcgactttatagagcataactataactacagaactatgaataatgagaagtgattgtattggattaacaacttgtctcagaaagatccttttttaaaaacatatgttttacccaagaggagaaaccttttagtgcccatttatacaagggtgtaacttaatgtaatgattaggagagtatcaactaaaaaaagcaggattctgagggaaagaaccacaaggaaggcaaggtcttgatactaaatcagatatccaaataaaatatgctgtttttatagagcagagtccagaaaggcacccctgtgagaagatctcgctgcctcagaggcacttggagtcattagcaccttgagaagacagtgtggggagaaagaaaagcacagccagttctggctccgggccatcctcttctccagtcagaccctctctggacctcctgctctttgaacctcctgagtcttttagctgtgtttgacaagtgtcagactccattttctgcagggcttttttccagtccccaacaacctctgtgtgtttttgagcataaaaaggaaaattctcagatggattcactgttgaactcaagcagggtgtacactgcctgctggggcccacagcaaattaaccctcagcacaaagacccacaaacgtacccaccacagtaaacagcatgttgtccaggagcaaagcgacgaataccaccaccagcaccagctgccgggacgctctcccctccttcagcaaccgctggggagcatccagaatggtccggagcatggtgatggccggactggggcagtcttcccctgcgggctcttagggaaggtcctgtgacagctacaggtctcctgcagcctttatggaagaggggagggagtctgcccagacgaaggaaactcactattaaaacgaaaagtgcaaagggttgcaagtagtaggatgatatttggaaacatctccatgtctgtatcactgttcacttcttataaatctcaataactctacctggttcccagaatgccttcctggtaagcatcgcttactagctatttatgtctggatttatatctagccattaatttcccttgaatttaatggctaggtataaatccagataaaaatagatgctctacagatcacttaaccctgtgtttttcaaacatccgacatttatttgcctatcaccttgatggtttatgtcatatctaaggactacctgtactatcatttacttcatctttttcctctagatccactcttttaaaatattgagatactgccaggtatggtgggatgtgcctggagtctcagttacttgggaggctgaggtgggaggatatcttgagcccaggagtttgagtccagcctggactacatagcaagacccctaactctcaaaaaatttttaaaaccaacatagatattgatatcatgtttcaaaaagttattttatgtggcatgcaaaaaaagtatgacctttgttctaggtgctaccccaaaatatttcatgtggcacagtgtcacttgggctgcccactgagaaacactgatgtagaccaaccttcatctcatagacaagaaatccgagcctctgaaggttaggagatttgtttggggttgcacagttagtgtcaaactgggatgaaatcccacgcttttcaacttgccagcttatcctctaccatgttcccttgctctgtggttctagaagcacgctcattcttttgtttgagctacaaacccctgatcagaaagatgccttcatctgtgaaaataaaatattgactttcatgattagttctctattcaggatttcatatcattagtcagcattaagtcacagtaccttgtcaaacttcaagtaataagagtttctggggagaatttcattttctttgacgtggcttctgttgtggtatcaacaatatcactcatttaaattttaaaatagattaccatcatgaaatctatcaggccctaaaaattgtatactctttgacttagtaactctactacaaggaacccatcctacaaaagaaaaaaggtcagagatgcagccaaagacttatactcaaaatgatcaattgcagaattatttttcttagtgaaaaaagtcaaacatgttaatggtggattattaagcggctcttaaaaattatattttcaaataattttaatgatacagaaaatactattactataacgttaagtaaaaaagggaaattaaactgtgttttcaactttatctcaattgtctaaatataaatatatgggcacatttttgagagagtagagagatactcaaatgccagttatttataatcaatgacttcagttatcttctgtgtatttctaaatattcaataatgagctacttttgtaattaaagaagtaaataattttaaatgattatcactgaaattcaatagtcagcctcaggtgttgggagtaccccaaacactgaggtactctgttctaagcccagggctggaagaaccctctcactactacatattaacgtgaccaaggtcctaagtgaaccaaattctcagttaagttttaaccagtaaatgcatgcaattacttaagatccttcatttctctatataaaggaggtatttctgaatacaaattgacttaggatatgtatggataagaataaaagacaagccatggaaaattaaaaaacatagtgagtgaagtaagtactacaaagagagagaaacacacacacccaaatcccaaaacaaaaacaaacaaaaccaggaatttgccaacaaatcaatagtaaactttacttaacagtcaaaatcctctgacagagacacaaatcacaaggaaagattaaatttgtccggagagagaaaaatcttaccttggagcccatgttggtgtgaggcactcagtgaggtattggcagctgttagcaagacagcagggacactgttctctgaacgtggatgtgctgttggatttattgcctcctgttatctgaggattctgtgtatgtgtgtgtgtgtgtgcctttgtccacaaagatttaattgcaacctccaacagggttcattcagacccttagctccctgcgtcaaaggcaggaaggcagggctggagaggataaagagagggcagatattagcctaagcaaagaggcactggactgtactgttttgcatctgtgcttatctatcatcgaactctttaactcttgcctgggtctgaatacaaattggaagccaagatggaaccagtgtgcagttcctgttccttgctacttagtcaaagtggctccatgtaccccaattagcttcctggaaagaaacaatgtatgttgttctcaagccataaaaacccaacatctgtggcctctgtaaaggcttagattatgcactgtgtcttcacatctcaatactggctcagtgcctgatacatggtagcatccaataaatatttcttgcatggatgactggatggttaactacaggagaaagtgcagttccttgtgggatcttgagaggctctaatgatctatattattctgacattaaaccattggtggctcaaagaacataagcaatttatgaaaaagcaaatacactttacgagcaagagcagtgcagagatttcctatttgtggaactggtgggcccctcctaattgtgggaattaactagggaactttcgatttaacgctaaaaaaaaagaaaatagttttttaattttattttttttatttttgagacagagtctcgctatgtcacccaggctagagtgcagtggcatgatcttggctcactgcaacctccaccacctgggttcaagcaatcctctaatctcaacctcctgagtagctgggattacaggtgcatgccaccatgctcagctaatttttgtattttcagtagagacagggtttcaccatgttggccaggctggtctcgaagtcctgacctcaagtgatcctcctgccttggcctctcaaagtgctggaattacagacgcgagccacagcgcgcggcctagatggaaacagttttaaaatgtaaacctagagcgagaaatagggataggaaacaaagacatcagcagaatgtattcatcgctatagtttgctgctgtaacaaattactacaatctggtggcttaaaacaacacgtatttagtatcttgcagttctggaggtcagaagtccaaaatacatcacaccgggttaaaatgaatgtgtcggcagggctgcattccttctggagattctgggggatggttgtttccttgccttttccagcttccagagatctcctgcatttcttggctcctagccacttttaccctcaaagctagcagcaatgcatattcaactctccctctgactctgagccttctgcctccctctttcacttgtaaggactcacgggatgaccctgggcccacccagatattccaagatcacctccccatctcaagatccttaatcatatctgcaaagtcccttttaccataggggactaccaaggcaacatactcacaggttccaggattaggaggtggacatctctggggtgccactgtccactccctacagggagcatggcacactgccccccacttacatgcagggcctgtggcctgagcctctagggaatgagggggttagggccaaaagatggaggaactgtattaataaagatatttgcaagactctgggcataaggcagtatcctttttggagtccaggtgacaattctgccaccatgccctccaccctaagtacagtgttagaactctgagggttgacagcctccggcatagtgtacctgtgtccaatagagggcgctagagggagagggcttgggtagagcagcctcacaggaatgttccgagacagcacctaactggggatgccccccaaaaattgggaaatcatgattttgggaaattgagggcctgggaaagcaggtatagactaagaatcatcacatgttgggcaataataagaataacagcaacaataacagtagctatcatttatggattacgtactatttgggcatgtttctaatacatactcatatattatagggataatacatattagatcaaatagatatattttttcagtttactgtaaccatgctagtattcacaggctggccaagtctggggtctcctcacaaatgcccatcactattaataatcaaattgttgtccattaaaaatgaatgagcactcaacttcctccctttaatcatagaataaaaaaaaaaactgtgagtactgtggaatggaaattcacatacactgttagtagctagggaaataccattcttttagaaagcaatgcggctttctatcttttatcttttaagttataaaatgtatgttgcttttgacccagtaatttcacttccttggaatctatctaaaaaggtatgctaaaatatgggggaagggagggaaatcataggtacaaaatttttgtcataggatttagagaaaaactacaaacatctcaaatgtccaactgtagaaattatttaagtgcatgagcttgaaggactgtcatgtggcccttaaaacagatgtaaaaaaaggttatgatgaagactatatatcaaactggaaaaaactgtatatataaaaataaatatataatttatatttatagattacatatataacctgtaatttatatttatagattacgtatataacatgtaatttatatttatagattacatatacaacatgtaatttatattctataatatgttatacataatatatttaatttatattatatgtatatacacacagatattatgacagaaagtaaaaaggtagaatataaaactttttgtaaattggggctgggcgtggtggctcatgcctgtaatcccaccactttgggaggctgaggcaggtggattacttgaggtcaggagttcaagacccgcctggccaacatgacaaaatcttgtctctactaaaaatacaaaagttagccaggcgtggtgctgcacacctgtagtcccaactacttgaggggctgaggcacaagaatcacttgaacacggaggcagacgttgcagtaagccaagatcgctccactgcactccagcctatgcgatagagtgagactctgtctcaaaaaaaaaccaacaaaaaaacctttatgtaaattcacggtagcattatgcacaatagctaaaaggtgaaagcaacctacatgtccctcaatggatgaataaaggaaattatgacccatgctataacacggatgaatcttgaggacattatgctaagtgaaataagccagtcaccacaggacaaatactatgtaattccatttatatgatgtaagtataacagtcaatttcatagaaatagaaaatatgatggtggtttccagggtctgagggaagagggaaatgggaagtgattgtttaataggtgtagagtttcagttttgcaagatgaaaacttctggagattggtcagttgcacaataaggtgggtatagttaacacgactgaaccatacacttaaaaatggttaaaatggtaaattttatgtcatgtatattttgccacaattaaaaacataaaaacaacactttatgtacattgtgattatgtaagtggttaggcccaatggcaaagttgtggaagattcttgatttattatttaaataatagtgaacaaaacttaaaaatgaagcattgccagtaaaaagtaacagctcagtctatactagtggactccgagcccttgcaaagaactaataatttctagccagagcatcctgttgagaactctctgagactgaaattgaagtttgaggctctttgatagtggctctgttatctttctagttaaagtggttggcatacaacatcctcagacggacagctttttctccgggccaaataatatctattacccaattacatgtaccctgggctgtggctgacatggcctggcagaggagacggccctgtgactcagagctggagggtgcttttgtttctcattgcttcctgtttcctgtgctgttcaaacattttaacaatcagttccaacttcttccattcagcatatgtcattatcccagcctcagattggaggctgactttggttcagaagtcacaggcttctgaaaacaaagccaaagaggaatcagggctgatactttacggccatgatctacagggcactgtggaccctgtaggagtggatatgtgtccataaagatagggaactgcgtgtctgtaaacatgcaagggaagtgctggtttcagatccaagggaataggaggctctaaaaaagtaaaatcaacatcagctggaaccccattgaacagttctattgtagggacagcggtagcaaactcagcaacaaataagtgataggaaaattcagttaggaaaattcaggccctacccccaaccaaccaccaaaactggcatcccttcacaacatcaaaaatatttggaaaataaaacaataaaaaataacaatacaggctgggtgtggtggctgacatctataatcccagtgctttgggaggccaaagcaggaggactgcttgagcccaggaggtcgaggctacagtgagccatgatcgcgccactgcactcctgggtgacagagtgagacccatgtctcaaaacaacaacaacaacaaaaatccaatcaaccaaccaacaaacaaacaaaaaaaaaccaatgcaaccataaaaaataacacaagtaaaaaacaaataaagtacgataactacttctatagcatttaccttgtatcaggtattaagagtaatccagagatgacttaaagtatacaagaggatgcacataggttatgtgcaaataccacaccattttatatcagagacttgagcattcatggattttggtttctgcaggaggtcctggaaccaatgccccacagatactgagagatgattacataccatttcaaaaaccctctttaactatccagtgtcagcctggccactttccccgattgtcaggatggattaactgcctagtttgactcaaacctgctttgcatggaaaatgcagccacagttacatcgactggccagaacttctgcctccttccctttgtttcatcttggagctatgcaggagatgcttaagaagtagactggccagatccagaagcagagatatcaagttctatgacacgtgggagatattgccctggattatggttatctgtctctagagcctaaactttaagggcaggggttttatcctacccgtcttggtattccacccatcaccaagcatctggcccaggagaggtgatcaataactattgatggttgttgttggtaatgatgaggaggagtcattctcgcctctctgagcatcacataagactggcaaggtattggaagctttgaaggagacatgcacctcccagagccctggtgcttcagaatgggaataaggacattccagctttcacttgcaattcagctctcaaccccatctgtccttgattgtgtgcgcagaatttcacaggcagagctgacgcgtttaaaatccaccacagattcttgagatattagcgttggcaatggctccttgttaagtttaatttatatgcaaggtatagaaaaatatctaccatccccaaaatcattgtgggtgaccagggagtctatggaaatatccataatttcaatggagcaggaaggaccagtgttaatatctcttagagacaagtgccgtgttttctacaaatatctttttagaaatactaggacacagaaaagaagcatctgaatgatcagtttcagtcctgggtctgccattcacttagctgtgagactttagacacactacctgatttcttagtacttccatttgctgacttagagcattcttgtgaagattcgagaaaataaatgaacaataaacacttagaagagtgcctggcacacagtaggcacataatatttatcctatacacttacttagtggaaaaacagtaaaccactaactctgctctcactgaactcttctttttgttgagggaatttctaaacattaagttccctaaaataaattcctcttctaaatgcagcattcaccgtgaactgcctcagaactcttatctcatgctaaccatgagaatgcataaaccttgctcaagacttacttccacccaacatagttcctcaaaatcaaatccttcccaagttatgtctaattgaaaaaacccacctcccctccccagcgcccctgtggagaaccacctgacctaagccactactctctgacctttctcttatcaggtaggcaacccagcatgctcttccacagtgttttggatgaaaaatcatgtgtgttaatcttctctacaattcagcctttagctgctttgaaataatgtattacatagtaatgtcgcctttgctttaaagatgcaacccaagcccagaggcacagaaccaattaggagcaaacctgaggctgctccttcaactctcagtccaatgtactcaccactgagagcagaaacatatcctacggtccttctgtggttctgcggttttcaacaccacgttgagttcatgagcagtgctcacttggtatgtacttgctgatagaaaatgtcattcaagtactttgacttctctgatgaacacatcataaataagccaagaattaaggccttttctggcaatggtcagattcagactttgagacagtgctgccacattgccatgacaactggtggaaatgatccaaattagaatatgtccctaaaatttttccagatactgtccgatgttatcagtccagttggtccccaggtgatctttgacacagaaaagaggcttcaggcagatgccaggtcagatcctgggtcttagatttttatttcagaggagcagacacccacaactgtcttagaactaatttggttttccgaagttcccttagatggggttagaataaaccctccactattactctgcatcagaaaggatctctcagacttacccagatttgtaaacaagcaacagagccaaactaggtggcttcagaggccaggtagtaaaaaaggaacgactgtctagaaagcttagactgctggtatctcacttccagaacttaggaaaatcactttacttccctaagattcagtttcctcatctgtaaattagggagttaagtctagctgagtgctaagatctattctagattttacaatcattctggtcttagaagtaaaacaatgaattctcatctaacgttgactctatgtcatccgttactaacccctttgacctgatttctatcaggtctctctaatatagaacttttaacatacctgattgcatgcttgttttaccactagccataaaacctgctccctgttaaagtgaaaattataccattttaaacagaagcaccttattatttctcaccgtacttttgattcaaaagcataatgaatgttcatgccaaaaatgtgacaaaataaaaaagaaagcaaaacatctcataactcagagtagtcactgttaatatcagtatatatttctttacaatattttccaagtgtatgtgtgcacaaatagataatacaaatcatatagtgtatgccacttcatatagaatgctgtactcagcactgtgttatgaaaattttcccaggcttccatcttaatgtctgaataatttttcatcaaatcaaagtatctgattcctttttgttggaacatttgggatgtgagaagactctcatgatctggcaacaaaagagggtctttgacaaaggatacttggagtttcaaggacaggtgtccccttttcagacagccaggcgacaggaaagcagtactcggtaagagaccttccatccatcagcttcttggtctgtatatttaaacatttgcatcaccttcttaagtagccattgttctgatcatagggcaccctctgctctttcccctctattggacaacacatctgtgaccccagtgacaaggaaagtaatatgggatatggaagaaaaccagagatctcagttttaggaggtcaaagtacagtttccagcctatacacctcactctgcctcagatggtcagaatttaaaaacagccaacacagccaggtgcggtgactcacgtctgtattcccagcactttgggaggctgaggtgggtggatcacctgagatcagcatttggagaccagcctggccaacagggagaaaccctgtctctaccaaaaatacaaaaattagctgggtgtggtggtgggcacctataatcccagctactaaggagactgaagcatgacaatcgcttgaacccgggaggtggaggttgcagtgagctgagatcatgccactgcactccagcctgggcgacagagcaagactctgactgaaaaaaacaaacaaaaaaaacaaaaacaaaagcaaaaaaaaccaataataaaatatataaataattaattagcttcctctcccatcttatgctgaaaatgttgtactgatgattttatattggtatatgccttgctacatagaaacacataggtctgtttatttaatctgttgtggtttgtcttcatagtattttccttgattagaattttccagcaaataaagagagatacacattatctggaaaaaaatcagtcactggcatgagattttcttacccctttcttctctatttttcttccccaataatcatttgtaataaaagaataagagtttgcctttctatctaagatgttgatttctggaagcttctttttaaattcttgagaagccggcatgacatgaaatcttcccaactcacagatggagattcaaagacagaaggagttgaggattggcccaaggttacactgtgcataaggagacagtcagcactgaaactgggctggtgattctgagtctcatgttttgaccacattccctactgctggggaattcctgggatttttgcattccttggaagtaaaacaaggatatggtttcagcaaataacaggaggacaatagccagtatacaatatctgtaggatgactcttccttggcggggggcggggaaccctccgtatggaagaataagattggtggacaactgttcatttttaagaaaaaagcaacacattttcatttatctaatagatatttactaagtactatgtgtaagttaccttgctaggtactttagatagaagacaagaaaatgataagatacagtcgctgcttaatacaaactactcaactagtccaggagccatatcatttctttcttagaaaagagcctgacacagccaggcatggtggctcacacctgtaattccagcactttgggaggctgaggtgagcggatcgcgaggtcaggagttcaagaccagcctggccaacatggtgaaaccccgtctctactaaaaatacaaaaattagctgggtggtggcaggcacctgtaatcccagttactcggcaggctgaggcaggaaaatcgcttgaacccaggaggcgcagatggcagtgagccgagatcatgccattgtactccaccctggctgacaagagcaagaatacgtctaaaaaaaaaaaaaaaaaaaagaagagcctgacacatattaattaacacataaatattctgttaatcaataaatcaaagcatgtaataataatgttagctaagccatatctagcctttgctatttgccaaatactttgcattatctcttttaatacaataattttatgaagataatattattctcattttataaactagaaaagtgaggattagagagaataaattttgttcaaagtcatagaactaatcaactcaggacttaaactaagtctgtctgacctcagagtccatgccccaagcccctgatagaagaaaaacttcagctgaattaaatttaaaggtgtttaattgagcagtgaatgatttgtgaatcaggcagcccccagaatcacagcagattcagagag

SEQ ID NO: 1178 - DNA, 69755 bp, Homo sapiens
aattgagaccaaatcttacaagtaccattactgttggttgcttttgccacaaacaccatttcatccctgcggtatctctagtgacttctaatgcaaaagggtgctgtggctgtggggcacctaatgcttgggcttgttttaccaacatttttgctttgtcaaatgcctcttgctctttatgtgtccagtcccattttgcatccctttttactagggtgtgtaaaggccagagggtttgtgtcaaatgagagatgaatattttccagtagcctaataaacctaggaaaacgtgaagttgctttattgtctgaggaataggctactgtgctatcttatcaataacagctctgggtatgtttcgtgtcttacccatccaggtaattcctaggaatttgatggctacactgggcccttgtatgttttgggggttgacttcccattccctgtcctttttaggctgtctaagatggtgtgcagggcagtctccagatttgtaagagattctgaggttaacattatattatcagtatggtaaaacaggaagactgaggtaggcaagaatctagacaggtcctgtgcaatcatatcatgaaagacggtggggctgcacagatattcttgtggtagcacctggaaaatccattgtttgccctcccaaatgaatgcaaactgctcctgtgaatcgtctgctaaagaaatactttaaaaggcattagccaaattaatcacagcatggacatttcccagcttaaggaccatttgctctagcagctgagcaataccgggtacagctgcaggtacggggggcatcactctgtttagctcacggcagtttactgtcattttctaggtatcatatggcttctttgcaggccacatagggctgttataggtgctctggactatttgtgccttatgtaattcctggattgttcaggtgatttcaaagcatccccctggcaggtggtattttttcgtgttaattgcctgcctataccagggcaagtgtacattcaattggctcatcccctttttgttctttgattatttcctggacttggtcctcgttttgcaacagagtctcactctgtcgccaggctggagtgcagtggcatgatttcggctcactgcaacctctgcctcccaagttcaagagcttttcttgcctcagcctcctgagtagctgggactacaggcacgcgccaccacgtccagctaatttttgtattattagtagagacgggggttcaccatgttggccaggatggtctggatctcttgacctcgtgatccgcctgcctcggcctcccaaagtgctgggattacaggcgtgagccaccgcgcccggcccagtccttgtttttatctagctcattaaggtccacaaatacctcgcccatatcataaccctttttaaactggaaatgacctagacattcaatgagtacctaaagtaattttaagattttaaactatacagaattttcacctacacacatttatctcatttacatgtactcagtttattcatttttagcagtttatctagattacttgtgagaaccaagacagtcaacaaagctaatcgtcattgcaagttatttccctgttaaccattttcatagcttgtgaatatcaggtgttcatctaagcaagagccttaaagttaaacacatggggattcctgctgataactcagaaaattcagttgttttcattaaaccaacaatatcgaattagtcttgcttatcaaaaaaatcatacagacaaagatcattttatttttggctgggtttacagtcttctaactttcatgtaaaaccctgaccctttaaagtatctagcagaggcaaatataaagtgtattttatcagaagactcagacaaaaatgtatgctgacacttttgaagatatctttatttttatttactaataatttaaaagccaacttatttagcaaagattattgaattcctgtgaacttgaaaagcatttggactttatacccatttatctataattttatttggtagcatgttagaacatataatacatgcacatatataatatatttaaacatgtatatacatacatacacaaagatctgataattttacttcagaactctagccatgagacaatataataaatttgtagtttttacaaaagacagttggacccaaattacttttgacaaaattgggacctgttatggctaagctctattttccctgataggtaatccaaggaaagctgtggatcaaaatttgggggaaagaagtttccatggcagtttgatttttaaaaacctcttttttccttttcgttttcattttattgtttacattttaactagaactggcttaattgtataagaaaaacaaaatctccaaataaccttgaattagtgttaccataaacagtgagttttatctcaacacggtggcttaataacagcagattcaaagcatgtgggaaaagaaagagagaaacagagagcatatgaagatgctatttaactctatagttgcagcttaaccatttgagctcttttttgttgttgttgttgttatttgcccatcagttttagaacgtgcacaagaataggccatcatatgtaacctgctggtgtcctagaaaacctggcatgcctttcaccttctgcaggagtttttaccctttctccctttcctgctctcatgatttctcagtagctacccttattgcaacaatagcacatttattatctttatcgtattttaatatcttaacttcttacaataggtgattcagtttctgccagtgttttcccagagtccacggtggcctgtgaagattgagcagtcgggcaactccacgccacatgcatgttgccaaccaccctaggattctccccgcagatgcgccttcctaattcatccattggtttctcagatcctgctcatgacagcaattgtaatgagaaaaacctggaattgtatttaaaaaaaaccttaccccaaactgggagggagcaaagagaccaagcatgtctgggacaagttcagcttggctagtagatgagtttattaggacttatgcatgaggcactcctgaatggcagcaggacagctttagagatctgtgccacctcccatctctaagctaattttctgtctctttacctactatgtgtgtgtgatgggactgtttcccttggtaggttctcagctattctccaggatgtttgggttcccagggacacctattcctcagctatacaccatggccttggctcattgcctggccttcagggttcaggcagtggacatgtacccttaaacaacctggcaggggatctgtcacactacataggtagttcttaacttgtggccctatttttgtcctaaggcagcaccgggtctagccaagacgaaaatcgctgaggttggagatgaaaacaaaagcctttggttgagatggtaaaggaggccctcaagagtggtgcaatcagtgtatccagaaggcagtgctggagtcggcctcatgaactaggggggttttctcggcattgccctttttcatttcatcaagtgttttatccaggtttggcgtggcatagttctgagccagatacattccaatcacattgccaaagtaaattcaagcaggaactggagcatgatgtcggcagggaggatggggaaggcagggagggcgcaaaaggcggctgcagctcttcgggctggtctgagactctgcacttttttttttttttttgagacggagtctcgctctgtcgcccaggctggagtgcagtggcgcgatcttggctcattgcaacctctgcctcccgggtttaagcaattctctgcctcagcctcccaagtagctgggattacaggtgtgtgccaccacgcctggctaatttttgtatttttagtagagatgaggtttcaccatcttggccaggctggtcttgaactcctcatttcatgatccacccacctcggcctcccaaagtgctaggattacaggtgtgagccaccacatctggcctctgcactcttatattggcttcccttctttcctgttttactctccccagtcacttattcctgttcctttggatccattcccaaataaatcacctacacacaaactcttgactcaggctttgctttcaggaggaaatctgggctaagacagtcgacataagagtggtcctagaaggcagacctgcaaggaagggattcacagccgtgatagctctactttctacaatggagtcatggccctgataggaaacatatggaaccctggaacaaagaatgggaacatttgaatagattaatgtgagaattttgaattcctggattctcctaaaccttcaaggccagcagaagcagctatctttctcctgctataggagacaagcctctccttgcctggaatcctgccaagactcctcctaaggcaagggccccaacgatgatgcttattctcctccatatcccctacctcccttcattgcctgcagaccaataactagggttaggtctcagcacagcctaagtggagaaatacagtatctgatttataagcaaatagcatacacattgaaaaaattacgggacctatgttgtggcaggaacagggataacaggggtgtgaggagagggttgtaagaatgtatcaatctgggggcactctcattattcagggattaacatccaatcaaggatacataaaaccattttcacatgcttctgagatgcttctttgaaacttggacacaattacgaccttcggaaatgaagtagagatgccagaaacttccttggcagaatactgaaggagtcagaagtctcagagggattagcatgttagattgtagttattatgcaagatcagagaacctactagaagactacattcccatgggaagtccagaggccactcttttcaccgaggcaacacaacatgtaaaggtgaggaattcttagtgtcagtggggatggtaggaccctggaattgcagagactagatgggtaacaatcaacagaggcagggtagatataaaaattatcacaaaatggccaggcgcggtggctcacgcctgtaatcccagcactttgggaggccaaggcggttggatcacgaggtcaggagatcgagaccatcctggctaacacggtgaaaccccatctctactaaaaatacaaaaaattagccggacatggtcgcaggtacctgtagtcccagctactcaggaggctgaggcaggagaatggcatgaacctgggaggcggagcttgcagtgagctgagatcgcaccactgcactccaacctgggcaacagagtgagactccgtctaaaaataataataataataattaccacaaaaccaaagtggcagctaagtgctttgacccatagggtctatctatggcaatggctaatagaccatagtgtccctagagttaactaaattggcagatgactgtgtattacttgactgtaacaacagcaatccccaaaatcaagggctcatgagcagaaggcagatgacagctgccataatggaaaatagtatttcctcataaatttccttgatctaggccagttctcaggctcagagcctattgatttaaggaaaggccaagcctttttatagaagagccctccaatgctgccaaaggtatacaagataattatttccccaatctttccacatgagagatctgtggccatttatcatagtaactctggtcagggggaagaaaaagaaccagactttcaaaggctattgggtacagagtatgagctggcatcagtgctggggggaaacactatcatggtccccccgtgacagaggctcatgaaagccaggtaaatggagtactcttgcaaacagatccagaagtctgaagatccacactgtactaatttccttatccctaagtaaataactaggacagatgttctagcaactggcagtacactaacatttactccctattttattaagagccattaaggtaggaagggccaaatgaaagcccctgacacttaccctcacctttcttactgatttattaaatgagaagtaaaaccacatcctgggtggtattgcagagattaatttcaacatcaaatattttcttctcaatatccttcagtcaggaggatgaaaaactgtttgcttttatgtaggaataatagcagtacatattcactctcttgcctctgggctatgttagttctcctctctgcacaacacagtatctagcgactttgattgtctcaatattccattgaacatcatggtagtccactgtattgatgacctaatgctaatttgacctagtaagcaagaagaagcaagaactctagatgtcctagtaaagacacatgtatgccaaaggatagcagataaaaatatgaagattcaggacattcatattgttcaacttttttcttacctttttgttctagaataagttaaatggatgtaaaagtagacaaactagtaaaacgaatcccttgaaccactattcacagcccatattatttcatctatatccccaccaacttcttctatcccatattattttgaaacaaatgggtaaagttatcagggatcagtagtcatgccaggttatcccctgtaaagtaaagacaagttattgagctctgtatcctccaacactaaggcatagtgcttggtggagtattcctctgacccatctatttcgtgcccctgaaggctttcagtttcgggtgaaacccagagcaggagagagctgtacagtgtgtccaactagagtacaagcttctctaccatttggttcatattatccagcagatacaatggggctagaggcatacatgatgaataaggctacagggcagagtctctgacatgccctaataaaagagtttcagcacagatctctaaagttctggagcaaggccatgcagcagagagatattcgacttttgaaaagcagctgtttggccccaataaaaaccaagagcctagcaatgggacatcaagggtctatgcaaccagagatacccattgtaagccaggtattgtcagagtctaccaagtcgtaagattaggcaggtttaagccaggcatggtggctcacacctgtaatcccggcactttgggaggaagctgagggcagagaattacttgagcccaggaggcaacatggcaaaaccccatctctaaaaaataaagaaaaaaaaattagctgggtgtggtggtgtttgcctgtagtcccagcaacctgggaggctgaagtagaaggattgcttgagcctagggaggttgaggctgcagtgagctgtgattgtgccactgcactccagcctgggtgacagactgagaatctctctcaaaaaaaaaaaaaaaaaaaaaaaaaagcagacttatcagcaatccatcatataataatagaacaggaatggtaaattcaggatcaggactaagcaggtcaatagggtgcatgtaagtcaacaaaaggtggctcagactcctatgacacctacctcagctatcggctataccaacccttctgtcttagctcagacctacagccttagtaggtagttctctgtaaccaactgatggaggggaaaatagcccttactcacagatggattagctttagacattgatactagttaaaaaagaaaaaaagaaaaagagattgttcctgtaacatagctccatttagggggtagccctaaacaactttgaagggaaattcccccagtgggctaagctgtaagcagtatacttgttcattcattttgtatggaggacaaaacaattccagatagagatttacatacacttgtgagcaatggcaaatagtcgagtggtacctgttcagccctcacttatgtgcaatctggaagtgcaagcagttgaccaatggagacagaactaggaaacaaatacctcctcattctatatggctctttagaagcccccagtgggattaaacctcagtaacccacagcaatggggattgagacaaggctgaggtgaggaaaaagagcaaggcacttgtctctggtgcaaatttaaggaggcaccaagaaattcagtaaccaagattaattatattttaatgcaatattttttaaaatagaaattaatgcaaatacccatgatgaacgcaatatcaaaattttcaataaagacaggctcagtattgctaattttccatttattcttaggctccactagggctccacacaacactgttactgatcttggtcatcgccaataaccatctcaatttcacagtctatgttggctttacctccctctctgttcactctcctccctagtccctcacttctgttttatggtatcattactcagaataaacgaccttatatacgttcttgtctccaactttgctctattatatggggtggagtagggagatgaaacccaagctaagtaagataatgaccataatatatcattcgaagaaggatacttgtgaaagtaaagggaggctctattaataatttcactggattaataggcataaatcagagctgtcctagcacatcaggatgtatagtcttattacaggtaggaaactgaggttccaagggggtgggaagtcctcctaagaggaggggtcagactggaagctacacaaaaagaggcagaaatgtccctccgcctcttaatcggagcctggggaaacaaacacactcgtgcaaaatctccaaagaggtgagctcttcaccctgtcaattttatctgcctcgtgaaccccagggctcaggctccaggcccgggctagctcacacaacagcagaagggccttaggtctgggcactgagccaaaaaaagggaggctgtggtccctgctttggttaccctgccgggtctgagcgccaaatcggatctcctacttctctctccctccctccctctgttcctggactgggggcaggcccttctgctaacagaaagccttccagtcggagaaagctctgacagcctgccgcgataaagggccctgggggcgtgaggagagcaaggggctcaaaatcagaacccagcgtgacgacagtgcctccatgactgtgctcccgcaatgcgcaggctccatgtcctggcgcccgcccgcccatggacccggcgggggcttccaggctgggctcagccattacgccggcgtgcgggggaggaaactcgcctcccgggcactcggttgtctcctgcccccgcccctccctccgatccgggcccatctctgacgtagtgtgaccttgctcatcccttccaggctgtgggcctgttttccctgtgcaagatgagggtcctggctgtcctgaggacgctgtccgggcgccgccaggggtgaccgaattcagctctgctaggactgttgggaaatgagctccctgtcggcgtgtgccagccgcctgcgcgaggcgccacaggagagggcgcgctcctgtcgctctgccgcccccagaagtttcccgggaaccgactccactgactcgcccctccgcgccccacgcgtggcagcctaagctcagcctccagattggaggagaccgcggagggaaccctgctggggtctgggcccggggccacgcggcccgagcagatcgagggccgacccctccgagaactcgctctctggcctcggctcctcccttgcgcccgccctcccacgtggggcccaggtctgggaatcagcgctcgggggtggctggggacaaccgagaacgagcttcttccccggcacgcgggcggaatggctgagcccagcctggaagcccccgtcaggtccttgggggcgggcgggcgcgcgaagcacagggcggagacagccgggagcccagcctcccgggctgggccgccctccccttccccgcgcccggccggggatgggggtgtggtcccaagtgtacagtggcatcaagctcagcgcgagctcccgggaacgctccaacgccttcagcctgtttcccaggaacggtccccggcttcgcgccccaatttctaacagcctgcctgtcccccgggaacgttctaacatccttggggagcgccccagctacaagacactgtcctgagaacgctgtcatcacccgtagttgcaagtttcggagcggcagtgggaagcatgcgggactacgacgaggtgatcgccttcctgggcgagtgggggcccttccagcgcctcatcttcttcctgctcagcgccagcatcatccccaatggcttcaatggtatgtcagtcgtgttcctggcggggaccccggagcaccgctgtcgagtgccggacgccgcgaacctgagcagcgcctggcgcaacaacagtgtcccgctgcggctgcgggacggccgcgaggtgccccacagctgcagccgctaccggctcgccaccatcgccaacttctcggcgctcgggctggagccggggcgcgacgtggacctggggcagctggagcaggagagctgcctggatggctgggagttcagccaggacgtctacctgtccaccgtcgtgaccgaggtgggtgccaggccgagaccgttgacccgggagtgcctgaccctccctctgcgtcagccccccttgagactccctgcgcagtgcccgggtcagcgctcccctccccctcaaacctgctgttcatacttccagcagcgggtgtgcaccccaagaaagaataggactcacgcgaggcgcattcctgggtcgtttctgtccaataaggaggtgatggagaaaggagtttgtcaccaactgtcttttcatttccgattttcacaacaaatgaagtttcctaagaacctagatgttgcgttgggggaagcgcagccccaggctacccagacgcactgcctgagtcaccttcctgccaggcatgggaggaggggtgtgagggaccttgttactgggcagggcggggccaaatcttgtctgttccctggccacagacttctggaggcatcaggaggtgtactgccgtaccatatacttgtgaggtttggggtcctttcctgaggccccagtttctctaagacagcagatggcctcctgaggctcattgggtgcaaggaagcacagaaggcgaaaccccagctggaagccctggccctcagggacctctctgagcacagggtgagttggcaggcaggggctgtagcccctcagcaccctgcgtggttagtggcaggttttctaagttccaggaatgaggatgcacacacacttctcccgcttttgctgcttcacatctggtaaggacctgggtcaggatacacctttcttctgaggagagcatcctcatggagctgttgcctgctattggtcaggcaggtaggatttccctgctgctagtccctcctctgcctcatgctcctcccaagaaaaacctgagtggcctctgctagtcccttatccctttccctcagcacggtatagcggtcatcagacattgtgtctggccttgtgctgagcactaaggtgtggacatctggtgtgtggagcctaccctcagatgcccatggggcacactggctgtgttactgagaaggctaacattaaccctggttagcaatagggttctggaacccaaattcaagtcctgccttgcttgctatgtgacctgggataaataaatcaccctctctgtgggacaataggtggaggaaatactccaagaaggggtgatatgattttagctgattctgaaaatgtgagcaagacctgtctaggcaagagtatgggaaattcaggtaatggaattctcatatatcggagtggctggaactcaagggatgacagatatgacaaatgagactagaaatggccacaagggctagttcatagtggccttctatgtatactgaggagctgactttattcggaggacagtgagaaaatagtaagcattctaaggccaggttcgtgcttttggaaagagctcactctagctgctatgataaacaagaagaccagtgaggaagttttgaaactctcctctgcaagagaatggtggccagccaggcgtggtggttgtcgaatctgtggcacctgtgggaagtgggctcagcccagggactgcctttggatcccccagcattggcaccatacctaccctgggccctaaggtggccatgcttctctggatttgcttccctagcaggggctctagtgcttgcccactccctgcccacagcatggcctgggagcagctgagactgggggccagctcatcccgcgtcgattcctggaagtgttatcagtgcctgttatggaggctggacccatgagtggcagccttccctggcagctgggctgacctgtctgcttttccattgctcgctggttttgttcactgtagggcgtgaggggtgagtagctgctggcctccaagtccatagctactcatgttgtacgctgttcacagggacctctaaggatgtacatcatcacacattcacacacatgcaccaggatttgctttttttggcagcttttcccttcctggcttcctttttgagtggtggaagtaaaataaaaagcaactaggggctgggcacagtggctcacgcctgtaatcccagtactttgagaggctgaggcgggcagattacttgaggtcaggagtttgagaccagcctggccaacatggtgaaaccccgtctctactaaaaatacaaaaattagctgggagtggtggtgcacccctgtagtcccagctactcgggaggctaaggcaggagaatcacttcaacctgggaggcggaggttgcagtgagctgagatcacaccacagcactccagcctgggtgacagagccagactgtgtctcaaaacaaacaaacaaacaacaacaacaacaaaaaactgggctctggtggttgggaggaggagggaaggaagcaagtaccagggtaagcaggatggatggatggctctcccccagaggggcggcagcacacagagttctggagtcagactcagtagagggccagttttgactccactgccaaccacctggctgactccaggcaggttacatcactgatgaaagcctcagtttccttgtctataaattgggggtacaagcgatgaaaagaggctcaacatcactaatcactagggaaatgcaaatgaaaatcataaggaggtaccactttgtacccttaaaaatagttactacaaaaagaaaaaaaaaacacccagaaatccactttgggaggccgaggcaggaggattgctagggggcaggagttcaagacagcactgggcaacatagtaagaccccatctctacaaaaaataaataaaaaattagccaggcatgagggcatgtgactgtagttccagcttctcaggaggctggggcaggaggatcacttgagcccaagagtttgaggttgcagtgagctatgaccatatctctgcactccagcctgggtgacagggcaagaccccacctctaaaaaagtgttgttgttgtttttaaacacagaaaataacaagtgttagtgaggatgtagagaaattgaaacccttgttcattcctagtgggagtgtaaaatggtgcagccactatggaaaataatgtggtggtccctaaaaaaattaaaaatagaatcaccatatgatccagcaatactaattctggatatatgtctaaaataattgaaacagggtttcaaagagatatttgtacaccatgtctatggtagcattattcacaatagtcaaaaggtgaaagcaacccaagtgtccttccacagacaaatggataaacataatgtggtatatgcgtacaatggacgattattcagctttaaaaaggaaggacatgctacaacgtggataaaccttgaggagactacgcttagtgaaataagccagtcacaagacaaattattttctgatttcactacaggagtagtcacactcacagaagcagaaagtaaatggtggttgccagggactggaagaaggaaggagtagggagtcgttgtttcatgggtatagagtttcagttttgtaagatgaaagtagtgttggagattgattgcacaacagtgtgaacgcttctgaactgtacacttaaaaatggctaagatggtaaactgtatattatgtgtactttatctcagttttcaaaatggggataataagagaagccaccttatctgagttgttgggaggactcagtgagataatgccccatgccccatccggtggtggccagcacagagtgtggcaccagcaaagagtgtggcaccagcaaatgggcttcctaggtggtggtgaggagtggtaaaggcagaagctcagcaccttctttgccttctccactggctggggacagtgggcatggtgggagctgttctaaagtccaggttgtggcctgtgtaataggtgatgggacttgctggaggctgagcccctctccccacagtggcagttccaagcctcagagaatagaacacaagtccaaacccatactgacttggccagtgccagtgtacagggccaagcccagggcccctgagaaggttctctgcatcccagttggcacaacacaggtagtgggactgtcctcagattgtgtctttgccttatactgccgtgccaggatctcccaatgggcatatctttggggacagacaagtctgcctgaactgccccccaacacctcttcacaggaggacagggttagccaggaaccaaggatggcatgctgtgctgtagaaatgcctttcatagtatgccaggaggtagcaataaggtgtctgagttggggtttgcgtgagtgcattcgtctgtgtgtgtacatgtgtataaggtagtttccttcttcaggggttgattgtgaggtccaagtttttcaacctgtgcagttactaagagtcaaattatttttcgttttattttattttattttattttattttattttatttttttgagatggagtttctttcttcgttcttgttgcccagggtggaggagtgcaatggtgccatctcggctcactgcaacctctgcctccttggttcaagcgattctcctgcctcagcctcccgagtagctgggattacaggggcctgctaccatgcccggctagttttttgtttgtttgtttgtttgttttttgtatttttagtagagacagggtttcaccatgttggccaggctggtctcgaactcctgacctaaggtgatccacctgcctcggcctcccaaagtgttgggattacaggcgtgagccaccgcgcctggcgattattttttaactttattttgaaataacttttgatttagagagaagtttgaaaatagtacagagatttcacatatacccttcatctagctttctctgatgttaacaatttaaatacgcgttatgcatttatccaaaccaggaaattaacattggttacaatagtaataactgaactacagactttgtttggatttcaccagtttttctactactgccctttttctatcgtaggatcccatccaaaatcccatgttgtatttagttgtcatgtctcagtctccaatctgtgattgttccttagtctttccttatctttcatgatcttgacatttttatgagtattttgatgaatgctcctcagtttgggttggcatgatttttctcacaattagattgcgttatgcactttttggtaatgataccttagaagtgatgcattctctgggcatcataccagtgggtacatgatgctgatgtgtcttattactggtgatgttaaccttgatcatttgtcaagttggtgtctgtggaatttctctgctgtaaaggtactattttttcctctgtcactaataaatatcttaagggaggttcttcgagattatacaaaatcctgtgtctcctcaaatttttattcactgattttagcattcatcactaggtcttgactgaaacaattattactgcagtttgcctagtgatgattttgcattttctgattccttcaacatttattaattggaattcttctgagaagaagagcttcccctccacatctatttattaatgtatgcaattgttaacttatatcagtacaggttcatacatacttattttatttcatcagttataaactaatgctatccatctttattttgttgctccagttattctagctcaaaccaagttatttttcactttaaggatagagaatgtagatatccagggtaagggcctttatctgtctctgcagtcagggctagaggagtctgtgtttacccctgcgggaggagtgccagtcacagctcgttgctaagttttccatcaggcagcagttgagcaggaacgcaagcagggactggtgggacctgggttgggactgaagcttctgttggggaaggaagtgccccaagcaacccagagtgtctgatgctggggtcctcatccctgagacctactgcaggggtcagatctcagtctccatgggcatggcccttcatatatagccctcagggccaagacctcagagagaagaggccctgcgtgtgaggaaacccggcagcctcctgccctgaggctaaaggagcaggaagggcaacaaatgctctgctctggagagggcctaagttcatctgcagggccacagggcaagcagcagaggcaatcctggctcgtggccaggggctaagcatgggctggcctttgcctcaagcatgtcctcttctcccatggagcatcattagggtcttgaccttcccatcagtccatgggctgggaaaactgaggcagtcacctctaagctggataccacttctgccaggtcttgtgctccagaggccctgggggaaccttgtgtgttaaggaccagccttctttgcaggccaccagtgatctaagacagggctgctgccacaccgtagatcctcctgtcctcttctgcagctgggctgcctcctctaggaaccctagtggagctgctggtagcccactggtagtggagttgatggagcctccagcaaagggcctggacctctggtggcactagccttgtgctttcctgggaactggggtcagggcctgaacagcagtaggacttactgattccccacccataacccagaggcgagccaggttatgtggcgaaggataaggcctcttcccctgctaacggggaacttctgggaggcactgagagcagcaagcaagggaataatgaaacagactaaccctcacatgcggctgccactatgtgggacttcacatagcggctctcaaggatgcacctcccctggggtctgggtaggccccgacaaaaggggaaaaccttccgtgataggcaggtttgtggagtttctatcaggcctgcaggctgccctgggacattgctcacgggtgtggagactgtcaagatagcctgaatattaaccaagttgatcatccaagtccatactcagacctgccctctggcagattccaaaggggataaggtgtgggggcctctggctccagccagcccggcgagacttctatttccagtcaatgcttcagaaagtagatcttgccagagagcacatagaggagactcaggggcttccccttgctctggcctgaatgtgcttccctgtttgtttatcagctgcctcaccccaaactgtttgcctctctgctgtgttcctctgacaacagccaccaggatctcagaatatgcttttgttcagaggctgcttcacctgcacctcctgccaagtttctggataaacagactttgtccatccctcttggtgggcagcagaactctcagacagagtccaaggtggcattttgacaaaaacaaggctttgacaggactggtcagggggagctgcaggtaccttgggcctctagaaggactgtaattcctcccttatggcaggctgcattcaatttaggtgtaagactaatacaggtgtgccttgttttctaaagctgtgttgtggttttatgcatgtctctggagtccaaaagaaaggcaaggatccccatttggaatgaagaaggtgtggagagaatggacgttctggggaaaggctggaatgacccacatgctctagcaagaagcacagacagtccaaggctggtggctcctgctcagcatttgcaagactggagggcaggttcaggcggcaacttccagagcttcccctcagtgcttggtgactggcacagacacgatgccatttgctcatgttcccctaatacagactggtagagctgtggtggatccattgtcaggatgcaaggggcacagccaggtccctgagtgacccttctccttcccacagcccctccactcccatccctatcttcccactcacactcactggttcttctgctttggtttagcctccaatgatcacagaactcatcagtgaggcttttccatctgtggtagcttttctaatataaagaaagaaagatactgagaacattttaaggcttagcagccttctggcttagttgtttgtaaatgaaaatatgagtagaagaattaaacagccaaaaagataacccacaaaatgggagaaaatattgacaaatcatatatctgataaaggatttgtatctagaatataaaaataactctgataactcagcaataaaaagacaacctgatttaaaaatggataaaatcatttgcccattttggagaatagatgttttgccaaagaaatacaaatcaattagcacatgaaaagattctgagacttcgaagttagcagtgtgaggagcgccagcgccatagaccagctcctcagtgaaacagccataactggtgaaaatacacacacacacacacacatttagagtctctggaagttgtcctaagggcatatatttattcaagaaagtcgactataccttggcaagaacagtgaagtctatgatatttgagtcataactccttcagccctccccttccccttcctcccagcacaagaaaaatggaagttccactctaggtgggtatggccaagaaaatactgttctctctcccatcagcttccaaggaagggctacagcagcccaccaagagggacaaccaatgcccatcccccacccatccctgtattctcttagctccaaaccacagaaggtaaaatcctcgtgagtgcaaccaggggatcataggttcccatcctccacccaccgcctattcatatagtagagactctactccaggtgccacaagttgagaatattagagccttgattgcccttatcccagctcattcatacggcagagattccacaccaagctcccacttccactcagtgtctgactcataaagtaggggtgtcattctgagataaatgggccgctttccctgcctacctctctacaacaggagctcagatattttgcccagcggggagagataatccaaaagaacagagttctaaagctgtccccacaggaacgaactttatttgaaatagagtgtgtgaaaggacagcctaagattgctctcaagaacaatggagaatttagtggtaagcaactaaaaggattctggtaactccattagagcaacaaatgaacccataatgcagctagtttaccaggaaaaaacagaaaacaaacaaacaaacaaaacaagaaagagacagctaagagcagcccttctggagtcaaaacaaaccttatagatttgcctcaaaaactaccactgcaaagaggcttgacgtcaactggattagactgtgggacaatatatgcccccagggcattattgaaatgaatgaggcaactggctagcaattagtgaggctaacagctgggtgtgataccagcagacacagacagcttaatagaaagatcagactggcgtggtggctcatgcctgtaatcctagcactttgggaggccaaggcgggtggatcacctgaggccgggagtttgagaccagcctggctaatgtggggaaaccccatctctactaaaaatacaaaaattagctgggcatggtggcaggtccctgtaatcccagctactcaggaggccgaggcaggagaattgctggaacccaggaggtggaggttgcagtgagccgagatcatgccactgtactctagcttgggcaacagagtgagacttcatctcggaaaagaagaagaagaaagatcagggaaatgggggtggaagaatgtgacagtacctaatttctacaatatattatctaaaatgtccagtttttaaccagaaattacgagatatgcagagaaacagaaaaatatgacctatacatggggggaaaacgtgggcaacagtaactgcctgagagggtccacatgtcagattttaacagactttaaggcataaggcagccattataaatatgttcaaagaatgaaaggaagtcatgcttttaaaagtatgatgacaatattgcatcaaatagagaatagcaataaagagagaaaaattacatttatatttttaaaagctgagccagacatgatggcatgtgcctatagtcccagttactcaggaggctgaggtaggaggattgcttaagcccaggagttcaaccccagcctgggcaacagaaagagaccttgtctcttaaacaaacaaaacaactgaatagaacttctggagtaaaagtatacaataattgaaatttaaaagtaactcaagggccttaacagaagatttgaacaggcaaaagaaagaatcagcaaacttgaagatagaggattggaaattatgcaatccaaagaacagagaggaaaaagggaataaagaaaatgtatagagtctcagagaaatggggaacaccattaaacatagcaatatatgcataatagaattactaggagaggagagagagagaaaagggcagaaaaaatgctcaaagaaataatgactgaaaacttcccaaatttggtggaaaacattaatctacacctttcagaagctcaacaaactccaaatagaatgatcacaaagagatccacaccctgatatatcatggtaaaactgcttaaataaaaaaagagacaaaaacgaagggaaaattttgaaagcagcaaatatatgactaggtacatacaagagaactccaataagatcaacgtttgacttctcattagaaaccataaaggacagaaggcagtggagtggcatattctaagtgctgaaggaaaaaagaaactgtcaaccaagaatcatgcatccaacaaaactgtctttcaaaactgagataaagaaattcaaaaatacacaaaacttgagagaattgtttctagcagtgatgtcttacaagaaatattaaaggaggcacttcagaaataaatttaaccaaaaatttgcaaaatgtatactttaaaaactataaaatgtcattgaaagaaattccagaaggccttaacaagtggaaaagcttcccatgttctgttcatggagcagaagacttattgttagtatggcagtgctctccaaattgatcaatagattcaatgcaaaagatgttcaacattagttattagagaaatgcaatcaaaaccacaatgagatacctctttacacccactacaatgactaaaattaaagacacacaataacaagtactggtaggaatgtggagaaattgaaaccctcattcattgctgttgggattgtaaaatggtgtagccactttggaaagcagattaggagttctgcaaaaggttgagtatatacttaccgtatgacccaacaatttcactactatgtatataccccaaagaaatgaaaacatgtacacacaaaatgttgtacatgaatgttcacagcagcattattcatagtagccaaaaagtggaaacaacccaactacttatcaactgatgaacagatcattgaaaacgtggtagacccaaaccgtgaaatatatatatatatatatatatatatatatatatatatatatatatatatatatatatagttgttgttgttgttgttgttgagatggagtctcactttgttgcccaggctggagtgcagtggtgtgatctcagctcactgcaacctccacctccaggctcaagcaactctcctgcctcagtctcccaagtagctgggattacaggcacgtgccaccgtgcccagctaatttttgcatttttagtagagacagggtttcaccatgttacccaggctggtcttgaactcctgacctcaggtgacccacccgcctcggcctcccaaagtgctgggattacaggtgtgacccaccgcacccagcccaaaccatggcatattattaaaccataaaaagtaatgaagtgctgatacactgcacaatgacatggatggacttagaaaaggagctaagtataagaagccagtcataaaacactatatattgtatgattccatttatatgaaatgtccagaataggcaaattcatagagacagaaagtagattagtggtttccaggggctagaggaagtagcgaatgaggagtgactgctaacaggtatgggttttctttcaagggtgatgaaaattctaaaatcagatcattgctgatggttgctgaagtctgtgaatatactaaaaatgattgatttgtatactttaaaagagtaaatgttatggtgtataaatcatatctcaataaagttgttacaaaaaagtaattaactagccatgtttgtttttgtttttctttgttttgttttttcatattgtcaaggaattcccagctttaagtcacaatcaagtgacaaagatagaactggggtggatgtatagtccattattaactactacttcttacttttctctagaataaaggataactatgagaggatactatagaaatcaatcttttattcttaaaaggaccattgctaatttttcactcacagtcatctctgggattgaattccatttatcaaatcccttttataagagcttttctagcttttagtaatggactggaataatttttatttcttagaatttctttctcttagtcagatttaagtgtaacctgctttgcttattcgtccatgtgttccaagtcatgattttgctcaggacaaataaaatgctctactagtatgagcctggtagaaagggaactaccatttaatgaggcctgtaatgtgtcagacgctccactgatatttcccatccaatgcacacaacaaacctaggagcaggtattattgtcatctttttgaaggtgaagaagcaggctaatagaggtgaatggattgcccaacatcacacagtccaaagttgcagaccccgagaaagcctgtgttctttgctgaacaccaggctaccttccagcgttctcagttccgtgcaggtcagacggggttcacttatctttatggtcctttatagctctggtaaaaactaaaactgccagactttggctacttggagagttagttcaaggctgagggtgattttccaagtgcaatgcgtgatactcctcagcccaagaaccacattttccaggctgattttctatgactcctaattaattgttcaatattcattcaacaatttgttaagcacccactgtgtgcctagcactgtgcaaacactagtcatctaaaatatgattatacggattattcaggttttagaactctgtccttctgctggaggatggtgaggagggggtgcctctttcctctctagccaaagagcaagggtgaagtggcccagaacagcgcccaccccacccagggctgctggcctcatgcatgcacatgtgcacatctgtcctgtaaagtatgcttgaccttgagctttgtgagggcagggaccatgtctttcttgtgccctacacagagcctggcctggagcaggtaggtgctgaatgtcagttgaatcaatgattaagcaatttttttttttttttttttttttttttttttttttttaccaattcactaggagaacttgggctggttgctttattgctctgtgccttcatttcctcatttgtaaaacaaggataagagtacccatctcacatgccaaccctgagatcccctgagataatacacggcactcagtgagcactccacacactgttactgtctttcccattactccctttactatagggagccatgggaagcggcacatccttctatgccaagagtgacctcctatcccctattaccttgtcacctggatttttgtttcttaaattagagctgaaggccatgcggcccagctaaatggagctcactctgctctgttgtgagaaccttggtctgggaccctgctgatgggacagacatagtaaccccgggaggccccatcagaggggcagggagaggggaggtaagctatgtttcagaaatgttaggatttgacttgaaagcacacccccaaagcaatgccagccagctccttaccaggacatctgccattagcctctgagctggtcatgtgtatgtatgtgtgtgtgcatgtatgtacaaacatgtgcagggacccacagggacaggtctgtcccatcaaggaaaacactgtctcccactgggcccgccatgtcactgttaaccacagggaggttttgtggccctggctagcggagacccaagacatatccctcaaacctgaagggcccaggggcaggcagggccggtttcctaagaaaagccttttctaaaggacccctcttaggactggcagctgatttactggactctagcccttcgctccaggtagaacttcatctgccaatcctgtgtcctaataccaggcccctcacagctttccaaaaagacacttgcggcaccataactccccaaaggagagcccagccctagaatcaaccatgggcagccatgcagtctagctgccttcccctgctggttgtaagcagggtctccaaaggcagatggcacccctcatgggcttggggcaaacggccactgcgtgtgcatggctcttcctgtgctgcatgatgctgacagggcttcttgggcccctcttcagggagggaatgggaccgaaagccatcgatgcagagcctacaggaaggagaatgatgggagatggccctcacctcaccccccttcccagtgtccccattcagaactcctgcatctgcttcatttcctggaggccaggtttgatcccctgccagggccagcttcatgggcatgcaactgtgcagtcacacagagcgccacacttggtttcaatgctttgccattgctgtattgaaattcttaataatttttgaccaaggagttctgcattttcagtttgccctggaccttgcaaattaagtagccagttcccagtcctaccctttgctcatgcaatgcctggctccacatctaacagccttccattcctttctatctctaaatcctatctatcctgccctaaggcaaagtccagacagaaaaatatttgacagactacaaaggagagcacattatatttgaaagagcttttctgctcaactgcagatggaatgatgatggttggcatgttaatgcctctaccaatcttgagttcttcttggctcagtctgaggctaaaggctgtgatggaggccttctactcctagtcctgggtaattgtctcctggtatcacattccttgaagaagtgtagggcatcatatttaataagctcattttgtcctgccttagggagtataggtccaaagcaggacactggtacaagattgggttctgaggcccaagtaggtatctatcatgctcatttacttgctatgacttcagacaaatcccattctcacagtctcagtttaatcttctgcaaaatgggtcacaccacatcatgaggctttgggcctcaattgctcatctctctaagtcagaagcagaacccaagcttttatctgaagctttggacaattatttttggagggagatggccatgaatgcaggcacacgtcctgtttaccacttccggtctatggactggcagaacacattaatctggccatacagttttagaggattcatttccctttctcctgaagcccatgcaagagccccaggcgaggcaatcctgctctgggtacagtctgagatttatccttggattgtgcctgagcagcagagcgctaacttcctggcccgagttgtttttcttctgcagagctgtgttgggcgttgcctgtggccagcatttgagcactgtgacaggcggcctcatgaatcttgctattgtctctaggacaggactattctcgaggacattatcctcagcatcacagagtggctcctttgtggaagaagtacataggagacacttctttcggatctcagtattcagaacaactgtgcttctgcgaataagcagactacttcggatactgtaacccttctgagagctgagctgctgggatacgcagagccagttttggagccccgtctggcaagcaggcaggcccgtggacaggatagtctagggtcagtcttaccccaggcttggtttttgcaacttccctcctctttattttccattttccccaattcccttagctttttgttttacatttttctcttgtgtgtgtctttataaacacctctgtctgctgcagaataaggtgtgatataaatatgtgagtttgtgcttaaatccaccacactttcaagggagttgtgaggattcagaaggaattgtttggcgaatgcagtaaaagcagccccatccaagatggagctagggctgggtgggaggcaggggtctttcctccagactggatcatctcgccacagacagcagcccccaaaacccaagcccaaagtgctcattggcatctgtttgtttatttatttgtttttaataaatgaaaggtcactaaacacactttgaaatttttgtcacctcccttgagatgttgcttaattgacttaagtcaaactgaaactctggctgaaactcattttgtagatgcactggcagggacttgttagggcagcagcatcccacagaccctagggaatgggagggaccacacttctggaaagactggatgggaaggagggtgtagggatgtaggaggggagctagggagccctggagaggagtaagtaggccccagaacgatggggccccgaatcaggccacaagcttggcctaggcgtgagtggaccagggaccacatgatttctcagaggggcctgctcagaaaataaagtcacagagctcctggaaccacttgcacttttcaacaagggaaaagaaattttacgcctggaccaagtggccatgccctctgccctgccctttgggcttttcaaacacctcccctccgcactaggctggcttctgaagatgcagtgccacctttactttggactgcctcacagctgaggggtcaccagtcacagccatggccttggctggcttcttgctatgtaatgcgagcggagtaggagcatcaccctccctttccaaagaggatcctgagtttcagggagggcagtgacctgccccaggttactctccccagtcccggcacaggccagtcaaacccagggctgcaaggcctatgccctttgtacaaaggcaatatcctggcccaggggaggagagtctgcccgccagccgtgctaatattccctcagagctgggctggggttgaggtctgcctcagggttgggctcacgcttcatgctgtcttccttggcagtggaatctggtgtgtgaggacaactggaaggtgcccctcaccacctccctgttcttcgtaggcgtgctcctcggctccttcgtgtccgggcagctgtcagacaggtaagcacatgggaggggaggaaggtgggatggtgccccttgtcaatcactgcctatcttggggctggactgaattcagggtatttctacccagagaaagggaggaccctcaggccactgattcagtgataggaggagccccgatgtctcctattcaccccgccctcagtccccttcacctggacacacttttgttccattctcccagcctcatgctcccagggctttggccagtggtggggaggggccactgaccccactggaaagtggggtcctcataccacagactccttgacaaaacatgacgctgccatcaccactgccctccctgctccaccaccacctcaggggtaggggtggatggcacaggatctgtctgcaaacagccagcagccagacagtgagccccaactgtgcacacactgctgctgtggcttggaccctgggccaggcactggggccacagagctgatgctggctctgaccctcatagagcttacaggcctgaggaggcagcatcacagcaccaggagacagtattccacaggcccctgtatgtgctgggtgaccagtgcaggaaggtgggggtactaaatggcaatgctggggaaagcctcccagcccaagccaacagccagagacatgagtttggaaaatggggcgggaaaggctgttctgctcacacctgtgctccattctatccactggtcactaccagaatgtgaagataatacttaaaacaacttcagtgtcaccaacagacattgctgaaagctacaccttcccacagagcagtggtttgcaatttttgttgcacgctactcatctgggaaactttcccaaatcctaatacccaaactgtatcccaaaatcttgggaggtggggtgctggcatcagtattttttccaagctctccgggtgattccaagtgcagccaaggttaaaaaccacttgcagagtgactcttagttctggatttacagaattttcatgttgctgattcaagaaatatctgcaatctgtgctgtacccactttccagaaatgtgctggtagcatctatctgtggctccttctaaagagcatatttccacaaggtccttgcgtacactgctccatgcttttgagacatggtgtctccacaggaagctgagaatctcaaaagatatctcctgagcagatggatgcctgagacctcaccaaggaggaagatgggaggatgtgacagagaaaaaagtctgccagagccctgaaaaaacactaagtctgcattgatgcctgactcagggcttgcaacacaccttggcaacctacacatctcatgttttgtgttatactgcattctctaggtttggcaggaagaacgttctcttcgcaaccatggctgtacagactggcttcagcttcctgcagattttctccatcagctgggagatgttcactgtgttatttgtcatcgtgggcatgggccagatctccaactatgtggtagccttcatactaggtaggaatggcttctgggacatggggtgcttccctctaaccctctgaaaggcccagaaagaggaaatcattgggccattgggctgtgcttccaaagcctttggatatatgtgtcttgggagggagccgtagccacagctcttggagcaagtcaggggcagggcaggcactcgcagggagccacctctgtgctgagccctgaaatgtggtggagaagaagagcaggagccattaagaaccagctgcacaacagctgagacacattctctggagcacagggcttaagagaggcacagaggaggacagtttaggggaagggcagcctgaggatgtctttgatctgagttgtgtaggcttgagacttcttcctggttgcttgtgaagagacttagggtagtcactgtggccagtacacaggtggggaggctcatgtcagacagggggagttcagtgccagcccgccatcactgggcctatctggcctcaccctgagttagagcccaccccagagcctatcagctaagcacaggacaagcctccccacactgatagccccatctcctgtcaggctgcatgaggaagactcatcagttacaaggtcatgaagaggtccctggggccctcagcagcttttcctgggagggagttaggtgagctccaggcgagttgatgagggtcatccacaggagtgagagagtgtgttctcttgagcccagcgaatgggcaaatgagagaagcagaggtgaggggtatccctgggacagtagacaccagttcccatcatctctagggtgataatatattctaggtggctcagtaccatcccaatttgtccctattgtcacagtgtcattattaataatactcctttaatagaagtctaacgattcttcttgcctcaaaagtccgaatctggttaggtgactctgattgctttttaagagtctgaaggactcgttggctttggagatgctgcactgtcttaattgatggtgtgtacaccttctgtcaagttgccaggatggaaatattccaactctactcctttaattatttgcgaagagccccgtgccatgggctcagcctcagtgtctgcagaggggagaagggaggagacaaggtgggaagaacatgctggagccacatggtcccagcaggtagcacactcttcagcaggccccagcgggaggaggctgctccccttcctgcagggggaaggagcggggcaagattttcttgaagatcatttgtgtagagggcacagggagcttcaggccagtgttgttggaaactggaggttggaggaacttaagatagaaattgcaacctcctagtccccagtggctccaagaacacaaggcaaagcctattgtcttcatgttcaaagtccccagaatccatcttccatgtgacgatcctccctaagcctgaaaaacccaacatgtggctctgcttgggccagacacataccaaaagccaaacaggcctccccaaaacggaggactctgaccagcaggcccatatcccaggaggacctgaaggaccatctggaacagaagggtagagagtcacggtgaagccagagaagctctctccgtgggaatgggaacaaggtgggacttgtgccaggtggtggcatccccggttctatagaatgggcagcactgagatctgcctttttagtggcacagggtgattctggagcctccaagcctcccctgtgtgagcgggtgaggcagggagagcataccccaggcttcctacaggaaagggctgccctcccccgccggctctgacactatcatctactctcctcccagttcccatgcagcatgtggtcccacatgcagggtgaagaagggtaagagggccaaggggaaagtaaggccatggaagatcagtcaagccagccagtcagtaggtaagaccctgggtgcagcagcctcgctatcagctgggatccaggcctctcagggcttgctatcagcctggggccaggcctgttatagggtgctctgggagcctcttcatggtagttttactccattgtgctctgcaggaaattactggcttttgtatcctggtatgagactcgttgtgttgggttctcaggtctgaaagtttaagtgtccctgaaaaccagcctgctctggaatggctggacgccccagtcagcacctggggttgggggacacagtacaaaggcaaggtggctgctagcttccctacagtgcagcagtgctctctggtgtttctgggataaaatagctgaattccaggttgtatttgactaaaataaaccaaagggtgtggtctgggctgaggagtttggtaggtgccttcgcttccaccctctggccctaaggaagggttggcaaagctctgcatgataatttcacattaacttgggaagccaaattactcccactgtcaaagtagtgcagaaatgagtccttgttttgtgctgcttttaaaaaatgatcaaggctgccacagtcgtagcagactagaaaagagaaagaaagaacagtgctaccctacacagcataaagcagacatgcctggaagtgatggtgttgccggaatgatgctggtttaggaggaaatgaccactcgggaccaaggacactaaccctacccacgttccagctcccctcacaatctcctactgttgcccagaaataatgccctccacctgtcaatagccttctgggtagaatgccatcagtatcctctcttatcccccataactagctgcttaaacacaaaaagtgtttctgtatttaataacacagaaaaaactcttgactgattcattaattcagtatttttcagtacttctaacatcaacctccatgtgacatttctttgggcatgctgaaccatttaaagctttgcttcctctgatgtctagaggttcctccttttgataggtgtgtaagtgatggcatcttcctttacaactctggctaccaggaagctcaggcaaatttgaaatttaactacatcaatgatgcagcttttaccagccacatatatatatattttttactgtttttaaattgaacagttgaaatataattttgtcttcgcctgtttaggatgccgtaacaaaatcctataggctgggtggtttaaacaaccaaaatttattttccacagttgtggagggtagaagtccaagatcaaagtgccagcagggttggtgtctggtgagggttctcccattgggttgcagatggctgccttctccctaagtcctcacatggtctttcctctgcgcaagtgctcagaaagagggaaagcaagaaagagagagtgagccatagagagctcactctctggtgtctcttcttgtaagaacactaatcctataccctatcaggtcaggggatcaatgtatgaataatagagggacacaaacattcagtccatgacagatttgcataccatgatattcacacttttaaagtgtataattcagtggtgtttagcatattcacaaagttgtacagccatcaacactatctaactcctcatcaccctgaaaagaaaccctatacgaattagcagtcatttccctcttcccctcgcccctggcaaccactaatttactttctgcctttaatggatttccctattccgcacatttgatataaacagaatcatatattatgtggcctttgtgactgactccacttgttttcaaggttgatccatgttgtaacatgaattagtattccactggatgaagacaacacatttcggtcatccattcatcagtcattgaacacctgggtgtttctactttggggctgttatgaataatgctatgaacattggagaataagtatttttgtggatatatgtttttaattctcttgggtataaggtaggacctctgctgggtcctatggtgattctatatttaaccttttgaggaactgccaaactgttttcaaaatagtcagctgcgtatttttgatcttttcaccaaggcacaactttttacttttctttatatcttactttaatgttaccattattttattgtatttaaatttgaagttgcctcaaaatctccaagggatgagctggcatataaatacgtaaacatgatgcagaaatttgctggcataccttatttgcattgcaccgtaagagggaagaactggggagacccagggaagagcaagaacttactcctgtctattcacaaggagctcactgcctggttgtgcctctgcagccaatgcagctgtcactgtggacatggggacatgggtcaagggagtggggcacatattgctgggtatacacagagataggaaatgttacttttgactggagtgattggtgcagacagaggggaagccctgagcaggggaacatctgttaagccctgaagaggagttctgtcttccactgggcctttttggatcaaaagcattgtactttccatcactcccctgacatgtagcacatttcaactgcttgatcaggataaagaataactattactgagcacctgccacatgccagacaccctcctaggcactttgcatacatgatctcagtcttcataataatatctccatgaaagacggcttatcacagtcactctagtagcaactcagcatcaaggaacccaggttctccccgtgccagatggaggacactcctagcccatggttcctgggtctcgcctcatatcctggcagctgcactacagtcttgtttcttgagctggggtctactgagagcctatgttggtcatttatgaaggtgcatgtcctgcctctgtgtggaatgggcccagcggttcctggggcaggtactgctctacatggaaggcagcctggccctctctgagtcactccctcttggagagagtgctcagattcagaggggtgtgacaggtggtgggcaatactcctagggctatgctggccctcatcctagccaggtcatgtccctttggcttagatgtcaaagtttcactcccaggagaaactcagaagcccagccagaccaagaccaaccaggctttgccctagaagcaaagcaggcagaagaggcagatagagcatagggggccaggacagggatcccccgtcagcacagcaggagtcactgctgtgtcatctgtttcactgccacatggaaagctcatggcagctgcaggccataaaagatctgtgtaatcagggttctctcctagcattactcagaggggtctggctggcttccagtgacaagccaaggaagggaaaatgtaaatccacttctgaaagggggataaggtgggtggatcacctgaggtcaggagttcaagaccagcctggccaacatggcaaaaccccgtctctactaaaaatacaaaaattagccgggcatggtggcaagcgcctgtagtcctagctacttgggaggctgaggcaggaaaatcgcttgaacccaggaggaagaggttacagtaagctgagattgcaccactgcactctggcctaggcaacagagcacaagtctgtctcaaaaaaaaaaaaaaaaagaaaaaaaagaaaaactgtaaaaatgacagcaggatatggccttacccatctcccctcatgtctctactggactctcagttgaagaactgctttataaggccaagtcatgcccccagtaatttttttcttggaaggtagaccagtatccatagagcaaataaggcttaaatcctggtgcaccacttattatgtgcatgaatttaagcaattggctttaactctgaagtctcagctaattatgtgtaaagtaggaggaatattagcttttgttttagtttttgtttttgtttgagatggagtttcgctcttgttgcccagtctggagtgcagtggcatgatctcggctcactgcaacctctgcctcctgggttcaagcgattatcctgtctcagcctcccgaataggtgggattacaggtgcctgccaccatgcctggctaatttttgtattcttagtagagacaggtttcatcatattggtcaggctggtctcaaactcctgacctcaggtgatctgcctgccttggcttccctagtgctgggattacaggcataagccaccgtgcctggcctggaatattagtttttatataactggtgtgaagggtcaaagagataatatatgtaaacacttagcctggaacctgtctcaaagtacctactcaaaaaaatgctagctgtgaagatggtgatcctgtttaaggaagggtgactgcctaaaagagagcagaaagtaggactaaaaaggaattatttcaatttgtaccatccatgctgtccacaggaaggcaaagagagagacctacaaagtctctgtccccaacatgcactctgcaaagttatataactgttctggtctgagacccatgcttagagagggagattatccaggaacccagtagtataacttctcttttcttaacaaggtcatgaaggtaggagaaagctcctctggcctcacaattctacaagattctcacttgatcctgcgccctttctcttttccaaaatcaaaccctctgccactgaatctctgcttaagaataaagcaccttctatttatttccacatcacaatcacggccaaggggtttagaaaccagtgcatagcaggaaggtcattaatgaggtcagaaaagacctggaaatcatactcatgatcctcaaagaagtcaggccctatccttggaaatgggtttataggctgagcaatgctctgggtggttagggcaattgtctccaacatgggatgcaggaggcacaaagtactggctgtttctatcagtccaggtttttaaatggcctcttgagagggacccactgaggcagatctctcagttatgaacagtgaaggggaatgagtggggtgggatgggaacagataggtggtaaaatgagaaaccagccaacatagtaattttgctgcttctctggaattagctcttaatcccttagcctgtgcctagggcatataaacatgactgagaaaatctctcttaaaaggcaagcatgaatgacctttgaattatctgttttgtatcttccaggccacttctctatagcatgggcagatccccaacaaaaggcagagccattgccattggtcacatctccgccccaggtgtagtgaaccaagggcagactctgtggaaagggcccagagctccgtgacaagagaaggagctttgttcttggactcccatctggtgccatctctgctcactgtggcactgagcagagcagaggccaatagtcgcctgcatgtcctttcccaaaaagcagtgcccgcaccaagcagtcatgggcctttctgctgttcagggaaagcactgtgagttcaatgggtgtgtggacaggtctagggctgctgcctgcaggggcagcagaacagcgcctgcttttctttccttggtccaaatggactgtggactgtgtctgcctgggctgatctctgggcacagcatgctgcaggaaggcctgtctgtgtacctccagagccagctcactccaactgatttctcagggctcaggcatgggtaagtgtgccctgaggtcttggaaatgatgaactctccactgcttcctgatgggccaatgtctgtttatttacagttcagaactgttggaaaggctacacacaccttgaccccacatggcccctcagaagagccactgcttgtctcctgaaatgctctctctgcttctcatgttggggctcttattttggaaatgtggcattctcagaagggattagctcttggggctgggcatgatatttttatgacatggaatggccttaaaataagttggccaggcgcggtggctcatgactgtaatcccaacattttgggaggccaaggcaggtagatcacttgaggtcaggagttcaagaccagcctggccaacatggcgaaactctgtctctactaaaaatacaaaaattagccaggcgtggtggtgcacgcctgtagttccagctgttcggaaggctgaagtgggaaggtcacttgagcttgggaggcagaggttgcaatgagctgagatcacgccactgcactgcagcccgggcaacagagggagactttgtctcaaaaataataataataataataaattaattaaaaataaataaataaatctatggctccattaaaatctcatagaaattcaaccttctataagttgccaagtcttggatcacgtcccaccttcctctaccctgaccatgcctgctctgggccatgaggcaaatgcctttccccttttctaagtggtgatagtttgaactctaactgccacataatgatataaaaagcaaatattaaagtgagttaatatgctaatactcctcccttgttttgaacaggaacagaaattcttggcaagtcagttcgtattatattctctacattaggagtgtgcacattttttgcagttggctatatgctgctgccactgtttgcttacttcatcagagactggcggatgctgctgctggcgctgacggtgccgggagtgctgtgtgtcccgctgtggtggtgagtgtgactcgtccccagacaggccctctgctgtgggtcagcacacctggaacacacctggagcctgatgctgacctagcctgggcttgcatgacctccacggaactcgcggaggccagcttccaagccgggagagtttttgcctcattgtgggtgggcctgtgtgctggagtttgagtctccattgtcctaaaaagcacattctcaggattccaatctcttccttgataccagccactcctgtctgttgctacttgttatttgtggagctggtggtgttggattttgttgtttttaactctgccccctgctctttcatcacttttctctctctagaaaaatctcactctatccaactaatgtaattcttcaagcttccctatcatataacgattagcatctatgaaagggaagcctatttattagcactatgatagtgtgcctatttatctgctatgtctcgaagagtgagaaaattactttttatttaataaattgttagagaaatgtcctcttctctcctcccacaacctcccaactcagttttaacacaacagttataggaataacaaagtttgaagattctggcctcagtcttgcccaatatgactatctgggggatttcaggtgaaagaataaattaaaaatcatagaacaaggtgtcagacataccctctttttggagatttcctgttcctttgctttttcatatttaagcaagagaaaaggagattccttccattggtgggtctggttctgtctctctctcattctctttctctctcattaattcttctttgtttgatttcattatatcaaagtcaaatcttccagcactgactggtttcaccgaactgcataacttctacctgcttacacataacacaagcttctttgaccattttttggaactcacaatttagactagacctcatggttgccctgtcctttggatacctcctgactgggaagctgtctaggcctttatcttactgcagctgttaggcagtcatagaggttgacaggcaggccacctgtctgacgagatagcgcaggtcaggtgggctcactctaagcccctgtattctcatgacctgtaagagtgctgtgatttactagtgtaaattattggcatgaagtgtgcagggggagttgacagtttgttaaaggttatgtattattctgatttgcaacattcctctggaaccctgtctgaggaccgggaaacccggcctgaggagcagtgaataagggctggccattatctacatagctgtgcctccaaggaaagcatcccagacttacaagagcagagcaattttctgaatgagagtaattatcatcatcatcatctgtccttctctccacaactcccttgctagctgaatttattggaaaagatgttagtgactaaggttctctcaagacacatgacaagattattcaaaggttcttttctgcctcttcagctgaatggttttaataaactatgttctctggctctagttgtcattttgacctaagagaccagtactttcaaaatgttataattagccaggtatggtgattcacacctgtaatcccagcactttgggaggccaaggtgggaggatcactttagcccagcagttcaaaaccagcctgggcaacatggcaaaaccctgtctgtactaaaaataaaaaattagctgggtgcagtggtgagcgcctgtagtcccagctacttaggaggcagaggtgggagggtcccttgagcctgggagttcaagattacagtgcgctatatgatcatgccactgcactccagcccagatagaatgagatgctgtctcaaaaaaaaagttataatcaatctgattaaggtatgattctatcagagagaaagagagagagagaataacaatataaagcctctgatgggctgtacagagattagtagggatgggatctttgcctcgggaccatatgtcacagcgaggaacgaacagctctgatccattagccctccagagtcagcctccagagtttccagcagagaaggtccatcccacagggagcctgctcactgtgccctaaggagagctttttcttctattccccaggagctggtccatgaatgctcctggctgtgggcatactgtaccagggacaggacttgccccagacagaggccagcctgggaccagcactgacaagctgagtgctccccctgaacatttaccagtggtcttaccattttcctataaaagaaaatagctttcttctgaacatcccatccttgcaggtgggtcttcccaaagggatgctcatcagtctagtggttggggtatggagggatgcttagagctgacatggaccctgccgcctgctcagtatgagacaagctctccagcaacacctcactgctgtttagtctgaattcaatctacagagagattatagtgtgctacctcatttggcactccattgacttttgaaatgatcagctagatttgagattatgtgcaccaaaaaaaaatcaaagcaattcaaaactagagataccagtggccctgagtacagtgggctagaaatgggaggtaaacctacatagaggcactgctggtggtttgggggactttttatgtcccaagtttcctttaaaaggcttggcagtaagtggccacaggtgtgaatggagtatgtgtataggcggtggggatggggtagggaagcaggccatagatgcaatgtgaggaaagctatgcaatttctagctgattaaacattaagaatctgaggccagtggtctgtagaaaaaaaggtaggatatttctaagcataatctggttggagaaagatactggccccatccatgaggtatatcgtggctgtgtagtaagatctctaattctgcactaatatagtagccaccagccacatgcagctatttaagttaaaattaattaaaagtaaataaaattgaattttcatttcttcaatcacactagctcaatagctacatgtggttagtgggtgctgtcttagtacagatacagaacatttcagaagtttctatcggacagcacagttctaattactgagagtcagtgacctaacattattgtagttcctatagggacccactaaaggcatattctgaaaaatgcaaactaggctcatttttcaactcatgtgctattaagctggagaggggacctgctggttggtcatttgttttgctctgagctaattcctagtgtgggtttggggccaattaactacacaggactctgtgtctgctacttataatttgttgtctaggctaagtaagtacagatgctctttgacttataatggggttacatcccaataagcccattgtaaattgagaatattctaggtcaatacacctaacctactgaggtaggaggccagacacgactccagaggcagggcttggacactggaccaaattgaggaccagctaaaacacagccagggcagaagacgctttccataagacacgcccacccgtgtgccatgtcagtttactgttgccatgacaacactcaggctttattgcccctttccatggcaatgacccaatgacccaaaaattactaccctttccctagaaatttctgcataaactgacctttcatctacatgtaattaaaagtagttataaatatgagtgcaaaactgtcctgagctgctactctctgcctgtggggcagccctgctctgcaggagcagtcacggagctgtaacattgcctcttcaataaagctgttttcttccacctccagtttgcccttgaattctttcctgggcaaagccaagaaccctcatgggccaaaccccactctggagcttgcctgccctgcatccctaccaaatatcatagctcagcctgacctaccttaaacatgctcagaacacttacattagcctacaattgggcaaaattttctaacacaaaacctattttataattaagtgttgaatatttcatgtaatttattaaatactgtactgaaagtgaacaacagaatggctgtatgtatgagcactcaaagtaaggtttctactcaatgcatatcatttttctcctatagtagaaaaatcataagtcgaaccatcataagttagggaccatctgtactgacaataggtaaggaaaatgagagctgacaggagaatggctaaaagattttgagaaataaaaatttagaaagaatagaagccctattatttgcaactgtgtttgagcatcagctataaatgggaatagactatgtaatttaaaacaataagcttttttagacattaacaaaaagacaacattggggctcatctcccaaaagctggtttgggcactcgctgatctgggaatctgttgaaagccatgggggccccacacaggcgggtgtcagtgccctcactttctcttttgactaaaggaaacgatcaagaacacaggtgccctggccatccttttcccaataaactgtgaacatcaccagctgggacaccagcaattctccttaggatggacccactgcaaagacagtctcttctctaggggaacttatagtctagtagctatgtttcttttatgagccacactacctataagttttggatgaacttctccagagccctggctcaaacatgcccatagttaatgtcaccccttatggtctggtcctggtctcaagcacaactgatgatcggtcttataatttgatcagaagtttgaaacttgaaggtggttttatttattcctatgctccaatagaaatcttatgtggactccctttaaaaagacaaactagaattttacaaaattaaaactatttgggggaaactcagatttaatagtatccagccctgctgttgtgaaaaattattaaatattaaaaataaattataggttcattcctgaatctccccgatggctgatatcccagagaagatttagagaggctgaagatatcatccaaaaagctgcaaaaatgaacaacatagctgtaccagcagtgatatttgattctgtggaggtaagcatttgcagatgtttcctcttgagatcagctatgcattcttgattttatggaatttaacttaattcaatatttgttaagtgcccactatgtaccaggcattgcactaggccttaggaacacaatcatgattaaattctaagataaaatccaccttaaagggctgtttataagaattaaatgcaataatatatgtaaactgcttagcaaatagcaagcgttcattaaatattagtttgctttattttgcaagtttatcatcaactttctattggcattgctccaaaccactgacacagctatgtactgatgatttttaaatgtccagattaagtggaaaaatatgtttcagggctagtccaccctgggttctccactgtaccctgaatcttaccacagactgctgaggaagctatgcatgtctttagtctcactctgtgtcatgtctagaaccttaaggcctgaaagcacaggcttgaggattcacccttgaaagctggtggccacaaggaaaagctgatattctgtggaagcagccacacctcctgacagttcgtgaggatatgcagtgtgccatgccctgtgctggctcctagaggaaataagaaaagacacagcccaaattctaaaggaacatagaatgtaactaagattggcaagaggattagataaaaagataaagaatggcataagggaggaaatggtaagtatccaagtagagacactgtgtgccagcaatacagagaaagatagcagggtggcccatggctggaggcaggtccaagccagggaggacagcaggactcacttaaatgagtggagaggatggggcagggcattcctgtctaggagataggtaggagtctgctcaggacacctaaaaaagactgtggtggcttcagtaacattatacatgccctgcaccaaagcatgtagtacagaaagcagaactctgtagaggacggtgggcatgccactgctcacccccacggcttccccagtccctggccttcaggaccttttccagaagcagatactctggctatggctagaggcttagactggccatgaactcaagctctcagagggctgccaggacaaaacatcccttaatcctttgcccttcaaatcaagaagtccatttcaagtctcagtcaatttaaatggataaaacaacaacaacaacaacaacaacaacattgggagtgtctaacacttctgcccttcagggctgtgctggggtgtttatcggtatttatcagctaggtggcctgattcctatctgtgaaacttagagtctagttgtagggatctacctatgtggatgacagcaatcataaaatagatatgagatatatagttatggacaaataagaatatagttcagtgttaaaacacatggttctggcagtgcctttatatatatatatatacacacacacacacacacacacacacacacgcatatataaatgtgtatatatatgtgtgtatgtgtatatatatatatatatatatatatatacacacacacactttaaaaaaattttgagtctcactgttttgctcaggctagagtgcagtggtacaattacagctcaatgtagcctcgacctcgaccttctgggctcaagcaatcctcccacctcaacctcccaagctgggactacaggcacttgccaccaaacccagctaacattttgtatttttttttgtagagacagggtttcactatgttgcccaggctggtctcaaactcctgggctcaagcaatcctcctacctcagcctcccataatgctaggattacagatgtgagccatcattctcagcctgacagtgccttctttcttcctgccatgatgcacatctagcctgaactggacaaacccattaagggaaagggggcttgcgctttcctgaggcctggtcatctcccctgctcacctcccgtaggatcctctttaggaggatctgcagagccctgtgccagcaaatgcaccctatttagaatgatattgaagagcctaccaaatgccaggcactgtgttctgctcattgctcatgctttttttttttttcaaaaaaagaaactaaggcacagcgaagttaagtaacttgcccaggatcacacagatgttaaactgggatttgtgacctagttctcccaggcaccaaagtacatgctcttaacaactgtgatttttcacttcatgttacaggcagtagcattaacttggataggaaaagatatagagtagagtattgtcttagaaagcaatctcaagcatccttggcttcagaagaagcaccttcaacctgcttctggtacctgatccaaagacattttggtggctccacccaggccagggacaaccactggatacaagcatattcttgttctgaggtttccaatcctggctgctcatcacaatcacccaagtgctttaagaatacagattctcaggcctctgtttaaaagagtcgaagtaggcaagcccagggaggaacctggcaacctgcatttaagaagggccccgtggaaccaccaagtattagcacaggactggtccacaggtcctgtctgtgtgcaccaccctggaaccctccaagaagatgtctggttcccactagtttatgcagtggctttgctttgttataataccagggttattctgctgggggcatgttctggggctctacaatccaaatagtgcaagagagaaaaggcaatgtggctgtgagctgtgtaagtgtctgatcattcctagaaaaaaggacactcacatttggagaggacctgctgtgaaggcaggcctggcactcccacttcttcataataaaaactcctccatcagtctcttactgcgcatgcactgtagggccacaaagtcacaaagtcctggtacttcatccctgagagattccccacctcagagcctaataacttttatgttagtttcaattctaatcagcttggttaccttgattcataactcatagcaagttaatatcagcaaattaaaagcaaaagaataggccgggcgcagtggctcacacctgtaatcccagcactttgggaagctgaggtggatggatcacctgaagtcaggagtttgagaccagcctggccaatatggcgaaaccccatctctactaaaaatacaaaaattagccaggtgtggtggcaggtgcctgtaatcccagctactcaggaggctgaggcaggggaattgcttgaacctgggaggcggaggttgcagtgagctgagatcgcgccactgtactccagcctgggcaacaagagtgaaactccctctcaaaaaacaaacaagaaaataaatataaataaaagtaaaagagtataaacccattgatagcagtaaggatttgtcactgaccgctgatggctagcctcttttcctcaatgatacagtaataataataatagtttaaatttactggacatttaccatggttcaagcactgtgctaagctatatatatatgatctcatttaatctctcaactcccaattaatatacccattttatatagcagtaagctgaagttcagagaggatcgttacttgcccaaggcccgccagtaaactgaagtctgttctgatgctaaatgactacaacaagagaagtgtaaaaagcaaggctgggtaatcccagcactttgggaggccaaagtgggcagactgcttgaggccaggagtttgagaccaacctggccaacatggtgaaacccagtctctacaaaaaatgcaaaaattagccagatgcggtggtgctcgcctgtaatcccagctactcaggaggctgagaggcaggagaatcgcttgaacctgggaggtggaggttgcagtgagctgagatcacaccactgcactccagcctgggccacagagctagactccatctaaaaaaaacaaacaaataaacagagaagtgtaaaaagcagacgtggcctcaaggaagggactacatggccctacccttcaataggcagtcctgaggatcacagatcagtgtggtaaatgacatccattctctgactgtcagtcagagaaaggctatgttagccaacaggctttgtctaacgagacagggaagggggtgttatatatttaaaaggcttctgtgtaaaatggactacaaacattttaaagtgtcagagtaagtgtcatatatgtagatgccctattgcctccaatcaccagacttctaagcatagtcaaggtgaagtgagagttgcatgcataagttttccccatgcatcatagccaaagatacttccttactacctcttaatctcatggttatttgcattattttggttacaggagctaaatcccctgaagcagcagaaagctttcattctggacctgttcaggactcggaatattgccataatgaccattatgtctttgctgctatggtaagtaataagtgacctggaaatgcagatatccagcacataagtatgcaactgattttcttaactcagaggaacattatgacaacgactgggttttcctgaggaaaaattaagattataaaattctaaattattttgaaatgcctctattcagttcatgggactagatattgaaaaatgtcactgggcgcaatggcttacgcctgtaattccagcactttgggaggccaaggtgggcagatcacctgaggtcaggagttcgagacgaatctagccaacatggtgaaaccccgtctctactaaaaatacaaaaattacctgggcatggtggcacatacctgtaatcccagctacttgggaggctgaggcaggagaatcacttgaacccaggaggtggaggttccagtgagccttgatcgcactactgtactccagcctgggcagcagagcaagactccatctaaaaaaaaaaaagtcacagggtacagtatttaagtctgcagtactgggacccaaagggaaagcattcccttccccctcctaaagttatgggattgagatcattgatgtccctgggtaatggttccctccccaccaaaaattatgagattaagactaatgatgtccgtgttgcctgaggcagagatgctaattcagctcctgcttcctgaagctgacctggcaattgaacactgaggctagaataacctagatccccattgcctggattggagccttgatcagctttttacacgtgccaatagcaaactaacaagtggctttcaggcgcagaaatactgaattggctttatagattagatttaataatttatctgccaagaaaaaaggaaaaaagaaaattcctactctatgatggcagcacacacacacacacacacacacacacacacacacacgatgatcgtcagaactggtagatttaggctgcagctaatctaagtttatttttaagggccatcctacttggcaattagaagagatcaatgacagagcttatgcgtctgaattaagcaagtgtgtcctaggtacatgggcttcttagttcttacatttcagcctatatccctgatgcaaatgttcttgggtagtggtgctactaagctaataaaaaattagtcactagttctatctaaactactcctattactaaatgggaaaatcactaagatcccttgagcatacttatttgttgtgtttatgaattagtccttgtattatctaatttgggtctagtatgtgtaaaaagatccactagtgttcctgaagtcatttttcagatatcctctgcttctcagtcatgttaataataagcaaatttctacacaggggtgtctgcatagtgcagttgtaacaaaaactcaggttcagtcactcacagcttgcagcgtccaattaacaagagcaaagtctgatgtaaggaaagtgactttttattccaaagctagcttagggagaaaggtatcggcttcctgcctgaagggtaccaccgctcctctttttgaagcggaaagcaggcacttctaaaaggcaggggaggacgcgagcaggtgagggatcagagggctagcttgctgccttatctactgggcagttgaggtggtgccttcatgggcagaaacaggttgtataggtggccaaaaactctagcaggcatactttgagttggaaattgactgatatcgcttgaggaaatctgggcggtgagagttccactctggagcttctaagcacatagttagatgaatttgccctgcagggagtgtccagtgaagaggaggttaaaaggctataattgcacttctaaagagctaagtagaaagtgcagaaaaggaggaaagagaaaagaagagagagagaaaataaactatctcttagaaaaatgggggtactcagttacatagttatttttccacagagaagcttcttttttttatttatgtttttatttttttgagatagagtttcgctctgtcacccagcctggagtgcaatggtgcgatctcagctcactgcaaccttcgcctcctgggttcaagcaattctcctgtctcagcctcccaagtagctgggattataggcacatgccaccaccatgcctggctaatttttgtcttttaagtagagacggggtttcaccatgttggccaggctggtctcaaactcctgacctcaggtgatttgcctgcctcggtctcccaaagtgctgggatttcaggcatgagccaccacgcatggcccacagagaagcttctacatggaagttaactataatgacagaatatacagactgcagtctgtgatactttgaaggattaggggacattcactcttttccctaaagagaatcagaatttattctaagtgaatcccacagtatgacccttgtatctcttttttgttaaagaatgaaatctggattttatgttcactgatgtgactaatattttttcttcatataatagctctaagagattgaggaggtacaaactattcaggaaataggaaaacttgaaatcaactagctgagaaaagttattgttgaatattggtatatctagactagcactgtccaatagaactttctgcagtgacggaaatgtttcatatctatgtcgttcaatatagtagccactagctacacgtggctattgagcacttgaagtgtggctagtgtaactaaggaactgaatttgtaatcttatttaattttaatttattcaaatttaagtagccaatgagggtagtggctacttataagacagcaagatatagagaatttcttgaccatcataaaattttagagcgattcacaccatccctttgtcatttttaccttcttctttcaggatgctgacctcagtgggttactttgctctgtctctggatgctcctaatttacatggagatgcctacctgaactgtttcctctctgccttgattgaaattccagcttacattacagcctggctgctattgcgaaccctgcccaggcgttatatcatagctgcagtactgttctggggaggaggtgtgcttctcttcattcaactggtacctgtgggtaagaagttaaccaagatgaacagcttaccagaaaagacccacatattgactaggctgcttctgagtcactgctccatgtttattcagcctttacatcataagccattcataagtcaattagacaggtgattgctcactacgtatgttgtttcctgtgttcaaaacaactaccccaaacagaagagacagtctcagagaagcagaaagcaccaaagaggaagagtaactctcccagtcatccccttcacagaaagactcacctaacatctccctttaactcatagtcatgattcctaatttctggctactctcaaacattttccctgggtgtatattcaagtattacagtgagtaggacatgtcggttccaggatacattcagtggttttctggtctgaatctttaagtagttaaatagcacacaaaaggatatatgcttcccttttccccttgtgtctgacgttctcataatattaaaatgtcactaaattattgatagtaatagaaatacatatttcttaataataagaaagaggatagaaaggattggtcctcctctttgaagataaaacttaactatattaacatgctaatagcttacccatgaaactgttttaacaaacaaaagacaagtggacaaaggtcactgaatgcattaatgacctagaataacagtagaacaaagtacaaagccacccctcacatgagctccatctttgtccatgcccaaatattaggacatttgaagagaaaatgctattttgggaatatatttatgttaataaaagtactcccactgaagcaaaaaggacaataaaaataactgatataagaaagtatcacttctaaaagcaccattgtttataccgggtctcttttccagattattacttcttatccattggtctggtcatgctgggaaaatttgggatcacctctgctttctccatgctgtatgtcttcactgctgagctctacccaaccctggtcaggaacatggcggtgggggtcacatccacggcctccagagtgggcagcatcattgccccctactttgtttacctcggtgagctgcatcttgtgcatttgttcttcctttaaattagttttcaatgtaaaagtaagattttcattgtgaaaatgtcaaatagcatagaatgtactggaaaaaagtacaagttcacctctcctctcccaggaggagctctagaaagccaatcacaaactggtgagtagcgctacagacattttgttttgcacaacatcatgtacacaggtatgtatataattttttaaacacacaagcaactcaggcgtggtggctcatgcatgtaatcccagcactttgggaggccaaggtaggtggatcacctgaggccaggagttcaagaccagcctggccagcatggtgaaaccctgtctctactaaaaataaaaaaattagccaggtgtgctggcaggtgcctgtaatcccggctactctggaggctgaggtaggagaattgcttgaacccaggaggcagaggctgcagtgagtcaagattgcaccactgcactccaacctgggcaacaagagcaaaactctgtctcaaaaataaataaaaataataaaaaataaaaagaataaacacacaaataacattatatatgttaaaactttttaaacttaacattgtatcagaatatccttccaaatagttacatattgctcctttaccttctttttaaataggtacctccttttaaaaatgtatataagtacattttaaaataagtatatgtaagtataatctacagatagattcacagaagtaaaattcctggagcaaagagtgccgttaaaaaattatatatatatgtgtgtgtgtacataatgttgtgcaaaacaaaatgtctgtagggctactcaccaaacagttcatgttggttttctagggatcctcctgggagaggggaggtgaacttgtacttttttccagtacattccatgccatttgaagttttcacaatgaaaatcttacttttatactgaaacacataatttatttaaccaggctccaatgaatggaggacatgtaggtcatttccaggtttttgctattacaaataacattacaacgaacattctcctatgctcctacaccctttgtgaatttacttacgtatatttggatttacaggtagattcatagaagtaaaattcctggagcaaagagagccattaaaaaatttcatagatattcccaaattgaactctacatattgtgccaattataatctaattattaataggtaagagtggttttcaataatctcaccaacaataaagattacctttttttttttttttttttttttctgagacagggtctcactctggagtgtagtggtgcgatcctagattcccagctcactgcagcctcaatcccccaggctcaagagatcctcccacctcagactcccaactagctggaactacaggcatgcacaccgtcaagcccagctaatttttttttttttctggtagagacgggattttgccagtttgcccaggctggtttcgaactcctgggctcaagtgatccacccgcctcaacctcccaaagtgctgggattacaggtttgagccacagcacctggcctacctaattttttaatcattggttatctgttatgtgaaaaatggatatcattgttactttcattcctatttattaattatgaatgaggttgagcatgtttttgtgtattttttggccattttatttatttttcagtgaactgactgctcatgttctttgcccctttttttttttttggagatggagtctcactctgtcacccaggctggagtacagtggcgcaatctcagctcactgcaacctccgccgcctgggttcaatcaattctcctgcctcaacctcctgagttgctgggactacaggcgcatgccaccatgtccggctaattttttttttttttgtatttttagtagagatggggtttcatcatattggtcaggctggtctcaaacccctgacctcaggtgatccacctgccttggcctcccaaagtgctgggataacagacatgagccactgtgcctggccttctttgcccattctttaatggtgtatatcgggcaaaattcagccctgataattcacataggttcttttctattttccctaagtgccagctggtctgagaaataaagggacagagtacaaaagagagaaattttaaagctaggtgtccgggggagacatcacatattggcaggttccatgatgccccctgagccataaaaccagcaagtttttattagtgatttcaaaaggggagggagtgtacgaatagggtgtaggtcacagagatcacgtgcttcacaaggtaatagaatatcacaaggcaaatggaggcagggtgagatcacaggaccacaggaccggggcaaaattaaaattgctaatgaagttttgggcacgcattgtcattgataacatcttatcaggaaacagggtttgagagcagacaaccggtctgaccaaaatttattaggtgggaatttcctcatcctaacaagcctgggagtgctacgggagactggggcttatttcatccctacagctacaaccgtaaaagacagctgcccccaaagtggccattttagaggcctaccctcagggacgaattgtctttctcagggatgttccttgctgagaaaaagaattcagcgatatttctcccatttacttttgaaagaagagaaatatggctctgttctgcccgactcaccagcggtcagagtttaaggttatctctcttgttccctgaacattgctgttatcctgttcttttttcaaggtgcccagatttcgtattgttcaaacacacatgctctacaaacaatttgtgcagttaacgcaatcatcacagggtcctgaggcgacatacatcctcctcagcttatgaagatgacgggattaagagattaaagacaggcataggaaatcacaagggtgttgattggggaagtgataagtgtccatgaaatcttcacaatttatgttcagagattgcagtaaagacaggcgtaagaaattataaaagtattaatttggggaactaataaatgtccatgaaatcttcacaatccacattcttctgccatggcttcagccagtccctcctttcggggtccctaacttcctgcaacaggtgtattcatctttttctttttgacttgtgcaaactctttgcaatggaagaaattagccccttgtatatatgttgtaaatatttttcctagtttaccatttgtattttcactttatgatatctttgtaatgaagacaattttagtttttatatactcaaaggtgtcaatctgaaatgaaactacagaggtgtttcagcggcatgttcaatctgatgtaggatctgacaccccatgcctggtcctcattaaggactctactggtgagaaatgcagacacacctcatcaattgggcaattggttacctactggtacacacgtacacacacacacacacacacacacacacctgaaaacatgtatgaattctcaggaaaggtataatccaaacccttacagagaaagagaaacattttcctaacaaacatattctgcacagttgccctgtgccacacctgagatagcagattatacagagtggtgttatttttccctttgtccttccctgtactttcaaactatttcaaactatgctcagatggtccagtggtcagacactggtacataagacagggagtccaagagtctcctactccacacagctactcctgttagtgacacagaggcctcagagaagctgcaataacaatattttccttatgttttgggtcaaatgaaatccatgggtgtgctgttcctctgtaagctctgtatgtatacaggggcaaagcaagatgaggatctgtttttctcctgtgtgagtaaagcttcacaaagagattacatattaacccaagacatgtaagtgctccaaaaagaagccaaatccaggcacacagtgcctttacagaatgtgcctgatacttataatttactgatttaatctgaagtgaacataatacttagttgttttttttttttttttttttttttttgagtctcatagccctgtggacctaactttccactgcagcctactagtttgggcaaaagcagagtcatgccagacctatcatagccaaaacctatccctgaaacatcctggttaacctccttctccttgatgtcctcccatcccccatttccaattacctccaccttaagaggagaactctggtaggcaaagaactctaccaaaggaacatctgtcacacatgactgagtagtagcttagaggataccagttgacaggaaagaatgaaaagccttatgataatgcaaaaggattatagacatgcacaatgtcatctgccaaaaagaaactgatattttgcttacttttttttctctgaaaatgttcagatttaaatccattctcttatactgttcaccaacttcacaaaatgatgctcaagagtgcccagagagtcctcctatctgattgatgttcttatgtcccgggctttacaggtgcttacaacagaatgctgccctacatcgtcatgggtagtctgactgtcctgattggaatcctcaccctttttttccctgaaagtttgggaatgactcttccagaaaccttagagcagatgcagaaagtgaaatggtaagtaggacttttaacaaaatgataccaaaatgccttagggagaataagcatggaagaatagctaggaaggttctgaaatagaagagtaataagtagagactagctctatcagataataaagcatattgttggctgggcacagtggctcacgcctgtaatcccagcactttgggaggctgaggcaggtggatcacctgaggtcaggaatttgagaccagcctggccaacatagtgaaacctcatctttactaaaaatacaaaaaattagctgggtgtggtggcagtcacatgtaatcccagctactcaggaggctgaggcaggagaactgcttgacccaggaggcagaggttgcagtgagctgagatcacaccactgcactccagcctgggcaacaagagcaaaactccgtctcaaaaaaaataaataaataataggccaggcgcggtggcacatgcctgtaatcccaacactttgggaggctgaggcaggcggatcatgaggtcaagagatcgagaccatcctggccaacatggtgaaaccctgtctctactaaaaatacaaaaattagctgggcatggtggcacacacctgtagtcccagctactcaggaggctgaggtaggagaattgcttgaacccgggaggtggaggttgcagtgagccaacatcatgccaccgcactccagactgggcaacagagctagactctgtctcaaaaataataataatagtaataaagcatattgttgagcaatagtaattaaaacaatgtgataatggtataggaatagaaaccaatggaataggatagagttcaggataaaacccaagaaaatataaaaattcagtatgtaataaaaagtagcaaagtcaagggggaatagttattcagtaaaaggtattagaacattcagctagacattttgaataaattaaaaagttgtctctttaaaaaatgcattggctgggcatggtggctcacacctgtaatcccagcacttagggagattgaggcaggcagattgcttgaggtcaggagttcgagaacagtctgtccaacatggtgaaaccccatctctactaaaaatacaaaaattagccaggcatggtggcgcacccctgtaatcccagctcgcgggaggctgaggcaggagaatcgcttgaaccagggtggtggatgttgcagtgagccgaaatcgcgccactacactccagtctgcgtgacagagcgagactccgtctccaaaaaaaaaacacatcaagataaaatccagacagttaaaaaatttaggcctaaaaatgtaaaatcataaatataccaggaggaaacaaacatttttataaccttagagaagatcttactgagcataacataaaatcaaagaaccataaaggaacagattgatatatctgattgtacattttttaaattattggcaaggcaaaaagaaaccacccacaaagacaaaagtcaataagccaggagaaaatatttgctacacaaaacctaaacataaggctaatatacttaatatacaaaaagctcatagtaaccagtgagaaaaagacaaacaattcagtaggaaaaccagcaaaggacaagaacagacagtttacagaagaagtcacttcagtgtccaatatatacatgaaaaaagttatttgtccacattaataaggaaatgcaaaaataaaacaattcaacatctttttttggcttatgagattgcgcaagggtttttcttcttgacgcaaaccaattctgacacctattgagtgtcctataatgcagttcaattttgacaatacctaaatttagcatcagactccacaggtgtaaagactcagtcccacaatactgccttgcttcacttgccactcacaaatgtcaggtccccaggttacccacatttctctctgactttgctaccaagtctggggttccaacaaatcccctccttgggtttgattatttgctagaatgactcacagcactcagaacactggccactagcggtttcttacaaaggatacaaatgaacagccagatgaagaggtacatacagagaggtctggaagggtcctgagtgcagaggttctgtccctacggagttaaggtgcactgccctcctggcatgtggatgtggtcaccaactcggaagttctccaaaccccatcatttagaggttttcatggaggtttagtcatgttggcatgatggattattaagtctatccccagcctctctcctctccccagaggttccaggcttctaatccaggcttagtcttctggtgaccagcccccaccctgaagctatctaagggcccagccaagggttgcctcattagaacaaaagaagcttttatcactccctatcactccagaaattataagagatttaggatctctatgttaggagccagggacaaagaccagtatctttttatgacaccacagcaaacatttaaaagattagtggtatttaggagaagtttagagtttcgagtaacactgcctggctttaaatcccaaatctactgcaaaaatttgggcatatcacttaatattcactaagcttcagtattcccatctgctatatgggatatttcatacggctattttgaggttataaaagataaagtgttcccagtgcctggccttgataaaggtaactctgcatatgaattaattctgatccctgacagaacatttatagcaaaaagtgcccattgttgataagttgttttcttctaatgatagaactacttcagtatcaactttaattgccaagaatttcatgcctccctctctatcctttgcttgggaaaactgtgaaagagtttaaattctggcttctatgcttaattaagaaagtagcctcagatgtttaaaagcataaaatattagatctacaccatgaggttctcattagagttcaaatagttacttgttcattgattggagaaatatttttcaatgtcaatttggatggagcattttgaggaggaaagtcttgaatatttaattttccttagcatctattttattttcaggttcagatctgggaaaaaaacaagagactcaatggagacagaagaaaatcccaaggttctaataactgcattctgaaaaaatatctaccccatttggtgaagtgaaaaacagaaaaataagaccctgtggagaaattcgttgttcccactgaaatggactgactgtaacgattgacaccaaaatgaaccttgctatcaagaaatgctcgtcatacagtaaactctggatgattcttccagataatgtccttgctttacaaaccaaccatttctagagagtctccttactcattaattcaatgaaatggattggtaagatgtcttgaaaacatgttagtcaaggactggtaaaatacatataaagattaacactcatttccaatcatacaaatactatccaaataaaaataacatcattgtattaacgcaaatattaggtgacaacaatgtgtgtgtatgtgtgtgtgtttgtacatgtggaagtgaaccagcacagtcaaaattatagtagtttctgaagtgaaccaaatgattatatgcagtattcctatccagaaaaccttccacactcctttgagagggagtgatcactgttagaggaaaaaacaaaccactttttaccctgtactgtcacactcaacccacaatacttctgtgaccagatgtggtggggggcttctcatacaccaagtaattctccagcagataccaatggggtgttctctaatagaattaagctctgaccctatctgcggggagatagtgtcagatcccacaggttgtgtgctctgtccctcttcagatgccattcgaacatccaagccacacgcacctctgacctaccaactacaaaccagggtttccacagaccccttcttaggttcaattaattttctagaaaggctcaccaaattcagctaaacctttacatttgccaatttattataaaggatacagatgaacagccagatgaagcagcatgaagggctaggtctggaaagattccaagtgcaagagcttctgtcccagtgaaactggggtgcagtgccctcccagcttgtggacgcatttactggaagctcctcaaatcttgttgttcaagagtttttaggcagcttgatctccagcaccttccccacccagagatcagtgggtagagctaaaagttccaaccctctaatcctcaaatgacctggtctttccgggaactagccccatcctaagaatatctagggccccacattaagtaacctcattagcataaactcaggagttatcgaatcaaaggggctcattatcactaatgagatattcctaccactcaggaagttctaaaggtttggggaactctatgacaagaactgagacaaagaccaggtatccatatttcatattaaaccacaatggtagatattaattgtattttagcctggctcatctggccaatctgcctgcaagaaggcagcaaggcagctcctagctacagtttcagcagctacacctcacagcccttacaccattaaatgctccccatttgttgtgcttttgttgagcacgtgactaaacctcctgtttcctaaaaatggcttaagatatattttgccggtagatacaaaatcagaaaaactgcacaaaccagttagattggtagaggtggtttatgtgccccatagccaagagaggtgtgcaccaaggaggatatcatcaaatctgacaatctggaaagcctttgaaactgttcttttcctaagcacagtattcagctgtgtcctcttgaacccatatctatcaggtcaacagctttagcccattccacatgatattggctgtgggtttgtcatatatagctcttattattttgagaaacgttctatcaatacctagtttattgagagtttttagcatgaagggcttttgaattttgtcgacggccttttctgcatctattgagataatcaagcggtttttgtcattggttctgtttctgtgatggattatgtttattgatttgcatatgttgaaacagccttgcatcccagggatgaagcccacttgatcgtggtggagaagctttttgatgtgctactggattcggtttgccagtattttattgaggatttttgcatcgatgttcatcagggatattggtataaaattctctttttttttttttttttgagacggagtctcgctctgtcgcccaggccggactgcggactgcagtggcgcaatctcggctcactgcaagctctgcttcccgggttcacgccattctcctgcctcagcctcccgagtagctgggactacaggcgcccgccaccgcgcccggctaatttttttgtatttttagtagagacggggtttcaccttgttagccaggatggtctcgatctcctgacctcatgatccacccgcctcggcctcccaaagtgctgggattacaggcgtgagccaccgcgcccggcctctcttttttttgttgtgtctctgccaggctttggtatcaggatgatgctggcctcataaaatgaattagggaggattccctcttttctattgctaggaatagtttcagaaagaatggtaccagctcctctgtacctctggtagaatttggctgtgaatctgtctggtcctggactgtttttggttggtgggctattaactactgcctcaatttcagagcctgttattggtctaatcagagattcaacttcttcctggtttagtcttgggaggctgtatgtgtccaggaatttatccatttcttctagattttctagtttatttgtgtagaggtgtttatagtattctctgatggtagtttgtatttctgtgggattggtggtgacatcccctttatcactttttataccatcgatttgattcttctctcttttcttctttattagtcttgctaacagtctatcaattttgttgatcttttcaaaaaacgagctcctggattcgttgatttttttgaagtttttgtgtctctatctctttcagttctgctctgatcttagttatttcttgccttctgctagcttttgaatttgtttgctcttgcttctctagttcttttaattatgatgttagggtgttgattttgatctttcctgctttctcttgtgggtatttagtgctataaatttccctatataccgtgctttaagtgtgttccagagattctggcacgttgtgtctttgctctcattgttttcaaagaacgtctttatttctgccttcatttcgttatttacccagtagtcattcaggagcagattgttcagtttccatgcagttgtgcagttttgagtgagtttcttaatcctgagttctaatttgattgcactgtggtctgagacacagtttgttgtgatttctgttcctttacatgtgctaaggagtgctttacttccaactatgtggtcaattttggaataagtgtgatgtggtgctgagaagaatgtatactctcttcatttggggtggagaggtctgtagatgtctattaagtctgcttggtgcagatctgagttcaagtcctggatatccttgttaaccttctgtctcattgatctgtctaatattgacagtggggtgttaaagtctcccattattattgtgtgggagtctaagtttctttgtaggtctctaaggacttgttttatgaatctgggtgttcctgtattgggtgcatatatatttaggatagttagctcttcttgttgaattgatccctttaccattatgtaatggccttctttgtcccgtttgatctttgttggtttaaagtctgtttaatcagagactaggattgcaacccctgcttttttctgctttccatttgcttggtagatcttcctccatccctttattttgagcctatgtgtgtctctgcacgtgagatgggtctcctgaatacaggacacggatgggtcttgactctttatccaatttgccagtctgtgtcttttaattggggcatttagcccatttacatttaaggttaatattgttatgtgtgaatttgatcctgtcattatgatgttagctggttattttgcttgttagttcatgcagtttcttcatagcatcgatggtctttacaatttggcatatttttgcagtggctggtaccggtttttcctttccatgtttagtgcttccttcaggagctcttttagggcaggcctggtggtgacaaaatctctcagcatttgcttgtctggaaaggattttattcttcacttatgaagcttagtttggctggatatgaaattctgggttgaaaattcttttctttaagaatgttgaatattggcccccactctcttcgggcttgtagggtttctgccgagagatccgctgttagtctgatgggcttccctttgtgcgtaacccgacctttctctctggctgcgcttaacattttttccttcatttcaaccttggtgaatctgccaattatgtgtcttgggtttgctcttcttgaggagtatctttgtggcattctctgtatatcctgaatttgaatgttggcctgctttgctaagttggggaagttctccttgataatatcctgaggagtgttttccaacttggttccattctccctgtcattttcaggtacaccaatcaaacgtagatttggtctttcacatagtcccatatttcttggaggctttgttcgttcccttttactcttttttctctaatcttcttgagttatttcattaatttgatcttcaatcactgatatcctttcttgatcgaatcggctattgaagcttgtgcatgtgtcacaaagttctcgtgccatggttttcagctccatcaggtcatttaaggtcttctctacactgtttattctagttagccattcgtctaatctattttcaaggtttttagcttccttgcgatgggttagaacatcctcctttagctgggagaagtttattattactgaccttctgaagtccacttctgtcagctcgtcaaagtcattctccacccagctttgttccattgctggcaaggagttgtgatcctttggaggagaagaggtgctctggtttttagaattttcagcttttctgctctggtttctccccatctttgtggttttatctacctttggtctttgatgttggtaacttacagatggggttttggtgtggatgtcctttttgttgatgttgatgctatttctttctgtttgttagttttccttctaccagtgaggtccctcagctgcaggtctgttggagtttgctggaggtctactccagacctgtttgcctgggtatcaccatcagaggctgcagaacagcaaatattgcagaacagcaaatattgctgagtgatccttcctctggaagcttcatcccagaggggcacctgcctgtatgaggtgtcagtcggctactgggaggtgtctcccagttaggctacatgggggtcagggacccacttgaggaggcagtctgtctgttctccaagctaaaacaccatcctgggagaaccactgctctcttcagagctgtcagacagggatgtttaagtctgcagaagtttctgctgctttttgttcagctatgccctgccccagaggtggagactacagaggcagtcagccttgctgagctgtggtgggctccacccagttcgagcttccacagccactttatttacctactcaagcctcagcaatggcggatgcccctccccatgccaggttgctgccttgcaggtcaatctcagactgttgcactagcagtgagcaaggctccatggacataggatctgtcgagccaggcacaggatataatctcctggtgtgccatttgctaagactttggaaaagcgcagtatttgggcaggagtgtcccgtttttccaggtaccatctgtcacggcttcccttggctaggaaaaggaaatcccctgactccttgcgcttcccaggtgaggcgatgccctgccctgcttcggctcaccctccgtgggctgcacccactgtccaaccagtcctagtaagatgaaccaggtacctcagttggaaatgcagaaatcatccgtcttctgcgtcgatcacactgggagctgcagaccagagctgttcctatttggccatcttggaacggaatcctcaatgagatattttaagaagttaaaaaatatttgtaaagagcatctgaaaaaagaaatatgtaatatgtttaagaaatttttgaaaaagatcattgataaggggaaatgttctcttacatatataaaaacacacaatgactacactactctgggtttcctggaaaacacacaaacacacacacacacacacagacacacacacaaaagataaatcaatcaacgaaatagaagaggtatcacagaaacagacccaagtgttgaaaaattgtaacatatgataaagatgaattataaattatcaagaaaatgatacattgttgaagactggtgctgggacaatcgacaagctgaagaactggtaaaaatggaaaaactgggggaataaatagtatcccaccataaaccacataccaaattaattcctgatcaactaaagagccaaatgtaataaatgtaaataaaatagagccaagagtaaataaatcaaaagctagaagaaaatataggtgacatttaattttaagatgaataggaaattgaagataaatagattttactataaacttttaaagaattctgtacaacagaaaatcttaaaattaactcaagttggaaaagtattaacaaaaacatactggacaaaattaccatcctttgtacatatgcatcaatttttgtaatgcccactaatactccagttaaagcaaatagggctaagtacatagcctttggagacaagtgttccaggacctgatgctgggtgtgtcacttctctatcagctgtgtgactttgagcaagttacagtcttccctaaaactcagcttcttcatctgtaaagagggatgataacaattccatttgggtggggattacatgagacaatgcatactgtgtttggctccatacctggcaaagatgtccacgtttttgctatctctcatcttactcatgtcctcacaccccttcttggccagcttaaattccatgcttaatcatcataatcatcttccttgcccctttcttatctgccttgcttttgtgggaaactataaagctggttaaatctaacctccctcctacttcttgctagcacctgcatagccaaatgtagatggaaaatatattccatctgactggtttcactttaaactgaccatcagtgacttcaagaggatcctaattgccctggttcattctctatcctggaagaccttctttctcttcagaactccatcacctcctcccccatgatcaccctcagctgtgccttggcttcctatttcacctagaaaatagaagcaatggagagaacctctacaagcagcataatccaccagcctaactccatctgtacccacaccctctgtcttttctcccgtttctcctgaatggtctctcctccccgctggagtgcagtggctcactgcaacctctgcctcccaggttcaaacgattctcatgcctcagcctccgaagtagctaggattacaggcatgcaccaccatacccagctaatttttgtatttttagtagagacagggttttgccatgttggctaggctagtactgaactcctgggctcaagtgattggcctgcctcagcctcccaaagtgctgggattataggtgtgagccactgtgcccggccccagccttatatacttcttacccctcccccaccccctactcccttaccaacagcagaaaagtaacatgatgtaattgagatagccctgactactatgctgagagtagattgaaggggcgtaggagcagccttaatgaagaaggattggctgggggctaacagaatacaggcaagaaactggattctacatatgttgaaattatggcaaaagactttattgacagattggatgtggagtacgagaggaagagcagccaggaaaataaagtttccatttactgagttggggaggacttcaggaagagcagatttgggatgaaattaggagcacatgttgctctagcaattctcctgactcccccatcataaatcttttccctctctactggatctttcccattcagtatgcaaagaggctgtaaaagctctctcttgacccagtttctgctgtcagctcctgccccatttctccctgtcccttagcagtgaaactccttggaagattgctatatctacttgctactttcaactttgttcttccaattttcacttggccccactacaattaagctttagccctcacctttcaccagagcacctctatcaaggtccgcagtgacctgcatgtttctgaattcaatagtcaattcacagtcatcatcttacctgacctctcaaggcatttgacaaactcatttctctttcatccttgaactgctttctacatgacacttgcgccaggcgtggtggcacacacctgcagtcccagctacttgggaagctgaggcaagaaaaacacttggacccagaaggcagaggttatagtgagccgagattgtgtcattgcactccagcctgagtgacagagtgagactctgtatcaaaaaaatcaacaaaaatgacacttgcttggttttcctcttaccttgttggctgctcctttaccatctagtgtgctggtttttcttcatctccgctactgcccaaaattggagtgcccagaacttagtcttcagtcctcttcctttttaaaaaatccagtctcatgatttaaatatcatctctgcactgatgaccaccaacacatagagagagtgaactccaggctcacataataactgcccacttgatatcctcacttggatatataataggtgtctcaaacataacatgtcaaatttaacatgtgctcctaatttcatcccaaatctgctcttcctgaagtcctccccaactcagtaaatggaaactttattttcctggctgctcttcctcttgtactccacatccaatctgtcaataaaatcttttgccataatttcaacatatgcagaatccagtttcttccctgcattctgttagcccccagccaatccttcttcattaaggctgctcctacgccccttcaatctactctcagcatagtagtcagggatatctcaatcacatcatgttacttttctgctcaaaaccttccaatcgcttcccatctcagtcagattttttgaaagcccaagtccttacaatggtctataagtagaatgattacacgtcagagtttgtccagcacagtcctggcttctctccactgaactagtgttaactttttttttttttttttttgagacggagtctcgctctgttgccaggctggagtgcagtggcatgatctcagctcactgcaacctccgactccctggttcaagcaattctcctgcctcagccttctgagtagctgggattacaggcatgtgccaccatgcccagctaaattttttttttttttgtattttttagtagagaacggggtttcaccatgttggccaggatggtctcaatcccctgacctcgtgatctgcctgcctcagcctcccaaagtactgggattacaagcgtgagccacggcaaccagccctagtgttaatgattaataaccctcacctccaactttcattctagaagtctcctaatttggatgacaaattatatatggcaataacctacaggtcacatttgacagtttactttaaaagtaaacagcttccaaattaacccatcttgggaaggtcttgtgattcatggcgataccttgtcctgagtaaggaatcttagaagttcctcaaattgttgatgtactgatcaatgcaccacctactgacactgaaaaggacactgatttatttctgagtcataacattttactgattgtcttgcatgtagacatgttagtctgcatgttgcaatctgtagccaattattgtaacctttgtattgtaccctccagtgaaaaaggacaactcctgtatgaagagtccccctcctgtcttctaactttccaacttgtaacagactccagaacactctcaactttgttggtgtgttttcctgggttcatcctcacatttggcttccaataaacttttatcaaatcatttctgcctcaacagccttaatttcatttgacagtggtcatccagtttatagggccctactctaatcttcatgccctcctttagctcgctgacatcatctcttattactctctccattgctttcttcattaaggctaccaaggctttgctattctttgaacatactagacatgcttctctattagatacttgttccctcttcctaggaatg

SEQ ID NO: 1179 - DNA, 67230 bp, Homo sapiens
cggggcaaaattaaaattgctaatgaagttttgggcacgcattgtcattgataacatcttatcaggaaacagggtttgagagcagacaaccggtctgaccaaaatttattaggtgggaatttcctcatcctaacaagcctgggagtgctacgggagactggggcttatttcatccctacagctacaaccgtaaaagacagctgcccccaaagtggccattttagaggcctaccctcagggacgaattgtctttctcagggatgttccttgctgagaaaaagaattcagcgatatttctcccatttacttttgaaagaagagaaatatggctctgttctgcccgactcaccagcggtcagagtttaaggttatctctcttgttccctgaacattgctgttatcctgttcttttttcaaggtgcccagatttcgtattgttcaaacacacatgctctacaaacaatttgtgcagttaacgcaatcatcacagggtcctgaggcgacatacatcctcctcagcttatgaagatgacgggattaagagattaaagacaggcataggaaatcacaagggtgttgattggggaagtgataagtgtccatgaaatcttcacaatttatgttcagagattgcagtaaagacaggcgtaagaaattataaaagtattaatttggggaactaataaatgtccatgaaatcttcacaatccacattcttctgccatggcttcagccagtccctcctttcggggtccctaacttcctgcaacaggtgtattcatctttttctttttgacttgtgcaaactctttgcaatggaagaaattagccccttgtatatatgttgtaaatatttttcctagtttaccatttgtattttcactttatgatatctttgtaatgaagacaattttagtttttatatactcaaaggtgtcaatctgaaatgaaactacagaggtgtttcagcggcatgttcaatctgatgtaggatctgacaccccatgcctggtcctcattaaggactctactggtgagaaatgcagacacacctcatcaattgggcaattggttacctactggtacacacgtacacacacacacacacacacacacacacctgaaaacatgtatgaattctcaggaaaggtataatccaaacccttacagagaaagagaaacattttcctaacaaacatattctgcacagttgccctgtgccacacctgagatagcagattatacagagtggtgttatttttccctttgtccttccctgtactttcaaactatttcaaactatgctcagatggtccagtggtcagacactggtacataagacagggagtccaagagtctcctactccacacagctactcctgttagtgacacagaggcctcagagaagctgcaataacaatattttccttatgttttgggtcaaatgaaatccatgggtgtgctgttcctctgtaagctctgtatgtatacaggggcaaagcaagatgaggatctgtttttctcctgtgtgagtaaagcttcacaaagagattacatattaacccaagacatgtaagtgctccaaaaagaagccaaatccaggcacacagtgcctttacagaatgtgcctgatacttataatttactgatttaatctgaagtgaacataatacttagttgttttttttttttttttttttttttttgagtctcatagccctgtggacctaactttccactgcagcctactagtttgggcaaaagcagagtcatgccagacctatcatagccaaaacctatccctgaaacatcctggttaacctccttctccttgatgtcctcccatcccccatttccaattacctccaccttaagaggagaactctggtaggcaaagaactctaccaaaggaacatctgtcacacatgactgagtagtagcttagaggataccagttgacaggaaagaatgaaaagccttatgataatgcaaaaggattatagacatgcacaatgtcatctgccaaaaagaaactgatattttgcttacttttttttctctgaaaatgttcagatttaaatccattctcttatactgttcaccaacttcacaaaatgatgctcaagagtgcccagagagtcctcctatctgattgatgttcttatgtcccgggctttacaggtgcttacaacagaatgctgccctacatcgtcatgggtagtctgactgtcctgattggaatcctcaccctttttttccctgaaagtttgggaatgactcttccagaaaccttagagcagatgcagaaagtgaaatggtaagtaggacttttaacaaaatgataccaaaatgccttagggagaataagcatggaagaatagctaggaaggttctgaaatagaagagtaataagtagagactagctctatcagataataaagcatattgttggctgggcacagtggctcacgcctgtaatcccagcactttgggaggctgaggcaggtggatcacctgaggtcaggaatttgagaccagcctggccaacatagtgaaacctcatctttactaaaaatacaaaaaattagctgggtgtggtggcagtcacatgtaatcccagctactcaggaggctgaggcaggagaactgcttgacccaggaggcagaggttgcagtgagctgagatcacaccactgcactccagcctgggcaacaagagcaaaactccgtctcaaaaaaaataaataaataataggccaggcgcggtggcacatgcctgtaatcccaacactttgggaggctgaggcaggcggatcatgaggtcaagagatcgagaccatcctggccaacatggtgaaaccctgtctctactaaaaatacaaaaattagctgggcatggtggcacacacctgtagtcccagctactcaggaggctgaggtaggagaattgcttgaacccgggaggtggaggttgcagtgagccaacatcatgccaccgcactccagactgggcaacagagctagactctgtctcaaaaataataataatagtaataaagcatattgttgagcaatagtaattaaaacaatgtgataatggtataggaatagaaaccaatggaataggatagagttcaggataaaacccaagaaaatataaaaattcagtatgtaataaaaagtagcaaagtcaagggggaatagttattcagtaaaaggtattagaacattcagctagacattttgaataaattaaaaagttgtctctttaaaaaatgcattggctgggcatggtggctcacacctgtaatcccagcacttagggagattgaggcaggcagattgcttgaggtcaggagttcgagaacagtctgtccaacatggtgaaaccccatctctactaaaaatacaaaaattagccaggcatggtggcgcacccctgtaatcccagctcgcgggaggctgaggcaggagaatcgcttgaaccagggtggtggatgttgcagtgagccgaaatcgcgccactacactccagtctgcgtgacagagcgagactccgtctccaaaaaaaaaacacatcaagataaaatccagacagttaaaaaatttaggcctaaaaatgtaaaatcataaatataccaggaggaaacaaacatttttataaccttagagaagatcttactgagcataacataaaatcaaagaaccataaaggaacagattgatatatctgattgtacattttttaaattattggcaaggcaaaaagaaaccacccacaaagacaaaagtcaataagccaggagaaaatatttgctacacaaaacctaaacataaggctaatatacttaatatacaaaaagctcatagtaaccagtgagaaaaagacaaacaattcagtaggaaaaccagcaaaggacaagaacagacagtttacagaagaagtcacttcagtgtccaatatatacatgaaaaaagttatttgtccacattaataaggaaatgcaaaaataaaacaattcaacatctttttttggcttatgagattgcgcaagggtttttcttcttgacgcaaaccaattctgacacctattgagtgtcctataatgcagttcaattttgacaatacctaaatttagcatcagactccacaggtgtaaagactcagtcccacaatactgccttgcttcacttgccactcacaaatgtcaggtccccaggttacccacatttctctctgactttgctaccaagtctggggttccaacaaatcccctccttgggtttgattatttgctagaatgactcacagcactcagaacactggccactagcggtttcttacaaaggatacaaatgaacagccagatgaagaggtacatacagagaggtctggaagggtcctgagtgcagaggttctgtccctacggagttaaggtgcactgccctcctggcatgtggatgtggtcaccaactcggaagttctccaaaccccatcatttagaggttttcatggaggtttagtcatgttggcatgatggattattaagtctatccccagcctctctcctctccccagaggttccaggcttctaatccaggcttagtcttctggtgaccagcccccaccctgaagctatctaagggcccagccaagggttgcctcattagaacaaaagaagcttttatcactccctatcactccagaaattataagagatttaggatctctatgttaggagccagggacaaagaccagtatctttttatgacaccacagcaaacatttaaaagattagtggtatttaggagaagtttagagtttcgagtaacactgcctggctttaaatcccaaatctactgcaaaaatttgggcatatcacttaatattcactaagcttcagtattcccatctgctatatgggatatttcatacggctattttgaggttataaaagataaagtgttcccagtgcctggccttgataaaggtaactctgcatatgaattaattctgatccctgacagaacatttatagcaaaaagtgcccattgttgataagttgttttcttctaatgatagaactacttcagtatcaactttaattgccaagaatttcatgcctccctctctatcctttgcttgggaaaactgtgaaagagtttaaattctggcttctatgcttaattaagaaagtagcctcagatgtttaaaagcataaaatattagatctacaccatgaggttctcattagagttcaaatagttacttgttcattgattggagaaatatttttcaatgtcaatttggatggagcattttgaggaggaaagtcttgaatatttaattttccttagcatctattttattttcaggttcagatctgggaaaaaaacaagagactcaatggagacagaagaaaatcccaaggttctaataactgcattctgaaaaaatatctaccccatttggtgaagtgaaaaacagaaaaataagaccctgtggagaaattcgttgttcccactgaaatggactgactgtaacgattgacaccaaaatgaaccttgctatcaagaaatgctcgtcatacagtaaactctggatgattcttccagataatgtccttgctttacaaaccaaccatttctagagagtctccttactcattaattcaatgaaatggattggtaagatgtcttgaaaacatgttagtcaaggactggtaaaatacatataaagattaacactcatttccaatcatacaaatactatccaaataaaaataacatcattgtattaacgcaaatattaggtgacaacaatgtgtgtgtatgtgtgtgtgtttgtacatgtggaagtgaaccagcacagtcaaaattatagtagtttctgaagtgaaccaaatgattatatgcagtattcctatccagaaaaccttccacactcctttgagagggagtgatcactgttagaggaaaaaacaaaccactttttaccctgtactgtcacactcaacccacaatacttctgtgaccagatgtggtggggggcttctcatacaccaagtaattctccagcagataccaatggggtgttctctaatagaattaagctctgaccctatctgcggggagatagtgtcagatcccacaggttgtgtgctctgtccctcttcagatgccattcgaacatccaagccacacgcacctctgacctaccaactacaaaccagggtttccacagaccccttcttaggttcaattaattttctagaaaggctcaccaaattcagctaaacctttacatttgccaatttattataaaggatacagatgaacagccagatgaagcagcatgaagggctaggtctggaaagattccaagtgcaagagcttctgtcccagtgaaactggggtgcagtgccctcccagcttgtggacgcatttactggaagctcctcaaatcttgttgttcaagagtttttaggcagcttgatctccagcaccttccccacccagagatcagtgggtagagctaaaagttccaaccctctaatcctcaaatgacctggtctttccgggaactagccccatcctaagaatatctagggccccacattaagtaacctcattagcataaactcaggagttatcgaatcaaaggggctcattatcactaatgagatattcctaccactcaggaagttctaaaggtttggggaactctatgacaagaactgagacaaagaccaggtatccatatttcatattaaaccacaatggtagatattaattgtattttagcctggctcatctggccaatctgcctgcaagaaggcagcaaggcagctcctagctacagtttcagcagctacacctcacagcccttacaccattaaatgctccccatttgttgtgcttttgttgagcacgtgactaaacctcctgtttcctaaaaatggcttaagatatattttgccggtagatacaaaatcagaaaaactgcacaaaccagttagattggtagaggtggtttatgtgccccatagccaagagaggtgtgcaccaaggaggatatcatcaaatctgacaatctggaaagcctttgaaactgttcttttcctaagcacagtattcagctgtgtcctcttgaacccatatctatcaggtcaacagctttagcccattccacatgatattggctgtgggtttgtcatatatagctcttattattttgagaaacgttctatcaatacctagtttattgagagtttttagcatgaagggcttttgaattttgtcgacggccttttctgcatctattgagataatcaagcggtttttgtcattggttctgtttctgtgatggattatgtttattgatttgcatatgttgaaacagccttgcatcccagggatgaagcccacttgatcgtggtggagaagctttttgatgtgctactggattcggtttgccagtattttattgaggatttttgcatcgatgttcatcagggatattggtataaaattctctttttttttttttttttgagacggagtctcgctctgtcgcccaggccggactgcggactgcagtggcgcaatctcggctcactgcaagctctgcttcccgggttcacgccattctcctgcctcagcctcccgagtagctgggactacaggcgcccgccaccgcgcccggctaatttttttgtatttttagtagagacggggtttcaccttgttagccaggatggtctcgatctcctgacctcatgatccacccgcctcggcctcccaaagtgctgggattacaggcgtgagccaccgcgcccggcctctcttttttttgttgtgtctctgccaggctttggtatcaggatgatgctggcctcataaaatgaattagggaggattccctcttttctattgctaggaatagtttcagaaagaatggtaccagctcctctgtacctctggtagaatttggctgtgaatctgtctggtcctggactgtttttggttggtgggctattaactactgcctcaatttcagagcctgttattggtctaatcagagattcaacttcttcctggtttagtcttgggaggctgtatgtgtccaggaatttatccatttcttctagattttctagtttatttgtgtagaggtgtttatagtattctctgatggtagtttgtatttctgtgggattggtggtgacatcccctttatcactttttataccatcgatttgattcttctctcttttcttctttattagtcttgctaacagtctatcaattttgttgatcttttcaaaaaacgagctcctggattcgttgatttttttgaagtttttgtgtctctatctctttcagttctgctctgatcttagttatttcttgccttctgctagcttttgaatttgtttgctcttgcttctctagttcttttaattatgatgttagggtgttgattttgatctttcctgctttctcttgtgggtatttagtgctataaatttccctatataccgtgctttaagtgtgttccagagattctggcacgttgtgtctttgctctcattgttttcaaagaacgtctttatttctgccttcatttcgttatttacccagtagtcattcaggagcagattgttcagtttccatgcagttgtgcagttttgagtgagtttcttaatcctgagttctaatttgattgcactgtggtctgagacacagtttgttgtgatttctgttcctttacatgtgctaaggagtgctttacttccaactatgtggtcaattttggaataagtgtgatgtggtgctgagaagaatgtatactctcttcatttggggtggagaggtctgtagatgtctattaagtctgcttggtgcagatctgagttcaagtcctggatatccttgttaaccttctgtctcattgatctgtctaatattgacagtggggtgttaaagtctcccattattattgtgtgggagtctaagtttctttgtaggtctctaaggacttgttttatgaatctgggtgttcctgtattgggtgcatatatatttaggatagttagctcttcttgttgaattgatccctttaccattatgtaatggccttctttgtcccgtttgatctttgttggtttaaagtctgtttaatcagagactaggattgcaacccctgcttttttctgctttccatttgcttggtagatcttcctccatccctttattttgagcctatgtgtgtctctgcacgtgagatgggtctcctgaatacaggacacggatgggtcttgactctttatccaatttgccagtctgtgtcttttaattggggcatttagcccatttacatttaaggttaatattgttatgtgtgaatttgatcctgtcattatgatgttagctggttattttgcttgttagttcatgcagtttcttcatagcatcgatggtctttacaatttggcatatttttgcagtggctggtaccggtttttcctttccatgtttagtgcttccttcaggagctcttttagggcaggcctggtggtgacaaaatctctcagcatttgcttgtctggaaaggattttattcttcacttatgaagcttagtttggctggatatgaaattctgggttgaaaattcttttctttaagaatgttgaatattggcccccactctcttcgggcttgtagggtttctgccgagagatccgctgttagtctgatgggcttccctttgtgcgtaacccgacctttctctctggctgcgcttaacattttttccttcatttcaaccttggtgaatctgccaattatgtgtcttgggtttgctcttcttgaggagtatctttgtggcattctctgtatatcctgaatttgaatgttggcctgctttgctaagttggggaagttctccttgataatatcctgaggagtgttttccaacttggttccattctccctgtcattttcaggtacaccaatcaaacgtagatttggtctttcacatagtcccatatttcttggaggctttgttcgttcccttttactcttttttctctaatcttcttgagttatttcattaatttgatcttcaatcactgatatcctttcttgatcgaatcggctattgaagcttgtgcatgtgtcacaaagttctcgtgccatggttttcagctccatcaggtcatttaaggtcttctctacactgtttattctagttagccattcgtctaatctattttcaaggtttttagcttccttgcgatgggttagaacatcctcctttagctgggagaagtttattattactgaccttctgaagtccacttctgtcagctcgtcaaagtcattctccacccagctttgttccattgctggcaaggagttgtgatcctttggaggagaagaggtgctctggtttttagaattttcagcttttctgctctggtttctccccatctttgtggttttatctacctttggtctttgatgttggtaacttacagatggggttttggtgtggatgtcctttttgttgatgttgatgctatttctttctgtttgttagttttccttctaccagtgaggtccctcagctgcaggtctgttggagtttgctggaggtctactccagacctgtttgcctgggtatcaccatcagaggctgcagaacagcaaatattgcagaacagcaaatattgctgagtgatccttcctctggaagcttcatcccagaggggcacctgcctgtatgaggtgtcagtcggctactgggaggtgtctcccagttaggctacatgggggtcagggacccacttgaggaggcagtctgtctgttctccaagctaaaacaccatcctgggagaaccactgctctcttcagagctgtcagacagggatgtttaagtctgcagaagtttctgctgctttttgttcagctatgccctgccccagaggtggagactacagaggcagtcagccttgctgagctgtggtgggctccacccagttcgagcttccacagccactttatttacctactcaagcctcagcaatggcggatgcccctccccatgccaggttgctgccttgcaggtcaatctcagactgttgcactagcagtgagcaaggctccatggacataggatctgtcgagccaggcacaggatataatctcctggtgtgccatttgctaagactttggaaaagcgcagtatttgggcaggagtgtcccgtttttccaggtaccatctgtcacggcttcccttggctaggaaaaggaaatcccctgactccttgcgcttcccaggtgaggcgatgccctgccctgcttcggctcaccctccgtgggctgcacccactgtccaaccagtcctagtaagatgaaccaggtacctcagttggaaatgcagaaatcatccgtcttctgcgtcgatcacactgggagctgcagaccagagctgttcctatttggccatcttggaacggaatcctcaatgagatattttaagaagttaaaaaatatttgtaaagagcatctgaaaaaagaaatatgtaatatgtttaagaaatttttgaaaaagatcattgataaggggaaatgttctcttacatatataaaaacacacaatgactacactactctgggtttcctggaaaacacacaaacacacacacacacacacagacacacacacaaaagataaatcaatcaacgaaatagaagaggtatcacagaaacagacccaagtgttgaaaaattgtaacatatgataaagatgaattataaattatcaagaaaatgatacattgttgaagactggtgctgggacaatcgacaagctgaagaactggtaaaaatggaaaaactgggggaataaatagtatcccaccataaaccacataccaaattaattcctgatcaactaaagagccaaatgtaataaatgtaaataaaatagagccaagagtaaataaatcaaaagctagaagaaaatataggtgacatttaattttaagatgaataggaaattgaagataaatagattttactataaacttttaaagaattctgtacaacagaaaatcttaaaattaactcaagttggaaaagtattaacaaaaacatactggacaaaattaccatcctttgtacatatgcatcaatttttgtaatgcccactaatactccagttaaagcaaatagggctaagtacatagcctttggagacaagtgttccaggacctgatgctgggtgtgtcacttctctatcagctgtgtgactttgagcaagttacagtcttccctaaaactcagcttcttcatctgtaaagagggatgataacaattccatttgggtggggattacatgagacaatgcatactgtgtttggctccatacctggcaaagatgtccacgtttttgctatctctcatcttactcatgtcctcacaccccttcttggccagcttaaattccatgcttaatcatcataatcatcttccttgcccctttcttatctgccttgcttttgtgggaaactataaagctggttaaatctaacctccctcctacttcttgctagcacctgcatagccaaatgtagatggaaaatatattccatctgactggtttcactttaaactgaccatcagtgacttcaagaggatcctaattgccctggttcattctctatcctggaagaccttctttctcttcagaactccatcacctcctcccccatgatcaccctcagctgtgccttggcttcctatttcacctagaaaatagaagcaatggagagaacctctacaagcagcataatccaccagcctaactccatctgtacccacaccctctgtcttttctcccgtttctcctgaatggtctctcctccccgctggagtgcagtggctcactgcaacctctgcctcccaggttcaaacgattctcatgcctcagcctccgaagtagctaggattacaggcatgcaccaccatacccagctaatttttgtatttttagtagagacagggttttgccatgttggctaggctagtactgaactcctgggctcaagtgattggcctgcctcagcctcccaaagtgctgggattataggtgtgagccactgtgcccggccccagccttatatacttcttacccctcccccaccccctactcccttaccaacagcagaaaagtaacatgatgtaattgagatagccctgactactatgctgagagtagattgaaggggcgtaggagcagccttaatgaagaaggattggctgggggctaacagaatacaggcaagaaactggattctacatatgttgaaattatggcaaaagactttattgacagattggatgtggagtacgagaggaagagcagccaggaaaataaagtttccatttactgagttggggaggacttcaggaagagcagatttgggatgaaattaggagcacatgttgctctagcaattctcctgactcccccatcataaatcttttccctctctactggatctttcccattcagtatgcaaagaggctgtaaaagctctctcttgacccagtttctgctgtcagctcctgccccatttctccctgtcccttagcagtgaaactccttggaagattgctatatctacttgctactttcaactttgttcttccaattttcacttggccccactacaattaagctttagccctcacctttcaccagagcacctctatcaaggtccgcagtgacctgcatgtttctgaattcaatagtcaattcacagtcatcatcttacctgacctctcaaggcatttgacaaactcatttctctttcatccttgaactgctttctacatgacacttgcgccaggcgtggtggcacacacctgcagtcccagctacttgggaagctgaggcaagaaaaacacttggacccagaaggcagaggttatagtgagccgagattgtgtcattgcactccagcctgagtgacagagtgagactctgtatcaaaaaaatcaacaaaaatgacacttgcttggttttcctcttaccttgttggctgctcctttaccatctagtgtgctggtttttcttcatctccgctactgcccaaaattggagtgcccagaacttagtcttcagtcctcttcctttttaaaaaatccagtctcatgatttaaatatcatctctgcactgatgaccaccaacacatagagagagtgaactccaggctcacataataactgcccacttgatatcctcacttggatatataataggtgtctcaaacataacatgtcaaatttaacatgtgctcctaatttcatcccaaatctgctcttcctgaagtcctccccaactcagtaaatggaaactttattttcctggctgctcttcctcttgtactccacatccaatctgtcaataaaatcttttgccataatttcaacatatgcagaatccagtttcttccctgcattctgttagcccccagccaatccttcttcattaaggctgctcctacgccccttcaatctactctcagcatagtagtcagggatatctcaatcacatcatgttacttttctgctcaaaaccttccaatcgcttcccatctcagtcagattttttgaaagcccaagtccttacaatggtctataagtagaatgattacacgtcagagtttgtccagcacagtcctggcttctctccactgaactagtgttaactttttttttttttttttttgagacggagtctcgctctgttgccaggctggagtgcagtggcatgatctcagctcactgcaacctccgactccctggttcaagcaattctcctgcctcagccttctgagtagctgggattacaggcatgtgccaccatgcccagctaaattttttttttttttgtattttttagtagagaacggggtttcaccatgttggccaggatggtctcaatcccctgacctcgtgatctgcctgcctcagcctcccaaagtactgggattacaagcgtgagccacggcaaccagccctagtgttaatgattaataaccctcacctccaactttcattctagaagtctcctaatttggatgacaaattatatatggcaataacctacaggtcacatttgacagtttactttaaaagtaaacagcttccaaattaacccatcttgggaaggtcttgtgattcatggcgataccttgtcctgagtaaggaatcttagaagttcctcaaattgttgatgtactgatcaatgcaccacctactgacactgaaaaggacactgatttatttctgagtcataacattttactgattgtcttgcatgtagacatgttagtctgcatgttgcaatctgtagccaattattgtaacctttgtattgtaccctccagtgaaaaaggacaactcctgtatgaagagtccccctcctgtcttctaactttccaacttgtaacagactccagaacactctcaactttgttggtgtgttttcctgggttcatcctcacatttggcttccaataaacttttatcaaatcatttctgcctcaacagccttaatttcatttgacagtggtcatccagtttatagggccctactctaatcttcatgccctcctttagctcgctgacatcatctcttattactctctccattgctttcttcattaaggctaccaaggctttgctattctttgaacatactagacatgcttctctattagatacttgttccctcttcctaggaatgctcttcccagctatctacatagcttgttctcttacttccttagtgtcttggcccaaatgccacctccttaataaacccttatctgaccacactatttaaaattgtatcctgttctctctctgaactaactttatgcatccctgcttcatttttctcctgcttcatttttctccatgggacttatcactctctgacatcctgactaatttacttctttgttgcatttattgtccttcttcctccactagactgtaagttccatgaggagcacttctgtattctcagaagttagaatagtacttggctggtcaaatggttgtaaccagaatgctgatggtgatatggaaagtgaaggcgtggctgatgaggtctcagatggaaatgaggaacctagaaatggagcaaaggccaccctcattatggcctagcaaagaacttggctgcactttgttcatgctgtaaggatctgtggaagtttgaacttcagagtgacaactagggtatctggcagaggaaatttctaagcagcaaagtgttcaagaagttacatggctgcatctaacagcttaactcagatgtgagagcaaaaaaaatgacttaaagttagaagttatatttaaaggggaagcagagtgtaaaactttagaaaatttgcagcctggccatgtgatagagaaagcagaagcattttcagtagaggaattcaagcaggctgtggagcaaccacttgctagagaaatttgaataactaaaagagagccaggtactaatagctaagacaatgggaaaaaggccttgaaggcatttcagagatctcaggggcagcccttgccatcacaggcacaggcccagagacctaggaggaagaatcatttcatgggctaggcctaggaccccatggctctgcacagcctccttaggacagtgctccctacatccaggctgttccagctccagctgtggctcaaggggcctcaggtacagctcaggctgctgctccaaagagcaaaagccatatgctttggcagcttccatgtggtgttaagcatgcaggcatgcagactgtaagagtgaaggaggcttggcagcctctacctagatttcagaggatgtacaagaaagccagggtacccaggcagaagcctgctgtaggggtggaaccctcacagagaacccctactagggcagtttggaggggaaatgtggggttgaaggccccacacagtctccactggggaactgcctggtggagctgtgagaaaggggtcaccaccctccagacctgagaatggtagatccactggcagcttgcaccctgtgcctggaaaagccacaggcactcaactctagcccataagagcagctgtggaggctgtactatgcaaactacaggggcgaagcttcccaaggccttgcgagcccacttcttgcaccagtgagccctggatatgggacacggagtcaaagaagattactttggagctttacaatttaataattgccctgctgggttttgaatttgcatggagcttgtagcccctttcttttggccaatttctcttttggaatgggcatgtttacccaatgcctatacacccattgtaacttggaagtatatagcttgtttttgattttataggctcataggtggaagagacttgccttgtctcagatgagactttgaattttgggctttggagttaacattggaatgagttaagactttggggaactcttgggaaggcatgattgtattttgcaacttgagaaggacatgagatttaggagggccaggggcaaaatgacatagtctggatatttatccctgtccaaatcgcatgtggaaatgtaatctctaatgttggaggtggggcctgctgggaggtgttttggtcatgggggcagatccctcatggcttggagctgtccccaccataataagtgagttcttgagaaatctggttgtttaagggtgtggcacctccccccaccttgctcctgtctttaccatgtgacacacctgctcccccttcaccttccactgtgagtaaaagctccctgaggcctccctagaagctgagcagatgcctagtgccacacttcctatacagcctgtgaaatcgtgagtcaattaaacctcttttcttaataaattacccagtctcaggtatttctttatagtaatgcaagaatggcctaacacacactggttctacaaaaaaaaaaaaaaaaaaaaaaggaagaaaaaaattaatttaaaaaaattagcagggtgtggtagcatgtgcctgtaatcctaacttcttgggaggctgagttgggaggatcccttgagcccaggagttcggggttgcagagtcatgatcatgccactgcactccagcctcgggcacagagtgagaccctgtagctaaaaatataaaataataaaataaaaccagtatatgagtgttaatcaaagaatgagtgaataaatgaatgaataaagtgagtttttaaagcgtgaaaaatagccaggtgtgatggcttatgcctgtaacaacagcactttgggaggccaacacaggaggatcacctgaagccaggagtttgagatcagcctaccagcctgggcaacagagcaagacttcatctctttaaaaaaaaaataaacatatatacgtatgtaatggcggggggctggggtggtggtggggaggcatgagaaaaagaccagaagaaagtaggctcagctgggcacagtggttcatgcctgtaatcccaacactttgggaggccaacgtgggcggatcacccaaagtcaggagttggagaccaacctggccaatatggtgaaacccccatctctactaaaaatacaaaaaaattagctgggcatggtggcgtctgtagtcccagctactcagaaggctgaggcaggaaaatcacttgaacctggttgcagtgagccaagatcacaccactgcactacagcctgggcaaaaagagcaaaactgtcttaaaaaaaaaaaaaggccaggcgcattggctcacacctgtaatcctagcactttggaaggctgaggcgggcagatcacatgaggtcaggagtttgagaccagcctggccaacatggcgaaaccccatctctactaaaaatacaaaaattaccagggcatggtggtggatgcctgtaagcccagctacttgggaggctgaggcaggagaactgcttgaacctgggaggcagaggttgcagtgagccgaaatcatgccattgtactccagcctgggcaacacagcaagactccatctcaaaaaaaggaaaaaaagaaagaacgtagactaaggtattaacagtaggtatgtttggatggtcagattatagatgacttctgttttattttttccagatttccatactttacaaatgcttcatatattacttttataatcataaagcagttaaaaaataaaaacttactgagtgttgactaagtgccaggtcttcagaagcatagatgaagagcatgaagaatgcaaattcatgcatcaggctgggcatggtggctcaagccagtaatcccagccctttgggaggccaaggcaggtggatcacttgaggtcaggagctcaagaccatcctggccaacacggtgaaaccctgtctctactaaaaaaatacaaaatttagccaggcatggtagcgggtgcctgtaatcccagctacttgagaggctgaggcaggagaatcacttgaaccagggaagcggaggttgcagtgagccaagatcacaccactgcactctagcccgggtgacagagtgagactctgtctcaaaaaaaaaaaaaaaaaattcttgcatcagtgggcttagtctagcctggttataaactcctgcttgtggccttagcaacttgcccagtgctcccctggggcttagccctgtggaggctgaaacccaggtcaaagtcatgttctccaatccagagctgggtgtctctctcacttcctttgagcagcaatcacctctaccctgatttagaccaagccaagcttgctatgctgaggtaacttagcttatcaccaaggttatatttaacagactgctgaaaggattataaaaaattatggggatttgaactatcacccaatgcctccgtctgttgacacagacaagtttaaagcttgattttgtgaaccttgagatgatcttcctccagcactgcaaatgtaatccttctcatctaaaactcccattctaatgccctactgtgctcctgcccctgcagagccctccagctcaccctcctgcagttgtcttctctgtgactgagtcctctgcaacacatattccattgtagacatgcaactctcctctttcaagtacatccctggttgttctctccatctcctttccttgatagagatctggcttctttctgagcactccactagcctcatggctctgtctctcaaaggaaggctactcattttgcactatccatgatcctggaagacaagagctgagcaggctctcagcattctccttgcttcccactgccatttctaaatcataactccttcaccttcacatacataaaagacctgctcaggtttgtgctgtgccctcctggttgctgttaccaacatctgcctggttggttatccacattctgtgagctctctgacacccagcccaaggtgctggtgacttttgtgctcaggaagatgagtagtgctacaccttagcctcgcagtacttgaccttcacctatacttcacactcttgctgctgaggacacaccctgggcctctcatcagtcacaacagctccatctcactctaggacctttgttttcctcccaactcttcagctctcacctgatatcatttcctttccctttcagtttataccttgtgatccctccagcccattcatactcttgccactaccccagtccttttgtttactagtcttgcaaaggctaagctcacaataagtcaaaccattttactcttcactctcaatccaggatgctgacttaagatacaagaaagaaggggggctgttgatgggtgcaaggaaacatgggttgagagagtaacaagtgggctgagggtccaattgtgattggaaatgtaaatgtgtcaagacaccaactcacatggttgtgtgatttcctccagtgacccagggtaggagtacagtgaccaaatggttggatttagggccttgcagtagaggtgaatggaatgataagacaacgaaggaactgagatagacggaagcaaagggccatagtagtatctaaattgaagaggaaagggagtaaaagcataacttctgttgggcctagtatgtacactgtatccatctactttctttttctttatttggggtatatgagaacctggcacagtgttaataagacccaagtgttcagaagagaatgcaagccaggctaatgaaggtggcaggaatagcaccatctctcctggaccattcaccacacacaaatgtgactgcggtgacatggagatctaaaatgatctaatgcagccagttggtaagggctcaaggctagatttcatctttcagggtaatgagatgtagcatcagtaattgagagtgcaggcttgaaggcagggggctacaatccaagaacaccaggggattcctgaaacctcagatagtactgaacactatatatactaggttttttcctatacatacatacatacgtacctaagataaaatttaatttataaattatgcagaataagagactaacaatagctaataaaatagaatgattataacaatatgctgtaatagaagtcatgcaaatgtgcatctctctctcaaaatattttattgtactgtactcacctatttggtttacccagttggccgtagatactgaaactgcagaaaaaaaaaaaaactgtggataagggggtattagagttttccaaagaaacccaactaataggattacagatataggtatagatcaataggaggagatttactatatgaactggctcatatgattacagaggctaagaagtcccatgacatgctatctgcaagctggagaaccaggaaaggtgatggtgtaattcagtccaagtctgaaagactgaggggaaaagggtaaggtgtaagtcccagagtcgggagatccaagaacatggagctctgatttcctgaaggcaggagaaaatggatgtcccagctcaagaagagagagaatgagagaatttgcccttcctatgccttaaaaaaaaatttttttttttttgagacggagtcttgatctgtcgcccaggctggagtgcagtggtgcaatctccactcattgcaacctccgcctccggggttcactccattctcctgcctcagcctcctgagtagcgggtactacaggtgcccaccacaacgcccggctaattttttgtatttttggtagagacggggtttcaccatgttagccaggatggtctcgatctcctgacctcatgatccgcctgcctcggcctcccaaagtgctgggattacaggcatgagccactgcacccagccaaaaaaaatttttttaaagagaaaggtcttgctatgttgccctggctggcctcaaactcctgggccccagcatcttcctgccgcagccttccaagaagctggaactataggcacatcctctgactttttgttctgtgtgagcaggagtcctcagtgaattggatgatgcctgcccacattggtgagggcggaccttatttgctccgtctactgattcaaatgcttgtgaacctctccgaacacatcctcacagacacagacacagacacaaataatgttttacttgctatctcataaaattaaccatcatgcagacagaccagacctctaatatggacctaccacatgctaactatagcaactgggtaaattactttacttctcttttgtttctttgcctgtaaagtgaagacaagaatatcaatcgcgtaaagctattgtgaggatgaaatgaggtcatgtactattgttagtattattcttgtaataatacaatagcagagcaaattgatacttgcccaggacctcctaatttctgccttaacctggcatctagcttagaacacattaacatagttaataacttatattatccaaatttaactcagccaagacctcctgatctccttcgatggaattttactctaagatgactgtattccctagggaaacctatgtgttcctatatgacttctctcctgggtgattctgtccagacccatggccttaaataccatctatatgtgaatgattccctaatttatatctcattctgatctcttttatgaccttcagactcatatatccagccgtctatttgacattttgacttggatgtctaatagacatcccaaaattgcatttaaaataaaactcttgcacaggcaacaaaagaaaaaatagaaaaattgggctacatcaaaaatgtaaaacttctgtgcgtaaaaggatataatcaatagtgaaaaggcatagaatgggagaaaatatttgcaaatcatgtatctgataagtggttcatatcccaaatatgtaaagaactcctacaattcaacaacaacaaaaaaaaaacctgattttaaaatgggcaaaagagttgagtagacatttctccaaagaaaatatataaattgccaataagcacatgaaaagatgctcaacataattaataattagggaaatgcaaataaaaccacaatgaaataccactttatacccattaggatagcttctgtaaaaaaacaaaaacaaacaaaacaacaacaacagcaaaaccacagaaaataacaagtattggcgaggacgtggagaaactggaactcttgtgcactgttggtgggaatgtaaaatggtacagctaccggggaaaacagtatggcaattccttaaaaaaattaaacatagaattaccacatgatccagcaattccacttctgggtatatacccaaagaattaaaagcaagtactcaaatagatacttgtacatacatgttcacagcagcattagtcacaacaggcaaaagatggaagcaacccaagtgtccatcagtggatgaatgggtaaacaaaatgtagtatacatatataatggcatattattcagtcttaaaaaggaaggaaattctgacatatgctacaacatggatgaaccttgaagacattatgctaagtgacaataaaagcgagtcacaaaaggacaaatactatgtgattccacttatgagagtggtcaaattcatagagacttctgtattatagaagggttttcggggctagggtaaggaggggagtggggagttagtgtttaataggtacagagtttcaattttgcaagatgaaaagagttctctacagatggatgatggtgatggttgcacaatgtgaatgtacttaatgcccttaagagtggttaaaatggtaaattttatgttatgtgtatttcaccacaatttttaaaaagcaaaaaataaaaataaaaaactcttaatttcccaaacccccaccccatcaaatctccccatttcaaaaacaaacatgaaaagctataaagttgctcaggctaaaaatccaggagtcatccttaatttccttccctcatgcccacatccaatagtaaatcatgtcacctttttcctccaaaaatattctgaattcatccatttatctcttccacagttaccactctagttcaggccatcataagctcttgcctataatgctgcaatgctttctaatcagtcaacctgctttcattcttgtcctctacagtcccttctctatatagcagccagaatgttccttttatgctagaagtaagaccttatgcttttctctgcctgaaaatactctgataggccaggcacggtggcccacacctataatcctagcactttgggaggccaaagtgggcagcattcaagaccagcctgggcaacatggcaaaatcccatctctacaaaaaatacaaaaattagccaggtgtggtgcgtgtagtcctagcttctggggaagatgaggtgtgaggatcacttaagcccaggaggcagaagttgcagagagtcaagatcatgccactgcactccagcctgggtgacagtgagaccctgtctcaaaaaagaaaaaatattctgatagtgttccatctagaataaaatccaaactccttgccactatctacaaggcactagacaatttggcttccataaaaactggcctcctgccaatgtctctgacttatgttccaacattactcactttgatcactatgttctagtcacgctggtcttctctccgttacttagtcaccccgagcacatcccttacctcacagtctttgtacttgctgctcttctgcttagtacacctgcttcccagatcttcacatgacagattccttctcgtcctttgcctctcagctcagatatcactttctcagaaacatgttcacttaccattcatctaaagcagctacccaatgactgtcattctataccattactctcttttctttcaccttggcaattaccactacttgaagtttgtatttatttgtacaagtttattgtcagcctctccatcctccaagtaaaatacgagctccatgaaaacagatagcttgtttctttcctcagttcccagaactcggaacagtgtttggcacacatcagtctattcatatgtttgccaaatgaacgaagaagtaaaaaccactagtgacccaattttcctgccatgtcatatatatacataaaagtcttttgggaaaactcatatttctatattggccctcactaatgtcttttccatctattctagaatgcaataaccagtctttaaaatgcaagcagaatatttcacatttcatttttgcaggtatctctgaggggaatgaatttacatttctactaccacaaataggatggtcaagtttgttgcaatgcaaaattttttctgtggaattcaaaaactgtcctgtacctcttgaagccgaattgtggggtttcacattggaaattacactcatctaaagaaacagtctggacatttaagtccttaaacagttgttcaaagtattttattacatactttttctagtcttcagaatgtttcaaggtccattgtcttcatggctagttacctgtctgtccaggccaaacaaactggagttaaaatgcagaatcacataacagcagaaatgtgatttctcattctattgtgcaatccaacagaattgtgccaagtcttgctaggctgacgctgctctactctgcccaaatgccaatatgcattggggtgatgacatcccacttgggatattgtctgatgacacagacagacttctctgtttctccactcttgggtcatataattcaatgttctggggctgaggcaaataatgtcttacagtgattttggcaagaaaaaaacagctatttcagattttgttcaagttcccctagtcatgtcagaccccattgacttcagtagggatggcaccatgttcaagaggctgaagaagagacctagaaccagaaactgagacataaggtttattgaggggacttacaatacagggcagtccagtggcagtgggctgggcaggagaaccaaaactccttgtaaaaagcatgcaattggccaggcgtggtggctcatacctgtaatcccagcgctttgggaggctgaggcaggtggatcacctgaagtcaggagtttgagaccaggctgaccaacatggggaaaccctgactctactaaatacaaaaaattagccgggcctggtggtgggcacctgtaatcccagctacttgggaggctgagacagcagaatcacttgaacccaggaggcggaggttgcagtgagccgagattgcaccattgcactccagcctgggcaacaagagcaaaaactctgtctcaaaaaaacaaaaacaaacaaaaaacaccatgcagtttatataacatttttacttaacacctttcccctagcaacctccaccaggcaaccttcatttaacctaaaacaaagggctttgatcgcctcgtagggcctgcattctacaggatgggctgggggtgggagcagttcagaagttcgtcatagataagaaatgaaatatctgggttggccactcccagattccttagcttggagctctgaacacacattcttcttagaccatagggtcattcttcaggtatgcataagttattgctgccaagtgcatctgtcgggtgcatctgccatacaccccttaccagaagcgtccaaacacggatttgagggatctacagcagacactggacagatgctctgaatcattctctactctgatgctgaagctataatattggactaagcttgggccttctactcttttctttctttcttttttttttttttgagacggagtcttactctgttgcccaggctggagtgcagtggcgcgatctcggctcactgcaacctccacctcccaggctcaggcaatcctctcacctcagcctcctgagtagccgggactacaggcgcgtgccacaattggctaatttttgtatttttagtagagacagggtttcaccatgttccttaggctggtctcaaactcctgacctcaggtgatccaccctcctcagcctcccaaaatgctgggattacaagtatgagccaccgcacccagcctattcttttcttaaaggaggaggccttcccttcctcaggcaagtaattgctgactactccagcctacataacgtccagacatatccaaatctgtggagaacacaaagttcttaaggtatttatttagagtcaataatcaaagtaaaactaataattatagctaatatttagtttgtagttaatatatgctaggagctcgagctaagcactaccatcccaggaaactgaggcttaaaacacttttaaaatttgctcaagctcacaagcttggaattgaagaagaaagcaattgaatattggtctttcttctatcatacatccagaggctctgcacttaatcaatacaacatactgtctcttattgcacaagtaactacaaggttcatctgtaaaattctattctgtagaatagaagggaaaacaaattaaggaattacagatgtttattcttctgagctttaatttaacgtattgtttgattcaaataatttatatattagctatctattgccacataacataatacctcaaaatttaccattttaaaacaaccaacattcattatttctcagagtttctgaggatcaggaatctgggagccacttaactgagtggttctggtccagaagactctcatgaagttgcagtcaagctgtcagtagtcatctcgacacccaactgatgctgaaggagctacttccaagctcactcaaggttgttggtgggcctcagttcctcattaaatgttggctagagacttcattccttgacatcacatggacccctcaaagggctgcttataacatgacagcttgcttgtctctgagcaagagaaagggaaaagaacacccatgatggacatcttttataatgtaattacccaagtgatataagtatcatcactaatgctgtatgcttttggtcacatagaccaatcctggtacagggatcattcattgggtgccatcttggaggcaagctaccacatctgccagggtatgaatgcatttaatctaaagttctagccctgaactgtagggttatctaccatataaatcagttttacattttttaatatgtaaaataggaacatcccaattcagaatattgcaggataaagggcctcaggtaactgattaagattctaagctctctttctcttttaaaagatgaaatttaaggctgggtatggtggctcctacctataatcccagtactttgggaggccaagacggggggatcacttgaggtcaggaatttgagaccagcttggccaaaatggcaaaaccctgtctctaccaaaaatacaaaaaaaatagctgggtgtagcggcgcgtggctgtagtcccaggcacttggaaggctcaggtgggaggattgcttgagcccaggaggttgaggctgcagtgagccaagaccacctcactgcactccagcctgggtgacagaaggagaccctgtctcaaaaaaaaaatgcaatttaaatagtaatggcattcagatagtaatcacagtgcacctggaactggacggcaccatcttaggttgctctctgctttgcgcatgtggacaagccatctatgacaaatagtttcttttcttcctaaggatatgcagcttcttttgtagtatactgcattgttttcagtccctttcaggaatgttatctgatgcccaactgatatttctcaaatgttaaaataagacttcttcatcttgtttggtctggacagaggtcaacattcttctcataaaagctttcatttcttttgaagcattaaaataatattttagcacacaaaaaaggagtttattttcaagaagctttgctttctttttcagttagttctagataagaactataacttcacataagatgttagaaggatttaagtacattgctgaaggtataaccatccatcttcaggaagtaagaatagtgaatagtaagtataaagaaacaaacaagtcctgtgataacatctttatcataatttttttaagtctattatgctttatgcaaatgtttagatttccttgttaaaaatctgctggccaggttaggttccctttctgtagctttattttcaactcataatatagtgactattaaatattctttactcaacacattatattgtaaaaatatacacttagttctgtttctatcactaagccactactattttaaaaaggaatatcttgcattgttaagtttagcagcccaaattcttaaaggccttaggaatggtgctgtccaataagataaccaatagctacatgtggctactgagcacttaaaaaatgagtctggccaggcatagtggctcacgtctgtaattcagcattttgggaggctgaggtgggaggattgcttaaacccaggagtctgagaccagcctgggcaacacagggatgccttgtctctgtaaaataaaaaaaataaaaaaattagctgggcacggtggcatgtgcctgtagtcctagctactcagcaggctgaggcaggaggcccacttaagcttaggagttcagggctgcggtgagctatgattgtgccactgcactctagcctgggtgacacagtgggaccgtgtctccaataaataaatgaataaataaatattaaaaaataaaaagtgtggctagtccaaattgaaatgtgctgtaaaatacacactggattcctttttttttttttttcaaatcctgagaacctgtgaaacacactgaattcttaagatttagtatgaggaggggaaaaaaagatcaatgatttacatataacaatgtaaaatatcaataatttctatattgattatatgatgaaatgatcatgttctggatatacttgattaaatataccattaaagttaatttcatcttttatttttactttttaaatatgcagcattgcccaataaaatacaggacaaccagttacatttttattttatatattcctgcttgggacataatatttaaaaattattcattctatatctgaaattcaaatttaactaggagtcctatatttttatttgctaaatctggcaattttattaatatggctactagaaaagttaacataacaaatgtagctccttatcctatggaacattgctgctttagaatcacctcgctgctttttttttttttccagttagcttctgaataaactctgcacggaaataactaatctgtggggaatatttaaccctaggctaggatcgttaatcgtgaagttaaatttttacatctgcatgaacaaaatggcttgttacagacgaaaatgtggaaagggcatctggactagaatgaaaagtcatagctcccagcctctctactagggtagttaacagtcccaggttcaaaataatccccgtccctcttataagattaggcggtgtcaagagcaactatctgtgagaccctgggccagtgactttctccttacctccgcccccaagtaggccttgcaaaaagctgggaggggtgcgttttcaacactggagcttcgcggccgctctcccactcgctccccgcccggcgctagaggagcgagttcggactcggaccccaaggcctcgagtcccgctgccttcctaagccgagcccgggctacctcggtcgtccccagcaggcttggctggcagaggccgggcctcgccaggtccccaggacaggccccgcccgggcctcaggtgcactcccggcccgccccgcgccctcgcgtcccgccccagctccgccttcgccggcgccgctctgcctgccagcggggcgcgccttgcggcccaggcccgcaaccttccctggtcgtgcgccctatgtaaggccagccgcggcaggaccaaggcggcggtgtcagctcgcgagcctaccctccgcggacggtcttgggtcgcctgctgcctggcttgcctggtcggcggcgggtgccccgcgcgcacgcgcaaagcccgccgcgttccccgaccccaggccgcgctctgtgggcctctgagggcggcatgcgggactacgacgaggtgaccgccttcctgggcgagtgggggcccttccagcgcctcatcttcttcctgctcagcgccagcatcatccccaatggcttcaccggcctgtcctccgtgttcctgatagcgaccccggagcaccgctgccgggtgccggacgccgcgaacctgagcagcgcctggcgcaaccacactgtcccactgcggctgcgggacggccgcgaggtgccccacagctgccgccgctaccggctcgccaccatcgccaacttctcggcgcttgggctggagccggggcgcgacgtggacctggggcagctggagcaggagagctgtctggatggctgggagttcagtcaggacgtctacctgtccaccattgtgaccgaggtgggtgccggcccctgctggggctgagaccagggctcggaggacctgtcgcggtccttgaacccgagctcctctctcccagatgcgcactggacgctgtcactccccctcccccaacggtcaacaccctagcgatggagaccctccagccaggtggcttgggaacgcttcacgaggtgacctccagccacagtgtgctcctccctgcacaggtggtcagtctggcctcccgtcctgatggccactttgaagagggtaccaggaaggtcctggcggtccctgggcgatgctctatggccctgtgtgtccaggacttactctagttggggttgggggtggtaagtagcagagccaggacttgggccaggggctatcccgtttttcctctagtctcttgatttctttttagaagagaagaaatacttctctttcctgaacttttaaaagttaaataaagcatgtgtatacaactgcctcttccctttttcctctagttactccttcccctaccgtccacaacccaaaaacgacaatctggtcatgccctgtaagtaattgtttgccttttcccatggtcagttgtcagtcttttttttttttgagacagagtctccctctgtcaccaggctggagcgcagtcgtgtgttcttggctcactgcaaccttcgcagtcgtgcgttcttggctcactgcaatcttcgccttccgggctcaagtgattctcctgcctcagtctccgagtagctgtgagccacgacgcccagctaatttttgtgtttttagtagagacggggtttcaccgtgttggccaggatggtctcgatctcttgacctcgtgatctgcctgcttctgcctccaaagctgggattacaaccgtgagccaccacgccaggccgtcagttgtcactctttaagatccattcatctgaagatgggttcagggtgacttgttgacctggaatattttctcaggtattatgaggcaaggctgtcggccagatttagttaaagcatacagccttaggtcatagggtgtaggggagcctttctcatttctcatccccttggattttccctctgggtggttttgtctgtcccctccgaacctgttggagcagttgttggagctggatgtaggaacatgatgttaatgatgtatgtgttttgtgtcttttttagacactggcactctagctccctgaagtttcagcagcattgagtaagtagccagtgaatagccctcattgatagataggctcactaaatgtgcagatgaccaattcgcaggttagagaaggcttcccagaagaggaggcctctccgtgagcctagggtgttcagctcagcataatagtgagctgaaggccccagtgcagcagcaagaaaccacccagcaggacggcggagttcacagagaggggagagttcatagagagggagagtgccacaggccctggcacagcttcaagccctgctggatgttggtgctgagcctcccctcctggagcctcagaggggcttacaggggctctggagatcccaactgtgttgcttcttggcgtcatcacccttcaatggagtctgagagctaccctgggagatccaagtgtgtgtgcatgtgtgtgttttttctttttggaaatttgatgtccccagcatttggacctgctttctccacatatatgtagtgggagtgtgaccggagccccactgggatttcttagctagtgacatagcttcagtgtccagaggcatcatggcttgacaaaagaggcactccttggaggtagccaactgtgctttctggcccatgaatccacaggaaattggaaccttcagttgccacaaatcctgggtcctagcctcacaggtgggtgtgttaccttcccggaagccagtgagtactatgaaagcagaggctgtccctgaggttgcaggcagaggccacagaggggaacatgacacaggaatccctacaaattctacttggggctgcctaaagaagagggaagtagtgaagcaagaagaagcacatggcatctcttggagttttacattgacccctgagggttccccggcttactctagtcacttgttcctgctttgctgcctccatcccacattgggctgagtgatggtggcattgatgagctcccaaaggccagctgtgccagggggtctgaccttatcttgctgccaatgtcagccttttgttttttaatatttagactatttatttagctgtcttagcagtttcaaaggagttatgtgccctttcacctacttatatgttgtcagtctttgcagggaggccagattaatgcttagatctttgttttgggctactggaatgcttgacttgaagttcagagctgcttgttcccaggtgaacagctactgctggaagttgctgcatcaacattctaatggctttttctatggcctgttgtctttcaacccaaacctggcctgctgaccactgcatctagtcccatgcctgctaaatgtctctaagcctgccctctgccccaaatcatacataaaggtgtttgtaagtacactggtattgaattactagtcatattttttccactgaagactggaacctcaggtgtcctgtttggatttttttaatttgttcaagttaaagtacatacatgtagtaccaaactttgtggtggatttagatctttgcgtcttcctcaatttctgacacaattctggatgcagagggaggttctcaggaaaatttttattgaatgagttaatgaataatttaagaaatcatctctaaagtttgagaactaaagaaaaatagttcagttcttagaagggaaacttgagggtggctgaaaaggattgactggaattttttaaaggaaatgtgactccccctgcccactgactggggctttgatgccacatggatgtggaatgaggtgttgggattggcagagggaatctgctagcaattaataaataaatattggcagggcgtggtggctcacgcctgtaatcccagcactttgggaagccaaggcagcaggtcacttgaggtcgggagttcaagaccagtctggccaacatggtgaaactccatctctactaaaaatacaaaaattagctgggtgtggtggcacatgcctgtattcccagctacttgggagactgaagcaggagaatcgcttgaacccaggaggcgggctttgcagtgaaccgagatcgagcctctgcactctagcctgggcgacaaagcgagactccatctcaaaagaataataataatattaataaataaaaatgatttatgaggtaaaagagttttatgcccccatgttccaggaatagtttggtggtccacatggttctcggctggcctctcctctggcccctcagtcatccctggggtactggggaattagccaacccatcatgcagtgcttcttggccatggactgccccatctgctggaaacctgggttgtttctgaggttgtctgggctgtccgctctttggtttcaccatagctctgtccagcctatggacagacaggttccttgagaaacttccggctgggtgtggtggctcatgcctgtaaacccagcactttgggaggctgaggcaggtggatcacaaggcaggagttcgagaccagcctggccaacatggtgaaacctcgtatccgctaaaaatacaaaaattagccctgcgtggtggtgggtgcctgtaatcccagctactcgggagggaggctgaggcaggagaatttcttgaacctgggaagtgggggttgcagtagccaagatcgcaccattgcatgccagcctgggtgacaagagcaagactccgtctcaaaaaaaaaaaagaaaaagaaaagaaacttccaagctgctctgcatcgccttgctctccacctgtctgcttctaagaagccctcggcccagtcctgggtgggactcccactccctccccattgtcctggactagcttttctatcagccttatcttgtgtagagacagatagtcttagaagatgggagagccctcactgttatccccaaagctgcctggaggaaaagccagagcaacctgggagctgggaccggggctgactctgggcagcagagacccgagagacctggagcttgaacctcactgttacgcctttgttgatttctctcactcaggggacacacagaccctcatccagccttttgcagctatatggcaaggcagagaagccacttgcggggtcccgtggcccactatgcacgtacatagtagacacatctggccatgagtggtcagattgagccactctctagctagctgacacctgtaatcctgggtcaaatttctgacagttgacacaaagcagggggtcagggagccaaaaaaaaaaaaaatggccaggtgtggtggctcttgcctgtaatcccagggctttgggaggccaaggtgggcagataacctgaggtcagagttcaagaccagcctggtcaacatggcaaaaccccgtctctactaaaaatacaaaaattagccaggctggtggtgcatccctgtagtcccagccactcaggaggctgaggcatgagaatcacttgaacccaggaggtggaggttgcagtgagccgagattgtgccactgcactccagcctgggagacagagcaagactctgtttcaaaagaaaaaaaagagtattctggagattgaagttcaggagttcagggttcatctcgactttgggcagccaagcaagaactaaagtataccaagatgttgaaggttgatacctttttatttatcgattcattcactcacctatgtaccaaagagctcctgagcctctcttctatacagggggcactgccaggagttgtagaggatgtgatagcaaagataggaaataccttttctctttgctctgacaacggtggggcaaggattcatcattgatttcagcaggaggcaggataaaatgtgtgtaggaatataggaatacatggcaatcagtaacatgtggtacctagcagcatgtctgactgttgatacggtcaggctaggtacatcccctcagggaagaacttctgtcttaggggcacacaccctatcttttttcccttcctgccaattcacaggtaagaacatttagtcccagggaactatgtcatctctctacttctcataactgaaaaagcagtgccaattatgtatgaggtataggagacacaattctccctctttttaaaaatgtttaatagctttattaaggtgtaaatgacataaaaactgcatgtagctaaagcatgcaatttggcacacatgtatctctacacccttgaaaccatcaccactagaaaggtgcatttctccccaggaagaggggcaagtctaggccctttgccagagttgctcccagattgttttcaggttgggcctgcattcacagctcagccagctgaagggtgacagcattagactcgtgacccaaatcttaaacccacacattccattttaacattgatacctgtgatcatcagccagtatagcccatcccatgtgccaggcggaggcatcaataagctggtctgtagcagctttaatcacagctggggagccaggagctaaggaatgctagactcctttgtaaacaatttaagtagggggtacttagcctggactctatgtgcttctcatccacctcttctcagggagattctggccaagtcctggaacctactgcagtccatctggtggttgacagatatgtggacggattggcaggctgggacccaatctatgtttgcccttgtgttcagttttgagacctagcacctttcctgatcctgctcacagaccccctgcggccaataggaaagaagtgttaatgcatatttgcttttggagggcccaaagccaggcccagagagttgtcaagggcggtcagtggtgggtggatggcagagttaaccaaggagttacacacctgcctagactaaggacaggctggaccaagtagagagggtggggctaagggagcctgagagatgctctggggcctatctcaaaatgagcactatagtcaccctgtcccctgcagagattgtctgacctggttttaggtcacacccaaccttgccagccaaggagtctttagaagcctgatattgggagacctgtcctggggtctacaaccccagaactcactgcagaagcccacgtggattgctagtctagctcagccatatgggtccccaaccctcacctcatgatagtcctgtgagaaaccgctgctgaccctttgttcatgttttcatcttttccactataaaagacatgctagctgggaaatagagcccatcatactcaagagtggcaggagccaggtcctggcccctgaagcttggcctcacacacagaggccggcaccctgtcatcaattccctcagctttttctccgcctccactcccagtcctagatttagcagccatgtgtgggtgggggccactgcagggatacttacccacctaccagagagatggcctgtgggtgctggcccttctgaggctgtggaggttggaggctgtggcagcctgggcagtcaggctgtggtcctcccatgttcttgactcctgctagtctgggctgcctcctgattaggggttggatgctccagttcttccctgggttggggattgccaccctactcccagcccatccaggttcacgcttattccaaagcggagcaccagcagtgtgcctgctgcgggagttctccgtgtccagcctgagggttgcctgccaacccctctgagaggtgcccggaggctgtgcgcccacactgcccagcagtgcggagaagcaggcttgtttttccctgtcactggcttggaagagatgctttgttctagggagccgcatgtccccttgcctgcgttgttggtgaggagccagcaggctccgtggagggcaggctagcagcctggcaccagggaggcaagggtctgagttcctaggagggtggttgctcatgtgagaagtctgcaaaggttactactgagcaccatctctctgtctgaaaaacatttttcatttttctgtgaaccactaagtttcccgtttgggctttcttcctgcttttggctcttgtttaggcaggcgcagccagatccaagcgtctggctgcttccccatgtcttcagacctctttttctgttcatggtaactatagatggaaccacacattggaagctggaaactcaagcggtgcagcctattccttaccccaatccctgttttacaaatggggaaatcaaggcacagcatggggtgatgcttatctgaggttggaagagttttaatagtagagtgggagctaaaacccagtttcttacctccaagctcaggactttcagctgtaattgagcctagtatagttggtgtgcagcatcagggattccagctctaaaggtcacaaaaaggacccgggggtcattggcccagggtgggaacccgagcagagcaggtccagatggtgcactctgtgccctggccttagtttcttgctggatgctttggcccgtagagccccagagccctgcttccagaaccactccagtgacgttcatgccaatggcctgaaccccactgagcgagggtgccctgcctcttccacagccctgggctccgctcagatttttaggagcaagcgttagaggccttgctttctccagggtcagcatgtggacagaacacttactctctgcctgtctctcctcctcaaaatggaagcaagacagtggggcctacaatgctatgaaaaacaggatgggaaagaagcctgctctctgccttcctgcccaggtgagccatcacctgactaagtgagttcacactcagagcgtgtggggatggcaggatgttctgacttcattttccaggatgcctttgctttaaaaccttttaaaaagaagtgaatgatacaccccctttgctcatcttgcagtggaacctggtgtgtgaggacgactggaaggccccactcacaatctccttgttcttcgtgggtgtgctgttgggctccttcatttcagggcagctgtcagacaggtaaggtgtctgtcttctggagcaccaggggacctcagcactgaggaagaagcgtgtgcctggcccttgatttcagttggtagtattctttcagcgcagggccctgtattttaaagaagaggaagctatgtctgtgatatagactccatgcctagtaagaagagccaacaaatctgactccgtaattcttgctaagtaaagaaacctgagctgtctaagctgaatgtatctgtgacccggttgactaggtaatatgccatgattcacttctgcagtagcctggcttgcctcccctgggtcactgtgactctgtcatgcccctgagcatgggagaggttgacatcatgcacacatgcacatgtgctagattgtagatctgtagtagtgccacggtgtctgcctctgtagtcccaagaagaccagcattctctctgcaaagtgaaaggagctctcaccagccactagtggtatgaaaagcagaactcttttgtccacaaggctgatgccccttagctaagtggcctgtggttttggcatttactttatgacaggagggagaatagtgttttgatccatttcttataagcaggttatttgtataattctaaagcttttaactcaaggaaacattaacggcttagagaatcccaaacccctcgaaattatatgcacaatgttagagactacatgtgagcatttttttggagagaggtccgtagctttcatgaagttcttagaggggtccattatgttgtgtcttctttccctggagcttcagggtctgtcagagaagactgtgaagagagtagcagccttcagcaagtccttggccacatgacacatgtgagaacaccccacaaatcggtgggttagccggtggaaaggagtcccagcatcttccctggtttttaattcctggcctcaagcaatcctccctccataacctcccaaagtgctgggattacaggcgtgagacaccatgcgcagccagatattttttattgttgttgtttttttttggaaaaggagtttcactcttgttacccaggctggagtgcaatggcacgatctcggctcactgcaacctctgcctcgcaggttcaagagattctcctgtctcagcctcccgagttgctgggattacaggcatgcaccaccatgcccagctaattttgtatttttaatagagacaaggtttctccatgttggtcaggctggtctcaaactcccgacctcaggtgatccacccacctcggcctcccaaagtgctgggattacaggcgcgagccactgcacctgcccagccagatttttttttaaaaagcaggttaacctgtttattattcctactttacagatggagaaagtgagacagagggattaaataacttgcccagggtttcacagctggcaagtggcagagttaggatttggacccaggtagtcttgctcctctattgtgtatggactactgttctaggtccctgctgtcctaaaacttgctttctagcaaggtggaatgtattaaacaaccaagtgaggaagtcgttgttgtccttggccatggtaagagatacagagaagtgcagggtgccacaggagtgtctaacagaggaggtcaggggcagcatccctgagaaggtgaagcatgagcgagagtgggaagatgagtcgaaagtagccagctgaggggtagagaggagaaagaacatccaggcagggagaatagcaagtgctaaagccggggctcatgaaaaggcatgggagcaggacaaagtccgtgtggtagaggtgcggagagtggtgttaagatgaaggggagaggcaggcagagccctgggcagatgagcaaccagggcttagtggatcacagttaggactttgggcttcagccacagagcagcggtgggctactgagattttttaaagcaatagtgtgacaatcagatttgtccttttttttttttaaagatgctttgacaaccttgtgaagaaagaattgaagggaagcaaaaggtgttgtagagagaccaattaaaaggttgtcacagtagttcatgccagagatgatggtggcatggcctagcatgacggtggtagaaatggagggaagtggtaagaggtaaaatcaacaagacttgccgatgggctggatgtcggaattgggggaagaaagctttctggcctgagtaactgggtgaatgaaggtacacttctctaagacagagaatgctggaaaagaaccacgttcatggatattgagttcaatttgtgtgtactaaatttggggtgactatgagacccctaagtggagaagtagagtgtgaagctggctgtatggatatggtactgcatgagaggttttggctagagaaacacatgtaggatttgtcagcatatagaaccctcagcagagccccagatagggatgaggttgcctggggagaggggagtggggaggggaggggggaactgggggaggattgtgctatgcttagaggccacctgagtggacatgggagattccttctcacggagctaagtgacagctgcggctcagaagaatgcccttgatgtgaaaaggagataccccaagttcagagtagaaatgcagtgtatttttctgggtcagctgtgtcatgggtcagcttaagaaccttcttgccatgtgacacaatgattacctgaggaaagcatttaagttccaaaaggtctattcccagggaaactggaaacaaaatttgtgagtgtgtttaggaccactttagtctacagaagggctaatatagtgtttttcaaacctttctaaacattttggccacagaactttcattaaagtaggataatttaagtctagtaaatgaaatacaccctaagtggctaaaagtatggctgttctgcctgcagcccctgccttcaattcccaatgccctgcctcaagcctgtctgtgcccccttggaaggcccagggccctgtgggatggacagcttctgagtgcattacttctgagtaaaccagttctaaaacctaagctaagtagattacctgaaagcaatcaattcatgccctaacttgtctaggacatcaatgtaactttttatatagtataaaggtttcaccttctttctggcctatgaatatgtctgaaattcaagagcaattaaagtactcctgggttgtcaaagccctttatgtaacactattgagttatctttatgcgtctgacttgtaagagatgcacaactctaggaagaagtagactgctgtgtcctgtttccaggtatgtgtgtgtttgccattttgttgacagactttaaaagcaaacatttctggccccaaccctgaactgccaaggactggtgctatgtaaagggttctctggatctgtctcttccctaccatcccagggagctcttaggaagggaaagggcatagagattataccagcctgccttgtggttaggaaccaccccttggttggcatatagaacatgcttgttaaaaaaaccatgcaggggaaagtagagtctactaccaggcgagagtttctcaacctcgaccctattaacattttgagccaaataattttgttctagggcattttcctgggcattttagaatatttaacaacatatctggcctctactcattagatgccagtgaaccccaagtgatggaaaaaaacaacaacaacagaaaaaaacctcttttattgaggaaaaacaccaaactcttccacatagttgcaagaccttgtgcaatttgcctcctagccaccactgtactcttgaattgcacgcctgatgccaaccacactggttcctcatgttcaccatgccccctccagccatgggggtgtgtggtcttctcagagtctgaagcattccccacccaccccaacccaccccctgtggccttctttaaccatgctggctaattcaggatccctagttccttatgactttcctttaaaacgtctaccagaaattgggggaaaaaaagtgttattataggattaatgttggtcttccgcactatactgtgaatatcattgagagcttggtccctacaccttaaatcccccatcgtcaactattttttcccatctcagtgtcccatgatcaaggagaccctccctgaatgtccagttccccaacccttacccccagtccagggtagcttccttccttgtgcctctcattaacctgcatgccgatccttcagtgcacttgactcagtgtgtaattgtatattcagtagcgtgttgttagattaaaatgtggttaatatgtgtttcaccagttatactatgacactccttaagggcagaaacagcatcttttttaatttattgatatccaagtgccctctataatagatgctcaataaacattgaatgaaagtgggtgtcagccagtactggccagactcaaactgaacccactgcttcccactagcttgactttttcctcctgtttgtggcactctctttaaaacaaaccaaaataaacccaattttaaaaactttttaaaatgagcacggatacagaaaaccacacagaacaaatgtgtagcttaatgaatttttttcagagaaataaccttatgaccaccaccaagtcgagcagtagaactttgctgtccactaagaagccctgtccatgtgccccatcccaattacagcatcctctctctctccccattaagtaaccgctagcctgactcctgtaataatcacttccttgtgagtttttttagttttattatcgaaatatgcatccttgacacaaatttagtgttgcccacttaatatatttgatgtcttttagtctacttaatctatggattctccttctatcgccttctatgccttactgattatctatgaagaacctgagctattccacctatagaatttcccagtctggatttgttgattgcacactgatgatgcagttcagcacattcctctatgctctgcatttcctcaaaattggcagttggatccagagacttgagattcaggttctgattcaggttcagtccttttggccagaccataggaagcatgcaattcctgactgtctctttatgatgttaacagtaattagtatataatgcatagatctattaatccattgggggctataaatggtattattctaattttattaccttttcatttaaaagttagaatacttttgtacatgatactacctcttatctattattggttgctgttcacatagtttacaaaggaaaatcaggacaaatgtttctttctctttatttgccagttttcatttataatgaattgtttctctgttattctccaaatttggcagattcttttttaaaaaaaatatcattatgaatgtatggattaaataattgatgtatttcagtctcttgcaatcattatcataattgtagcattgctttttaggcaaccctggtacccaggctgtacatttgtcatggggagtggggagggggagaaatagcatgggcactgtgagaccgagactgtccctggcagccagtattctggcaacactgttcacacccacttactggatggatcttgagaaagccccacttggtggagcccattcctgctgcccttttccagctggttatctgtcactctccttttcttcccaggtttggccggaagaatgtgctgttcgtgaccatgggcatgcagacaggcttcagcttcctgcagatcttctcgaagaattttgagatgtttgtcgtgctgtttgtccttgtaggcatgggccagatctccaactatgtggcagcatttgtcctgggtatgaccatcaggttggagttgagtacttgatcctgtatttcaccatcatcccatcacctacctttctggagacaactgtgatgtccctcaagggggacagggtttctaacaaaactagccagagcttcctggtgaaccttacttacaggcagggaaactgagccagacatgagaccagcctggggtccccagcagcacaatggcctgacttctgatttccagttcttttctggcctctgggctgtggctccttggtcttagtacttgatggtcaatttactaggactcaccagagatcctccatttacaaaaagggcctgccactgcacagggctgagccagccccagaaagagggcggcatggttggaggaggaggggctgtgactggcaagcttgctaaggtagagaaccccttgtctgcagagcactgtggctggtgatatctacggacaagaataaattgataggaaggggctttcgtcaccttcagggttttaattcagagtgcacactgcagggctttgtctcaaatgtgccagcctgttgtcactgagaagctgccaggccggcctgtgtttggaggaacctgactctagctgataaggcctttgagttccttgggttgtattgttgaaagggttgttttttctttttatatttaatattctttccttgaggcttaagtcagcatgtgctgacttagtaatgacttcacttttaataaattcttcctcatgtgaggattaaagggggcctaccatggcatctttagcacatggcttcagaacatggcgaaattttcaagagagaactgttgcttgggggcctgagaggccacagggatgtacccccaggagacagtcagacaggaggggttcagaacgccatccgctccctagcgccatgaacttagagagagttctcgctgttttcttgtctgtgtattcacaaagataccataaaaaattaataaggaaggaacccaaattaaactgctaactcgacctcccttgttttgaacagggacagaaattcttggcaagtcagttcgtataatattctctacgttaggagtgtgcatattttatgcatttggctacatggtgctgccactgtttgcttacttcatccgagactggcggatgctgctggtggcgctgacgatgccgggggtgctatgcgtggcactctggtggtgagtgtgaccttgtgccccatgtgcccactggcaggatgatttctgtctggccttcactagagggcagcaacaacccatgaatccctattttgtctcccagagacaggaagcatagattataaattatttcagaatgttttctccacactcaaaagagccaaaacaaaacagaatcccatgacagcaacagacttgctctcagccctgtgctgggttgccccaagtgtggggaaaaatagcagtagctgtgagaagatggggtccagcatgccctgtaggaagttcccaagcctcagggcaggacagtgtaggccctagttctggctgtgtgctgctgaagcctcatgccacaggcactggcaccaaaagcaagagtcctcagggtagccacatggaggaagccaggctccttctgcaccaccaaggtagaggagttgaacaggcagagaagaggccattccagaccaagaggggaacactgcagaggtgctaaggtgggaatcaccccttgcaggtggagaaggtgagatcaccagcccaagtggagcagagagcatttcagggcatagtgggagagtaagccgcacatcatggggcccagtcatgaccgagggtggggggcggctacctggtcccagcaaggtggaaaataatatccatagagcactcaagtgccttgataaacatgctaatttttttcctttttttcttttctttttcttttctttttttttcttttttttttctcagacaaagtctctgttgcccaggctgtagtgcagtggcgtgatttccacttactgcaacctccgcctccccagttcaagcgattctcatgtctcagcctcccgagtagctgggactacaggtgcctgccaccacacttggctaattttttttgtatttctttggagagacgggtttcactgcgttggccaggctggtctggaactcctagcctcaaatgatccaccggccttggcctcctaaagtgctgggattataggagtgaaccactgcacctggccaaacatgctattttaggtagagtatctgactaatctgttggataaatcaggggtagggtgaggagagaagagaagctaaaaggccagtgcagaagcttctgttggtgccggggacagggaggagagtgtagcagggcctgggctgacatagacatgcacagaagccaggcttccggagcccatcttgcacccatctcctcagcccagcagatggcaacactgctcttcagaaatggaggtggccagccagcatggggatgccgtcagggggtgcagggctctcccatttttgtgcggtgtggggtacacataagctcatccaccccaggttattgctgcgtgtggatcagctctttgcttctggcttgtgatcaccaaacattccacaagctctggttctgcaaccttattcccacctatggctgtgctctacctggtctgtgggtctgctgttggcagggaggcctcactgagattggaccttgtactgccaggttcatccctgagtccccccgatggctcatctctcagggacgatttgaagaggcagaggtgatcatccgcaaggctgccaaagccaatgggattgttgtgccttccactatctttgacccgagtgaggtaagcaccatgtgggtgtgggtgagagggacagactgaccgtgatttgagagcagcagcacccagccctgaagtcctccctgctcacagcagcccagccctctctccgcccaagccccaactgcccattccccccatccccccactccccacccccacacgggccctgttaacactcagaagttgaggaataggttacagctgcctcactcttttcaccacgggtttcagattttcattttttacttcctttctaggcaatcatatattttaaccattacttctaacaataaatactctttttgagtaataggcctttcataaagtcagcatttgggaaaatcattgtttcttatacctaaggtggcttgtcaccttacaaagctaaccccaaacgtaaaatgtaaagcacaaatagatttggagttagaagtatttcatctcttgagtattagcaattattcattaaaaagaaaaaaaaagtgtttagtctctttctgccctccaatggttaattattgcatatcatcttggagtcaggtcctttttgatgtccacctcttccccctaccccacccctcccgtcagccctgttctcacacaccatgactcatttcttggctctacctagttcctggttcttgcttttccttcccgttccctctcctaccatctctgtagcaggcagttttccttggtctcgtgactatgagaggttagaagctgtaaatgctgcctggtggggttctggaatgtgtctgtggtctgactggaagatgaggggttgggtgtgggaacagccacaagcagccctgctgaagtgtgagaggcaggcatggttgggcttggaaaagagggaacagttattgtagacagcggaggccaatggccactgccagccctgcagacttcccagtgagtggtggcccagcagccactgtcagcatgcaccagaaaggggtcctgtgcgcaaaggtcaggcaggagtgtggcagagggcttttaagttaggtggttttgggggcttttaagtgaggggtcaatctgggtgaatgcataagccccactggcatctttgaggaaatgaggctatttcaggggatactttcagtccaaagttgaccttttgttgaacttctaactctggaaaaacaagctccaaacctgggtttgcttaagaaagcaacatcagtgtgtttagacgtgtggtttattaatggccttggctgtgctgaatttcataggaagtcactctgggtgaagctcaggtcaattttcctgtttttctatttgaattctttttccctggaagcacaccagtaactacatagtataaggactcaaaacattaacttttaaaaaatatcagaccaataaaccacacagccaggtactctctctgacccagagggcagggagccaggcttcgggaggaatacttagaggcctccttggaatgtggccaccgacaggaatatgtgggggtgcagtgaggaagctgtcagcctgggcctctgtcttcctgtacccttgagggactggtcacttacttttcctcattttcattcactctgatttgttactgacaaggcctagggaagttttcacagcctaaaacacagtcagtatacttactgttcttagaaacgtaacactccccgacgctgagatgcagacagctaagatgccagggattcaagtatgttattgtgtgctctgagtctctgaccacctcttcttcccatacacttatgatgttgttcctgcagttacaagacctaagttccaagaagcagcagtcccacaacattctggatctgcttcgaacctggaatatccggatggtcaccatcatgtccataatgctgtggtatgtaaaagagacctgcctgaggcttccagacaaagcttcttgaagtggccattgggcctcttgtttacagacatgcctcagacaaaattcaaagcctatgtcatcagagagtgaaaaggatatgtcttgtgttagatggaaaaaatgggcatgtcacaattcttaatgggatggaacctcagaaaaggagaatgaaaacaattgtggaggctgttgtgggaaatatggactcttgtggggaatctctccagatcttaagatgaatccttgcccaatttgggtcatttagttcccgtctcctacccagttaccgacagtggctgaggaggccaggtagggcttttaagaaggatctgagtgaagacaccatgtcctgtaggctgcagaggctgccagttactttctggaaatgtggaagtgggatgtgctcctcctgggatgtccataaacggtcctggagtcagggctatagcctagatgtccttaccaggttcccactaatgaggcaaagtatgtcagaaagggatttgtgaattaccagggagaggaaacatgtccaagtgcacatcgctagcttttgctcagcggccgaaccctgggattctaggcgacttctggagcctggtgggttagcggtgagaagatgggcgaggagggcggacttcatctcagagtccttattactagtctcatccagctttgaggcagtcagccactgtgcctactgagggagtgctatgagtcacccgcttccaaggaatggcccaggatccctccaggcagttcaccattccctgagttggcctcaagacaggagcagcatgtagcctgcaccacagacatgcaagcctgtgatgagtcacccacttttgtgttcacccaggctctcctccctgctctggatttcctggggactcatgcacatactctttttattgtaccagctgtgtgttccacctgcagatgagtcaaaacagtctaatccataaaggtctggtttgtcaaagagtgtgggtcatcaacagagagaatgcctactggggatgcccaggtcaggggtactgcagggcatcctgatgagaggcagtgtggcccctccattgggagccacctctgtgctccacaagtaccgcggggctggtgtcagctgtctctgaccagcctcttcctgactggtcaccacaggtagtgtgtgagggtctctctccaagtgtttgacctaatgttgttccttttgttatcttatcccccaaatcctatcacacctcacttgatgtctgcctcctgactcattctctagctccttctgcagttgctggatttgaggaggttcagcttaggatttttaaagctgaaaggcaggttggaatttttcttttcaatgaagtaaatctatctgaattatacaagcttttttgctgggacactgtctatatggaaggctctgagagcgcactggcgcagggtttacactgtaccacttgggctggggaaaattatcttttgatctatgaagtaagacgcagggttacagttactgctgccttactagtctctgcttaaagatggtttggaatttactgaaataattgcattgtaaaagttgtacaggttgggaaagatgtggatactgcttttccagctttcttctgcactctgtttcaggatgaccatatcagtgggctattttgggctttcgcttgatactcctaacttgcatggggacatctttgtgaactgcttcctttcagcgatggttgaagtcccagcatatgtgttggcctggctgctgctgcaatatttgccccggcgctattccatggccactgccctcttcctgggtggcagtgtccttctcttcatgcagctggtacccccaggtagggaccatgtgcatctatggtttggggtcttcactgagtctcttactgtctaccaggctgtctcaattaataaagagaataaaatcaagcccatcacagctcccttgcttatatacattcttggcctaaaaatcaatagaaagtgtcttctgagactagaacacttatggcctgggctttgagggagtgggaaaaagcagccattggggctgttggttaattttactctgtacccaagttaatgtgctcatactgttttccactgcagaagaagagggaagaaatagctatcccattcctttttttcctggccctgtcttctttatttattcaacaaatagctatggcatgcctaccatgggctgggcactgtgctcggtgataacgatacacaagaaaacaagccaggcagaaccccaggccctcatggaacgtacaccctagatgagaagacagacaacaaacaagtaaataaaatgcttaatatagttcagactgtgttaccttctaggaatacaaatgaaggacaatgccgagttagtttacatagtcacagatagtgtccctgaacagggggcagttcagtagaaatgtacataaagtgacagaaagccctgaaaaagtctaggagaacattttaggaagaagaaatggcaaaggcagcgaccctgagcaggggatgagcctggcatgtttgaggaggagggagaaggggaggggccagaccactgagagggcctcacagagccttagcaggattttatttctgaaactatcttagtatcccacagatgggtgggaggtagccatttccaataatttatagaacagttcatgggccctcatctctccctctccatcactgtgcccagagacttcagtgtacctgtagatttgggagcctctgatggtcacttttgggcccatcaggctgagaacactgcacgggaacagctccccatgggatgtggcaggaggagcccagaactgatgtagaggctcacagctgagctcagagtgaccttcaggtcacacatagctctcccatcagcacagcacagagagattagaagatcaacttgagattctgatggcctatgatttttttgaggtctgagtgggaggaaagcatgaaatgagttagaactgaattctccattcatctaaacatcatgagttaattccatagtgcctgcagtgtgaggttctggggtgacagttaatccctgacagacatgtctttaatgacttatagactgggaagcaggttgattggactattaaggagcttactctggtggtctccaggttgaggaaagtgcatgtccttatagctgcaggtcccagcctcctttcagcaatcaatttggagggaaatcttggctatagccccttcccccacaataggaagtgatagaaactgactccccaaaaaatttgggaagaaagtatgtttgttttgctctcaatagctgcatgccatgggttggtacctactcctaccctctttcctttgcttctccagacttgtattatttggctacagtcctggtgatggtgggcaagtttggagtcacggctgccttttccatggtctacgtgtacacagccgagctgtatcccacagtggtgagaaacatgggtgtgggagtcagctccacagcatcccgcctgggcagcatcctgtctccctacttcgtttaccttggtaagtcccatgagccaagggcacactagagcaacgggatggaagtactaactggcttgaatgtgagctggaggttgcgtgttaacaggaaaacaagttcatacagtacatgggctccatccagtactggatctttggccgggaagggttcttgtcccagtgcactggccctcactttcaaatggaaaacaacctatagattacctagaaattgatgagaatattagagggtttgtttctgttttagccatcccaggccttccatcagagactacaattcctttatcctaagaacctacagagtggtttagggagccagtgtgcttagttggagaaatttcttggaatcagagtttaaaaggaacatgaggggaaagatgtccatgcaagaggtctgatgaacggaaaattattataacctagagcactatagagtgattttatcttgtgtgaagatccaccccatgccattttatgtagcaggtctccagttttctcttctcagaattatgtcttcatagcacctgtggtttcctgcacatccctagccagtacctctttagggagggtggcacccacctgagagtactcagagtgctttgtgaacatgctatgtagatctcaaagcaagcaaaagcaccctgcctaatctgaaggcagatcacatgggctgggacacatctgcagaggtggaagagttatttccatccctggacaagtacctcaggttccttggaaacccaaccttggtaaataagaataatcagcatggcccagaaataggaataatcagcatggcccagctcttctactgcaaccgcccctttgtactcctcccctgcatggtggaacactgctgggctctgggcatgcctgtgccagctctgggttctgaaacctgtctagatgccagattctaatctgactgctcagactgtgagagatgtgagaccaagaaggaaagtgatccccttccagagtcctgggagcataaaggggtagatgagagaccaagtctaactgcagccctgggcctgaggctccgtctgctttgccataggtgcctacgaccgcttcctgccctacattctcatgggaagtctgaccatcctgacagccatcctcaccttgtttctcccagagagcttcggtaccccactcccagacaccattgaccagatgctaagagtcaaagggtaagaagacctcctctgtcagtgttgatgcactgggtctgggtctggccaggtctcaggagcccctcacaatagagctactcgcaaactccctctcacagacaccatggactagtttagccattaaagggttgtaaatggcaaggtgcttacttatagcccatcctctctggtctgttcctgtgtggacatgtcactatacacatctccatggcagtagccgcactggataactcagaggctagaagaaacctttcagaatctgctgcaggattctcttcccagggaagatatcctcagttcttgtttgtttggagactgggaggcatctttttaaaatgtgttactgacatatttttgcttgtttttatagaatgaaacacagaaaaactccaagtcacacaaggatgttaaaagatggtcaagaaaggcccacaatccttaaaagcacagccttctaacatcgcttccagtaagggagaaactgaagaggaaagactgtcttgccagaaatggccagcttgtgcagactccgagtccttcagtgacaaaaggcctttgctgtttgtcctcttgacctgtgtctgacttgctcctggatgggcacccacactcagaggctacatatggccctagagcaccaccttcctctagggacactggggctacctacagacaacttcatctaagtcctaactattacaatgatggactcagcacctccaaagcagttaatttttcactagaaccagtgagatctggaggaatgtgagaagcatatgctaaatgtacattttaattttagactacttgaaaaggcccctaataaggctagaggtctaagtcccccacccctttccccactcccctctagtggtgaactttagaggaaaaggaagtaattgcacaaggagtttgattcttaccttttctcagttacagaggacattaactggatcattgcttccccagggcaggagagcgcagagctagggaaagtgaaaggtaatgaagatggagcagaatgagcagatgcagatcaccagcaaagtgcactgatgtgtgagctcttaagaccactcagcatgacgactgagtagacttgtttacatctgatcaaagcactgggcttgtccaggctcataataaatgctccattgaatctactattcttgttttccactgctgtggaaacctccttgctactatagcgtcttatgtatggtttaaaggaaatttatcaggtgagagagatgagcaacgttgtcttttctctcaaagctgtaatgtgggttttgttttattgtttatttgtttgttgttgtatccttttctccttgttatttgcccttcagaatgcacttgggaaaggctggttccttagcctcctggtttgtgtctttttttttttttttttaaaacagaatcactctggcaattgtctgcagctgccactggtgcaaggccttaccagccctagcctctagcacttctctaagtgccaaaaacagtgtcattgtgtgtgttcctttcttgatacttagtcatgggaggatattacaaaaaagaaatttaaattgtgttcatagtctttcagagtagctcactttagtcctgtaactttattgggtgatattttgtgttcagtgtaattgtcttctctttgctgattatgttaccatggtactcctaaagcatatgcctcacctggttaaaaaagaacaaacatgtttttgtgaaagctactgaagtgccttgggaaatgagaaagttttaataagtaaaatgattttttaaataacagcaactgcctagaatctttatttctagaatttagtgagcctgtgccacactgtcatctgccttttctctgtatcagcttgggctaattctagcaatggttgggattaatctctaagactaagatttgattcttgtgcactagaattcttcactttattaattgactatgggctgagccagccttcttgcacaaatgtatcttgggttcccttgaaagtagagactgagacaagtgcttctgtgcagttaagcagtttatgctttggggacaagattccagggagcagcaataaaggacaggaggagaacagggaaggagggaggctgaatacaaagatgcattttcaggttgactagcaccaaaggcagggatgctccatccagcaaggacttcagaagaagcttatgaaatgcatctcaacaccatctgtaccttgagtaaaagggggaagcatttctctgttggcatccatttgtaaaggcagcccacaggtgtcagctccacatgtttccaggctgcacatgcatgagtcccaaataagttctgtcccgtgggtagaaagcaagagagaatacattgcagggctgaagtaggggttgccagagcccatcagaactggtcactgcaacagtggctggagtaagtggtgggctgagaggattgggggttgagtgtggtgcacaagaggtgtcttaatctatatacaatttgcacagggcattttgggctagaaggtgtggatggacctgggtaaaaagctccagtgttggatagaaactcaagggcatgttgcataacaaaacaagcagcatcaaacttgggggagaaggaaggcagcacgtcttctggaacactgttggcttctccactctcctcaaacatggttctgtgctggactactgattaactgtcttcccaggggctctagaatctgaattgcagttctgtctacccattgtcctgtagcaggagtgaatagtttctgcattttctctcttattctccatgccactgattccagtcatttgtggccttctgagggcaaaaaccataattacctgaatgcttagagctcttcatgtggtgaggcaagagcccaagtcacttccagggttgagccaagcatgtggaattccaagtcctctgtctaagcctgttggattcgtgtgtggcttgtttcccttagagccatgactttgggaagactgagtgtgttatcagaccaaggatctcctctgctccaggagagaggcatacacaaactgtagccacaggggcagagttggtgagtgatgaggtgttcagttaatgtgtataactagaaaccagcatacccacagaaatataaaagacaaagaaaaggaggtggaggaacaacccagattttcttaaaaaccagtttcctgccacagatcaaagtaaaggcaaagatttgccataccatcttttcctattcttggaaactagttcttatctctgtcagggttccctgaacattctcatggattccataaggctgttgtttgtcaaagagaattattctgcttaatacctggtctaagtgacggtcaatgaggtgggcacaagaccctattccctgccaggtagtaaatagcacaatagaactttcttctgggggtttgtcttttaattcttttcctaaagggcttttaggctgatagaggcttgatgcaatgcactggcaacaccttatgttctatgccattgctttaaaagcactttggaaaataaaatctcatgagattaacagaggatgcactgatgacagacacaggtttctcagcagaaatcatgttttggagctctcaggcagacccacccctgaaggtgtcacctcatgaagaagggacataacctcagggacagagttctgtaagaagccgccagagacactgggacatcatctgtctgttgcgccagccagagggcagcagccaggcccctgactggctctttacctgggaataagtctcacaaaagacttctcatagaggaagtgtgaggatacactccacatcaaggataagactgctaaatactaatacacagtgatattggtattttgcatggttcgtctactgaagagatttgaaacttaatgctcatgcaacccctgattatgagcaaaatagttctgaaaattctaaatgtcctcatagaattgccccccaccccatgccaaacaaatgagcactaaaaacgtaaaagccccaggaacagctctggtctggagctcctagcgagatcaacgcagaaggtgggtgatttctgcatatccaactgaggtacccggctcatctcgttgggactagttagacagtgggtgcagcccacggagggcaagccaaagcagggtggggcatcgcctcacccaggaagtgcaaggggacagggaactccctcccctagccaagggaagccatgagggactgtgccatgagaaacagtgcactctggcccagatactatgcttttgccacagtcttcgcaacccgcagaccaggagattcccttgggtgcctacatctccagaccctgggtttcaagcacaaaacagggcggccattcgggtagacaccaagctagctgcaggagttttttttcataccccagtgatgcctggaacaccagtgagacagaaccattcactcccccggaaagggggctgaagccagggagccaggtggtcttgctcagcggatcccacccccatggagcccagcaagctaagatccactggcctgaaattcttgctgccagcacagctgtctgaagtcaacctgggactcttgagcttggtggtgggaggggcgtccaccattactgaggcttgagtaggcagttttcccctcacagtgtaaacaaagcccccagggactgcagtctggcaaagccgctgtagccagactgcctctctagattcctcctctctgcgcagggcatctctgaaagaaaggcagcagccctagtcaggggcttatagataaaattcccatctccttgggacagagcacctgggggaaggggcagcagtgggtgcagcttcagcagacttaaatgttgtgcctgccggcgctgaagagagcagcggatctcccagcacagcacttgagctctgctaagggacagactgcctcctcaagtgggtccctgacccccgagcctccgaactgggagacacctcccaacaggggtcgacagacacctcatacaggagagctctggctggcatctggggggtgcccctctgggacgaagcttccagaggtaggaacaggcagaaatttttgctgttctgcagcctctgctggtgatacccaggcaaacagggtctggagtggatctccagcaaactctagcagtcctgcagcagaggggtctgactattagaaggaaaactagcaaacaggaacagcatcaacatcaacatcaagaaaacggacgtccacacaaaaaccccatccgaaggtcaccaacatcaaagaccaaagatagataaatgcactaagatgaggaaaaaccagtgcaaaaaggctgaaaattccaaaaaccagaacgcctcttctcctccaaaggaccacaactcctcgccaacaagggaacaaaactagacggagaatgagtttgacgaaatgacagccttcagaaggtgggtaataacaaaccccctgagctaaaggagcatgttctaacccagtgcaaggaagctaagaaccttgaaaaaaggttagaggaattactaactagaataaccagtttagagaagaacataaacgacctgatagagctgaaaaacacacacaagaactttgtgaagcatacacaagtatccatagctgaatcaatctagcgggagaaaggatatcagaaataaagcgtgaagacaagattagagaaaaaagaatgaaaaggaacgaacaaagcctccaagaaatatgggactatgtgaaaagaccagacctaggtttgattggtgtacctgaaagtgacagggagaatggaaccaagttggaaaacactcttcaagatattaaccaggagaacttccccaacctagcaaggcaggccaacattcaagttcaggaaatacagagaacaccataaagatactcttcaagaagagcaaccccaagacacataattgtcagattcaccaaggttgaaatgaaggaaaaaatgttaagggcagccagagagaaaggttgggttacccacaaagggaagcccatcagactaacagtggatctctctgcagaaaccctataagccagaagagagtgggggccactattcaatattcaatattcttaaagaaaagaattttcaacccagaatttcatatccagccaaactaagcttcataagtgaaggagaaataaaatcctttccagacaagcaaatgctgagagattttgtcaccaccaggcctgccttaaagagctcctgaaggaagcactaaacgtggaaaggaacaacttgtaccaaccactgcaaaaacacgccaaattgtaaagaccatcaatgctaggaagaaactgcatcaactaacgagcaaaacaaccagctaacatcataatgacaggatcaaattcacacataacaatattaaccttaaatgtaaatggactaaatgccccaattacaaaacacagactggcaaattggataaagagtcaagacccatcagtgtgctgtattcagaagacctatctcatgagcaaagacatatatattgtctcaaaatgaagggatggaggaagatctaccaagcaaatggaaaacaaaagcaggggttgcaatcctagtttctgataaaaacagactttaaaccaacaaagatcaaaagaaacaaagaaggccattacataatggtaaagggatcaattcaacaagaagagctaactatcctaaatatatatgcagccaatataggagcacccagattcataaaacaagtccttagagacctacaaagagacttagactcccacacaataataatggaagactttaataccccactgtcaatattagacagatcaatgagacagaaaatcaacaaggatatccaggactagaactcagctctgcaccaagtggacctaatagacatctacagaactctccaccccaaatcaacagaatatacattctgctcagcaccacatcacacttattctaaaattgaacacgtaattggaagcaaagcactcctcagcaaatgtaaaagtacagaaatcacaacaaactgtctctcagaccacagtgcaatcaaattagaactcaggattaaggaactcactcaaaactgaacaactacatggaaactgaacaacctgctcctaaatgactactggatgaataacgaaatgaagggagaaataaagatgttctttgaaaacaatgagaacaaagatacaacgcaccagcatccctgggacacatttaaaacagtgtgtagagggaaatttatgcactaaatgcccacaagagaaagcaggaaacatctaaaatcaacaccctaacatcacaattaaaagaactagagaagcaagagcaaacaaattcaaaagctagcagaaggcaagaaataactaagatcagagcagaactgaaggagatagagacataaaaaacccttcaaaaaaaatcaatgaatccaggagctagttttttgaaatgatcaacaaaattgatagaccgccagcaagactaataaagaaaaaaagagagaataatcaaatagacacaataaaaaatgataaaggggatatcgccaccaatcccacagaaatacaaactaccatcagagaatactttaaacacctctacggaaataaactagaaaatttagaagaaatggataaattcctggacacgtacaccttccctagactaaaccaggaaaaagttgaatctctgaatacactaataacaggctctgaaattgaggcaataattaatagcctatcaaccaaaaaaaggccaggaccagacagattcacagccaaattctaccagaggtacaaagaggagctgctaccatttcttctgaagctatgccaatcaatagaaaaagagggaatcctccctaactcattttatgaggccagcatcatcctgataccaaagcctggcagagacacaacaaaaaaagagaattttatatcaatatccctgatgaacatcgatgcaaaaatcctcaataaaatactggcaaactgaatccagcagcacatcaaaaagcttatccaccatgatcaagttggcttcatccctgggatgcaaggctggttcaacatacacaaatcgataaacgtaatgcatcatataaacagaaccaatgacaaaaaacacatgattatctcaatagatgcagaaaaggcctttgacaaaattcaacagcccttcatgctaaaaactctcaataaactaggtattgatggaatgtatctcaaaataataagagctatttatgacaaacccacagccaatatcataatgaatgggcaaaaactggaagcattccctttgaaaaccagcacaagacaaggatgccctctctcaccactcctattcaacatggtgttggaagttctgggcagagcaatcaggcaagggaaagaaataaagggtattcaattaggaaaagaggaagtcaaattgtccctgtctgcagatgacatgattgtatatttagaaaaccccatcatctcagcccaaaatctccttaagttgataaacaacttcagcaaagtctcaggttagaaaatcaatgtgcaaaattcacaagcattcctataccccaataacagataaacagccaaatcatgagtgaactcccattcacaattgctacaaagagagcaaaatacctaggaatccgacttacaagggatgtgaaggacctcttcaaggagaactacaaaccactgctcagtgaaataaaagaggacacaaacaaatggaagaacattccatgttcatggataggaagactcaatatcgtgaaaatggccatactgcccaaggtaatgtacagattcaatgccatccccatcaagctaccaatgactttcttcacagaattggaaaaaactactttaaagttcatatggaaccaaaaaagagcccgcatagccaagacaatcctaagcaaaaagaacaaagctggaggcatcacgctgtctgaattcaagctatattacaaggctacagtaaccaaaacagcatggcactggtacgaaaacagatatatagaccaatgcaacagaacagaggcctcagaaataacaccacacatctacaaccatttgatctttgacagacctgacaaaaacaagaaataacaagaaatggggaaaggaatccctatttaataaatggtgctgggaaaactggctagccatatgtagaaagctgaaattggatcccttccttacaccttatacaaaaattaattcaagatggattaaagacttagacgttaagatctaaaacgatgaaaacctgccaggcgcagtggctcacgcctgtaatcccagcacgttgggaggctgaggagggcggatcatgaggtcaggagatcgagaccatcctggctaagatggtgaaaccccatctctactaaaaatataaaaaattagccaggcgtagtggtgggtgcctgtagtcccagctactcgggaggctgaggcaggagaatggtgtgaacccagaagtcggaggttgcagtgagccgagattgcaccactgcactctagcctgggcgacagagtgagactgtctcaaaaaacaaaaacaaacaaacaaaaaaacaccataaaaacctagaagaaaacctagacaataccattcaggacacaggcatgggcaaggacttcatgaataaaacaccaaaagcaatggcaacaaaagccaaaaatgacaaatgggatctaattaaactaaagagcttctgcacagcaaaagaaactaccatcagagtgaacaggcaacctacagaacaggagaaaatttttgcaatctacccatctgaaaaagggctaatatctagaatctacaaagaacttaaacaattttacaagaaaaaaacaaacaggggcaaagtatatgaacagacacttctcaaaagaagacatttatgcaaccaatagacacatgaaaaaatgctcatcatcactgctcatcagagaaatgcaattcaaaattacaatgagatatctcacgccagttagaatggcgattattaaaaagtcaggaaacaacagatgctgcagaggatgtggagaaataggaaagcttttacactgttggtgggagtgtaaattagttcaaccattgtggaagacagtgtggcgattcctcaaggatctagaactagaaataccatttgacccagccatcccattactgggtatatacccaaaggattataaatcatgctactataaagacacatgcacacgtatgtttattgtggcactattcacaatagcaaagacttggaagcaacccagttgttcatcaatgatagactggattaagaaaatgtggcacatatacaccatggaatactatgcagccataaaaaaggatgagttcatgtcctttgcagggacatggataggctggaaaccatcattctcagcaaactctcacaacgacagaaaaccaaacaccacatggtctcactcataggtgggaattgaacaatgagaacacatggatacagggcagggaacattacacaccagggcctgtcagggggtgggaggctgagggaggggtagcattaggagaaatatctaatgtaaatgacaagttgatgggtgcagcaaaccaacatggcacatgtatacctatgtaacaaacctgcacattgtatacatgtaccctagaacttaaagtacttaaaaaaatatgctaaagggccaggcacagtggctcatgcctgtaatcccagcactttgggaggccaaggtgggcagatcacctgaggtttggagtttgagaccagcctggtcaatatggtgaaactctgcctctactaaaaatacaaaaattagccaggctggtggcacatgtctgtaatcccagctacttgggaggctgaggcatgagaatcactggaacttgggaggcagaggttgcagtgagctgagattgtgccactgcactccagcctggacaacagaacaaggagactccatctcaaaaaaaaaaaaaatgctaaagggagtctttcaggctaaaatgaaaggacactggccagtaacttgaatacttgaatctgcatgaaggaataatgaacatggggagaggtagatacctaagtaaatataaagggcagtattaatttttttcctaacctctcttttcctacataattttaaaagacaactgcataaagcaataattaaaaatttaggttgatgggcatacaatgtgtaaagatgtaatttgtggaaatataatataaagggagtagagctgaataagaacaaagtgtttgcatattattgaaattaacttggtattaatctaaaccaggttgttacaaattaatatatgaactgtaatctctagggcaattattaagaaaataaataaataatatatactttaaaaagatacagatttagaattatcctagaaaatatggatttaacacaaaagaaagcagtaatgaaggaattgaggagcaaaaaagataaaagacatagaaaacaaatagcaaaatggcaggagtaagcccttttcagtaattatattaaatgtaactcttcaattaaaaggcagagattcaccaaatagattttaaaatcatgatgcaactattatgatgtctacaacagtttcaatttagattcaaagacacaaataggttgaaaattaaaaggttggaaagatcttccatacaaataaccaaaagagagtttgaatggctgtattaatatcagacaaatagattttaac

SEQ ID NO: 1180 - DNA, 39838 bp, Homo sapiens
ttgcagaaaaagtgtgttcacaaagtagaaagaaaaatccagccttagaaccaagaatctttacaaggtcaggaaaagcttctccctttccccacctcctgctccgaggttttcctgctgcctcccgggaaaggtgggactcttccaccaccttgtggacacccagggatggcaggtgagcaggcttccaccgcctcacaccagctctcctctgcactgttggagcctattattctgggtccgactgggtctctctaggctcacactgtgcatgtcctgtctccatcctctgttcctttctgggctggggcagtggatggggctcctgtgtcctcctggctgcctgccggtccccgtgtacgtggcagggctgcagcagtcccctgttttccttagatcctggcgtggagttggtgtggctcctgcttccctggggccctggctggccccgtagacccctccaggtctctctgccaaagtccccccacccagccacctggcccaactgtccttcccacagtgaggctgagggtccccccaccccacgtcatgtcccagccccacggggccattgcagcttcagctctgcatccaggcactgaatgggagccacaagagcctcacagggcaaattagagcccccactgttctgatcccccagccgggctgcggccgctgtgttggtgtacgggggctctgcccagagcaaactctgccacgacagggctgaggcgcagggagaaaggagctgggatgcaccccaagcaccttcctccccctcactctccctcctccctctgccatccttcccccacacccaggaccggaagggcgagcgtctcttgtctttcctgcatgttctgtcagccccttccactctggcccccagtctagacctattgtcgagacaggagaaatcttgtctgcccccagggagaaacactgctctctgccctgaacttggaggggctaaaaagcaaaagctctagccttagaaggttctcactttggaagtttaaaaaaggtcaaaggaattttcaaaatccctttctttctcaacaatgcttagatttcaaacctcttctcttgttgcaaaatcccgttgtgaacatcagaacctcgagatgatctttaagttttctcagcattccccatcttctctcccctctgcaagcagctaaaagttacagaagcagttgaagccagcaactccccacccccatctcctcctctcctggggacaggggccccatctctcagccctgttgtgggttgggtgtggccggtgtggctgtgtggcagggtcctagccaatgggattcgagtggaacgtgggcctcctgcacacctggccccgtgggcaggcaccacctgggctcctccctcagtgcaccagggcagagcaagatggaggcaaccgggatccctgaatggcttcacagaggtccccacccatcaggcacacttctgccaacctcatgtggaagtaagcttctattgcattaagtccctgaggtgctgaagctcatcagttgatggcaggccacttgcatgcaaaatagaaaaggacatcggtatttttttcaagctgttaccctgttatagagataaaagaagccagaaccagccccctccagtggctccttctcttcagcctgggcaggatctgttgaaattcccatggtgtcctctggggccctctgccctgcgcctctccctggcagtgcgaggtccacagttcacctgcaattagctcccatgtgcaggggactcataaaggagcatctttgagctccagacccaagtgtctggtggcctagaggctgcgaaggccctcaagctcagcatatcccaaagcaaacctatggcattcactccagcacacacctgctttggcctccatgaatccactctcttccctcatcgctcaagctagaaacttcttagcaccaccctcgctgttcctgtacccccccaccttcagtcaatcatggagtcctaagtccccggccagtccatcacctctctccctctaccaacacccccaactctcccacctgtgccacccggtacgcccatgtggtcccctggttccctccaatctgttttcactctgagctttatgatctttgctaactgtgaataggattcatgccatccactcccctacataaaacctttctaggcttctctttgctcttagaaactggcaactgcctaagaggccacacctgggcctgtcccacctccccagccctcacctccttcccaggcctctgcatccctgtccccctccacttcctttgcagtgtgcctccaggccctctcccctccggagctctgccagtgcagagctctctgagccctctgtgtgggacatgctgttctctctacttggcctggtagggctccttgaggagccctcgaccctcccaatggggtggaatccgccgcggtaaacttccacagggccccgtgcccccactctgcagcgcttccctggggttattattccactaccagctgcataattatttcatccgtaattattggactcagcccagctcacttctgcccctggcctttgcacttgctcttcccagtgcctggcgtgaccttccccacacgtcagtctggctggcccccctagctcctcaggtccttcttttctttttgagatggagtctcactctgtggcccaggctggagtgcagtggcacgatctcagctcactgcaacccctgcctcccaggttcaagcgattctcctgcctcagctgagtagctgagattacaggcacccagcaccacgtgtggctaatttttatatttttagtagagatgggggttttgccatgttggccaggctggtctcgaactccagacctcaggtgatctgcccctctcggcctcccagagcgcagggattacaggtgtgagccaccgtgcccggcctgctccgcaaatcctccttctagtgtcaccttccaggtgaggactcgccaacaacctgatagaaacctgcaaggccagcgcctctgcagccccacactccctaaccccttctctagggcattgccatcttctgacataccatttattttatgtcttgtttaatgtgtgtgtgtctctctcttaaatgtcatgcagccgggtgcggtggctcacacctgtactttgggaggccgaggcagaaggatcacttgagcccaggagtcgagaccagcctgggcaacatagcaaggccctgcctctctgtattttaaaaaatgaagtaaataataaatacataaagtatttatgtatttacttacattacaaagttcccccaggggcgggaactttgccttgttcttgcggcatccccagtgccttggacagctccgggcccagagtcgcgacgcctccagcaggcccggctgccccactgcgcacatgggcacaggcttggcacacgcactgcggcattcacgtatccgcgaacacatgggtatctatttatacatgaagacacgaaaatgtatttatttcttttaaaatcagaagaaaacggtgagaactgtgaggccggggggacgttttcctccgggatcctggcagatcctgcagaccgcgccgtcgtgcgcgaagcaccgggacgggcctcccgcgggaagggcccaggaggacaccgggctcccctcccgcccgcggggccccagacgcggcgccgctttaaggctccgggccccgcgcggatgcggaggctgcggccgtgacgtcagcgccccgccccgggtgatgctgcagcagccgggaccgcggccgggcaggcagcagcccagcggggacagggatgcctgccgtctccacccacaggtaccaccgtctcctccgcgccctccgcccgctctctggctccgtgcctgccggggcgccgcgccctgggccccggggtagtcagggcgccgagaccgggacccgaggccggcacggagacctttgttcctcgtggaagtctcatgaattgcagagtccacggagctcccccgtctcgcccctccgagggcaggagcctcgggcccaggggagggtgccggccagatggcaggtgctctcatccttgctggcaaggggaggagaccccggccttggccccagctcctgatgcgctccttgagccggaggcctggtccctagtcacctgggcaggtgtcatccgctcccggctcacctcttgcgtggggctgagccctcttgttgaccaggggcctggcaacgcccctcagcatcccagggttacttagcgagggcaccgaggactcccctttcccgagcgagtcagcaccaaggggaacgcgctgaggtggaagccgttcagctccttctgccctcgacaatcagcaacttctctaattatttctagagtgacagccgtgcatgtttttcagctcttacagggaagcagagtcaggggcggaggaaagccacgttcaggctgcacctggcctgggcttttgggaaaagttggccctggagtaggggtcaagctgccggagatgcaaagtgggaaacggccacgattcagtaactagcctattaagtgcaccctcccaagtccgtagagcaccttcctggtcctggaggacctcactgaagaattttgagaatgggtagaaagaagcatgaggggtcgggcgcggtggctcatgcctgtaatcccagcactttgggaggctgagtcgggtggatcacctgaggtcaggagttcaagaccagcctggccaacatggtgaaaccccatctctactaaaaatacaaaattagccgggcgtggtggcacatgcctgtaatcccagctacttgggaagctgaggcaggagaatcgcttgaacccaggaggcggaggttgcagtgaacccagatcatgccactgcactctagtctgggcgatagagtgagactccgtctcaaataaacaaataagcaaatacgccctaggaagggaggtggcccaaggcaaccccgtggggggagctcattttcataacgagaagaaagaaatgaggaaatggtttccgctcgtagtaggatcattgtaagcattcaaactacattgacattgattacttttattaatcatttgccgcttaaacttcccacaacacagtttgaggaatctgttactttaagcatcctctgtactctggaagcacagtggaccccttgcatagccttcgggggatccagggagatgagtggatttccttttgaccgagtaaatggtcatatggtacagtaaagatggtctggcgaatgtttgtatttgtgcatgaaaattagattttatgatcttaaattccactttcacccatttttatgggaaccttaaaaatggatttttgttgttgttgttgttgttttttgagacaagagtctcactctgttgcccaggctggagtgcagtggtgcgatctcagctcgctacaacctccacctcctgggttcaagcgattctcctgcctcagcctccggagtagctgggattacaggcactcgccaccatgcccagctaattttttgtatttttagtagagacggggtttctccatgttggccaggctggtctcgaactcctgagctcaggtgatccacccacctcggcctcccaaagtgctggcattacaggcgtcagccactgtgcccggtctcaaaaatgagtttctaaaattcttcttatgataaacatttgtgaacagtttttactaaatgtagttttaataaaaatggtaatgctgatccccagatttgaagatgaatccttagtaaagacttcttctgagccaggattaagctaggtttaattctggttcagatgctagagagaagttcattgagtgtgtgaggatctcccttctgctaggacaggctgcagtggggtgtggcggaggtggcagtagagttgtcctcttgcaggtagagaagtgggccgtctacatagtccactttaaataaggtcaaagaggctcctcttttcaaaaagacacttcaggggctgggaatggtggctcatgcctgtaattccaacactttgggaagccaaggcaggtggatcacttgagcccaggagtttgaggccagcctgggcaacatggcgaaaccccatctctacaaaaaaatacaagaattagcctggtgtggtggtgtgcacctgtagttccagctatttgggaggctgaggtgagaggatcacctgagcccagggaggttgaggctgcactgagcgatgatgactgcactccagcctgggctagatagagggagactctgtctgtctgtctgtctgtctgtctctctctctctctctctgtttctctctctctctacacacacacacacacacacacacacacacacacacacacacctgccatatgctgtttaaagctgaagtttttccaaactgggccacagttcttcattccaaatttaaagggaaggtttctaatgcacttaagttcacattatggttaaaatgctgattagaaagagtgggagatatgcctgtgtgcctgcaggtggggagaggctgggcagagggacagaaagggagatggccactgagagcatacgtggggctgtgacctttgggcggagtccgatccaaccgtccacctcacctgtgctgggtctcgcctctgactctgaaggagatggtcttacacagtgttggaactggcgctctatttctgtgcttttgatgaatgaagctccaggggatgctaactgctgcttggggttttgaaaggaagacctgccaatcaccaggttttaccatgcagaagtgcttgagctaggccagtgaggaacataaataagcttagcttcttaaacatgttaatcttgatttactccttataaatgaattctatttcaaatgaagtattacttgtctacatggttcttaggttcatctgttctcttcctacaggaaagcgtggtattttccaaagccacaggataagtcttttatagaagtgacaggagactctgtctctgctatatcactccctgtcaccttggaataaaacccatctcttagcaaggcttcaaggccctccatgattagctaagaccttcctgagggcttcatctctcaccccacccccactgtgcccaactgttactcatatctgtcttttacccaatgattctaccccccaggaaggccctttcctccacctttttacctaactcaaggacaagaactgtgtcttttatctctcttatctcagtgtcttggtactcagtactcagatgaattggaggctgggtaggtgagtgggtggatgagtaaatgtttggaaggggggataggtagatgggtgagtggaaggatggatagaggagtgggtggaagaacgggtcggtggatgtgtggatagtttttggatagacagatgaatagatgaatggaagagaggatgtgtggaaggatggatgggtagatgactgagtggaaagatggatgaatggatgtgtgggtgagtggatggaagagtggctggtggatgaatgggtgcatggatgggtgggtggatggatggatggatgggtgggtgggtggatggatacgtggatgggtgggcaagtggatgggtggatgagtggatgggtgggtggatggatggatggatggatggatggatggatggatggatgggtgagtgggtgggtgggtggatggatggatgggtgggtgggtggattgataggtacatggatggatgggtgggtgggtgaattggtgactgagtgggtggatggatgggtgggtgcgtgggtccatagttacatggatggatgggtgggtggatggatggatggatgagtgggtggatggatgggtggatggatggatgggtgggtgggtggatggatggatgagatggatggatggatggatggatggatggatggatggatggatggatggatggatggatggatggatggatggatggatggatggatgcatggatggatggatgggtgggtgggtggattgatggatgagtgggtgagtggatggatgcatggatagttgggtgggtagatggatggatgaatgagtcattggattaacacagtgttctttatcctgctgggatgtctctagatccaatcattttcaccattggtgtcttccaaagagaagaaagacaatctctgagtgggtggggtggtggaagagttttggatacaaatctggagtgaggaatttcagagtgattcataaataatttattgtctagtgatagtgtgatggaaagtggtatggtaagttaatgtcaggaaaaaagtggcttacttttgaagcttaaaactaattttgagagaaagcccgtgatatttatcttggtcaatgacaagcgccatcatcagaaatcaatgttgggaaagttgtcccagtttggggcctacgtctcaggaaggacttcaaagggaatttagtctgttgcttttttgtggagcaggtgggctgtgtctgagagaatcctggaaccccccaccccctctgttatgttggtatctgtctctttccctctgatctgagcagcttttctctccttgtgcttatacaagtggacatcggctaaaacacacaagctaacatattagaatccattctgttaatattaataatccagattaatttcaaagcagtgaaaaacagttcgacactttggaaccggtgcctaagtggtgcagattgcaaaccccagctgggcagaggacagcgcgggaggggagtggaaggatgtctatctgggaaggccttgaacttgctctctccttacctaggtcatgggcattgtgaaaatgtttaaaaagtaagttgaggctgggcacggtggctcacgcctgtaatcccagcactttgggaggccgaggtgggcagatcacgaggtcaggagatagagaccatcctggccaacatgatgaaaccccgtctctactaaaaatacaaaaattagctgggcgtggtggggggtgcctgtaatcccagctacttgggaggctgaggcaggagcgtggcttgaacctgggaggtggaggttgcaatgagccaagatcaagccactgcactccagcctgggcgacagagcaagactctgtctcaaaaaaaaaaaaaaaaaaaaagtaagttgaagctggggggtggggatctgtttctcagctctccctggttctgtccctctgcattcgcatgttgtctgtgactacgggattccagagttcggcttattaaagaaagcattttcgaacactgtcaaagcctcagttctccccactggactaaaactcacttgtcaatgggtgctgaaggaaaagggtttgtgttaagcccattcagctgcctttagggagagtgccctggcctaccgcgaaggagggaacacaagcgttagggagtggagaggactggctctgactctatctggtgacagaggagctgtccccgcaacgcgaggaagcactcagggtgccgggggggtggttcctaaccatgcccagtctctcttcctctctggtcccctgggaccttcagggaagggcaaaattagccctggaaatgggccgcaggtcctaaaatagcctggtgtccttggaggccggagaggagctgagaggctctcacttcctcaggacagtcctgaccgagcctctgtttgggggatggtccctttgagtttgaggtggggacctgcaggacgggggtcctctctctgagtagggaaggcactgggctttggcctcctggggcagaggagctgcagatgggaaagtgaggccccggagcatcaaccatgagcagtgcattctgctttcgggggatggtgtttgactctaaattctgcagtgtgaactcaaatgttgggggaggactacccaggcaaaagtaactgtggcctccccacgggctttcctcacagggacgcccaccagccctccccacgatgatccccgcagccagcagcaccccgccgggagatgccctcttccccagcgtggccccacaggacttctggaggtcccaggtcacgggctactcggggtccgtgacacgacacctcagtcaccgggccaacaacttcaaacgacaccccaagaggaggaagtgcattcgtccctccccacccccgccccccaacaccccgtgcccgcttgagctggtggacttcggggacctgcacccccagaggtccttccgggagctgcttttcaacggctgcattctctttggcatcgagttcagctacgccatggagacggcgtacgtgaccccggtgctcctgcagatgggcctgcccgaccagctctacagcctggtgtggttcatcagccccatcctcggtgagccccggctcctccccgatggtggagggcctctggaagcctccagaagcctcatcgcagtagcctgagggtcctgaggggagaagggaggatcaagagttaagttcccttcatcagtctgggactgtggggaacacaggtaccaccggtcatatcccagattttaagttccttatcgaaagcagacaatagaacagggatttagcagctccccgagggctgacaccgtctgatgccaggctctccttgttggagggtccaactcataacgcttggtgtcatgtgagcctggaaggtcctgaaatttcttggattcccaaggaaagtcgtggctgcttagggccttagggtccaaagtggaggatttaaggagatgctgagcaatccccagagtctgctgagctttggtttccgagttcagggttttgtcactgactgtttcatcatcttattcttttgatgcactgggggtgtttgagagcaggcacttcaggaatgtggaggctgattcgatgtccccatgtgccatggggaccctggcaatgaccgctggcctgctctgtttcaggattcctactgcagcctctgttgggtgcttggagtgaccggtgtacctcaaggtttggaaggagacgccctttcattcttgtcctggctataggtctgttgttttggcatggaaataaaatggagaggaaaaaaaaaaggccccaactgcttccttttaggaaaattttaaaaaatgttgaccaaagcagttacccagatagctctgggcccgcactggtgtgaggcagggagtgccccgcaacctggcctcagttaactgtgagaatagatcgctttgatcatttttaaaaattgagttgataaagttcatctcatttcttctctgcttaatgaaataaaaacccccatccaagtgcaaaatatatggtgagtttgcaggcggcttttccaccgggctgtgcttgaggtttaagttttaaaaattcttgagtcctaaagattctagacataagtcgtgagctgccggggacagagctggtctgcattttcttggggtgactttgtttctctgtgtccaggggcactgctgggcctctcgctcttgctgaatggccgggacattggcatcgccctggctgacgtgaccgggaaccacaagtggggcctgctgctgaccgtgtgcggtgtggtgctgatggactttagcgccgactcggcggacaaccccagccacgcctacatgatggacgtgtgcagccccgcagaccaggaccgaggcctgaacatccacgccctcctggcaggtgagtctccgcagcagggccgaagctgaatctgccgggctgcaggcttcagacgtgtggctttcgaggcccttcctcactccctgatttaacaaagaagctgggagaattccaatacatggagaaacactgaagtgattgaaaatacatatctcacacaacacatatcaaccacaacctatgctgttgacacataaacaacaattataggtctataaattcaaatgtttatattcgtggattctcattgtttgaggtagttatgttctgcagagtcaccacaaacactgaattagcaaacaccgcatctcgctcctaggaaaaatacagggttaggttcctgtgagcctccagtcacaacgttttcatcaacggatcaacacataaccttgttgtatgtgtttctgtttaaaaccccttatttcatctgtgcctttggctgattaacattgaattgacggccgacagcgctgcaactcaagcctgaacgaagcgtcactgtcgcatgcattttctgcacaaggcacatccggctttcttgcacctggaaacgtcagacagcttgggggccatttaaacagtgaaacaccaacaaaaaacacaaaaatgtaaaaaaggtggcactaaatagaccacacaaaaaactcttgtttcggccaggcacagtggctcatgcctgtaatcccagcactttgggagggtgaggtgggtggatcacctgaggtcgggagttcgagaccagcctgaccaacatggagaaacgacatctctactaaaaatacaaaaaattagctgggcgtggtggcacatgcctgtaatcccagctacttgggaggctgaggcaggagaatcacttgaatccgggaggcggaggttgcagtgaactgagatcgcactattgcactccagcctgggcaacaagagcgaacctccatctcaaaaacaaacaaacaaacaaacaccaactcttgtttccagtatgagcgtggagacgagaaggcagagctcagccctgcggggcctcagctggatcacgcacccttggaagcacaggcgttgtgctgttctgtgcaaatccttgaatgattttgagagcaccgtgaggattggttctgagttttcctcactaaatgaggaggtgaattcacaaatacagaatctacagataatgaggattgagtgtgtgtgcatggacacacacacgactatatccataccatgcatatatgtatgtatatatacatacctgtggcatgcttaatggtgaaacaggagaaatgttcccatcaaagtcaggaatgaggcaagaatgcacccatcccacagagccactgccattagggacacacaaacaaaaggtgtgaggtcagccccactggtctctggggctggacgtatggaaacttcaagagaattagctgcaaagcagtgcaggagttcagcatgatgcttagttatcaatgtactgtataaaaatcaatactggttgggtgcagtggctcaggcctactctcaacacttcgggaggctaagccaggaggattgcttgagttcaggagtttgaaaccagcttgggtgaacagtgagaccccatctctaaaaacataagattaaataaataaataactctagcttgtctatataaaatacttgccttgttacagaataaaatggaagaaaaaaattccatttaaaatagcaactggggctgggcgtggtggctcatgcctgtaaccccagcactttgagaggctgaagtgggtgaatcacttgaggtcaggcgttcaagaccagcctggccaacatgacaaaatcccatctctactaaaaatacaaaaaattagcctggcatgtggtgcgcacctgtagtcccagctactcgggaggctgaggcaggagaattgcttgaacccgggaggtggaggttgcagtgagccgagatcgtgccactgcactccagcctgagcaacagagtgagacttcatctcaaaataaataaattaaaataaaataaaatagcaattggctgggccgaaggtagtgagttatctcgattgattgcccacagtcagttacagatggaactccttcctctactctttccccaaccctcactgctgcacttgactagtcttgaaaaagaaacagatattggaacaatgtttaaaaatcaagggaaaagcctaatgagacattaggccttcattacaggacccgaatgaagaggctgggtcacccagtggttaggggctcgggctctgggagctgaaagtccacgtggcgcaaatggctctacttccacaagcctcggtcgcatctcctggaaaatgttgccgcttctcttcctctttccacacgtgcgctgctgtgggcgagggaacttctaaaggggccatgccgggcgagtgctgggcttggcagagaggaagaaggacgtcggtttttaccttacgcccgtctatgagaatgcaccactttgatcattcaagaaaattagctagtaaagttcatctgggccgggcgtggtggctcatgcatgtactcccagcactttgggagaccaaggcaggcggatcacctgaggtcaggagttcaagaccagcttggccaacatggtgaaaccccatctctactaaacatacaaaaattagccgggcgtggtggtgagcgcctgtaatcccagctactcgggaggctgaggcaggagaatcacttgagcccaggaggaggaggtggcagtgagctgagatggtgctgctgcactccagcctgggcaataagagtgaaactccgtctcaaagaaaaataataaataaaaaataaagttcttctgaaatctgaccttggataagggtcacgaacagcaatggtgtctttcaggaggggaggagggaaggcaattagaatcatgagtgtgggaagtcaagaataataaaatgcctgggagggcagtggggaggcaaaaagactcccaagtctagaagaacagaggcagagaagggacgggactggagcttttgaatggacacgccaagtgaaatgaaaaggcccgtctgggacaaacaaaggaagatctacagtgaaacctcgaaataatgagatccatggtcatacggtccttaggtacgtgtggaaggctgagttgggcgtgtctgaagcccaagcctgtccatagaagttcttatttgaaaggtaaacccctaatgtggccaagtcttccctaaaccaaaaatcccgtgctggtagcaggcaggttgctcctcaccagcagcggtaaaccgagagaaccctcctctcctctcaacactagaccgactcaaaatgtagctgaactcacaataaaacaaaataaaacaccggatccctgatggggtgggtgtcgtggacccgcagctggctggggtggtgcccctgcagcttccctggctcttgccatcgaagcacagagcctggctggaagaagctgcagtgtttggaggtaaatctgcccactgctgttggccgggtccccacagcatcgctcacagtttcctgccatgctctgtggccagggctgggctggccggtgccccgaggcgtggaatgagaacagagcagaaacagcagtgatccgatccctgcttttctgctgtaggctgatagctcagagatcggagagctgcctgccagggtgtggggaggcaggacccatctgtggtcaccacagggggcggctctcctcatggtgttctgtgcatggggacaaacacccgcatgcacacatgtggtcggctgtgtgtgagccatggggtcggccctgagctggaggggccctcggagggaggatgtgcccggtgtcaacattcgctccaggggcctgaaaggttacggggaaagtggaacaggcaggaagtggaaggggatgtaggcaggtggtcactgtgctgctgccgggggtcacaccaggaagggccctgcaggtggctgtgcaggacaggagggggacctcctcaaggggcccgccctgggaatcctgtcccattttgttggggtttaggtggaacaggttctgtgcccacgtccctggaatggccttggctaccttcatgtccttctaagaacggggccaccgcgtttggggcttctcctcccgcagaagggaactcaaaccctgtctctttccccaggtctcggaggaggctttggatacgtggtcggcggaatccactgggataaaacgggcttcgggagggccctggggggacagctccgagtcatttacctcttcactgcggtcaccctgagcgtcaccaccgtcctgaccctggtcagcatccctgagaggccgctgcggccgccgagtgagaagcgggcagccatgaagagccccagcctcccgctgcccccgtccccacccgtcctgccagaggaaggccctggcgacagcctcccgtcgcacacggccaccaacttctccagccccatctcgccgcccagccccctcacgcccaagtacggcagcttcatcagcagggacagctccctgacgggcatcagcgagttcgcctcatcctttggcacggccaacatagacagcgtcctcattgactgcttcacgggcggccacgacagctacctggccatccctggcagcgtccccaggccgcccatcagcgtcagcttcccccgggcccccgacggcttctaccgccaggaccgtggacttctggagggcagagagggtgccctgacctccggctgtgacggggacattctgagggtgggctccttggacacctctaagccgaggtcatcagggattctgaagagacctcagaccttggccatcccggacgcagccggaggagggggtcccgaaaccagcaggagaaggaatgtgaccttcagtcagcaggtaacagcaaatgtcgggggagctgaggctcagagggtggcattcgggggtcccctggtcagttacatgacaaagagggagagtccctccaggaagaaattcccggctgttatgggggtgttatcaagtgctttgacctaaagagaaaagccttagaggccaggtgcggtggctcaagtttgtagtcccagcactttaggaggctaaggcaggaggatcgcttgaactcaggagtttgaaaccagcctgggcaacgtggcgaaaccccgtctctactttttagtattttagtatttttaaaaaacacttttaaaaaatatttttaaaaaacacttttaaaaaatatttttaaaaaacacttttaaaaaatatttttaaaaaacacttttaaaaaatatttttaaaaaacacttttaaaaaatatttttaaaaaacacttttaaaaaatatttttaaaaaacacttttaaaaaatatttttaaaaaacacttttaaaaatatttttaaaaaaaaaatatttttaaaaaatactttttagtattttttatacaaaaagtagctgggcttgatggcacacatgtgtggtcccaaccactctggaggctgaagaaggaggatggcttgagcccaggagggtgaagctgtagtgacccatgattgcaccactgcactccagcccaggtgacagagcaagaccttgtctcagaaaaagaaaagacaagcctcagaaacgtgacgtcttcccttgcatgttagtgaacaagttctgggcctgagtccacctatgagtgagtgagttcaggacatctgttaggtatcaggtggcttaaaatcctggctgggagcgacagtgacaactcttttttttttttttgagacggagtctcactctgtcgcccaggctggagtgcagtggcgccatcttggctcactgcaagctctgcctcccgggttcacgccattcttctgcctcagcctcccaagtagctggggctacaggcgcccgccaccactcctggctaattttttgtatttttagtagagacggggtttcactgtgttagccaggatggtttcgatctcctgacctcgtgatccgcctgcctctgcctcccaaagtgctgcgattacaggcgtgagccactgcgcccggccgacaactcttttaaacacttacgtttgcccaaatgtaattcaggccgggcctgtcctgctagtgagtttcttagaggcatagtgtgcaccccacttgtttctggtatttttcccaagacgtccgggctccagcccgttttggcagtgggaatcctgtgccaatacatccaagtcttcatggacggtggaaacaaaacgtgaaacctgcagatgtgtctgggatcgtccctcctggtgcctgacgtcggttaacttccggaggctataaaaacaggaatctccagggcagcgccatcttccacgaaggccaagaaccttctggaaagctgtttaagttggtatttaagttggtatgtttaagttgtatacgtcagatgggctgcaaggccaccaactgatctgtggggtttcacgggctgattttttttttttttttttgagacagagtcttgctctgttgcccaggctggagtgcagtgatgcgatcttggctcactgcaacctctgcctcccgggttcaagtgattctcctgcttcagcctcctgagtagctgggactacgggcacccaccaccacgcccggctaattttgtatttttagtagagacggggtttcaccatgttggccaggctggtctcgaactcctggcctcaagtgatccacccaccttggcctcccaaagtgctgggattacaggcgtgagcaaccacacccggccagaatccatggtctttaagtaaagaaaggttattctcttatttaaagtagacataagagttgctggcctgcacctgtgggcgttgcaggaggagagtatatttcagtaagaacgtggtgtttccggtcctacaaagccgagtctcgtttgcctcatccctcgagggagtcagctggaaaagctgggcagcctggagatctagccgaggagacacttcactcggccgcagacgcacgtgggccgtgtctcctgaatgaagtagaccctgctctgcccggccccatcccactgggtttaaatgggacctggtcctcagttcattctcccgtcaggggttcaggtgtcccatctctgcctagatgacttccctgatttagtcggaggttaactagagatggggcttgcactgttcattttcttttcctttccttttttttttttcttttatttcttttcttttttgattattttgtcttgttttgttttttacttacttttttaaaaaatgtagagacaggcttttaccatgctgcccaggctggtcttgagctcctgggctcaagtgatccccctgccttggcctcccaaagtgctggaattagaggtgtgagccaccatgcccggccttgtttggttttgttttgatacagggtctcactttgttgcccaggctggagtgcggtggtgcattcacggctcactgcagcctcaatctgccaggcccaagtgatcctcccatctcagcctcctgagtagcagggactacaggtgtgcaccaccacacccagctaattttttattttttgtagaaacggggcctcactatgtggcccaagctggtcttgaactcctgggctcaagccatcctcccacctgtgcctttcaaggtgctgggattccaggcgtgagccaccgcgcccagccctgtttcctccttggagtgagcaggatggggcctttcgtttgcttttctctggtgtgtgtggccggggtgtcttcacgcctgcgtaccgtctcagcgtgaggaaggacactgcccaggcatgcgcaggcctcacagggacatctgttgaggttcctggtggcaccaaggacacagcgagctcccgtctggaaagggtttgaggaactggaaatcactggagagccaggaaagtccatccttatcaaggaaagaggttttctaatcgctcaggttgagggcaccgtcagcctcattgtggatgatgccagggtaattaatctggtctttgtcaacactggatcgtcccagactgtttcacaaagttcaaactggctttagatccggttgtttaggtgtggttgaaaatctcttcttcatcccctttttctgtttcctttctccttagagtgtagtttatgcatcagttctttgaggaaagtaaaaatcatgagctaaatataaacgcatccaggctcaacggagacagaggcgtaactgcagcgctgttcctccgcaggcatgggggacgcgctctgccgatgtgggtgtcctgggagccggcactgcggcctctcagcttcctttcccaccaggagtatccagggcggaccgcaccacagacatcccagtggagccaggcagcaacgcctctttgctctcaaacatctaaattcaaaaacgactagttccccaaggtgggaggaccacttgaggccaggagtttgagatcagtctgggcaacatagtgagaccccatctctgtaacaattttttaaaaattagccaggtgtggtggtgctcgcctgtagtcccagctactcgggaggctgaggtgggaggatcacttgagcccaggaggtcgaggctgcagtgagccatgaccgcaccactgcactccagcccaggcgacagagcgaaactgtctctaaaacaacaaaaacaacaacaacaacgaaataacaagctcccctgaccagagtctgtaccccaaacccaagcagggctacttggaatgaaaccttctcgttccaggaggagtttgcaaaccgagtgaagatgtccatgcaatgttgttcttgagccccagaaagaaatctaagcccctcgcacccgtttccatcctgttgaccgtggggcgtgtcgtgtgctctctgagcccctgtcaagggctgaggtgctcatgtgggcagggccgccctgtcttctgtgtggtgggggttccacctgtccagagagaattttgaacacatgttcctggtggccaccttgaaataagtcgttcccagtcttcttttacaaaaaagaaaggacttcctaggcgtgtggatctgaactgacccatgttttttcatttcaaatgtattttgcattttgcaaagtcttatctcactccctgtggcacagatagtgtcctgtggccacactgtgggcacacctgaaatggaattctagccttagctgctccggggcctcggaaacaatgccctgaatttgttcctctgaggttggcgtcgacacggggctcatgccgtcagataagaagacagacccttgcagcctccgtgcggtgtttccgagagcgcattcccctgagcagagcagggtctgcgctgtgtgatgggggtgcggggctctgatgaggggtttgtgggctcttcccaggtggccaatatcctgctcaacggcgtgaagtatgagagcgagctgacgggctccagcgagcgcgcggagcagcctctgtccgtggggcgcctctgctccaccatctgcaacatgcccaaggcgctacgcaccctctgcgtcaaccacttcctgggtgagctcccggccaagcctccccgtgagtcctggtcctgctcagggctctcgccccactggcctcccaggatgcccctgagcctcccttcccagaacctttctgagttcaccagcccccaacaacagcaccaagggcaggcctggggtgtggtggctgccctggagggcttttctccagggtgcctgccctgcatagccccaaactaaaccaggtgtcaccattgagagccacatagctcactctgggcccgacacctgggtccccacagagccaaaattctcactaccagaagccctttggacaactccacagtgaaatgatggacccacaccttcccaccttcccaccttccaactttgtcttgctctgtcttcaagcacagaccccacacctgcctgcccgtgtctattgctgtttgtaaattcacacggctcggcctttgtatgagcattgaaaagcaccaacttgcgtttcattccatttagtctctttctgctgtcgagtggttgaacatttgagcatgattcagaatttgaggccaggcgcggtggctcacgcctgtaatctcagcactttgggaggccgaggctggtggatcacgaggtaagatgattgagaccatcctggccaacatggtgaaaccccatctctactaaaaatacaaaaattagctgggcatggtggtgcgtgcctgtaatcccagctacttgggaggctgaggcaggagaatcgcttgaactcgggaggcagaggttgcaatgagctgagactgcaccactgcattccagcgtgggtgacaaagcaagactccatctcaaaaaaaaaaaaaaaagaatttgagataatctggggctctcatacattgtgggacataaatcaacatgaccttctagaaggcaattttgtaatgggtgagaatcttaaaaatggtcctacctttttcccctatgaccttactcagtattccatgcaagcccataatcaaagactatattcagaatatgcatgcaaggtattgatcacagcatggtttcagacagccacagactgcgattgggggatagagatgtccaacagttggggaagggttaaatatattagggtgcacccacactgtgaaatattttgctgccatcaaaacaagtctatttaataattcttgatggcatagaacattgtagatgataattcattatggttcgagagggcctataaataccaccttcctctaccaaagaaggaattcccatggttcaaggaacggagcgctaagcacttccgccagcacatccatgtctgtgcttcccggtggatttctcccaattaaatggatcccctcccctgcaccacccaggtagctggagcacctccactgctacccttgcctcatgtttatagaaatatatggtggtttaaaataaaaaaattgtaaggaaactctgttagtctgttctcacgctgctaataaagacatacacgaaactgggtaatttataaagaaaaggaggtttaatggactcacagttccacatggctggggaggactcacaatcatggcggaaggcaaaggaggtgcaaaggcacatcttacatggtggcaggcaagagggcatgtgcaggggaactcccatttataaaaccatcagatctcatgggacttattcactatcatgagaacagcatgggaaagacccaaccccatgattcaattagctctcacggggtcccgcccacgacacacagggattatgggagctacaattagagatgagatttgggtggggacacagccaaaccatatcagaaacgaacacaattttaaattgcttgttactttttttttgaaatggagtctcgctctgtcgcccgggctggagggcagtggcgcgatctcagctcactgcaagctccacctcccgggttcacaccattctcctgcctcagcctcccgagtagctgggactacaggcacccaccaccatgcctggctaattttttgtattttcagtagagacggggtttcaccatgttagccaggatggtctcgatttcctgaccctgtgatccgcccgcctcagcctcccaaagtgctgggattacaggcgtgagccaccacgcccagctgctcattacttttataaccagtagacgcatgttggttagagaaagggcagagtgttggcctttgcccccgaggtcatgaacctctttctttcttccagggtggctctcattcgaggggatgttgctcttctacacagacttcatgggcgaggtggtgtttcagggggaccccaaggccccgcacacatcagaggcgtatcagaagtacaacagcggcgtgaccatgggctgctggggcatgtgtatctacgccttcagtgctgccttctactcaggtacccgctgccagccaggctggcacggcagtgagagctttggttgggtccatggagcatgcgaaatgaaggcaggttcatggccttacgattgcagacaccacatcccaatttgggggacgccactgtctttcccggctgcagggcgctgggcctgggggagctgggctgaagaaatggagcttaccagcctcaggcctcccagagctggtggcctacgggggcacgggtgcttgtcaggacctgactacaccggcaggccatagcgagggcgaagtggggggccctgggggaaccccaaggccacacccaggcagcgtgctgtccaccagcccccagctccttcccactttgattcaaggagcaactggtccccagggaggtgggggcaggggtgtgtggtcgtggagcgtaggggtgggcaggggccaggggcccagatgactttgaggttctctgtctggggtacccttggagcacagtgctgagttcacaccagggcgaagccgaggtgccatccccatggggcctggccggtagcgtgcaccgggcaaattttatcccagaggtccgcatacttttttcgcaaaaggccagagagttggtatttccggctttgccggcccagcggtctctgttgcagcccctcaccgaaagccacagacacgggaaaccgagtgggcgtgccaagcgccaatcaaaccgcactgtgttcgctgaaatacgagtttcatgtgattttcacgtgtcacaaaatattcatctttttttggttttttaaattaattttttttttaaatttacaaaactaggctgcaggctggacttcgccttcgatccataatctgccaactgctttattttagttgcccccatctttgtgggttcaagccccaaagtagagggtcactgaggggctgcggcaagaagaaatttgtcagatctcacttgtgagtccatggggtggcacctcgggtgttgggttcccccatagccatgtggccttggggcgtggggaactggccccattttatctgattctagggagccccgtcgctgacatccatgctgtcacatcatcttgggggtgtaaagatggtggctggctacgggatgggctgctgttgtacccacaattacacaagaacacagaggtttaactcgagaccctcagtccctgagcccctttggtgtcacagccccaagacccctccacctgcagaagccctgggggacctggcccgggccagtgtgaacaggacaccctggtcctgccatctatccagacagccctgtcctgggcacccaccagaattactggggtggtctctcagctcccctgggttccccaggaagtactttctggtctggggcaagtgacctgccaagccgggtcccaccactgctagcttcaggtcagccgccgggaggtggcactggaagctgaatccccggaggctctggccgtgtggcactgctcaccctctctgtggcccgcagctatcctggagaagctggaggagttcctcagcgtccgcaccctctacttcatcgcctatctcgccttcggcctggggaccgggcttgccaccctctccaggaacctctacgtggtcctgtcgctctgcataacctacgggattttattttccaccctgtgcaccttgccttactcgctgctctgcgattactatcagagtaagaaggtaagtgctctcccttgtcttgcttcgggtctgcttcttggagaaaccccacctgagaactgtcccccaggaccagctgcacaatctgcagagcccggtgcaaaatgtcaagacagcgaccacagagcatgaaaccaaggggggcccttctgagtctggggcgtgccccctgcctgtaatcccctcattgcttcattagcagaagcctccagcccacccaggctctgggtcaggctctgtccttcccagggatgtggggaatgggaggctgccccttcctactccattgtcaggccaccgggtctcctgttgatgcctgtcccagccattcagggtggggcttatggggaggcagtgaagctcggaaaactcagcaatccagatcgataacatgttaatgcagtatttttaaaaatcagaattcttgccaaaaatccatggagaacaaaaacatctttctttctttctttttttttttttttgagatggagtcttgctctgatgcctgtgctggagtgtagtggtgcgatctcggctcactgcaacctccgcctcccgggttcaagtggtcctcctgcctcagcctcccgagtaactgggactacaggcacgcaccaccatgcccagctaattttttgtatttttagtagagacggggtttcaccatgttggtcaggctggtctcaatctcttgacctcatgatccgcccgcctcagcctcccaaagtgctgggattacaggcgtgagccaccgcacccagcccaaaattttaaataaagagaggatcagttcaccatgtactaggggttctgatagccagctcagctcctgatcctttttctgtgggaacttcagttctgtccttgaatcctgactagacgtttcttgccctctggtctcagatttctcttggcttttattccttgatccacctgccggttttatcacctccccttgttcctcatggcttcccatcaaccgtgggtattaggtgacagtgtaatttattagatgttggttttgcccaaatactgggcatggcttaataacaacgaaaccatttcattatttggacaggcctgagtaccttatcaagcagattaaaaggatatggtacccgtcctttagaaaaggacagctgaaatctcgttacggattatggatttagcataaagaaaaataatcaggcataaattaagagtaagagaggggtccgggcgtggtggctcacacctgtagtcccaggtacttaggaggctgaggtgggtggatcacgaggtcaggagattgagaccatcctggctaacacagtgaaaccccatctctactaaaaatacaaaagattagctgggcatggtggcgcgtgcctctagtcccagctactcgggaggctgaggcaggagaatcgcttgaatctgggaggcggaggttgcagtgagccgagatggcgagatggtgccaccgcactccagcctgggcgacagagcaagactccgtttcaaaaaaaaaaaaaaaaagagtaagagggacaatgaatagaaatttcacttcacagccgggtgcggtggctcacgcctgtaatctcagcactttgggaggctgaggcgggcggattacctgaggtcaggagttcaagaccagcctggccaacatggtgaaaccccatctctactaaaaatacaaaaattagccaggcgtggtggcggacgcctatagtcccagctacacgggaggctgaggcaggagaatggcgtgaatctgggaggcggagcttgcagtgagccaagatcgcaccactgcactccagcctgggcgacagagcgagactccgtctcaaaaaaaaagatagtaatactttgaaaaaaaaaaaaaaaggatcagtaacagtgctgagccacctcatattggagtctgaggcaaaaggaaaaatggcatttaaaaggccaaacgcagtagctcacgcccgtaatcccagcactttgggaggccgaggcagatggatcacttgaggtcaagagttcaagatcagcctggccaacatgacgaaaccatgtctactaaaatacaaaaattagccaggcatggtggcccgtgcccataattccagctacttgggaggctgaagcaggagaatggcttgaacctgggaggcggaggttgcactgagccaagattgcaccactgcactccagcctgggtgacagtggctatgtaaataaataaataggccgggtgcggtggctcacgcctgtaatcccagcactttgggaggccaaggagggtggatcacgaggtcaggagatcgagaccatcctggctaacacagtgaagccccttctctactaaaaatacaaaaaattagccgggcgtggtggcgggcgcctgtagtcccagctactctggaggctgaggcagaagaatggcgtgaacccgggaggcggagcttgcagtgagctgagatcgtgccactgcactccagcctgggcgacagagtgagactccgtctcaaataaatacatacatacataaataaagtgccttaaatttttgttgatattttgctcagcatagacttttaccggctgtattgaaatatgcaccatctaacagtgtgtgatgtgcaccgttcggcggtttcagcacacgcagagttgtacaaccatcaccaccatcaatttcagaacagttttgtcaccccaggaagaaacccgtcagccatcacccctctgaccctcccactctcccaggcctaggtgaccgctaaccttcttcctgtccccatggacttgcctatttgggacgtctcctgtgatggagtcaggcagtctgcggcctctcgtgtctggcatctgcagtgcagctgtgggcttcgagctccatctgtgctgtttcctgggtcagcgcctccttcccttttatggtcacataatgttcccaccataattttcctttgcagtgactttgaaatcttaaaatgctgcattgaaatattacctggacagtctgggcaacatagtcagaccccatctctaaaaaaataaaattaaaaattagccaggtgtggtggcatgcaccggtagttccagctactcgggaggctgaggtgggaggatcacttgagcccaggaggctgaggctgcagtgggctgagattgtgccactgcactccagcctgggcaacagagcaagaccctgtctcaaaaaaaaaaaaaagaaaagagaaaagaaagaaagaaaagaaatgtgacctggattactgagtttctctctctcccttttaatctcatgcctcagttgcctcccccaggcctgggcctgatttgttttagggagtttggagtctgacaagttcagctgggctggccctgagcacagcccttctgatggggggaagccgcaggggaggcccaggctcccaggtcacagcaatgcccactcacgcagcaccttgcaggccggctggtgctgggggagcccagtgagggaaagccatgccaccgctccccaccgtcactctgcacagaccacactctcagccactgtcccccagcatggcatgcaggggagggagagtgagtgacgtgcccaagctggaggccacgaggaccttggagcctcggacagaggaccagcggctgtcatgtgcagaggactttgggggtgtagggcaggtcccatcctggatgaaggtgaaggaggggatggcaggagtggagcggtcgcctggctgggcagattggttttctttgggtgagaggatggggaagagctcaagtgctgagcggggaaagtgtctcccgccacctcggcccgtgggagctcagccctctgccccattagtcatggattcttttcattgtcgtcatctctccgaacacaaatattgttaaactcttggctgaactccctgtgcatgttggcgctgaaaaatgtgaggccgctgtgtgtgggccgctcgggcctcctgggctcgcaggacacaccgagctcggtcaccccgtgctggccgcggcgtgtctcgctgacacgtttcttcctctgggtcagtttgcagggtccagtgcggacggcacccggcggggcatgggcgtggacatctctctgctgagctgccagtacttcctggctcagattctggtctccctggtcctggggcccctgacctcggccgtgggcagtgccaacggggtgatgtacttctccagcctcgtgtccttcctgggctgcctgtactcctccctgtttgtcatttatgaaattcctcccagcgacgctgcagacgaggagcaccggcccctcctgctgaacgtctgacatcgcggagcctcgactccggacacgcgcctgcacctgggggtctggagcaggccgaccagtgaggaccaaagggccttgttggacagggggactggctgcctactggaatgtaaatatgtgataaaataataaatgacagcggcaaagcctatggtttctaggcattgctctctggtggctgagaggtccccatgggattgagttaccctcctgaggactcgggcaggggaggtttgtaagaatctttttttgaaagtaaaggtgtaattcaatggttctcaaccaggggcaattttgccaccccacccccacccccaggaagacatctggcaaagtctggagatagctttggttgtcacaactcggggatgctgtaaacctcccacggcacacaggaccgccccaacagcaaggagctagcaagacccagctgtcaattgtgctgaggtagagtgagcctggtctaactggaccatacattctgtacattgcatcccagggtagagtcacagtatacaggtcttttggatcagaaggcctcatattcattcacttgtccattcatccatttattctctcatccattcattcatctacccatccgcatatccacccatccacataaccatccatccactcatccaaatatcctcccatccaaatatccactcatctatatatccatccatctacatacccacccattcatccgtccacataaccatccgtccactcatccaaatatccacccatctgaatatctactcatctatatatccatccatccacatatccacccatccacccatctaaatatccacttctccatatatccatccatccatccatccatccatccatccatccatccatccacatccaaatatccacttctccatatatccatccatccacatatccacccatccgtccatccacataaccatccatccactcatccaaatatttacccatctgaatatccactcatccacaaaaccatccatccacacatccacccatctacccatccacataaccatccatctactcatccaaatatccacctatccgaatatccactcatccatatatccatccatccacatgtccacccatctacccatccaaatatccatttctccatccatccatccttccacccatcctcttatccactcatccaccctccagatatccagcgagtgcctgggtgtggcagacagtggttggcctgggaatccagctgtaagtgtccactctgccctgctggaactgatgtgagaggaagggagacacatggctcactgaggttccgtgcagcgcaagcgcagggaaggaggacagggcgacagcagcgtgtctgggtggcctcagtagtgaggtgccgtttgagcagtgtcctgatgaagccagggagtgatctctgaagtgagcacttgcttgacaggctcgagggagcataggcaccaagatgctcagattgtaaaatgccccaaaagttgaaatctcaaagagtttggagctgatgtggctggccagcgcccatcctgccttttgactccacaggcagggactaggggctggagggcgaggttcgggtcattcttccccctccatccgccaagggttcattccacagatggacaccatgtgcctgctgcgtgcaggcgtcgctgggcctgggtctgcccgggctgtgcccactgcctcccagtgcccctttgtggatctggcaaagctctcgtgagtgtggcagtccctcgccatctggcctctgaccatcttcgtcacctgacgctggaagctcaccaaggccccttctcagaggcctgggagggctcctccacgcatggtgattaatggccatgaggggtcacggccgggtccctgttgtcgccaagctgggcctggtctgggattgtgcagcccccagttccctcactgcatgggccctgtgttctggggacatataagacatccctgaccacaaatccacaacaaacaacaggggttctggggcctgttgccagccttggggagtctggcgttcatgacagtgtcttatcatcttgctgtgaccacttagggccagtcagaaaggctacctccccacctgggccacagcctccctcccaaccacggcctccccaccttggttatgattttcccacctgagccccggcctcccccatgggccatagccttcctcagtgtcactgcctgctgcctcctggagccccaccactcctctctgcgcccctgctggactcctggcctcctgtctaccctcacatccatcttccaccctgaagctggggggctgtaaacacgggcctgagcccatcccctcttctagtcttccatgacacctaccctggctccccagaccctaaggaatcaggtagaaattccttccaccaaacagagcccagcccatcttcccgagccagccacccgccacgttgccagccccctgtactacagccacagaacctttgtgggccacaatcggttcctgtgtttaggatcttcctgcaggccaagtccacctcttctctgcccatcaatatctgattcatccatgtagacctgtctgaaatgccacttcctccgtgcagtccaccctgcttggagccagtgattctttccctgtgctttcatgtgatgctgctttacccttcatggtcatgagctcagtgaagcgggtctcacggtccctgatacacatgtagctgaagcacagagaggtttagtggcttttcaaagtcacaccgctcctttgagcctctgtagactcaggccctgttagtcccatgcttttcctggaactgcagacttaccctccccacatttatgttgtttggaagagcttcagacttcctagaaaatgtggtgttgggtggctgtcctctggtctgggctgtctttgcccagaactggtcaaaatgaagaataaggggcttcccgcttactcttggcttgtcaaatcttaggccctcttcctagaactttctaacaaaacacagattgcttctacacgtgggaatcgtccctgtcagcctctcttttctgagaacctgccctgcctcccgaactgtgggagtactgccctctggccgggtccgaaaagctgcccttgacttccaggtctattcctagcagatggcagtgggagcagccaccagctccaaaccacgaggcctaggactcactgagagccacattcgtttgactttcacatctcagagaggatttctctctacttaaaaatcaagctgtgggccgggcgcagtggctcacgcctgtaatcccagcactttgggaggccgaggcgggtggatcacgaggccaggagattgagaccatcctggctaacacggtgaaaccctgtctctactaaaaatacaaaaaattagctgggcatggtggtgggcgcctgtagtcccagctacttgggaggctgaggcaggagaatcgcttgaacctgggcggcagaggttgcagtgggctgagattgcaccactgcactccagcctgggtgacagagcgagactctgtctcaaaaaaaaaaaaaaaaaaagaatcaagctgtgatgatgagggtagtcaccgctgcttgctgtttgtgaagtcctcactacacacgaggccacgtgtgaatgaatcttaatccattctccgaccttgctgggaaagaggtatcattcccccatttgacagatctggatcctgaggcaagcacacccagtacctggcccacgtcacaacagggtggagtttgagcccggggagtctgagtccagcctcatgccgctgagtgccttaggagcgctgtgagccggccaagcccctgagggcgggcagcttcctgcccgtctgtctcctgaacactgtgctgctgcagggaggccttctcgctccccagggctcgctccccagggagctcagcttggagggagcttctcatcctattcagaggcgaggggacagcgggagaaggcctcttgctttatcgatcagcgctctgtgagactcatgcttctcaggccactcaaaacaaaaaccacatcaccaagatctgaagccactcctgactttcctgtcagcaaacttggaaagtggctcccattccttgatgccactcagaaacgaaacacacctaacagccatcgagcactgcccacagcacttagcatggaaactgaacgtcatcaaaggaattgccctagaggtcatcgcctccctgggttttgtgtttcttcctccctaggctgttgggctaaccctggaccattccctggggaaccgggacagggtaaggtggcattccctggagaaccgggaaccgggacccggtaaggtggcattcctacactcaccaggctgggctacaggtttctgggggaacagggatgatttccctggaatatgcaagaactgacaattgcctggcccccccgcagtcgggaggtcctggccctccctgcacctgctcagagtgtgtctgcagaatccactcgggtgcgtggggcgtgacgtatcatcctcagcggggagcgggtggagggcatccgtagagggaaggagcaggtgtctggaactgggggtgggtacttttgtggcacacaaggacccccagcagctgctcagggggcttgtcggggagtgggggcgcggttagttatgggagtcatgattcttggaagtcatccgctgctgatgccatcctgggattctcttccacacaaggaacattgagttcctaccgggtacctcccaagccttgggggatgcagcggagaacagaagaaacctcctgttctctagacaaggcctttgccctcattctcacagccgtgcccgccctgcctgcccacagccatcagcctcacctgcccacactcagccccctcttcccagccatctccacaacccgctctgctgaggcctgtccagttgcctgatctctgacccgcctgtccggccgcctgcctcgaggaaacgtcggatctcttacacaatgctcgctgtcaaaccctccagccttccccaccatcgccgggggccttgacttgcccctacaccagagctgcaggtcttgtggcagccgcgggcccagggcaagcacctgggccttgtaacgactgccacctggtggccaggatggggatggactctgttcgacggctgcccagcagcagggtccaaggggattggggggtgggggggactgggtggtcacatgcccagaaaacagtgggataggcaagaaatggcctcaggaatcctctctgggacaactaaaaggtgctctaaaagcctgtttttaatttgctccaatggatactcaaaccctaggggttcatcagaagctgatcccccaagccccattccccacttctacgatggtgtcaaccagggttggagtcagagggactgcagggcccacacggcaggcacagtcaagagaatgtgaagggagggtctccaggtgcccagcagaggcgtccctgggaagccttccgaagtcaacccaaaaggtccttctatctggtccttcacacccactttccaatagcacatctggactggcagcaaggaaccttgccctgcagggcccgtccgtccgtccatccgtccgtccgtccatccatccatccatccatccatccatccagcagggtccatccacccatccatccatccctccaatatctgcagagcaagtgccttccacaaacttggttcattaagaaggggcccgggtgcctgtgcatacacagaactgggctgtgggagatacagggggacttctgcagcctgggtccctgaggtgtcaaaagggaacaatgaccactcttgacaaagacagccactagagaagccaccttgagttggagaagcagagaaccaggtcccagaacttgagttgccaaggattccagggcagctaggaacccagtggggattcaggtaaaggacctcagataccgagactgtcaaaggccgacaatgccgcctccgagaggaccgggtgaggcatctgcagctggagctcatcaggggctgagcaggaggctgttcctggccccctggggatccacgatggatgccagctccagccaggccccgccttctaacgggaggtccgggaaccttatgaaccagaaagggcttgctttatcctgcagcccgtatcagtccaaccggatggccaaatgtgcggctgcatcccttggctggctcatctggcagatcctccttaggaggaggtagggaggccaaggaccccgctgttcctcggtctccattgggcagcaggaagggccccaggggtccagtgcaggacagacttttccactggttttggggcctggcagcttcatccccagtatctgggtagctggttctgatttcaaagctctgagttcagatatgtacccaagccttctgggctggtcaggtgaggctgatggtggtcactgaagtctgtgctggtgcccagtcacactgccctgggtctcaccatgtggtcaggctggggctagtgagggctcttagctcagatgacggctccccacatctcagcttccacacagaagggctctggccctgaccccccccccccccgccccccgccaccactcatcagctgatcacatccacaattgtatagctcaccagtgctgatttttgagggcctggaagcttgcaatctcgtgtgtgtgtgggaggccaccgctgatctctccacggtgcatccttgcccttcagatgcgtgatcttgacttacccaggtgaggcttaagtgaggtctctccctccctagacttaccatggacaattatcaacaatgcagccacacacccagctgcacacctacactgtgctgaggccctgggacttacaccatgccctgcaaagtgccatcttcctagcccacctgcagtggaaccagcggggctgctgagccaccatgctcaagctgaggatgcgtttccaggaacaaaggggcagagggcacgtgggacgtcgttggggcagcaagaggcgagggcctggctttggggtgctgctggaggacagcaccatttccctccgccccgtccacccagcagatgtctggttagcattcccggccctcttcctcacatgggtgcgtggcagagtggtgacaatggccacagctgttcatgcctgagaagctgcccagctctgatgaggccttgttgtagcatgaacctactatctcctcaagacgcttggatccaaccatttaaccacactgaaatctacacttcacagacctgtacctgttaaaccctgcagcttcctaaggggcacagtcccggagacccaccaagacagcgcctggattccagcctctcccagccaccccagtgccatcctctcacccaagacctggactgagagccacctggggctcctgtggccagcctgcgggcccatccctgtgccctggtcagccacgctgctgagcaggacccctgctgttcgcctcaagggccgtcatcgtgtgcgccactcgggtctttgcatggcgaagctttctcaggtcctgagcgaggcagtgcctggtgcctgctgctccccaagtctttaccacgtggcggaccctgcctggtttgaggacagtttaccaacagtcagctttctgggctgctcttgccccatgtctgcaaacacctagaaactgatggccctatcccagatgacaaagggtggacacacatttccggggacaatcctgaggctccaggaaaatgccctcaacaggttctgaagccacagcgcaattccaacgcctgcccccctgtggccatgtccacaccctgcaggctgcctgcagcccctttggagggttagagccccttaggcctgggatgcatcctccacctggagtgcagctctagagctgggtggctgggggtggggtgtgggggcactggtaggccacggggaggcagatgggggccaggcaggaggccgctaggatggggtggttccgatgtgtctcctgagcaggcagggtgccacatgcccatacatgctggtaacgcccacggattagaggtgtggggtgaatggcaaggggtgggggaagatgctcttagtcccaatgccagtgcctgcttagggcccatcccgctgcttggggagcctccaaagaaagacagcaccctcaccagggaaagcctcttcccagacagaggatgtttctggaagccactctgggatgcaaacagggtcccgagcagcagggaacagccgactctccctctgtcccttccccacctggggtaacagccaggatccccgcccactctccaggaatgagacagtgcacgggagacacccaagggttgtagtgtagcttggttttatttatgtccacaaatatttcaaaaaaattacaaaatactcaaatggagagaacacagaagtcacgatttctgggtgtctactgtttacactgtgttatctcatggcaaactactcatatatacatttagcttcaagatatatagaaacgtagcaaatccgagtgtgcacgctgcctctgccgcagtggagtgaagctcaacctcgaggacaccgaacaagatacggacacacacagaggagccaaaccaaaccccgaacaaagggaggaaaatccgaaggaaaccgagtggttgggcttcaaagacaccatgaaggtcagggcctcctaaacaaactgtagtttatctggtgagggtttcgggtcgagggttttttagatggaagaatctcagcgcttcgccttgggatatggggagaaaagcaaagctaacaagaatgccttcggacggctttcaagcacagacctcagaggactcgactcttctttggaaaaatggatgccaaaggaggagataaagaaggtttaactgaatggtagatgttgtgttctaccaaaaagaaagaaaaaccagaagccgagaaggtgggggcctggatgcaggagtctgggagcccagcaggaagaggcctcgctcagagccacgggaacaagcctgccatgagggcctgtccccaccccagaaggaaacgaatgccttcaagccaatgtggcctgaagtcccacgacaaaaggttcatgtcagctttgcctccctgtgaacaaactaaagttaaggcagaaatggaatgagagaaaaatgaaagaaaaaaaactagaaacattttcaacagacaaaacaagcctatcccaactgaaaccaaacacggtttttaagagaaactggaaatgtcgctatttgacgccagaacctgaatttgagccagtagctgctggtttctagatcaaactatcagcatctcttcctgctccctctgcggcctgggtcctggatggactttgtgtccgccgacccagtgtggtctctgtcctacaattcttgggatgggaccagcacaatggcagaagagacctccagtgtctgagagaaaaggatcggaagaggccacgtcctggcaggaagcagggccgacagagggcagacaccccagaacacccgccctcagcctgggagaaagtgcgttacggctgcagcctggaaacgagggcaggctctctccaggacggttccgctcagaagggcctggcctcctgagaagcagcccccacacagcatgctttctgaatgcactgtgggtgggactccagttcccacttccaggatgaagagtgggactcaaatggtttaccagtgcaatgtggggtcaccatgcagacctgcccctagggtaaaatacaggctgcccccaacacctgtcttaactccaggatctcccttgctcaaaagtggcctcaatctgtggcaagaaagatggggccgtcctcaccacaagatccaagtgacaatgcgcatgagaaggcagccttctaacacatccctttggcaggcatatgtcctgggtcacttgtgtgctgagttatttgtatggaatcattttcttagatgatgaaattttcggagtattaaaaaagacattcatccagaacaatcaagtgtgtgtacacagaaatctagaaggaaatctacaatggacacaggcccatgcgctttccatcccgtggaaacagaacagtgacactggag

SEQ ID NO: 1181 - DNA, 146545 bp, Homo sapiens
gtttaagaagctttttggcctagacaatggggttttctagataaagaaccatgtcacctgcaagcgaagattatttgacgtcctctcttcctatttgaataccctttatttctttctcttgcttgattgccctggccagaacttctaatactatgttcaataggagtggtgagagagggcatccttgtcttgtgctggctttcaaggagaatgcttccagcttttccccattcaatatgatattggctgtatgtttgtcatagatggctcttattattttgaggtatgttccttcaacacctagtttattgagagttcttaacatgaagagatgttgaattttatcaaagaccttttctgcatctattgagataatcatgtggtttttgtctttagttctgtttatatgatgaatcacctttgttgatttgcatatgttgaaccaaccttgcatcccatggatgaagccagcttgattgtggtagatacactttttgatgtgctgctggattccgtttgcaagtattttgttgaagatttttgcatccagaattcctatggttttctacataaaagataatatcatctgtgaacagagataattttacatcttactttccaacttagatgccctttatttctttttgttatttaattgctctggctaaaactttcagcactatgttgaataaatgtagtaaaagcaggcatccttgccatgttcccaaccttagagaaaaggatttcaatatttcaccattgagtatgatgattgctatgggcttttcatatatggcttttattatgttgaggtagtttccgttttctctagtgtgttgaatgtctttatcgtgaaagtgtgttgaatgttgtcaaatattttcttctgcatcaattaagatgttcatgtggtcttttttccttcattctgttaatgtggtgtggtttttttccatcagttttcatatgttgaactatctttgcattccaggaataacttccacttggttatggtttctaatcattttaatattaaatgctgataaattttgttcgctagtatttagttgaagatttttgcctcaatgttcataaaggccgttggtctttagttttctttgcttgtagtgtttttgtctggatttggtagcagggtgaggttggtctcatagaatgagttagaaagtattctctccttcaaacttttttgaaaagttttggaagaattaatgttagttctttaaatgtttgtttggtaaaattcaccagtgatgccatcaggtccagggtttttctttatttaaaaatttttgattactgatttaatctccttactatttataggttgattcacattttctatttcctcgtaagttggtcctgataagttttgtttttctaggaatttgttcatttcatctagaatatccaatttgttgttgtgcaactgttcatagtactctcttataatcttttttatttctgtggaattaggattaatagtaatgtctccaccttcatttctgattttagcaatctgagtctgctctctgtttttccttgtccatctagctaaagcattatttttgttgatattctcaaagaatcaacttttgctgtcattgattttctctattgtgtttccattctgtatttcatttattgctgctcttatttttattattttcttttcttctaactatgggtttagtttctttccttttcttatttcttaatttgaaaagttagattgttaatttaaaatgttttcatgtaagaatttatagctataaattttccccttatcactgctttcacagcattgcaaacatttttatatattctgtttttgttttcatttttctctaagtattttctaatttttgttaaaaaattttagcttgtctatttgttgtttaagagtatgttgcttaatttctacaaatttatacattttccaacctttcctctgttgttgatttctaacttcatcttgttttcattggagaagatacttcatatgatgtcaatcattttaaatctgtggagacttaatttgtggtataacatatgttctgtcctgaaagatgtctcatgtgcacttaagaagaatatgtatgctgttattagatatatgttagatatagttggtttattacattgtttaagttctctattttcttacataacttttgtctggtcattctatttattattgagagtagggtattgaagtctccaactattattgtagaatagtctatttctccattcaattctatccaaagtttttgtttcatatatattgatgatctgctattaggtgggtaacagtttaaaattgttatatcatcttgctgtattgagccttttattaatatgaaatgtcttcatcttttttaacctttttaaaattaaaagtctatttgttctcatattagtatagccattcctgctctcttttggttattgtttacctatcactcactttcagtctatttgtgtctttgcatcttatgtgagttttttgtagacaacacggagttggttcattttttttaatccattctgccaatctctgtcttttgattggggagtttaatctatttaaatttaaagtaattactgataaggaaagacttatttctgtcatcttcttacttgttttatattgttttctatgttgctttttttgtccctccttttctgaattactgtcttcttttgtgtttaatttttttagtaattaaatatttatatttctttctcatttctttttgtgtatactgtatagcttttttggtgtggttactatggggattacatttaaaaatcttagaattataacagtttaatttgaatttataccagtttaacttcaataacatacacaactctgctcttttacatctccatccccaactctttggttgttgaccacaaaattacatccttattaggcattgtgtacactgtgtgcccaaaacataaactgataatttttttttaagacaaggtctggctctatcacccaggctgaagtgcagtggcacaatctcagttcactgaaacctctgcctcctggactcaagccatgctcccacctcagccttctgagtagctgagaccacaggtgtgcactgacatgcccagctaatttctgtatttttttgtagagacggggttttgccatgtttcccaggctggtctcaaactcatgagctcaagtgatctgcccgcctcagcctcccaaagtgctgggattacaggtgttagccaccccatctagccaataattattttgaatacattaatcttttaaatttcatataaaacaaaatgtggagttacaaacgaaagtgtcaatataatttttgtataatattagtctcttaaaaaatgtagaaagttaaaaatagagttataaaccattgttataataatgctagcttttatgattgcccatatatttacctttattgagatctttatttcttcatacagcttcaatttactgtccagtgtctttttatttcaccatgcaagactcctgtgaacatttctttcagggaaggtctagtgttaatgaacttgctcagcttttgtttatataggaatgtcttaatttctccttcacttttgaaggatgattttgccagatgtagaattatcagttcacagattgatttttttcgatctctcagcattttgaatgtactggcccactgccttcttgcctccaaagtttctggtgagaattctcctgttactctcattgagaatccctgatatgtgatgagtcacttctctcttgctgctcttaaaatgttctctttgtctttgtctttcaaaagacaaagtatggatctcttttagctcatcttacttggagtttgttgagcttggatgtttatattcatattattaatcaaatacagggagttttcagctactgtttcttcgaatattctctcttcgtcttcctctcattcttctccttcttggacttccacaatgtgcatgttggtctgatgaatggtgtcccacaagtccattaggatctctctactttttctcaatcttctactcttctgttcctcagactcaataatttccattgtcctgtctttaagtgtactgattcttctacctacttgaacctgcctttgaatccctctagtatatttttcattccagatgttgtattttcagcttcagaaatgtttcttttcaagtgttctatttctttgttgatatttccattttgtttgcacatgatttttttgacttcctccacatctttccttagcatatttaagagagttgttttaaagtctttgtctagtagatctaccatcaggtcttttctaggaacaactcctgttgatttattttcttcctttgaataggccatgcttttctgtttctttatatgccttgtgactttttgttggaagctggacatttgaatctaaaaatattgtaactataaatcagttatttccccttccatagggtttgctgttgttgtttttaatacttacatgctgcctctgtgccagggatcagcataaagtgtaaacttgatatctctggtcttttctgagcttgtgtcttttcctggccatgtgcagtacctttctaattttccctatatatagagttgctattaaatatcttagtctttaatgtctggctcccaaagggagaaaaatttaaaaaatggaagggggaacagtagtgctggctctttaaatcctctggaaatcacttcaattgatgagggaggggattgcaacaacgaggggaggtgcaaaaacaatggctgcccatttatgtgtttgcatctttgtggttagaagcagcaaccagcattctgagaacagctacctgaaatttgaagaacaggatgattttgcccaccctggcccccacacactgcatgcaagctgctcctggaacaagtgctcagctgcctgccatggaactgacagtgggggatgggtagttgctactctactaatggctgaaattgaccaaaattaacctcaatttatgtctaagccttcccttggaagttgtaagccttcagtaggctccagagtttcaaaatagttacataagacataatctgccaatgaatttgttgtctaagtaggaagacagatttctggtgctccctactctgctatcctcccagaatcctctaggacaaattatttttacatagataattgtttttggaagcttcatctgagttacaataaaaaagagaaacaaaaccttgcatttttataatcttcaaagtagtttatatcttattttattttctcctctcctttctttcttcctatattctctcactcctcccttctgttcttccttcaaaactaatttagtgcttttccagtttgggggcattttacatttggtgaattaaccatttaattcctccaattctttcttcttgtcaacctttgaccattttcctgttaacccttgcattggaagaaactggatgatgagattaattgctgactgaggttattatcactggattcatgtttcccatgttctctccagcctttctcccctttgaaggaggggagacaacttagataactgaaagtggagtatatttttgtgacctctagggaagaggagaaaggaagggacatggaagagagaagatatgattaagccaatgtaaacattgttaaaaaatttatttgcaattttttttgttcatttgttaagtaacatcattccttaaatataaaagcaatcttacaggattatgcaatagtgtctcacacagaaatgactccaaagctctcctggaaaggttgccccttctggatttcatgacctttcttaagggtaagaagacactgccaaagaggcctctgaccacaggatcatttgatcattactaactgtgcaggaatatttacaacagtaagactgtgaagttgtggcgtctagaggggaaggggcagaagtgtgcagaggtgtggggaatggtgacaatggaggcactgcccatcttcccatgactctctgaaacaggcatgatgcagattggtttaggggcatgaaggtgggtctgagcaggaggacatgaggagaggagggatggcagaattttatctggagcctttcacatggaaggaagttttgtgtggtagctctggtgtattaaaataaaacatcaattgtatgagtgtaatagacattctagttcttcagcagctggggatctgtcaccttatttcctaatgaattcatgtgtttttccgtaagttgttttcacctgctaccattacagactggtccagacctgcttatccttttgtttcccacagcctatttcagtgcaaggccttatttccatgagactctgggagaacagcatgcattctgggcagggtgggacacagtgaagggatggaaggtggtctggctgggaagtcaagagatggattccaggtttgaggatagattgcagctggatgcattgatggcataaggccagaaagtagaaggtgctcactgtgtttgggtcacaggggatgccttctgaaggagccctctgcacaggactgtgttaacaaatcatctgcccttgatgctcaagtttgttcctccaacctagaaacttttaaacactggtgtagtttctccatgttgggaaggcttaggggttgggaacttggcacaggacccagttactcatcctcttttatgcctcttgggattctacagaaaagcattttctgctctcttctcttggctaagggctcaggagaatttcctcaaggtgtcttgaaacctgcactctccagttccttggcaagcaaacaacagcttaccctactgcctacttgcctctttttccttttccccttggtaataaatttgagggatctaagaatgccagaacaggaattctccaggcccagtaaataagaaccattctgtcaatttctatattttcttatatagaaatcatactcttttaacatctacaacctcttctaccaggagctgtctctgataatcaccttggttcaaggagcatgagtgatttttagatggtgaacgttcagtcaatgtatgatttatgccaggagaagtgggatagtaccctttttggaagggctacaaagccaaattatttacattctgaaaatggggatgcatgagaggacccacaaagaggacgttcacctatgaatcagccagtatctgatctaacagctctggttacataacattctggttacataacatttcaagcttttggttacaaaacatttcgagcttttctttaattacttagtctttgtcttgtctttcttattgttagtacagacataagagaatttccacggaaaatcccacttcagactctactccttgttgaactgatttgttattcttaatatatttattcagctgcaatccctagtgtccttccagagactgattaaaaggcttttctaatataccagaaagactaagggtctttaccacttcgtgtgctattactcaaatttcttaaaatcatctgaggaaaagttaatgattttaggaggagtagtattttttcaatgtagataaataatatttatttcataataataaatgattctgatggcactatttccacccacagaagtcattctggttctgtctccatgtctatatacacaatgatcgcccttctgggaggaggaaaagttccttatggagagctcaaccccagcccttgaaccttaagggtgtgtatattctgaggtcttcgagcatctccccaataatgtggagatctagcagaaacccatttacctgctgtaatgctatctggctccacaaagcaacatttcattgctttgcaataaaaaattaattaaaataaaaccataggtggattcacaaagaaactgtgtaagcatctgtaaatataggttaatttttgaattataagtaatatattaaaccactatttctagtttcattaactttatgtattaagtaagatccccacaatattaagtaagaaaattactgactctcgacttctcactacctgttctcttgtttctcttctccatgtctgtccgctatgccattatctctaccctcatgagagtagtacaagtgctcagaataagaactaaactcccaggcttcatgtataccaacaaaagaggtcatgagggatcccaaagcactccaacacccactttctctgacctgctttctcccaccaagaagtgtcaaaggagaaccctatgttttcagagtaaaatgccatctcctccatgaggggataaaagtgatgccaaggtactaagtccatagccatgtctctctgggcctatgatgctccattgagggagttcaagtgggtgaattgtccacaaagcaagactcagctttctcagatcacctcaaatctatcaatagggatgatgaatgggcctcaggagcttgagtaagtttttgcttattcagttttgctccacgacaagaggtcatcagggagcccagtcaccacctcgcctaattttgacactcactgtttcaccaacactatctgccttgaatccgtaagaactaacctcattatgtcctctgcccccatttatgtcagtcacctaaatagccacagaattccaaactatctctcattccccttcttctaatttccataagtctaacttccatatatatcctatttgcttctttttagctcagattccagttcagaaatgagcattctcttcaccatcgcacactcagcaaaatctgattcccctgaaaccttctcatgcagtggctgtttactttttcttgctgctctgtgaatataggtaagtctcttctccttgttttagtttccaggccattctcctcacttcctcccaccacaaaggaagtggctccaaatttcatgtcatcagatcttaatacgatatctcactgctgcagtcatacctacatcaaagttaaactccccctttccaatgattttagttcctctctcttgtttcaaagccagtcttggtttgaaccttggttattttttatatgcccagagttgaagtctcaaacttcatgaaactgaaacttaacttttcatccttccccctaaacctgttctatacagcctttctcttctcatttgctttcttttttcatatgatgcatctgatcatttaggaaatcatattaacctgtaaagcatctgtacaaagtccttcagttaactggcctgctttctgtccagctaccaactcacactttgaactggcaactcagtttcacacttccattccaggctccttctaggtatattctgtatttcagcttcctccactctgttgtatccctgcagacactctcactccatttatagtacacataaataaccatagtgtattgacacccacttctcccacccttccttactccattctcttcatccattagggatttatgtcattcttatatattgactgtcatttcaacaggaaggagagtaaggagtagacaaacaggtatttgtctgttcattctattctcttttaccagaagccctatattaatcaataagtcctcttctatgtctaaaatccttcaatttttaattttatccataatttacaaaataataatataagtagatttagcttttaatatgtaccttagcctttactaacctctgtttcataacagaagctattgtctaagattattttgggaaaattagtgtttgtgttctaccttaggacacaatgggtgatataaacatcggtctaaagagtcctgaatcttagaaagtggttctttgacaatatctgacattacaaacagcctttaagaactggagtttttataatattgtcctttcatcctttgattcagacacttgtttgtaagaaaaactttagtcactggatttgaattactgaaaaaaaatccaacaatctttgcctcatgatgtttaataacctgcttaagtttgtcagtattctgtacaaattgagcaaatgtatgagtaataaagaaaagaaaaaattgaaagtaggagggtatatttatgagtaatctattatataggagtcatgcctagaatgaataagaagagttaaagaacgattcctaaatagaataagaagatgtaggcttctctcacatggaagcgataaacttgaataaaatatttaaatcttcacataacagaatgagaatttaggcatctgaataattccaatatcaaagaacaaatttagtggaattaaataggttttcataacagaaaatttttagaagtattagtagaaggagatgtaggaagtacacccttacttcgatgaattaagggaaattgctgtttcaacataaaaataaagctggctctaagaatcttctttagggggctgttattgatgtccctcctaggaaaactcaagtgtcactgataccttagaaatatcattagtgaacattttattattttgagttaagaggttttttaggttcttaaagacaagaaaaagttatctattatatctctactgatttttaaaacaattaagttgtacagcatgttctctaattctgaaaaaagtaatataataggacaattacaatttagttttcaattcatcatctttcaaaaccgtggacttttggtatatatctttgcactcattttccttccctttgacttttgtctctataagctctgttcctgaagaggcattttcaccaggtagatgacacttcctcaaaagaattaagatgattaaggctggaacaaagcttgatcctcttagtgctgccggcaatccgaggtagatgtatctatttttttaaaagttaaaacatattaaatattacatagtgtggttagtgcaaactaaatttgtatatctttgtattttattctgataaaaacagcagctgatggttttgcatgctgatcttatataagcaactttgctaaactctcttattaatttcagtatttgttaaaatattttatgtttttttaattttcccactgagaaaatccaaatttattttcatcttttctaatgttttattattgttgttataactaactagtttttcattgagtaggatcttcacctcaaaatgaatactggtagtgatagcagttttattctagtatttagtaagaatgcttccaaagaatcatcatgaattataatatatactcttgtgagagtttctttagatgaccttgatcagattaaggaagttattttctattgtgagcttgctcaaagttttaatcatgaatgtgcataatataaccaaataacttttctgcttgtagtcggaagaatatgcaaagttttctacctttattgtgttaatagcatctattacaccaatagattttctgatattgacctatccttgcatgcttaaaataaactgtaatttttatacattactagattcaatttatcaatttttatgtagaatttttgcatgtataagattagcctacaaatttttttcttgtactgaacttgtccagtgtgattattaagatagtactagctttgtgaaatgaattacaaaattttccctttttctgtttctgagaataacttgcataatttacaaatgaatcattggttcattgtaggttttttcagactttcctgaaaaatatctgaacttggtaccttgggagatgagcacttttgaaagttttacatttttaagtaactataaaaatattcatgtttctatagatttataataaaatctggtaatatataattaattgtctagaaaaatatctatttaatatgtttctaaattgttatatctaaaatccctatgtaagtgttataatatctgtacttatattagctttttcatccttaatgatgttttatttgtgcctcctctctttatttgcctttccacagtattgttattagtaatatctttgcacctttacaaaaacatagctctttactttcttattccctctatggtatatagtctatttattaatttcttcatctatttttatctttctacttctaaaattttcttttattatgaaacagtactaggattcagaaaaaaatggacaccagtgattggatttaagcctatggtaatccagtataaccacatttaacttaactactctacttgtaaatgctctatttgcaaataaggtcacattgtgaagttctgagtgaatatcacattttgaggaacactaaatcctgtaaaaggtgttttacctcattaattggattaaagcattgaatctgaatttagtcgcttgacttagaagtaccttattcttccttggaagctgatatcagaaaccactgctcattttgagacatagagcctgtgaattcagctttgtttactcctttatgtttctgtttaatttctgaaaaaccagatgtttaggatgatatttatattgtcttttaatcaagaaaagtcccttttgaattttaaaaatatattgtttcaattattcttatttgagataggaaatatatcaatatgtaaatttttgagtcatttatcaggtcgttctatgtcatttgtacatatttcattgttctttttctaaattctgagttcattaattttcagccttttatgtgtaaatgtatatatgtatatatttttatacatattatgttttaaatgtataaatatatacatctttatatacatatgtgtatataaacatatatacctatgtgtatataaacatatatacctatgtgtatatacatgtgaatatatgttgcatatgtatatttacatatgtaatatagctatacatatgtaaatatacatttatatacatatgtaaataaatatgtatatatgtacttatatgtatatattatatacatatttatatacatatatttgtacatatgcaaatatatacatatgtgtatatatatttatacatttaaagctctaaaaatccctttgattactggttggcttagcttcatcccacaagttttcttattcagtgctttcattgacatacagttctaattatttatgtttactataatttattcttttaaccatgagtaatttaagactgcattcttttccacttttcaaacatttggggtttgggaattttttattatagactttcatctccattgcattgtgaacagaaaacaggatttatgtggtatcaatacttttttttaactttttagtggcataggtgctcgtattttggttaacaattatccatgtattcatgtagaaatagatatagatgtattatagattcatacagattatatatgtttatacagaatatacatttatctgtatattcaattactcttgtacaatttgaagttgaaatattctatattatcactcatttttgtctgtatttaatattcatttgtgggacaagtatattgaaattttccattctgtagatttattcttataattttataaatttttgttttgtatatttgaggttatgttgatagatttacatagcttcataatttttctatatttttatagtgttttccttttattattaagtaatatctctggttaaccctattaattttttccctttaacttacttatattttgttgaaatcattaatataactacagaagttgatttagtatgtgtctggtagatcttttcaaaaccttatcttcaatcattttatatttttgatctatctatctcttacaaacaacatttagttcaaattttgaaaagtccaatataaaaattactatcttttaaccagcaagtttaaccaatttgcaaaaccacttaggcttattttttaacttatttgtgtggggttttttcttatgaattaccactactgcattttctccccttctattggttggaataaatctaattaatcattttcacatttttaggaaaatgtaaaggtaatcagaagtttgttctcaagaactgtaaaagagtctaagattttacttcatttgtaagctaacaggctagcctgccacagtttcaaggatgctaacagaagatacaagactcataggtcagggacaaaggactttttttactcacaacacagcagtcagcacaagcttcatgttcaagttgattttccttaccctccaagtcccaaagtggtgagacagagggagaacccaggtaaacattgtacacacagtgaatttgggctgcagttagaaagtcctgagtttaggaaatcccaatctttcttttaaatgggcttcaaaaaaatctgcccaaactttgccccaaagggagacattttcttatcatcatggacaacaagctacctgccctctgtccttgagagagacactatttatatcttccaaggtcatttactgttccaacatccttgaaaatatagtccagaaaaaatgctctcagtgtccctgctaacaagaaaagcagaaatgtagggatccatggagaattgtctaccaacaatatttacccttatttctagaatatcttggcttctggtagatttttctcatggatacaccatttcattgaccagtctaattggtctgactaacagagaatggagccaagtccgtttaatgtgtcttaagcaccatttaattcaggagactatcaacaagaatccaagtagcaggatgaggccaaccctcaatagtgacccttggggttcctcaactgtggtagaaatccaccgcatacatagcatgtagctgagcttccctcagcatcactcctggggagctctgggggaaaggggaatagatgcagagatgaatctcctgcgtctgctctccccatacttcttgatatgtgtccttttgctgatcaagaccaatatcttagaatgctttaaacaatggtaaattgttttatattgaatgaagtagctttattattgccccatcaagagaagttaattcaaatttaaacaaaactcaaatttccgaatgaaaaagaacatgaaaatagaaataacaaagagttttattcaaaattagatttgtatttaccaaagagaaggcattaggagacatgaagaagattgtttcagcaaaatgtaaagagggagaaaatatatgattttggagaccagagactggtggtgagaggaagtgaggcttcagactcgtgagatgatgaaatcatgcaggataaaatgagagcctttagagagcaatataaattggataggtatcagtgtacaaccattaccttcaatattgtgttgactgctaagaatttaacgaacaacactttgaaagccaaggttagggaagccatgtatgcttatatttaccaagcacttgagaaataatgggaaaatacaattctagtatgcaaataaggaatggagatataacatcagtatctctgctggaaataaccacaaaagtattcttttcacttgacaaagaaaaagttacgtgtgaatggtgctgcgttatgcacagtctatgcttataaaacaattttaaacaaattattatctttacctgaaggtggtggaatcatatatcctgcatgcccctgactcaccacatttcaaagttccccagtgtaaacatgtggaatccattaaagcgccaaaatatataggtgcaggaatgccagctacaattgacagggaaagaaaaatctatcaacaagaattaagatacttgatttatttggaaatatttcaattttctttatttgtacggcaaagtttatcaaaacataaatctaatggtctaaattttatttttagaaatgatgagttacttttactgtaaagtttctaaattattaaaagataagtaatcttatggtcaaatgcaacataattattagtagagtaaaacattgaattaaagattctgaactttatatattttcttaaatgttttgggccagttatatgtacattttatttgggcagagcattttctttcattttattttcaaatcttcaaacaaagaatagtgtaattaaggtcagacagggccttttcaagtaaaagagattctctatctctttgtgtgctgcattctcatatttataacgtgctttttacatacagaagggacatttgctagactgcttttctgaaataatattaccttgtttatctagtatttaatattgttctgcacatggacacaggaaggggaacatcacacaccagggcctgttgtggggtgggggaaggggggagggatagcattaggagattcacctaatgttaaatgatgagttaatgggtgcagcacaccaacatggcacatgtatacatatgtaacaaacctgcacgttgtgcacatgtaccctaaaacttaaagtgtaataaaaaataataataataatattgttctgataggatgtgggaaaaaataactatttttaccaaatactcttgtgcaaaatgtatgtaatcccacaccaagggacttctcttcagatttcatacacctgaaaagtaaataagtttgtaaataaaagaaaaataaagatttaaaactatcatattgtcttgaaaaggccagttgtaagctagtcacacataatgaacattcaaaattttactttcatgctcacttattggttattcagggctttattatccagctggcagcctacacaggagcccatttctggtcactggcactttactcatcactttttcttattaatacctattttattggtcaggcgcagtggctcacccctgtaatcccagcacactgggaggccaaggcagacggatcacctgaggtcaggagctcgagaccagcctggtcaacatggtgaaaccctgtctctactaaaaatacaaaaaattagctgggtgtggtggtgggtgcctgtaatcccagctacctgggaggctgaggcaggagaatcacttgaacctgggaggcagaggttgcaatgagctgaaattgcgccactgcactccagcctgggtgatagagctacactccatctcaaaaaaaaaaaattgtttttaataacacagaaactagatacactaaaaatctgcagtaagaataacaataaataaattttatatagttcttactaagattagaaaagaacaagaatactcactatcacaactacagttaaataaatcttggaggttttaatttatgctataagagaattttagaagtctcagatgtgtaaggtttggaagtgaaaagacaaaacttgtcatatttgcacattgaaaaacctacatagaaaacctaacaaaatcaacaaattatgagaacaaataagaaaggatgctgtataaaaagtaaatttttaaaaacagcagcattcctctaaaccagcaataaccaactagaaaatataagagaacagtaccacacatatacatatatacctatctctacttatgcgtagagatgatagagataaatatggacacacacacacacacacacacacacacacacacacagacctatctgtccaaaatagtgcaataatttataagggaggggtagagcaaggagctaaatagaagtctccaccaatcatccctcctgaaggaacaccaaatttaacaactatctacatacaaaaaaaaaccaaaaaaaacctttgtaagaatgaaaaatcaggtgagcactcacaatacctggttttaacttcatatcacagaaagaggcactgaagagagcaggaaaaatggtcttgaattgccaacaccagccctcccatcccccagcagtggccacatggcatggagaaggaatctgagcacttgggagagggagaatgcagtgattctgagactttattaaatcctgtgctgccctgtcacagtggaaagcaaaaccaagctaaactcagctgattcttacccatggagggagcatttagactagctatcaccagaaagtaatcacccagccccacagttagaacttgagttccagcaagcctcgccaccatgggcaaacgtgctctccctaaataaacttgaaaggcagtctaggttgcaaggactacaactcctaggcaagttctagtgctgagctgggctcagagccaatggacttgggagtcacttccctactgagacaccagccagggaagctaaggaagtgcttgtgccacccttcacccaagcccaggcagcacagcttgtggctccaaaagagattccttccttctacttgaggagaggggagaaatgagtaaagaggactttgtcttgcatctgtgataccagctcagccacagtaggatagggcactggtaagggtcatgaggtgcccattccaggccctagctcctggctggcatttctagacataccctggatcagaagggaacctgctgtcttgaagagaaggactcagtactggcaggatacatcacatgctggctaaagagcccttggggcctgaataaccaacagctatacgcaggtagtatgttatgggccccaggtgagactcaggtgtgctgtattgagatgagactcagcacattcagagctgtggcagctgtggtgagagactctctgtttgagaaaagcacaggcacaggaagcaaagggaattctgtcttgcatcttaggtaacagctcagccacaatggggtagagcagcggttcccaaacattttgcaccagggactggtttcatggaacacaatttttccactgaccaggcaggagttggggatgattttggatgaaaatattccacctcagatcatcaggcattagttagattcccataaggagtgagcagcctagatccctcacatgtgcagttcacaatagggttcacgctcctatgagaatctaatgctacagctgatctgacaggaggcagaactcagggggtaatgctcgctgctccctcctgctgtgaggccagattcctaccaggccagggtctggtaatattctgtggcccagtgtgggtagggaccccaggggtagagcaccaagcatgtttttgcagttccagattctgggccttgggtcttggatggcatttctgaacctgccctcctgggccagaggagagctaactgccctgaagggtgagtcctggcgtagcagcattcacacaggctggctaaagaactcttgtgccttaagtaaacgtcagtggtggcctggcagtattccctgtgggcctgtggtggtggtggtggccatggggtggggctcctctgactttggaaaggggagagaagagtaaaaaggtgtttctcatagtctgagtgccacctcagccacactagcatagagcataaggtagatttgtatgattttttacccatcccaggctcctggatggcatctctggaccttcctggggactgggaaaactcacagctctgaagggaaagacaaaaacatggctggattaccactggatgattgtagagttgggtcttgaacaaacataggtggcagccaggtagaggtaacagtgggccttgggtgagactagtgctgtgctggattccaatctaacccagcacagtcccagtggtggtggccacaggggtgcatcaccctacccccacttctgggcaacttagcacagagagactccacttgtttggaagaaattaaggcaaaagaacaagaatctctgcctggtaatccagagaattcttttggatcttatccaagacctccaaagtggtaactctgtgagtctacatgaaccacagcattattgggcttgcgggcccaagtccttttgaatacctggaaagcctgctcaagaaggatggcacaaacaaacccagactgtgaagactacaataaatgcctaactcttcaatgcccagacatcaacaaacattgacaagcataaagaacatacaggaaaacatgacctcaccaaaggaactaaacaaggcagcagggaccaatcctggagaaagagagatatgtgacttttcagatggagaattcaaaatggctattttgaggaaactcaaagaaattcaagataatacagagaaaaaatgcagaacactattagatgaattttacaaagaggttgacataaataaaaagaatcaagcagaaattctacagttaaaaaaatgcaatgacatactaaagaatgcctcagaatctcttaatagcagaatttatcaagcagaagagagatttagtgagcttgaagataggctgtttgaaaatacacagtaagggatacaaaagaaaaaaagaataaaaaaaagtgaagtgcacctacacgatctacaaaatagtctctaaagggcaaatctaagagctatttgccttaaagaaaaggtagagaaagagataagagtagaaagattattcaaagggataatagcagagaacttcccaaacctagagaaaggtattgattccaagtgcaagaaggttatagaataccaagcagatttaacccaaagattacctcaaggaattcaataaaccccgcaaggtcatgtataaataaacaattctaaaagcagcaagagaaacgaagtgactaacatacaatggagcgccaatacaactggcagcagacttttcggtggaaaccttacaggccaagagagagtggcatgacatacttaaagtgctgaaggaaaaaaacttttacctttatatctggtgaaaatatcctccaaacataaagaagaaataaagattttcccagacaagcaaacactgagggatttcatcaataccagcccatgctataagaaatgctaaagggagtacttcaatcagaaaggaaaggatgttgatgagcaatgagaattcatctgaaggtacaaagatcactggaaatagtaagtaagcaaaaaaatgcagaatattataacactgtaactgtgatgtataaactactcttaactaggaagactaaaagatgaaccaatcaaaaatattaacaacttttcaagacacagacagtaaaataaaatggaaatagaaataacaaaatgttaaaaattaggaggacaaagttaaaatgtagagttttttttttagttttctttttgcttattagtttctttatgcaagcaattttaacatattatcacctaaaaaaatgggctataagatagcatttgcaagcctcatggtaacctcaaatcaaaaaacatacaatggatacacaaaaaataaaaaagcaagaaattaaagcataccactagagataatcaccttcactgaaaggaagaaaaaaaggaagagaaaaccagaaaacaaataacaaaatggcagcagtaagacctttcttacgaataagattatttaatgtaaatagactaagctctccaatacaatgacataaagtagctgaatggatttaaaaaaatacccaataatctgttgtctactagaaacatatgtcactcataaagacagacacagaaaataaagggatgaaaaagatattccatgccaatagaaaccaaaaaagagcaggagtagcattacttatatcagacaaaatagattttaagaaaaaaactgtaagaagagacgaagaagatcattatataaggataaaaggattaattaagcaagaggacataaaagttataaatatgtattcacccaacattgaagcacccagatatataaagcaaatattattatagctaaagagagagatagagcctaatacaataatagctgaagaattcacacctcactttcagcattggacagatcttccagaccaaaaaaaaaaataaataaataaacaaagaaacattggatttcatccaaattataaaccaaatgaacctaataaatacttacagaacattttatccaatggctacagaatacaaatatgaatccagcacatggatcattctcaaggatagaccatatgttagctcacaaaccaagtcttaaaacatccaaaaaaaattgaaataatatcaagtatcttctctgaccataaggaaataaaactacaaatcaataacaagaggaaatttgaaaactatacaaacacgtggaaattgagcaatatgctcctgaatgaccagtgggtcaatgagaaaattaagaagaaaatttaaaaatttcttaaaacaaataataacagaaacacaacataccaaaactcatgggatacagtgaaagcagtactaagaaggaagtttataactataaatgcctacatcaaaaaagaagaaaaacttcaaataaacaacccaatgggccaggcgtggtggctcacacctgtaatcccagcactttgggaggctgaggtgggtggatcacaaggtcaggagatcaagaccatcttggccaacatggtgaaatcccgtctctactaaaaatacaaaaattagctgggtgtggtggtgtgagactgtagtcccaacttctcaggaggctgaggcagaagaattgcttaaaaccaggaggcagaggttgcagtgagccaagatcgcgccactgcactctaacttgagcgacagagtgagactccgtctcaaaaaaaaaagaaaagaaaaaaaaccaataatgcatattaaagaattagaaaagcaagagcaaaccaaacacaaaattagtagaagaaaagaaataataaagatcggagtagaaataaatgaaattgaaatgaagaaaacaatacaaaagatcaacaaaacaaaagaaatagttatttgaaaagaaaaacaaaactgatgaccctttagccaaaataactaggaaaaaagagagaagactcaaataaataaaatcatatatgaaaaagaaaacattacaactgataccacagacatccaaaggattttaagacattattgttaaactatgttaaactcaaggctattatgaacaactatatgccaataacttggaaaacctagaagaaatggatgaaatcctagacacatacaacccatcaagattaaactatgaagaaatccaaaacctgaacagatcaataaaaagtaatgagattgaagctgtaataaagtctccagcaaagaaatgacccaatggcttcactgcctaattctaccaaacatttaaaaaggaaataatatcaatatactcaaactattctgaaaaacagaagaggagagaagccttccaaactcattctatgaggccagtattatcctgataccaaaaccagaaaaagacacataagaaaaaaaaaaaaaaggaaaactaaaggctaatatcactgatgaatactgatgcaaaaatcctcaacaaaatactattaaaccaaattcaacaacacattaagaagatcattcatcatgaccaaatgggatttatcccagagatgcaagaatagttcaacatatgcaaatcaatctatatgatacatcataccaaaagaacaaacgaataaaaccatatgatcatttcaattaatgtggaaaaaacatttgataagattcagcatcgctttatggtaaaaaaaaaaactctcaaaaaactgggtataaaaggaacatggctcaacataataaaggccatatatgagagacctatagtaagtatcatactgagtggggaaaaactgaaagcccttattctgtaatctgggacataacaaggatgcccactttcaccattgttattcaagatactgctagaagtctgagctagagcaatcagacaagaaatataaacaaagagcatccaaacttgaaattaagaagtcaaattatcattgttcatagatgatatgatcttctattttgaaaagcctaaagactccaccaaaaagccattcaaaatgataaacaaattcagtaaagttgcaggatacaaaatcaacataaaaaatcagtagtgtttgtatatgccaacagcaaacagtctaaaaaaaagtaattctatttacaatagctacaaatgcaataaaatcactaagaattaccctaaagaagtgaaagatctctacaataaaaactgtaaaacattggtgcaagaaattgaagaggatacaaataaatgaaaatatattatatgctcataaattgaaagaaacaatattgctaaaaccaaacaaaggaatctgcaatctacagatttgatgctatttctatcaataaaccaatgacattccccacagaaatagaaaaggtaatcctaatatggaaccacaaaagatccaggatagccaaagttatccaaagcaaaaagaacaaaactggaggaatcacattacttgacttcaatttatatcacagacctatagtaaccaaaacagcatggtactggcataaaaacagacacatagaccaatggagcagaatagagaactctgaaaaaaaatccattcatctatggtgaactcatttttgacaaagatgccaagaatgtacattggggaaaagacagtctcttcaataaatggtgcagggaaaatggaatttccataagcagaagagtgaaactagacccatatttcttgccatattcaaaaatcaatcaaaatcgatgaaagacttaaatctaagacctccaactaacaaactactgcaagaaaacattcaggaaactctccaggacattggactgaacaaagatttcttgagtaatacaccacaggcacagataactaatgaaaaaaaaatggataaatgggatcacatcaagttaagaagcttctgcacagcaaaggaaacaacaagatgaagagacaactcacagaatgagagaaattatttgcaagctacccatctgacaagggattaataaccagaatatgtaaggagctcaaacaactctatagaaaaaaaatctaataatccaattaacaaatgagcaaaatttgagacatttctcagaagaataaatacaaatggcaattttatgaaaaggtgctcagcatcaatgatcaagagaggaatgcaaatcaaaactgcaatgagatatcatctcaccccagctaaaatgacttttatacaaaaacaggcaataacaaatactggtgagtatgtagagtaaagggaaccctcctacactgttggtgggaatgtaaataagtacaactactatgcagaacagtttggaggttcctcaaaaaactcaaaatagagctaccatatgatccagcaatcccacttctaggtattaatatatacccaaaagaaaggaagtcagtgtatcgaagagatatctgcactcccatgtttattgcagcactattcacaatagtcaagatttggaagcaacctaagtgtccagcaatagatgaatggataaagaaaatgtggtacatatacaggatggagtaatattcagccataaaaaaaagaatgagggggaggagccaagatggccaaataggaacagctccggtccacagctcccagtgtgagcgatgcagaagacgggtgatttctgcatttccatctgaggtaccgggtttatctcactagggagtgccagacagtgggcgcaggccaatactgatgggagactttaacaccccactgtcaacattagacagatcaatgagacagaaagttaacaaggatacccaggaattgaactcagctctgcaccaagcgaacctaatagacatctacagaattctccaccccaaatcaacagaatatacatttttttcagcaccacaccacacctattccaaaattgaccacatactgggaagtaaaactctcctcagcaaatgtaaaagaacagaaattataacaaactatctctcagaccacagtgcaatcaaactagaactcaggattaagaatctcactcaaaaccgctcaactacatggaaactgaacaacctgctcctgaatgactactgggtacataacgaaatgaaggcagaaataaagatgttctttgaaaccaacgagaacaaagacacaacataccagaatctctgggacgcattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacataaaaaacccttcaaaaaattaatgaatccaggagctggttttttgaaaggatcaacaaaattgatagaccactagcaagactaataaagaaaaaaagagagaagaatcaaatagacacaataaaaaatgataaaggggatatcaccaccgatcccacagaaatacaaactaccatcagagaatactacaaacacctctacacaaataaaactagaaaatctagaagaaatggatacattccttgacacatacactctcccaagactaaacaaggaagaagttgaatctctgaatagaccaataacaggagctgaaattgtggcaataatcaatagtttaccaacaaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaatgcaccaatccttcatgctaaaaactctcaataaattaggtattgatgggacgtatttcaaaataataagagctgtctatgacagacccacagccaatatcatactgaatgggcaaaaactggaagcattccctttgaaaactggcacaagacagggatgccctctctcaccactcctattcaatatagtgtcggaagttctggccagggcaatcaggcaggagaaggaaataaaaggtattcaattaggaaaagaggaagtcaaattgtccctgtttgcagatgacatgattgtttatctagaaaaccccattgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctctttgaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcacggtactggtaccaaaacagagatatagatcaatggaacagaacagagccctcagaaataacgccgcatacctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacattagacttaaaaccataaaaaccctagaagaaaacctaggcattaccattcaggacataggtgtgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaaaatgggagaaaattttcacaacctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaaaacacatgaaaaattgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaacgactataaatcatgctgctataaagacacatgcacacgtatgtttattgcggctctattcacaatagcaaagacttggaaccaacccaaatgttcaacaatgatagactggattaagaaaatgtggcacatatacaccatggaatactatgcagccataaaaaatgatgagttcatgtcctttgtagggacatggatgaaactggaaaccatcattctcagtaaactatcgcaagaacaaaaaaccaaacaccgcatattctcactcataggtgggaattgaacaatgagatcacatggacacaggaaggggaatatcacactctggggactgtggtggggtggggggaggggggagggatagcattgggagatatacctaatgctagatgacgagttagtgggtgcagcgcaccagcatggcacatgtatacatatgtaactaacctgcacaatgtgcacatgtaccctaaaacttaaagtataataaaaaaaaaaaaaaaaaaagaatgagaccctttcatttgcaacaacatgaatggaactggaggtcataacgttaagtaaagtagggcaggcaccaaaagacaaactttgcatgtcctcacttacttgtgggagctaaaaatgagaacaggctgggcacgatagctcatgcctgtaatcccagcactttgggaggccaaagcagatggatcatctgagatcaggacttcaagaccagccgggccaacataataaaacactgtttctactaaaaatacaaaaattagtgggtgtggtggtgcatgcctgtagtccccgctactcaggaggctgaagcaggaggatcgcttgagccagggaggcggaggttgcagtgagccaagattgtgccactgcactccagcctggacaacagaatgagactccatctgagaaaaaaaagaaaaaatgaaagcaattgaactcatggagatagagagcagaagggttgttaccagaggctggaaagggtagcctgggtgtggtggggaagtagagatagttaataggtacgaaaaaatggaaagaatgaattaaacctactatttgatagtgtattagagtgactatagtggaaaataatttactcgtacattttaaaataactaaaagagtataaatgaattgcttgtaacacaaaggataaatgcttgagggaatggataccccatctaccctaatatggttattacacactgcatgcctgtatcagaatatctcacataacccataaatatatacacctactatatacccataaaaatttaaaattaaaaaaactatatttatatatgattaattttttaaatctaatttttacttctgatttattttatgtataattttaattatatgctatgtaattataatctagatataaaatttatatttgtatatggggaaatgatacacatatatacatatacatacaaaataccatgtacaatcacattgataatcacaattatttacaagcaatacaaatataaatttaaatatatttaaaatcaatacaaatataaatcagtttaaaatcatatacatattcatatctctatatatttgcaatcacaaatatttacatgtagatggatatatatgtatattgtacatttgtgatggtaatggtaccattctgtgtgtgtgtgtgtgtgtgtgtgtgtgtgtgtgtgtgtgtatggcatcactagaaatatatttggtctttgtccctagcttctgacacgtgtccttggagttcttagaattcccttggaacatcctgagtgataggaatgtattttgtcattcttaaggagattgttttgatcacacctgagtctatagtaatgagacgacagggtggcctcccagactgatgttgggactggtcaccagaaagaccaagttattagaagattggaattctcagccccacactcagacctccaggagaatggagtgggatgtgtgtgctgaagatcaagctccctaaaagctcttgaactaggagatttgatgagcttctgagttggtaaacatatccacatgccaggagagtggcacaccccaactccaccctggtttccatttgtgtcttttataataaccttcataataaaccagtaaatgtaagaaaagtgtttcttccctgagttctgtgaaccattctagaaaatggaggcatcaaccttaatgcatcgtttgtcagtcagaagcccagggtaaaaaaaaaaaaaagcagcccagggtgtctggacttgtgattttgtgattgacatctaaagtgggggcagtcttgtaggactgaaccgtttaacttttgccatctgatgcaaagtctatgcagatagcactagaattgcatggaacagtagaacacccagttggtgttgcagaattgaacagtgtaggaaaataatacacacatctggctatcagaagtgttctgtttgaatagagaaaccgtttgtttttctcagtgtgtgtgtgtgtatgtatgcgtgtgtgtatgtatctgtgtggctgtatgtacatatgtgtgtgtgcatatagagacatatatatgtatatatgtgcatatataatttatatatttatatatagtacttaagaagcaatctaatggcacatcacctttatgaaaaatttttaagaactttaaggatacaaaggaatatttaagcaaatgacaggatattacatgttcaaaaatatttgatgtcagattttctccaagtaatctatggaatctacacaaactcagtcaaaattcttatgaagatataaagatccacagacagcaaaataagtttgagaaagaaagaataaaggaaaagtgaagatggcaggtgggtgaggcaaagttaccatatgagatattaacatttgcaaggccaaagtaattaaatcaaggtgacgctggtatgggaacaggcaaataaatctgtggagcagaataaggatgaaaaatagactcactaattataaaaacttgagatggtggcaccacaaatcaaaggaaaaaggacgtattatatacactatgattttggaaaacaactttattattcggagaaaaataacactggatatctatgtcccttaaaccacatataaaaatagatttgagatggcttaaaaaactatgcaaaaggtaaagcgggaaagccaggggggaataaaatttaagggaatatttttataagttagaaatgtggaagcaattttaaaaatgtgacttctcttccaaatacacaaacactaaggtaagaaacttgttagattttagtacaacaaaatttaggatttcatttcataaatggcactgtaaaagttaaaagaaagaagacagactaagtgaagataattgtatcatataaacagtattacattaatatctgtaatttacatagtaatcatcaaattcatcaagaaaaacataggatgcaggaaatataatgagtaaagtgggtaaaataaattgaataagcatcatgaataacttttagctacaaagttatttgaagagatgcttaagctcagtgtatcaggacatcacatattgacacatcaatgagctatcattagtattttacacccattggattagtcaacatcacaaagttagataattctaactctcatgcagtgatgatataaaaattactctaaataggactggtgaatttatctatgcatctaccttatgaatcggaacaagacttaacaccacaccaccattgttgtgaatataaaaacagatgcacacaaaaaattctaatattttacaaaggaaatacatatttaagacatctatctgtcatacttaagtgagcagctatggtgactggaagtagggaattgaatagaaataaataaataaatgaagtaaaataagagagaatccttgcactggcctatgatgataatgtgttatgacttgagcattgtgattaactgaactctactttagagctccaaaagaagaagaaaaagagagaaaaaatgcaaattatgttcaggattgtttactaggcacaaagactggtgtagttgaaagaagatttatttaatatacctaaatttgaaaactggctctgcaatttcctagttttagaaagtctttcagcattgatgtctcacagtagccttgtaagagagccaagtatttattattatgcccattattattaaagaaaaatggagctcagaaagatcaagtgaccttagcgagatgggggcttctgacagctttgcactgctgtcctataggttgaaccctaggaaatggctgctaggcacccactctttacctatcaaaatggccattttatacggcctaccctaagatataaatgtgtctcttttgtcacaaaatgagaggtccactcatttaactctaagaaataaggaagaaaagtagcgaggaataggagtgaaatgccagcagatgaacatgtgcattgctaactttaaaattttgtgaaatccaacaatgcttaatacaaaacccttaataaatggtacgttagagcactgagttcttagatactgagtcctgagtgactttcttagaacaagctaccttaataaatgaccccaaaaaaatataaataaagaaaataattttgtacctcaagagaaccatatatccaggtatggcagccaaagaataaatgaaactgctcatcgctgacaagattaggaagtactggagcatcaaggaacagtcaggtcctttgtcgcacagcccaagaactgcagatgaatttcctgatgtttgaatacagctgcaattttggaacacctgccaaaaaataacatattatactaagaagtaaaaatcttgaacacaaattttaaacattttctacacagccagttggatcaagatggagactgcttgttccctttactccatctccattatgatgtctctcaagattacaccatataacaaaactggaagggtgatttcagaaaaacggtatatttttctaaatatgaatagtaaatttgtaataactaataagttaccctaaagacacacttttttattattttatttatttatttatttttttgaaacagagactcaccctgtcgcccaggctggagtgcagtggtgcgatctcggctcactacaacctctgcctcccaggttcaagtgattctcctgccctagcctctggggtagctgggactacaggcgcctgccaccattcccagctacattttgtatttttagcagagatggatttcaccatgttggccaactggtctcgaactcctgacctcagatgatccaccggtctctgccttccaaagtgctgggattcctaggtgtgagacaccgcgcccagctaatacactttttaaaacagtgttttgatacaacactacattggacaaacaaaatctgtttcagagtgctcaactgaaatatttagatgcttacaaataaagctttgcttcaaaggaatagtttatttcagcagggcgcagtggcttacgcctgtaatcccagcactttggggggccaaggcaggcggatcacaaggtcaggagttcgagaccagcctgaccaacatggtgaaatcccgtctctactaaaaatacaaaaattacccgggcatggtggcatgtgcctgtcatcctagctactcaggaggctgaggcaggagaatcgtttatacctgggaggtggaggttgcagtgagccgagatcatgccactgcactccagcttaggcgacagagtgagactccatctcaaaaaaaagaaaagaaaagaaatagtttctttcaaaaaaagaattgtcaaccttttttgaattgttacatgtttccaggtcttaataagaatcaaaatttatagtttactttgatcaccaaccaacgttatattaatattacaattgatgttatattatattgtgatatcttagaggcaagagaacattcctaattctaaattctcaaagaactgtcagaatgtgaaaaacacagaaagcacatccatacatatacacagaaaaatatatatatatgtgtgtatatatatatgtatatatatatagcaaagcaattagctggacaattgaaatcaaaaccaccaactttatttcaatgataaaatttttttagtccagagtatttacaacccaaattatttgagtaataatataaacttcttggaaatttcagatcactggtcagatgctatggaggtttcacataagatctgggaaataaaaggtaatcaagtgaccatcatagagttatttttccacatacaaaaaaagtaatatggttttgaggaaacactaattttacttttattaaatataggcccagttcatagttgggaagtaccaatgcaactcaaaaaagttctgtcaaataggatgtcttaccatgtttattcccgttccaatggatgtctcacaaccagcaagacaagctgacagatatgacaagccattgtttccacacacaggatcccatattttagatggacagttgcaatccacattgcaatcagcaaagatgtcattttccacatataaatcttgtggaattctgaagtgatttaaaataatgccatagatattaaaagaggattcaatcctttttttcttcttttcatctcaatccccagttagatttcctctcctcccatgaatagaaagagaaattttccagtcatcaatgtgtgacctgtttactatagctttggtataaaagagacctgctttgatgaccacatagccactccttcaatgatttatctcagaagaatatataggcaataaacaagcattaattgagcacctaccatgtggagtcatgttttcacatactattagatctcgaaagatgaagatgaactaatctctgtgattcatccattaggtagcaaatagcaagacaggactagcatgaagataaaaatctgaaagttccatttgtaatatagataatacatttagctccagaaacataggtatttgaattaaagaagtgcattctactaatataaaaagtgaccagtgcttgtaatatgattgaaagagcacttgcatagcagtttagagactgcattcagactagatcacagtgcgactttctacacattctgtctgggaatcagcatcattggagatggaggcaatctttaaaatttattccaattttaaaatccatttctatattgatgtagttgaagagatttgaaatgaactgcttttatcattaaatttctctgaatctcaatttaatctgtaaagtggagataataatgcttatcttagatgaagctcatgagtctcaaatcaaatagcatatgtaaaattatattactattttacatttgaaattatttcaatctaataaaccttgataattttgaaaaaacattttaggatgttctttatttcattttaactgatagcttgattgtcaaaatacgccctacaggtgaattcttttaatgtacatcactatggaaaacatttcagtaaaacccagataacctttaaaatacaaaatatgaaatgattcaatattttagacatagcaatataaatgaaatatatgaattatgtattaattaatttatcatgtattatgatttagttatgccaaacttaagcccattggggaaacatataaaggccattttgactgtataatcaactcttagttttactcagttatgggagtataagatatatggataacatattttaatacaacctgaaactgtaggtagtttctttcataggataatgtctactcggatatcacaaagacaatcatgcacacacacccacatgcacatacaatcataaattcactcaccctgtgatatgttcccaacctcattaataagcctagagcttggatagattggcttgattgacagatggaggaaagatacaggaaaagcatggattactatcattaactccaataagaaaatgatctgatcgtgcattgccattgtaaaaaatatcatattaaccatttgttgaaagattctcacattcattagaaaacaacatacccttcataagaggtatttattccaacaactgaagaattttcacaagtcatgagaaaagataaaaaatagagaagatactcaagtaaggataaccaacatcctatgtgggcagcttgtttgacagtaatcttgaacttcttcataattaaaccaccaattatatatccaatacatattggaggtaagttataaatacctataaatgcaaataaaatattatttacaaaatgacttaccaaaggaacaaatatgttatcacttttatgtaatatgccttatataagtaactatttaggtccaactcatagtgaagaagaatgatttaattttatccccacttagttacacattacccacagggagattttgaaatgcccccataatggggaagtatattttgggagactcttgttattatattatcattcatttaactcattgcagtagcttgtgaatttcttataggcagagatcatgataaaaatctcttttcttaggatccaggtagaagtggcaagtcaaaattggccagtaatttattcatttattaccctctattctgtgtagtgagaatatatatatacaatttttcagttacctatcctcactttggttgtgaagaattagactcctctcaaagtgctttttcttttctttttttagagacagaatcttgctttattgcccaggctggagtgcagtgatatgatcatagctgactggagcctcagcttcctgggcttaagagatgctcccacctcagccctctaagtagctgggactacaggtgcacaacaccacacctggctaatttaaaaacaaaaattgcagagacaaagtcttgctatgttgtccaggctggtcttgaactcctggcctcaagtgatcctcactcctcagcatcccaaagtgctggaattaaaggcatgagccaccacacccagttcaaggtactttagagagtcactttgctgagcctgttgctgtcaagtgtatttacatttcatgtcttgctgctactggctcttcctctctgaacccttcccaataagtgaaaaaaaagaatagaaaaaggagaagatagccctaggttccatctatacaatgtgagcatctggctccccgaatcatattattgagagagcttgttaaaaatccattccagagccccacgccctagagtctgattcagtgtgtctgagggggaaccccaggtatttgaagctttcacaagcactttaggtagtgtggatacaagtagcctgggatattgacttttaaaaacagtggaaagatcccaggaaaaacccaagttaggctaaaaccactgaggttagtgtggttgcaggaaaagccgaatgtgtgtggctgcagagacacctaaaaccactagggggaccaaaaaattaaattaggaggaacatagaatccttgaactggaaccaaaaagagtaaaatttggtagtaaaatgcacaatcctatctgaaaatatgtaatttttgcactcccaaatatttgcattcatattatgaattcacattctgacttcagagagaagaaaatcaaggtatttctgacctcttcccttccctaccctttctttctttccttctttccttccttctttccttccttctttctttctttctttctctttctttctttctttcttgagattagaaggaagaaatccaccagagtcaaaaaatatcctaaaacacttcaacttaggagtttgctacacccgccatcacactgttcgtgggggggaaagtgtgctagtaaggcagagaaaaacaaacatacccattagaaagattgcatctgaagatgatattccatattgctgttctaggtatttaggcatgaaggagatcatgttaacgaatgcattgaactgtatcacacttacaagtatgaaaagcatataaattggattgcaggaaagacttttcatgaaaggtagaaaatctgaaatgaaagaatgacaactgtgtcaaacgaacttggctttgcattttgtgactggcttttcctgaaacatccacctcctcaacaaattatgttttttactattttgtaatatgtattgtttgctaattcttttttccccttgaaagctgaagtcatagcaatgttttggtggcttctggaagtcagtgatgtagctgactgggtagggatcagaacacaacagttttgccctcaataagtcactgttgagtcttaaagatcagtaagcaaaactacaaagtgaccaaaatattgtctacgtccacagcattttattactaaccttttgttcttctattaatatattcttttttctacagctcattagaatgaaagatgcttgttctgttctgtaaagtctggaggaaaatcgagttgataaagaagatttcacacaaatatttattttatcactccctgaacatttgaaataaagatgtgtgggaattaatgagatatgaatgttctcaagtatccggaatttttttttgcttcttcagaacaacagtttcagtggttctgccattggttctcagcaagatctacctggagatattttttaaaataccaacatccaggtcccatcctcagagatgctgattcatttggtacattctaaggactatgtaaatgatttaatcaaaaatgattcctgttagaaaaagcacagagccaaatgtgtggcctgcctctagtaatgtttggcctgcttctagtaatgtgtggcctgcctctagtaatgtgtggcctgcttctagtaaatgttcttggtcacactgctaccattcaggctcaagttctcacttttaatttcctttcacttttcctgtccacatgttctctgtcttgactttcttatgcacaatcttggtttgcttaataaactgctcacaattcattctggaacaaaatttcaataaataaacaatttagaagaggaggacacacagattaatgcaagtaaatgagttataattgtaaaatttatatttatgaatagggtacctgacaggagagagagttatctgaagatttttaagtcacccatgtttgttgacatccctgtcctaatagatgagtttcagtagcacaagtttcttttctatgtcttgcaacaagctaagctctttcctaattttgaaaatggaactgatcttgcagactgcaagaggtctatcagtccataacaatcctttaagaagagtttttaatatcatcagaatgattctgagaatttgcaagattctgagttggctcctaatgaccaaagatgtattaaattatgctcaattatgatttaagagaatttacaattgttaagaaaaattctatgcaaattgacattgtaacttatgggtgatgatagaaacaacaatgacaacataaaagtactaacactagtatcagtattaataataatgtgtgctagaatgtcttttaccttcacacaacaattctatagtaagtactattattatccccatttgacagaaaactgagaccctcaccatccgtcaaataaacatttttaagttccaatagccaggctgcacatccacactaattaaatctgaccttttgggaatactacagaactttcaggcatcaatcatttttaaaatttcctaggtgattccaatgtgcagccaagtttgagcatcagtgctcttgagtactaaatacttaggctatcttagtttagtttcccacagaaaaaccttctgtaaattatactttgagcttttattgaggttctgtaccaaaaaaaatgttacatgcaatttaccctttcatttgctggaaaaccactatgtggctcaatattacctgtatcatgtatcttatgatcatttttaaatttttttacaatttcttccttggagaactgcttctgtttaaaaattattattcttccctctaccaagtatagagaggtgggtcaccgatcatgtttttttttttctttctgatttaacttccaggaagctcttcgttaaactaacacactggttacaaaactatactacctattaagattagagtatactttttcctacttttgttcttagtttaaatttgcttgttcattttgtttcaattcaacctatgttctctgtaaaatcggttttttgagcaaatgggaccatatatatacgtgtgtatatatatatatatatatacacacacacgtatatatatacacacacacatatacacacacatatatgtgtatatatatacgtgtatatatatatacgtgtgtgtatatatatatacgtgtatatatatatatacgtgtgtgtatatatatacatgaccctctctctcctctctctcatatatatatgtgtgtgtgtacatatatatgtgtatatatgtgtgtagatatatgtgtgtgtacatatatatgtgtatatatgtgtgtatatatatatgtgtgtgtacatatatatgtgtgtgtatatatatatgaaagagagagagagaggagagtgccaagactgacataaaagtttacacaaatgctgatctgaaatatttcagcttccaaattataatatttattttcaagtagtaccataggaagaatcggactagttaggtattcttgactggtgactgttgatgacaaattgtctcaacacagcatagcatatcatagtgttagactaaaatacagacatatctatatgaaataaaaggtcaatttcatagtatttagaatatgtatatttgcctttagtgattccatatttttccttcttgacctcttctttttgtttgtcttcattttcatttttaatgatgtcagcattagtctctagtccttcctttggaagtgtgttgggcaaaaagaaaaaaggaatggcagtgagcacgttaactcctgcacaaatcagaaagccaaaccaccatgcaccgacccaacgagtgtcagtgggagttatgatcagatcatctgtaaaaaaatacacacactgttattagcttaagtcagtattttctgtatgaactatagaaaattattaaaattagaattatcgggtcccaaccaactataaaattggcttataattcagacactgataaaatttttctaataatatgtggtgttgtaatattgtctagtaataaattaggctggttatctgtctatcatgtaagggatttaaaagcaggtattaactaaacagctacaagttctatttcatcatcaacaaatgattgcttaaagttctatttcatcatcaacaaatgattgcttaattgaaataaattcaaacctacatgcttaaattttgtaaaaccaagaaatatagttgaagtgcactagaaatagcatgtgattctgtgtcagattagcattttattttgcactactgctttctggtttggaatattttaaaagttatttaaattcctccactagagtttctcacttttaaagtagagatcatttatcaaattgaaggtcaagtaaggccatgattatatatgataacatacctgagatgctttgtatagtctagacactgtacaaatagattttattgaattacctgtgttcacaaatccagtgtcaacataaacatttgcacagaatgatgccaacaaaagtccaatcaaaggaccaataatagctcctgtttctacaagccctaaaaataaataaaagtataaggttatagtacagttatatgcccacataaagagttctaggtctatgaaaagcctgaagattgaatatttttgccttggatacttttgactagatacacaatttatatgaagttaagcttgatgtacatataaatgatggttgtttctgtaaatgttgaaaaagaagcctcataatttaaagccactttccctggcctccaaattccctttcatgctgggtcacaggtagagatttgctgtaacagcacaggcagtcccagctgggatcatgccattgactaggtcgtgatataaccaaggtcctgttaattcatcccacaggcatgttttgggaggaattctaaagcaataccatcttatagtggatttctcatggcacattcctcaaaaaagtttcactctcagatctgcaacttgaaacttccttctggctatgtcctcattattattatatgatacaagtctttgattttatcatgttctccttcctttacttccacagttttattttccatgtccatcagtcctatctgtcttcacttgaattcttatccattaaaatttcatcatcagctgtctcatcacttgtctacaattcagaacctatgctgaaccctccctgatctctgaaaatccagacacgagcttcttcaactttcttcctgttcacttcaaaatttggctttgcctattatctctgccttctccatggttcttggagaacccgccctatacacacctaacttcttggttccaaccccttctatcttctctaaggttttgctctaccaaatactccctctcttgtgcgcgttcaatttccccgtagccaatgattctacaaaatctcaaatccaccctgctttctctcctttcactatactctctgcctctacttcctcacctctcactcactttactcaaatccttttacattctcctccaaatactctcaggtagccccagtgatctctttgtcactaatttagtgtctttttttggtcttcatcttcctagctttctaggttatttgacattgctggccaactcctctttttacatttcttcctgagagtttcattaaactatacatgtattgtttcattgtgttcttatgactattccttctttgattttcctttctcctattctatttactaagtaaaagtctttcccagtattttatcctaatatctctcagtatatatatgttcttccacagcaaccttatttctccctcttgatttcatttattacctctccatttttttttttttgagatggagtttcactcttattgctcaggctggagtgctcactgcaacctccacctcccgggttcaagtgatccacctcccgggttcaagtgattctcctgtctcagcctactgagtagctgggattataggcacatgccaccacacctggccaatttttgtacttttagtagagatggggttttatcatattggacaggctggtctcgaactcctgaactcagatgatctgcctgcctcagcctcctgagtagctgggattacaggcgcataccaccacactcggctaatttttgtgtttttagtagagacggggtttcatcatattgatcaggctggtctcgaactcctgactgcagatgatttgtccgcctcagcctcccaaagtgctgggattacaggcatgagccaccacacctggtcaattttccaacttttaacctagcttttatattctcttctaaactccagagccatatggaactgttttcttggtgtagagctatttgatttatagttatttggttatggatacacacatgaacacacactatatatgtatatacatatatatacacactacatatatatagtactaataattatgtagttctttatttactaaccttgtatggaccacatcatcctcattttaatatgtatagagattatcacagctacatttacatataatacaccatagtatttgttgaataaagaaacagatgtcatagcaaggtgtttgttaatttattgtaggagagtgtttgcattcttttaatataagtttgtgaaggaagttaaaaggactgaatagaaaatcactgaaaaagattattgcaaaattaatgagttgccaaaatgtgtgaaaagtcacttgggttaatgatccctcaatattttcatccatctggattatgtgtaatcatttccatcttctctcaccctctttgacttttttagtttttaaaagatatgcctacatacattaatggcaaaatgtccctatactaaacgttatgagtttatgaccaactattgatagaataacaaaaaatataagcaagtcgtgcataataaattaagaatatttcagagattggaaggcagcacaagaaggtgggtcttaagttggctattgttccaggtgacctacatggattttaaaatggtaatttcaagaaacataaacaaaaagatgaagacgtatttgtgaaaaatatgaagaagcctgactatatggagagatcattaagaagagaaactgtatagaaactaagtaagtgaatgtcatgcagagccatgagtaataagtggacagatcagatttaataaatgaggagcttatatgtgtcataaatatagtagagaagacatgattaaaacaatgcttgagaaaaattatattgcaagaatgtttcttaaaaactgagaaaataaaattctgaagagaaaataataaagagaaactacagacaaagtaatgagaacctcaacaaaaacagaggtagtgaaaatagcgagaaaggttttgaatgcacagaacattttagagaaaacatttgcaaatctcttaacagattggatgtagtgtagtgccaagcagatgaaagggtcacctccaggggcactagacttgtggtatttccaatagtagaaagtagatttattaaccaagtagctcattgtcatttagcatatctcatctccattcaacaaacttttatggaaggccaactgtgccaagatactctactcatcattgtggaaatcactaagactacaaaaatataactaatttctaacctcaaggaacatattgccctgaaaagaagctaaggtagatttccatacttaccaatatataaaggagaattttcaaatttggcaaaatcttctatataggaaatacccaaaggcaggatgggagtttcacccattccacgtacaatattgcctactaggacgtacacccacattaatgatttaacttcctttgtacactctgcattaaaaaaaaaagacatgacattagtgctttgacgataaagtgtcagtaatattaattctatgttttctgtaggcatttcacagttatatgaccatggccccttgtcaatgatttatattactattccagcagtgacttctcagggcacccctagtgcattttctgacagtggacttgagtatggacaagtgtaagtgatatgctggagccagtccctactgagttgggagagatgagtatacacacctcctcccaactcagtgttcagtgacacctcattggtagtttcatagcagtgttacaccacagaaattggcaaacattaaaaatcaaagagattcagtttctccacaactcctggactcattcagctgctacaagtgcttccccattcctacccaactttggggagacaaaaatatatttctctagaattggtactatatttataagatttaaacaaaagttcgctaaagtgtgaattctctacagctctaattatttcatagaaactaaaaatatttaattgggtaatcatcataggttctctatagagcatgttgtatactgtaaccaccaaataactttcaatacagaaatccactccaatccttggagccgcagctgcttagtagagtaacaaagactagaccaaagggaatagaaactgagaaagatagggagatctctgaaggattctgtaaatctctttgccatctatgttctaagccaaaatagctggtaagctgtgaggaagctctgtggagtcccgttttcagggatctgaaggacaatgcactctcacctcctataaatttgccaggtgagactgtgaggtcctgaccacagctgggtccaggaatttcttgtgagtgctatctctccattatttccagtcggaaaataatagtctctatttctaggtattcagatttgtttgtgtgatgcacaaagtgatttgtgtctagagatcacaggcaaactctaggcctattctagggcaaaattgaaagcatcaatccaccttcctggagatgtgccagaatgggaaggttttgctatatccacaatgaagccgactagcacctgggtcagtctttggcaatagcccgctcaggaagagaacacaggccactattaatgtcattgttttcctttgtttcccccatgggggttctttggcttcttctgagacagacatttttcaaatttttgaaactgttttggtttcctgactcaatgatggtcatgaaattcccacccttgtggactactgcaatttccacaaacatgaatccagaataaaaatgtccccataaaaatgttgagtcatcagagtcatctccagaccaagtataaccagaagattatacaagtctcttagcagaagggacagaaggggcagaagccagtacattggtgcctagggctaccagaagctgaaagaagcactgctattgtgtagaattttaaagcactatctccagtagagggggaaaaaaaaagagcagaaagacaagttcctaagtcaatagaaagggaatagagtaattcagaactatagcgtacttgcctgttttccccgctattaaagatcagtgatagaacacaaatctcttgaactttgtttctgtctctagttcctatttacataatcatatacaccaaatcatcagcataaatccatccttataagatgttttcctctgtgggatgaacttaacagtggtccttggatagatgtctttgactctttttttttttgagacagagtctcactctgttgcccaggctggagtgcaatggcgcaatcttggatcactgcaacctctgccacctgggtttaagcgatcctccagcctcggcctcctgagtagctgggattacaggtgcccgctaccatgcttggctaatttttgtattttttaatagaggtggggtttcaccatgttggccaggctggtctcgaactcctgacctcaggtgatccatccgtctcagcctcccaaagtgctgggattacaggcgtgagccactgcacccggccctttgactcatttttagataacatgttaataaataaacaaggaactctcaataaatacattcaaatataagaaaaataacattctttattattagctattcttattgcccattgtaactcctttggaagttcctggagagagaacatatctttgtttatttatctaactcaatcaatatctcattcaagcccctcagcagaaagtgtttagttataagttcgctgaacaaaaatcaatacaatgaagtagacaacctgatggatcctgcgttggtcttaaaatctgggttccattttccatacacaagaaactgtttgaggacaagttgcctgaaactgaaactgtagattcatattcatatctgtataaacacagggaaaatgagtttattttaagaaagtaatgaggacaatgtgggcaatgtgcagattgttaccttctgcttcccatacaacacaatatccaaatccagtaaaaatggcttttcatccttggcatccaagttatcataagttaatatcatcaaaaaacttgccactttctgtaaatgaacaatctttttatacttagctttcaataatctgcctgtggatgatctacctttagattatcaaatatcaactttctttgatttttaggttatcatttcctggatataattattatgagataaggaacacaaactttaaaaaatgtgacattcaataatgcataattaagaagataaatgctttggaaggaataacaacaaaacaagccttcaacttggcattctctaaagtttgctcaaaagaagcgaaacctccagtttctgagaaaccgtacaataactcctccatgcgtttcataaacccctaaaaaaaccaaaatatttgtccatcataatgagaggccttaagagaatctcaatcaccatgacacataatgtaatgactttttctcttctcataagaacaaatggattaataaactatgaccatttaatttaagcaaattaccacaagatccacatgcttttcctcagaaagtaaattacatgccgtaagatgggaaaaaaagtatgttcaaagtatgttcagtgaagtctctgtttgttagaaataatgctggattgttttctgtatttctattaaataaggtagtcagaagaaaacttgcccttctgagttctacaaaagctagagtgttatgcttggatgccactgatagtcttaatttctgtgctataggatataataaaaaggctcaaaataccttccccttagaacaattgctcattgatgcccaaagagtttggctgtgaactatagacaaaggcttctgtctccatactcacaatcctatgagacatgacaacctcaaggaaataacacctttggcaggtggtagaaagaaatgtatacagtggctgaatattacttgacattgttttggataggctaggaaataaaagaaaaggaaagactctgcttagaaactctgatcccttcaaaaatactttaaaagagaaaatatgttttgttaatttatccactaaaaatccagtaactcaaagtctattcattcccaaagcatcagcaaaatgacggtaaatagattttcaaacagaatggggaaaggcatgattccacaaggataaaaaaaatagggaattttacaataaaagagagctcaacaagattttcaaaatggaaaagcaggtaactgagtggtcactgaaataaaagatatgagaagtgcaactctaagtgcctgcaaggaagcaatgctgcaaagcccaggaacattcaggcaagatacttaaatgcaaaagtgagtatgatccaaaacaataagagtgcaaacattttggtttaaagtttgtttaagaaacattcaactcccagagacatcccctgccactccagctgaaaatgttcattgactccagagtctggagaggcacactgagcatagaaaggcaatacaaaaaaaatgggggtattaagttaaaaaaatctacatatctacatattaaacagtgagattccaacttccatttggctggtagctaagcttctacctcccaaggaacagattgaagaattcctgtctaggataacaggttatctgcaattctgagccatgtgcgaaacagccagtccctgcgtaatgactctacaaagaagtcctcctttaaccaagtcctacacatatttacagaacttccagctggcttcttgttgttgttattcctccctcttaaatgtgaatagataacaaacaaccaccagatatatgagagaagtctgtaacagtaaagacagttacaaacaaataaaaaaacggtacacttggaggagccagagaccaagaagaaagatgaacaaaatttagatgggaagagataatgcattcttgaaagaatagtatgttccttaaaaagggacattcaaagaataagagcccttgaaaattaaaaatgtggtagcataagctagaaagccattcaaaggcatggaaaataaagttaaatctcccagaaagtaacaagaagacaagaggacaaaaaagtagggataaaagatgagaaaaacataaggttaatacaggatgtccaatattcaagtaatagagatctagaaagagaaaacagtgttatgaaagaaggtataggggagatattatcaaagaaataacaaaagtaacttttccaaatgtccagattgaaggctcctggcacaatggaggagacagatttataccaagacaattatcatgaattttggacttggagcttaaaagaaaattccaatagtttccactgaaagaaaactgatcacagagattagaacggcataggattctgaataataacacttgattacaagtgttagatagagctagaaaacattgggggaaatgtcttcaaaatccctagggaaaatatttccaatctagaattttatccaagccaaagtaacaatcaaatatgggagtaaaataggagtattttcagatatacaaagtcttacattttatatttctcttgtatactttcttggaaagctactagattatttccttcacaaaaacaagtgaagaggaaagaggaaagcaggagacatgacatcccagaaaatgaataactgaatgtatgaaacaggtaaaaagcaaattctcaaggataataatgagagaaaattccaaggaaatagcaatgcagcaggcctagagaattccaagttcagattgcagatggagaattgaaagtgatatgtgaggaatctccaagacaaaaataatacactgtgatatggataagaatattgaggagacatttgccctaccagtggagaatttggtgatgaattcgtgaacaatacaaagaaagctaaccatatgatataacgaggtaattattaaatctagggaaaataaaaagttatataagtaaagaatgataagcgcatggttcagtggtaaaaaagatttacataattatacaaatgtaaatagtaaaaatgattttatagtaggaattcaatacatattgtgtaacactaatgtatagacatatctcagagacattgcacgtttggttccagattgccacaataaagtgaataacacaataaagcaactcacatgaatttttttaattttctaatgcatataaaagttatgtttgcactatattgtagcctattaagtgtgcaatagcattatgtctgaaacacaatgtacacacagtaattgaaaatgttttattgctaaaagatgctaacaatcatctgagccttcagcgagtcatcatcttctgctggtagaggctttagcctccacgctgatggctgctggctgatcagggtagcggctgctgaaggttgtgggggctgtggaaatttcttaaaataagacagtgatgaagtttcctgtggcaattgactcttcctttcacaaaagttttttctgtagcacataatgctgttgtgttgttgttgtttgtttttgagacggagtctcgctatgtcgcccaggctggagtgcaagtggcacgatctcggcgcactgcaagctctgcctcccgggttcacgccattctcctgcctcagcctcctgagtagctgggactacaggtgccaaccaccacgcctggctcatttttttgtgtttttagtagagacggggtttcaccgtgttagccaggatggtcttgatctcctgacctcgtgatccgcccgccttggcctttcaaagtgctaggattataggcgtgagccaccgcgcccagccgcacataatgctgtttgatagcattttacccacagtagaacttcttccaaaattggagtcaatccttgcaagccctactgctgccttatcacctaactttgtgtaatgttctaaaacattagttgtcatttcaacagttttcacaggctcttcatcagtagtagattccatcacaggaagccacattatttgcttgtccataaacagaaagtcttcatttattcaagttttattatgagattgcagcaattaagtcacatcttcaggttccatcttaaattctagttctctttctctttccacatctgcagtgacttcctccactaaagtcttgtgactttgttcactgaaatcttgaacccctcagggttatctaagaggatttgagtcaacttttcaaaattcctgttaatgttgagattttgccctcctctccttttcctagtggaatgtagaatagtgaattctttcgagaaggttttcaatttatgttacttagatccatcagaagaatcactatttataacagcaatatccttacaaactgtgtgtcttacataataagacttgaaagtccaagttactcctgatttgtggccacacaatggatgttgtgttagcaggcatgaaaacaacattcatctccatgtacatctccatcagagctcctgggcaactagatgcattgtcaattagcagtaatattttgaaaagacttctcctccctatctctgaaagtccgagatggcatcttctttcaaaagaaggctgtttccacttcgggaggccgaggcagacagatcacctgaggtctgaagtttgagaccagcctgaccaacatggtgaaactccgtcactacaaaaaatacaaaaattaactgggcgtggtggtaggtgcctgtgatcccagctacttgggaggctgaggcaggagaattgcttcaacccaggagtcaaaggttgcagtgagctgagatcacgccactgcactcgagcctgagcaacagcatgagactccatctcaaaaagaagaaagaagaaggagagggagaatgagaaggagaagaagaaggaggaggaggaggaagaggaggaggaggagaagaagaggaggagggaggaggagaagaagaagaggaagaagaagaggaggagaagaagaagaggaagaagaagaggaggaggaggaaggagaagaagaagaaggctgtttcatccacattgaaaatctgttatttagtgtagccaccttcatcaattaacttagctagatcttctggataacttgctgcagcttctccatcagcacttgctgcttcaccttgcacttttatgttataaagacagcttctttccttaaacctcatgaacccacctctcttggcttaaaaatttccttctgcagcttcctaatctctcttaactttcgtagaatagaagagagagtcttgctcttctggctcaagggaatgttgtggctggcttaatcttctgttcagactactcaaactttctccatctcagcaataacactgtttcactttctaatcatttgtgtcttccttgaaatagcactttttccttgtgttcacagcttggctatttggtgcaagtggcttagctttgggcctattctgaatttcaacttgccctcctcgctgagcttaatgatttctagcttttgatttaaagtgagaaatgtgcaactctttctttcacttcaacacctgaaggccacaatagggttattataataattggcctaatttcaatatttttgtatctaggggaataagggggcccaaggaaagggcaaaaaatggggcaatggctggtcagtggagcagtcagaacacacacaacatttgttgattacattcaccatcttaagaccagcacggtggctcacacctgtaatcccaacattttgagagtctgaggcaggcgcattgcttgaacccaggagttcaggaccagccagggcaatatggtgaaatcctgtctctaccaaaaaaatatatatatatacaaaaattagccaggcatagtggcacatgcctgtagtttcagccactggagaggctgaagtgagaggatcacctgagcctgtggaggtcaaagctacagtgagtgagatcgcaccactacaccccaccttgggcgtcactgtatctctaaaaagaaatacataaataaataaatcaccatcttaaatgggcataagttagtggcacatcaaaacaattacattagtaatatcaatgatcactaatcacagatcgccataacagatacaaaaataatgcaaaagtttgaaatattgcaataattatcaaatatgacccagacacaaagtgagcacatgctgttggaaaaatgattctaatcttcaacgtagggttgcaataaaccttcaatttgtgagaaatgtaatatctgcaaagtgcaataaagtgaaatgcagtaaagcagggtatgccaggattcaaaactaatagaataacatttagttagaaatacagaggcaaggcttggccaggtggctcatgcctgtaatcccgcactttgagaggccgaggtgggcggattgcttgaacccaggggttccagaccagcctggccaacttggggaaaccccatctctactaaaaatacaaaaattaactgagtgtagtggcatgcacctataatcccagctactcgggaggctgaggcaggagaatcacttgacccaggaggcagaggtttcagtgaaccgggagatggcgccactgcactccagcctgggcgacagagtgagtgagactgtctcaacaaaaataaaaacagaggccgaggcgggcgggtcacgaggttaggagatcgagaccatcctggctaacacagtgaaaccccgtctctactaaaaatgcaaaaaattagccaggcatggtacctgtagtcccagctactcaggaggcttgagacaggagagttgcttgaacctgggaggtggaggttgcagtgacccgagatcacaccactgcactccagcctaggtgacagagcaagactgtctcaaaaaaataataataaataataaaaaaaaaaaacagaaaaaaaagaaagaaattggtggcaaatacaagaaagagctaaaagttataagcacttgcctctggaaagcagtaataagtgacaagggagacctttttgtcaatgtaagcttttttgtaatagtttttatttttatgactttgtacatagttactttggtaaaaattaaaagaaaaatcagccttcagactgctctgtctcttggtgatctgcaattaagcagaatctcattattaattagaagtatttacatggtcctgagaagggaataatcccaagtttcggctggtcctgagaatcttttcaccagactcaactccacaagaaaaggtcccaaatccccattgtgtaaattgacaaaactgactgcttaagtggaagtgaggcagccaagagcaccaaatagacagatggaacagaatgtgcatcttccccttcccattacagtgccctatgctgttggaaagcattgctcctagagaggaaagtgcaacttcatttcctgcaagtgaaatttgaccacccaaaattatcagactggagtacttactggttcatgaggaaatgaggtagtgattttaagaaacagcctaagcccataaccacacatccaatgccaatcattataggtctatgcagtttggttccaaaataactcacaaatataatcaacaaaagatttcctaggaaaaaattgagaataatcattttaaaaagtatgaacaaagtcttaattaagagcctcacccaatcatttacattctagcatttactgcataacaactatcttaaatacttggatttgtgctagggttgcattaaataataaatgaatataacacaatccctgccccgaagaagggttctgttttgcaatgtagacagatacagaaacagatatctctgaaacaccaacatttacagaggggagaagaagagaagccggtgaaagggactaaagaatggttctgggaaatttggaaggctctatttgtgactatctagacttgggaaatgaggttcaaaagaaggtgtcagcctgcatgtgacctctggcctctctctcaatgcctactccacagaacattatcatgttttcctatgcccagaaagagaagcaaaagtcaaatttaggtagctgaatgttttgtaactcattgtttaaaaatatcttcattttggtcaacatgaccaagacagggatctattttttttctacttctttccctagatcagacaatgcagtgaagtaaaaattagtagacccccacttctactcagtcttcagtgagtctggatttgaggaataaaaatggcaatgaaaaatgtatccgcatgtcttaggacgaagctttagaataaagaaactaatgggggaaggcccatctgatggacagatccttgaagagtgtggaataaagatttgaaaaaaacaaatatacgaataagttttttgcaaaccatacatttttaattcagtaaataatatctaccttgcccccactatatataaagaatgcctctgcaatgactcaagattataaaaatttcaaaattttttttcctcaaggagttaataattttctaagtggtgtatattttgaaaagttttctttccacctgtatttttctctagtctgccttgtgtgtagaagatatgtccatttgtccattattttatatggagagcgccccaccgcaataactatatcagccacattgacctctctagttttctaaaatctcatcaccaagcccatccgtgttacaggtagtgtctccagaggccattgtttgaaatccatatctgttttttgaaaggagaagaaaggaagaactttccttcttcacgtaagagtgagttcatgttttaaactgccttgctctgtcaggaaataattgcaatgagaaagcatgggaaaaggtaagtaatttttttcaaaggtatggagaatgttgcctgtaaaactgactggggaaatataagctaagtgatatgtttattgccttttgtaaatttcacactatttctaatcatcattctcctcaagctacctatcaccacccactagtggtagaaattgttaatatattctactttatcaagaaatttggggcaatcaaacatgaaggcatttgagttttccacctgatggccttaccacgttccttcagtttgagaagttgtggtgcccatctgaccacccaacactaaacacatcaccagggcactgccattttcttcagccacttactctagtaattaaaatctctcatatgtattttaagcctctctctctcaactagactttagcctacacatattctctagtttctctccaaacttcccagaacattcatccatattcatagattccgcttttcccccctccctaatcccctatcgtcgctcctaccttcactgcttcctagcgtctaaatttgttagtgccctggcaaagatcatcagttatctccatattatgaaacccagggaatagttcttcatccttgtctaactggatatttctaatgcttttcacactgctgatactttttttttttttcaaatttctactcctttgtttttcataataccattttctcctagttccccctcttgtttctctgaccattccttctcttaacatagactccttttcttctacctgtgccttaaatgtttgtgcagctcaagatctattctttgtccattgtaattatcaccctatatcctctccctgaataacctcataaattctctctctagttttagcaaacgcctacttacttgctaatcaatagctccagcccagatagttccccagtgcttcagactcacatgactgcaatgtgaacatataactttgtcaccaattgtcaccaatagaagttacagatatgttcagatgacaatatggctgttgcaaacaattcaaaacattgacacaataattactttaaaattagtaactttttaatttaatgggttgattaaaagtacaaatattactatataaaaatttgttttaatattttgataattctacttcaatataattggcttcctttgcacccatatagttttttttatgcaattaaaattattactccgggatcatatggtgttagaatgctaaaagggtcctgggcacagaaaggttaataatcccttccaatcctcagtgacactccctcacctagaaaattaaaaagtaaatgccatagcaggcacacaaagctctcattaacccatttctcacccctgcccatttctgcaggctcacattcctaatcctttccaactttatcttggctagccaatattatcaagctgaatgttgcttctcacataggctattgcactgcatccttcttaggctttttctactggaattttcttcacacttgcttaacctcatttcttctcctagaaaattttagctatcctccgagagtctggcttccctaaatgagtctgtgtttcttctgtccctgtaagaccttgtatatatctatgctaccaaacttacttcattcaattaatactattattatctgcatctctaccttccgttagattatgagctgagtcaattcgtgggctatacatggagttagttctaactctctcactgggatcagcacacaggtgatacaggctaagatctaaaggagttgaacactagtagacaagatcaagaatcacttgtttcagttttgcttctcctcaatcctgattttttaaatacatttatattaaaggaaattatcaccttgaagaaagtggaagctattataaaactagaaaggagtgacacttatatttctatataacttttttcatggaagaaatcttcctttcccccattctccctctctatggtcacatattcccagtcatccacaaaaatcagaatctatgagtagactttatttttctctagaggctgcctctgaaatgaattcagagagctataaaagcagtcttttcttctctctgtacttagaaaaaaaaattgtcaacctcccagaccaaatagcagaaaaatatttgcattttcatttgtaaggcaatttccttgatctccaacaatatcttctacatcttctaggtcttctaccttttcttttttttttttgagatggagtctcactctcacccaggctggagtgcagtggcaatctcagctcactgcaagctccgcctctcgggttcacaccattctcctgcttcagcctcccaagtagctgggactacaggcgcccgccaccatacccggccaatttgtttgtatttctagcagagacggggtttcaccatgttagccaggatggtctcgatctcctgacctcgtgatccacccatctccgcctcccaaagtgctgggagtacaggcatgagccacctcgcccggcggtcttctacctttgtatcttctaaatacaaagatggaacccttagtatcccttagggttatcaaatgatatttaaatataaatactgtaaatactctgctactcatgctacataactaagaaactattagaataaaaagaacaatggtaggatatgtggcaatatttaggtgttaatatgaggtaatatttaaatgaattatttccaagcatattctaagcttagctaatcagttagttttagaaaacttataactcggtcagattaaatgacctaaaacagcaaataaggagaataaaattcagactagctccacagataagacaaaatacaaaaagaagaaatgcaaaaataattcattaccaatctcaaagcttccattaatgaatccaactagagatgttgggatgttgaattgtctctctatttgtgtgagcatggaattcatataagatccagacagtgttttggatacaaatgcacatgttattgccaacagaaacatctaggaaaaaaatataagaaaacgtagaaaaaattatttttaaattgtatacttgccgtctgttgacaaaatgccttccaccataagactgattgtctccaacttaagtaacctttgaatttgcaagaaactgtaaagtgtagtctgctccttttgtctgtcatactgtgatttctctctgaaaactcaaagtgagactaattttgtaggcagttgcagcctcaatattgtataacatactggtacatacatagaaacaaacagtcattctaagtaatacatagctgataacttaaacatgtcttcagagctacaatgatatctaaagtacaaaagaattcatacatgtactgtaatgaaaagaaagaatgcagaattatacaaagacattatttcggtagcaaatatacttaagttctctctgcaggacaataggtccccagattaccttggccgactccactctttcctgttcttgcttgcaattcttggtcagaaacattctgcattctcagcaatgagggaaatatccagaacaatctgagttatgtcctcattcttcccatagtaggatgctctgcaacccttgagctcagcaatcccagttgtgtctaaggcatataagcccaggacagagtattttcagggtttctcagctgcagtgtaaatggaggaccacacaaaaatgagactccatttattttgggaagctttcctgaaccttggagaatcagctcacctggaccattggcttctgtttatccttactgcttgcctaatatatatactataaatttccataggttttatcaatcatacttcctattattggtatagttccaggaaacagtgaggttgatgcaatccataacaacatcagggatgagttcacagatagaaccactgtgatcaccaggagctactatggttttactgaaaatatgaaaagttaaaattcatattttaaaattaaatttaaaaagatagcttttagtaagaggttttaaaacaggagcactgtatactggtaatagtatagttaggtagattaattactgcttcaaaatgaacaaattatagatagatttacatcaacttgaatggtggtcttcagtcacatgccatagagatttttgcttggtcctattgaagacagtttctgatgacacttgcaacctgggagaccatttgacctactatttacctagcacactcaaattcttaaaattctcacaccttccaccttccacacctccagtcttgagccaatcacacaacttattttctacctcacatattcctttcaagttaactcacaaccttttctgtttctcagtctccaacccagccacattctctctcttcatgatcagcaaatgatatcagcaacttcacctgcaaacttacctctatccctaccttctctaatttgcctatgtctttagaaagattggtgtccctttcctgtacataaaatccctccaatcttgctcttgaatccattcttcccattttcgagattctaattcatccgttattgctcttttctctctctctcttttttgttttgttttgtgttgttttgttttgtttgagacagagtcttactctgtcacccaggctggagtgcagtggcataatcttggctcactgcaacctccacctcctgggttcaagcaattttcccacctcaggctcccaagtagctggggctacaagtgtgtaccaccatgaccggttagcttttgtatttttagtacagacggggtttcaccatgttggccaggctggtctcgaactcctgacctcaggtgatccgcccaccttggcctcccaaagtactggaattaaaagcatgagccaccatgcccaggcttttctctctattttcaacctcacaccctttattgcttgtttccccactagcttattaatatatccaaggcatttcttgccttttgagaaaaaaacaaaatgaaacaaaacaaaacaccttccctcagccttgatggttagctactctagctaccacaaagctgtttagaagaatggtctagactctagactgtttaaccttccatccaccctatagtctgctacaggctggtgtttcttgaaactacctccataaaaggtcataaacaacttcctgattcccaaatatcccaaatccacaagctatgtctgaattaccatcttacttcgtgactctcagtcatttgatactattgatctctcttttcttcctgaaattccctcccccatgcatacctatatctctgactaactgctcgattctttctctcttctttggtcaaccctttcaggcctctgtcttgtactccctacccttttgctatgcatgctgtctttaggaagttcatgctcatccatgcttttaactaccacacgtatgatgaaacctctcatatgtatgaacagtttagctcagacaattgaaatcctgtttactctcctctagccttgtctacctccaacctctctttcacacgccacctccactaatttggatcataattttttgtcaaataaattaataaaatacatagttagcaaattttacttcttaaaacttttcagtaattcccataaacaaaaatctctgatttttaagatggtaaacaaagcctcatctgtatttcagtatcatctcctgttgcttgtccttagacacagtgttctacatgtagctgtgttaattaaccctgccattttataggtcagtgcttttgtataatattcctccagttttaatgcctttcttccctttgttcacctggtcaatatataattcattctcaagactcaggtattttattacttccattgtgaggcctcttttgcctctgtgctccccaggtaagccctaaccattcattcattctttatcttcccaccctactgtgtgcctaacttgattacaacctctattacagtgtactttatttatggatttagatgtctataagttcctctctcattattctgagagcaagtcagatacaggagccatatgttatttacccctgtggccctggtgcctactaagtgcctgacaaatagcaggcacccaatacaagtttattgaattaatgacagaataagtatcaaaaacatcttgaagaaatcagagctgaaagtaaaataaaatcaaataagattaaatatactgttttcatccatctgggctgctacaacaaaataccctaagccgagtggcttataaacaacagaaatgtaattctcatagttccaaagactggaaagtccaagagcaaggcactaacaaatttgggttggctgatgcctgtgaacccaaaagtatctgagacagttctcaatcaatttagaaagtttattttgccagggttaaggatgtggccataacacagcctcaggaggtcctgacaacatgtgcccaagatggtcagggcacagcttgcttttatacattttagagagacataatacgtcagtcagtacatgtaagatttacattggtttaatctggaagggcaggacaacccgaagcagggggttcccagtcataggtagttttaaagttttaaaatgtgctgattggcaattggttggaagagttattatcaatagaaaataatatctgggttataataagggcttgtggggaccaaggttctatcatgcggataaagcctctaggtagcaggcttcagaaacaacagatgtaaatgtttcttgtcagacttaaagtctgtgttgatgttagttctggttggttttttcctgaattccaaaagggaagagggtacaatgaggcatgtctggcccacccctccttcccatcatggcctaaacttgcttttcaggttaattttggaatgcctttggctgagaggaagggtccattcagatggttggggtcctcagaattttatttttgctttacattctccctcttccacctaagatttgccagaggcaacagcaatgtctaccaaatttttattttgtctcataccattgtgggggtggcatggctgcctgcttgagatccaccctgtccctcagtgggaccccctatggccaaggtacttagagtcaaaagacttatagcaaattaaatgttctaggccagataggaatggacatggacaagtattcattaccccttaaatttttttcagtaaaaagtcaacaaacagaaagccaaaggccaggttacaaaactgacttatctttaacttctatgcattgagctactataatcttggttttagttatggacttatagcaattagctacacaaaacataagcattgctctgaaaaataattttttaatatatactgaccaggcaccgtggctcacatctatattcccaggattttggaaggccaaggtgtgttcatggcttgagcccaggagtttgagaccagcctgggcaatatggcaaaaccctgtctctaaaaaaatacaaaaagacaaaaagctagccaggtatggtggtgcatgcctgtagtgccagctacctgggaggctgaggtgtgaagatcacctgagcccagaaggtcaaggctgcagtaagccttgatggcaccactacactccagcctgggtgacagagtaagaccctgagtgagtctcaaaaaaagaaataaataaatgaaaataaactttaaaaatacatatctatctatctgcacagctcataactgggagtcttatatccagaaggctttgtcacaaggtatctttatcctctcagtagttattttcttttaattctacaaatagcatgacattcttcatggttgggctggatgaaaagatgcctcataatagctcagagggcaaaaaactttgttttaccagctgtttaggcatcgtgtacccatccttggtttggatgatctgaactaattcacttcctcaaacctagcccttacaatctcacacacccacctcttccacaacagtccttaggcctagagggagggtgcttgtatagtcttaacagaagggcatttgcagtgaaaaacagatcgggctcagtgggatgacaaatgagagagatttgcatctctagtcttgagaataccatcattccagtttccttggaagtaaaccaaggagagataaataacattaatattttgacaatcaaaagagtatttgtgtgtcagaatggaaaatggaagctatctcattagggattcaactaaaaatgtaaagaaaaactataatccgctatctctttagaggattattatagccaagaaataattcatgattcaatctgcattcaaaaacaaaagtcagggctgaaatccagtaacaagtgttaaatttttcctttgaaacaatttttctctctctctagccctccttttctattaaagagaaattatagtaagaccagtttgtgtgtaaaaataagttttaggcttattatacttggcctgattatttgcataaagtgcagcaagaaattgactgaccatataggctctttttaagttggctttgctggaaatttacctgcaaatatgttattctagtcaaagacttggtaaaataatcagtgtctccaattgtcctgttataaaacaaaagactcttactaaacttatgcaaataactatattgtcataaaaccagaatactcacggtttccaaatttgggagaacttggagagaaaggtaaatttgctcataaaaacatacttcacccaattgctctaaagaataaataatttaaaagaaaaagattctcttgactctttaaccagagcatcagccttccaaacaacatgtcctttgttcaccttgaattgccattcacatgctaagcagttcttgttatatgagagctgtttaccaggcactgtagaatctagcagctccttacagagtcagagtcagccctaggggaaaaagaatgctctctgctcataagtatctcctctgcatcctcaggtagcaagatcctatgcaaacaatttttactttattatggaactctttggggtaccattatttcctttagcaaaggggtagcttcagttaacattccataacaaggcagtaaatgtccctcaactggaaattctctagtctagtatttgtcattgggaagtgctcccagtcttttaccataagccctaataaatgctccacaaatggatatgaagtggagaatttgtccctactagcccttcagcttctaccctacattgtgtaggctcaggcaatcttactagtttccatttagtgtgtccaattaacattcctcaaagggcacatttacatgacttcagtttcatagtacttgataggagaaacatcccccaatcagatacaataccaattttcacaagatatttaggtgaagaagttaaaattaccttacataaaggctgtttagacatctcaaatttcataatcctatcaacctgtacatttttatgttctggtttgaggaacttttcttttctacccccagaccattttactttttctggtgaaaaatgatttgagttcccagcaagggattgagccaagggacttgggctcttttttcaatcttcatcttaatttgcctcagatttgccccaggcaatttcagctccctcattataacctttgccttttgctgtttcttcaatttccccaatctggggcaaatgcagaaaactgatatggggccctttaatgttggaggatcagtaggggttccctttggtccactcaacccttgatagtgttgtaaagacctttgtttcaaccccatcaattttcattttatttatttcatttcttataaaacgtccaaatattttaatcaccctctggggtgagtcctctgactcccttttgcctttctcattattctttgttaattaccccagtgttttattaagcatctgtaagacccatgaggacagcaaatttgatcagtctgtgattctgtggtagtaatgtcacctggagtgcccatgtagcacttaacctccaaatttaccatgtgatatggtttggctgtgtccccaccaaaatctcatcttgaatagtagctcccataatccccacatgctgtgagagggacccactgggaagtaattggatcataggggtgggttttcccatgctgttctgtgatagtgaataagtctcacaagatctgatggttttataaagggcagttccctggcacatgctctcttgccaccatgtaagacatgcctttgctcctcctgcatcttccatcatgactgtgaggcttccccagccatgtggaactgtgagttcattaaacctctttttctttataaattacccagtctcaggtattttttcacagcagtatgaaatggactaatgcagtaaattggtacagagagtggagtgctgctgtaaagatacccaaaaatgtggaaatgactttggaactgggtaacaggcagaggttagaacagtgtggagggctcagaagaaaataggaaaatgtaggaaagtttggagcttcctacaggcttgaagggctcggaagacaggaagatgtgggaaagtttgaaacttcctagagacttgttgaatggctttgaccaaaatgctgataatgatatggacaataaagtccagactgaggtgttctcagatggagatgaggaacttattgggaactggagcaaaggtgattcttgctatgctttagtaaaaagactggcagcattttgcccctgcactagagatcagtggaactttgaacttaagagacataatttaaggtatctggtggaagaaatttcaaactaaagctttcaagaagtgacttgggtgctcttaagagcattcagttttattaattcacaaagatatggtttgaaattggaacttatgtttaaaagggaagcaaagcatgaaagttaggaaaatttggagactgatgatgtgataaaaaaggaaaaacccattttctgaggagaaattcaagatggctgcagaaacttgcgtaagtaatgagaagccaaatgttaatcacccagacaatggggaaaatgtctcccggacatgtcagaagtctccacagtagcccctcccatcacaggcccagaggcctaggaggaaaaaaaatggttttcttgtccagtctttggacttggtgctctgggtcccagccatgggacccagaaggagccaatgtacactcaggccactgcttcagagggtgcaagtctcaagctttggttgggcctgcaggtgcataaaagtaaagaattgaggtttgggaacctctgcctagatttcagaggatgtatggaaacacctggatgtccaggcagaggtatgctgcagaggcaggaccctcatggagaacctctgctagggcagtgtggaagggaaatgtagggttgaagcccccacacagagtctccactggggaactgcctggtggagctgtgagaagagggccaccatcctccagatcccagaatggtagatccatcaacaacttgaaccatgcacttggaaaagccacagaacactcaacaccatcccatgaaagcagccaggagaggggcactgtaccctgcaaagtcccaggggtggatcttcccaagtccatgggaacccacctcttgcatcagtgtgacctggatgtgagacacgcagtcaaaggagatcattttggagctttaaggtttgactgctcactggatttcaaacttgcatggggcctccatcttcttcattttggttaatttttcacatttggaatgggtttatttactcaatgcctgtatccccattgtatctaggaagtaactaacttgcttttgattttttttgatggctcctaagttaggacttttgggttaatactgaaatgagttaagactttgggggactgttgcgaaggcatgattggttttgaaatgtgcggacatgagatttggcagcagccatgggcagaattatatggttgggctgtgtccccaccaaaatctcatctttaattgtagctcccataatccccatgtgtcatgggagggaacttgtgggaggtaattgaaacatgggggtgagtttttctgtgtttttctcatgatagtgaataagtctcacaagctctaatggttttataaaaggcagttcccctgcacatgctctcttgcctgccaccgtgtaagatatgcctttgctcctcctttaccttccgtcgtaattgtgaggcctccccaaccatgtggaactgtgagtccattaaacccctttttctttataaattacccagtctcagggatatcttcctttgaaatagatacaaaacagtttgaaaggtggaggaatctatgggaaagagaagagaaatggggaaaggactcagtcttttttttaaataccaaatgactctggcctgaaccagaaatgcagttacaaatgagaataacttaaattatctgataattatagtatttacaacagaaggggagggagtcacctagtgcccctcttccaggctggacagacatcaatcctactgctaggctggatagatgcctattcaccttactacttgtaggggtctcaggcctctaggcagttatggattctcctggcgtgagcaggtagaggtggtgggattgcctgttttatgcagtgtcctaaccttggcccaccaccctgccctacaataccatgaggtctctggagctctttctgacttggaggccttccctctttctgtgctgaactaccattggcctttggagtattctgtacagtccaactgcacttagggcaggagggatttcccccacccagtttcccctgaactagtcccaagaccaaaaaagaattacttcagaggccagtgccactccaggacagtgagcaaaggggaggggagaggttacagggcactgaactggatactagtcatattcaatgggagaatatcccagttataaagacagtttcacatggcttgcatatgaagcatatcaactacattatctggggtgctccacttggcattttatagggatggttgggaagtcccatttccagagtaaacagaccttacagtagcaattatccagtcagttaggcaggttgttctcttatgaataacctcgtatacatttggatcacatatactcatcagcaatttaatagtgatttgtgaatcctgcatcaacccaaacaagctctttcattttgtagccttcaaaataaaggattctttccttaaagtagttaaggtttctcaagaagctgattatattgatctacaaaatggaacaattactttgcattataccctctggttttaatagttacttggttttgcccttcccacatattgactatcttcttggtaaccacagctctcagaggtaacttttgttgctctggtttaatttttctttctgtgggtagcttggagtctagtggcttgagctgggacagacccacctctgggcctgatccagccttaaggatcaacccagcattcttgtacattcatttagcaattacagataacaataaccaagggattgaatatttttgctttttttttttttattagtttgcatctccttatgcatttagagagctaactcctcgggagcataatccatctctaaattctaatgaattttatcttttgtaattgaatgtagctcagctgcatctccctaccataggtaaccacatggccaccctggagtcaaggtttctcctcactcatcttttaatttctctctttatccatttagttttatctatataatatttttatctttacttaaaataactcttagaaaaaaaaattctttagcaaaagctacatcattgtatttttataaattttaccaaaaacactatttactctcctactattttaactcttagtaacccagattcccattgaaaaaaataggagttatttaatttaacataacatgactttaagatgttaaactactggaggtaattttgagattaaatttaccagattagtcttacccaaaactactaaggtcatatgaattaaaaggcatctttggtagcttccttcagtctgaaaagcacttatttttcttttagccaagtgattagaggtctttaatataatttggtagtgaaatattacttctacatgacacatataaacatatagctataacagacatacagacaaaagcagatccaaaatatttttcatttgcctattttcaaaaattctgtttcttagtttcaactattaacttaaaaaggccagacaccatggctcatgcctgtaatcctagcactttgggagactaaggcagacagatcattttagtctaggtgttcgagaccagcctgggcaacatgtgacactccatctctataaataatacaaaataaataaataaataaataaaaaagcttggctttgtggtgcacacttgtagttccagctactcagaaggctgaggggaggatttcttgagcctgggaggttgagggtgcagtgaactgagattgtgccactgcactccagcctgggtgacagagtgaggccctgcctcaaaaaaaataaaataaaagtaaaaagttacaggagccaaacaaagttgaaggagagagttaccattccaggccttctcaaaagagaaaaaaactgaagcagtagggcacaggttctgagatatcaatctaaataattttaaaaagaaaaagattatagaattcaaaaattttaaagtccttgcattaagagtaactcaacatttttaataaatcttgttctaaccagttctttagtgttgcatgagtgtacttttaatatcaaagttcaatttttagaaaaactattataatttcctttaattgtagccaactgaatcacataacattttaacaaattcctgttttactaaccttattacaacttacacagaccatttacaacatgcttggactttctggtttgacataaatatttctctttcttgaacgagtcattttatcttaggacaaaaattcatcatgcaagattctttctcatataaaattacttttcttttaagctttcttaccaaaaatacctctttataactttctttacatctcttatttcctggtcctttttacctcattttatatataatccttaaataacctctgaattagacaaaaataatttacctttgaataagaacactttagaccttaagaagaatctgcccatgactcttgaaactccacagagaaagaaagggtgagtgatgcctttgttctgagtgttttaaggggttcaagtcatttgatggcttctctagattttttttggtaccagacagtgaagggggaaggagaaatagtgtggaagaaaagaaaatgaaagaacaattgtgtttttaagacaggaagctgcaacagaaaccaagcgcataatttgtttgttttctttttttcagttatgaggaattttagcagcttcagaggtctggctgctcataatttggaattctcatttgaatttggccaagttgggtacagttggtcaaatctgatgggagaaacaccagaacaacaaaaaaccccaacaatatgattactgagcactctaatgctaaggagaaattaagactagccggctgtcaattctaatttttagtcattaaggagaatcgctgagataaaaaaaaaaacccaactcagctacttatctaggaatgagaccctggctcaagactgctgtttaccatcttacaggcaggaaaaaaaaagctcaaacttgccttccctgttggaaattagctgaaactccagaaaggagttgcccacgctccattgtcatggaagcaggaaaacttgccttctttgttggacacaagtaaaactaaaaaataggagttgtagagaaaaataaattttagatcttaaccaaatttaggggattggggattctctggagtgggtgggggctcccaggcctcagcaaattgtcctatcagtttgagccataaggatagctcaggctggtaccaagtacccacaggagattcatcaaaggtcaggggcacctccactcagaatcctttcatggctgctaatttgtgaacccaaaagtatctgagacaggtctcaatcaatttagaaagtttattttgccaaagttaaggcatgcctacagtatagcctcagagaagtcctaaaaacatgtgttcaaggtggagtacagcttgctcttatatattttaggaagacataatgcatcaatcaatacatgtaagatttacattggttcaattgggaaggtcaagataactcaaagcaggaacttgcaggtcacaggtagattttaaaatgttctgattggcaattggttggaagagttattatcaataataaaaaattatttcctgtttacaatcagggcttgtggagaccaaggttttatcatgcagataaagcctctagatacgcaggcttcatagagaatggatataaatgtttcttatcagacttaaggtctgtgttgatgttaatgatggttggttattcctgaattccaaaagagaggagggtataaagaggcatgtccaacacctccttcccataacagcctaaacttgttttttagactaactttggaaggctcttgaccaagaggaggtccattcagtgctgggagcagggggtgggagggttgaattttatttgtggcttagaggctgtatatactgattcataaactaccatctttctcactgtgtcttcacatggcagaaaatgcagtgaatctctcttagtcctctattataaagccactgaacccattcataaaggctttacctttgtgacctaatcacctctcgaaggccccacttcctactgccatcaccttagaaattaggatttcaacatgggaatttggatgggacacattcacaccacacaatacatctaagccaaaatttatcaattatttttgtgagacctaaatagaaatttatgtgaaaaggacctagaaatttgaatagcattcttaatatgaatcaaaactgattgactacagcatagtatggccatatctctagctattttttatattgaataccatttgtggatattctctcttcccactataaaccttctcagagtgtattcttaagagcaaactattttcacctagttttataaatcagattttatatttaaaagcaagtcctactaaatcaagtacaaatcaaatttggaaaaataatttattctactttacatgttaagaaaagaaattagatggatcatgacctcattgcttttcccctaaaacacatgggttgcctaactagtttggttttattcgcagagtgaaagaaatcagtggctattctgactcatgtctagtgctaaataatctctgtatttataaagctggtcctactagcttctagcaataatgccctttcaacttatttcaacaacaaagtttaaagcaaatttgttaaaaatagttctttcatgcttcctaatgaattttgcttaatgagtatatttctaagttcagagaaacagagaaacctaacttgctattaagcaattgcctctcacttttacctgataaacttgtgcttacagcattttgtcttaacatccacattaatatctaaccttgctaaactccaaagcaatcaaaaattaaagacctcttgtttataaataccacttgacttttctccacaaatgcttttaatattaatagctaatatttattgaaagtttacaatattccagtcattgtttcaaacataaaagaatcctataaggtgggaatgttgctattacccttttcagatgagaaaactgaagcacaaaaagtttttcttaattaacataccatttcaggcaagtctattttttttagatttatatcataattctccaattttgtatacatgtttaaatttccccaacacacatataaatggaaaacaaacttctgatagggagaaaatgagtgacagtgtcttagttttgaaaccacttgcaggcactagctatagaatcaggacaaatgtccagatcccttggtttatcataaattcaaatttgtttgaatataaatgactttgaagctagaaaacagaattttctctgaaatagaaaaaaaaatcagaacagctgacaaaatggccatttttcttacaggaaattattgttatgttgccaaagcttaaagaaaacatttgttttgctgggtaattgcatacaaatcaacaaagcatttctgtgcaatgagccattttcggagagtgactcccacatttctctgggttagaaaccctgcaagagtgagcatggcctttgatccagaaaaataaatcctgccacagtatgtgtgcctggaaatttttaggatcctgtcttccatttaagtctctcaaagccatttaggactaacttgcctgaatcaataatcctgtgtagacacaccctcagttataaaaccaacttctttaaagcaagaaattatcaatagaacaggcaatatggcattaatattagatcacttcatgcagataggagcaattttaccaggactgtcgtattttaaaaactagtgtacatgcacatatatccacatacaaaaattccataccttcaacttggaaagacatcttattctatgggtttcaattcttttctcagtttctcccatgttgctcttcagggtgttccaagctatttatgttttaaatcttgatatgtcttacttctaccctttcaagcaaacaaaaaaatatgttaaattaactacaaaattgtaaagcatcattcttttgaagtaagtgctgaaaatgaacaacataattgaaatccattgcattacaaaaatacctggaacgctttaatacagattagaaaatcatggtgttagagaagatttagttgttggttttctatttcaaaaggtacatcaaataactttagtgactctttagtgagattaaagatattagaattgtttgttatgatcttgcaaaataatggtcacatggttaaaagaaagcttttcacttctctagccaaaacaaatagtaccaaaagacttccatgaaaatagctacttttaataacacacatactttgagttgtgtttgtactaaaaacctgcttcactaaccctaccaaggctcaaaaatctttttttggccaggctctcttttcaagttatttgcattccaaggcttccctagagtctcaggaagggaaacactttctggggcactgctgatacatggaaacctggggagacacggaattttaatcatgaaaacaacctagtaaaaataacaaacaattctatgatctggaaaataatcccacgattgcaaactaagatgtaagacttaggagattaaacatataaatgggtatctatatgtagctatacgtaataggtatagatatatgtggaaatatatgtacagatgtataacatacaggcacacatttttatatgtaaaacaaaaagttgaattaaactcaaataaattctactaatcccatcaaagattttgtttgttttacatcttgaaactaaggcaataatttgtatcaaaaccaaagtgtttcactttggcaatatttattctagtttctagaatgatttcttaacagtatccccagcattaattaattaagtcctttaaacaatatccatttaacaagtgatcctgaatggcactaattttttaaaaaaccaactgctttacctctacaaatgtgctgaatcccaaacacacacacatcaaggcatagtcgctgcactattatgtttgagttttgttattttaacacattctctcacagatacaacaaatacttattgaacatctactctgtgccagtcatggtgctacgcaccagcattcagcagtgagcaagaaagccaagtacgtgcctacagagagtataaactagcgagagaagtatgtttctgtggaagatacttggacccagattccaaggaacttaaactttcattgggaaagataaaacttttaaataaaacacattggaatagaaccagacagtgtagaaggaaatgcaatttgcttggtatgtaagtggtgaaaaaattcacaggttattgttctgaactgccctcatttctttcttctcgtgcatttagaacccaatctctctccccttttctcttctctctctcctaaccattatcttagcccaatatagtcaccgtatcaaacactaagggagagaacttattcttctcccacgtcaaaattgccttcactcttctttgtggctaaaaacattactatattaaatgtctattttttcatatatagccagagggcataaaagctggaggtagtgccacagaaaatcaccatataggggaattctatatagttccctccatgaattgtgacactaagtaaccatctagagcaggttttttcactatgtctggaagatttgcttcaaaatgttttaacatattgaaaaaaggggttaaaaaactattatcttaactgaagtaagaggtaatatttaaggctaagcacttgaaaagaattacatgggattaaattaaccctaaactttccctagttttccaacttatatgatgaaaatattttatattttcagatacatttcaaacatcttcatggaggaaaataaacaaattaacaaaatctattccatttattcaataaaaatccataaaatccaacggttaatatcatagtcattgttgtccatcttggccccaaatcaggaaattccgtgtgccgtcttttcatcttctcgaggctgtgctagtgccagccatgtgaacagtcctcttttgttagcacagtgttgtttacacagtgacttctgctcccaggaccacacagtgtcaccaacaaatccctgtcaatcatcacttctaatgaaaaagacatgctgaagttttattaagtggagaatcatgttatttccctaactctttctcagcattcaaatgggaacaggtaatgcttcagtatgctttctcacacaaacgttggatttcttccatgcctgctggtcatagctctgtgttgtgttgtttttctgtttgattgggattttaaaaaacacacaaataagaggaactctactctcttacatttttaagtgcacagtacagaattgttaactatatacacattgttatgtagtagatctctggaacttgttcatcttgcatgactgtaattctatatccattgaacagcaacactggggcttttgacacctgttggcttccagcccctaatgatgtgtctcaatcacaagataatacaaagttttataaaacaataatacaaagttttatgaaacaaatataaaacaaatcttgtttgtgctcttgcagtattaaacaaattaatatagtttgtgattgttagaaatcaactgggaaaaaatgcttgtgtttaattttacattattctctactctcaaattaatgaaataaaggccttactttacagcaaagctagtagtacatacatgaagaagacttaggagatcatcctttccctagggaaaaaaaaaatttacactagcaaaaatcttatgaaaatcacttatttccaggatcttgaaatggctcctagctctgtgagacaagaacagcctcttgggtggtatccagctgaaacaatttcaaccaatactaatccaagcaagtatgtgccaatgaattacatgtagaatcaacaatggctttttgtattttgtctaccaaattattttacttctattggttcattttcaccagaaactaaagaataaaataataaattctgcaattcagtcttataaatataagtattattttactttctagattcagaggaggtactaagaatgtattgcttggaaaaactatggcagaaacttaactgagccataaaatgttatccatacatgtgatttcaccatgcaaagcaaagactggaactcacaaaaacacaagtaaacactttcatcaacaatccatcagtaaaaatacctaccctatcactttagataatgtactaactctagataatagaccaagcaacagaaaagtaaagttgaaacctgaattctgtgtttaggggaattggttgtaaatatcatcaatgtcacacaccataccaagtaattctagagaatgagtagataatcatgtggctaaccagcattttccacacttgataacaggatgaactcctttacctaagtctagttctgactcctctatgtgctctaggcctcagtcttggtgtccaaccctctactgcctaattgtagtgagaatcttgctaagtctgtttggagagaatccctcactcttgatatctgatcatcttgatagttgatcaaattctacatcccccggaaccccccaggcgatatctgatcatcctggccttcagtcagtaaaaatcctgtcacattggtttagccacaatccctccttactcccgatgtttcctcttagtaattttccatcccctggcccccaccctgctgcttggctaaaaatctccatctgtccaagctatattcggaattgagcccagtactacactgaggtctcttttctcctatcgcagtagtcccttaatgaaatcttttaccactttactgtccagctctgattttagtttggcagcaatatcaactatgtcatttcttcagattattatcccaattcttattttccttttatctgcgtagactaggtaagtacaaacatatgtatttccattacgtgccaatatatggcatgtaaacactgagctgctcctttttctcatagagacaagactttatctgtttataaggctcaaaaaaaaacctgaaaattcaataaaatgatttgagttttttccaacacatttatttatgtatttttcacataaatttatgtagggaggcagctagacatagtcaaaatagcagaccttgtaatccacttagcctagcattaatagcagattaattgtgagctgtttaaactctttgagcctattcctcatctctgatattgaaatatttatgactactttgcaagattgtcatgaagattgagttataaaatttacataagactccttgcagggctgctgaaataaaatagtcactctgtcaatgacagtgattactactcatttattctacaaatatttattaagaatccactacattccaagcacagtagtaggtactggggatacaaagatgaataaaatgtgcctgctctcaagtgaccttataaacaattgggagagatagatagttaagtgatgatgatagctagttagtgccataatgcagacaatttgagctaagtaatagaaagaggtgattaatgaaaactattcatttgggtattcatttgaacgatcacttgattgcagcatagtagttcaaatacttgggctttgaaattaggtacaactggtttgaaagcctgtttttaaactagccgtgtgtttttgtacaagttacttaatatttctacaaaatgaagacagtctctatctttgtcaaggtcctgataggaaaatagaactcataatagataatttaatagagggatattatatggaaaactagttataatgatataagaagagctaaaaaaaattgtgggattgtgggcaactcagagatttacagcagtggaaagtcactcccactccaaaggctatatcagaaaagggaagggctgacatgcaggaagctgtgagaggcagaaataccttgctttccccttctccacaaccccagtctcacaccagtacttcccactgacatacataaaaggaagtcaggtggcattggagtggaaaacttagtttgcaggagttattctcttgggatacagagaggatcagaggataggagagaatgggtgtgaggccagataaacaaatgaccaacacaaccataatcattgcaatagagttagatgaaagatgtatggtatataaacatataatataaaattagcatgcaatcaacattgaatgaagggtcgctattcatatttaacaacataatttcagtcctcaatgctcttctgattctcagtaagaaaaaaattcaggagatttacaatgtgcataattggtcagctccccactttacatatgcaggcattgcaatttctatgtcataccaaataaaacaaaatgttgttgtcaaatcaactgatttttaaccaacctgcatacattaactaatcactgttgcatcatgtaaacacagtcatagtcaccaagtcttcacatagcaaaatatatacagtttgcttatttaggttatgtgtgtggggaaaatgtccaaggactgacttgatgatacatacaccgtatttgttaccattgctttgttaccaatgcttcagcagccagattacaaacagtacataattttgtaaggcatataaaaatgaatagtaaaatgtttccacgttggaagaagaaaaagagaaaaggaaaagattaatattgtttctcatttttagtatttgcctccgcatatatttagctccattagcacagcacgcctttcctctccataccccagtcactcatgtgggtaacactgacgtaatccagtgaccacatggaaagtccttctatttggagtttcactatgaggaaatccacttgccattggatcctctaatttaagccacatttcctactatgagcttgcctagtggtaaaattgacactttggactccacgtgcaatacttgtctgtctcgggtttaaaatgatttacaattaagatggagaaagaaaggtggtatttactaagcactttcaaagaccccaacatataagaaaaggatgaagaggcagctaaagggctagcaccaagttggaaagacacaagctttaatataacatacaatgtgatgttgctttttgtaaaactatatacaattagagataataataaaaatataaacaatatatactgctttccatattccaagcactgttctaggggcattgcagatatcaacccatttaattctcctaaaatcttatgacataagtattattcccaactttaaagatgtaaaaattaaagcacagagaggtcaagtaacttgtacaaagtcacacaccttataagtggcagagccaggattcagactcaggaagtctggccctagagaatcgtaactaccctaagctacctctccacaggtgtgtgtgggtgtgggtatgcctattgatgtattcatttagataaaacactggaggacctaaaccagaattttaaaagtggttatttctgtataatctatagttatccagaaagtggataatcctgtggttgattttatttttcctttaggaatttctatgctgttttccacaaggatcattatgttttcaccaattaaaaagtcattaaaaatcattggaattgattctttaaaaatgtaataagaatatagaacactttgatccatgttaatgctgtgttcttgactacttcaggttttggtatgttttcttgtttctctaattattgtattttgtgttgtccaagaacctctgtcagtctccaatttttctgcctttttttattacttagagtgtaatttagaaaactggcctgaggcagccataatgttcctgactggagtcacgaaatattagttagagctaggacgcatccagcgttgattcccagaacttctcaaactggctgcatgtagttcaaggtcaggatagtatccattcagatttctactttgggacgagccaataatcatttaaatcatataaaggaaacagtttggagctctatgtatgtataaaatggttcaaggtcgggatagtgtccattcagatttctactttgggacgagtaaataaaatgatgatttaaatcatgtaaagggaacagtttggagctctgtgtatgtataaatgaggcatgggatgaggattaatcgatgagcatgtgcatatgactcacctatccttccctttgccactcagctgaataccgtttgtcagcatggtggtttggatcattagacaattttaaatgatctatatttgtggttatatgctgttttatttctacctctaatggaccatggctaaaggcaggaagcataaagagcactggtctcaaaatataacctaatgaggagcataaaatgataatgttatacatttctctcaagattgccttcatctgatcagtaaatttcattcacctattcaaaatatttacctactacctcatgttatttttccactgcttcaagacctatttttgaaaaaagagtaataggatggagaattttacataagcaggcttttcatatttagagaaatatgcttatacaaaacctactcttatttcttccattttaaactccaacattattaaacaagtgtattaatatattacacttttaaaatattttaagtataaaaattccaaacataaaaaatcagcttcctcttattttaacaaattaaaacatatagtaaactccaatctacaaatatgacataatgtcatctataaatttatttcttaacaggccacgctttttctctcaacattaatttaacataaggggtgtatgtcacaaattaaatagcacgatatataagacaaagaatattgtcttcatgtttaatattaccaaatgtaataaataagtaaattttataattatctacaagcatatcgatctaaaattaaacattttagatagaatcatctattcataaaaaataaaaccttttttgagaattaattaatatttgtaactaacatctttggtgattactgaatatatgggatgaaagaggaggaggaagtatcaaagatgattcctaggtttctagcttgatagtaccagtacttgcgataaaaaattaggacagagagcagctctagggggaaaagtacactcaatttcaacatgaacatacgctcatacttacgctgacatgacctgtgcgtcacatccaggtgggtatgtcctgtgggcagtaggacatgagtctgaagctcaggcaaaaggctagagttacacattttggaatcttcagtttagcagaggactgtggcaccagatgtggaaaggcagggagagagacttacttaattgacctgttgctttgggactctgtagatacaaacttgtcatgccattaggttcatattttcttgggccatggagacatggttgcccattttctctgacatctccttagaacattttcagaactaaatattcccagtcctatgatcatttctacttgtgctgagaactaattacaaatgagacttaatatctcttcacatatagcactcatggcaaggtcttgtacgcagtaggtgatcaataaatgtttgttcttattgcttatattcatctggctcttcatgtacaaaattggccccttttttcttgcaggaccttctttcttgcttctcaagtgtaacttcttacagctttctaagacaacttcaaggttaaatgcaagtgggctgttcttagtaggtagttgtcttccattcatcaagattgaatgtttgccttatcaccacaaattgcttattgcaggatttgtgaacatctatttcttatcttagatatcccttgagtacctcattttgctacttttcagcatgacatcagctaaccaaagaacattctgattaagggataactaatcctcatcctcctttccagaaaaaaaaatatgtatgtttataaaacacaggagaagactctcccctagcttacctcatgcaaagggaaaatgttaataatggacatttgcattggaatggaaatagggcagagcagaacaaaattttgcaatacctttcaaatcacacccactagatggacacttactgtgtctaccctcaagaccagttgttatgcagaaagtatgaagaatgcctattaatggctgaagaaaagcaaaggaatcatatgggtccaacatattccttttgcctgataaatagtgtcctttaaatatgataaaattactgatgagcggtaaaaacttgaactttcataagtgaattcatgaatcttcaaaaattagataaatcttgtttactgagtgaccatttgcatgtagcattgatgttacaggtacattaagcaactttatgagctatcagttgtatctattaaaaaactatatttcctgcctttcgggaacttctacaatgacagaatcataaaattttagcataataagaagctgagagacaatataatccaaggaagagccctctctccttaatccatcataccagaaacctatgtttctgatactcggcttcatggaggcctaagttacagtagttcacctgactcactttccatagtgttccataccttggttctattctagttgccagaaagctaatccaattaataaattcataacaataaattaccccttcttacttttgaatttgatatgcccctcccagttagatatatattttaataggggccttttgttagttttttaattaaggagactggctcacatgttagaaattttagcacacttgaagccaaagaggcacatatatgtagtctgggagacgttttaggactcttcatataatgctgtgaatttcttatctgaatgaatgcagcagaaaattatatgcataagagaaagacaagataaaggaaacatatgaattaaagtcctgctctattcaatgttaacaatgcatttgattcatcaagttacagacaaatgagattttaaaaaaagaaaaggtaacagtttgggattttagatttagaatgggtttttttctttacattgaactcaaatgttagtaaatcctagccctatttcttaaataactaattgcaatattgcttctaccttttcttgataaaatcactgttaataataaaggttctttccccaaaatctcctattccatatttatataaacccaaggagtttattcatataaactccataagaaagggtgggtaaatgttacttttcgttatcataaaaatactaaaagccataataacacaataaaagaagctggttaatttttaatcttcaagcattggagggctttgttttgattttgatctctttttgtttcctgcttggttttgctaagtaaaattgcagattttttttacacttctgacgtttatggtgcaaattcagttcattcttctgtaaatctcagaaaataagggctaaatacatgtgaaagtagcatgttcagatggaatctgctttctccttgcagtagaaacagtaaatcattataaatctgtgactcaattcttatgatgtaagcaaagtagtcttgaactaagaatggtccaggctattctaaaatgttagaaccagagaaagagtgatgggttcgttggcatgcagggttacatcttttgtttttcctttgggcaaagacagtaactctgctcattcatcttagataaataactaatcctaaaaaatcaaatcattatcagttctaggaataggattacagtatcttgttgaaaattataattgattttaaattggtttttattacatcatcatagaagccaagttgaaacggctgaatgaaagctatgaaacaaaaatgtattttttccattttaagtcttgaaaaacaatcacaaattatgctttcttaagtaagtaaattgataacagaattaaacccgaggtcagtaacagcatcaattcaccaagtgacaaacttgccaaattcaccaaatttgcaaatttactaaaatttagtataagaaatattatttttaaatatacacattctcattaaatacattttaaataatgttcagtttgccagaagctggatcctaggcttattgcttttttgtgaatattgttaacaaatatatagaatatataacatgtatatatcttaatatagtcgagtataaatatgttaataaagagcatgttccaataaagcagttctacaaacataatcaagaagaataaattaatgaatatattcttatatgtgaaaaatatactctaaacactacaattaggaagaatgcatttatgaagaatatattcatgctgaatatgttcttcagtagattattaaatatattcaagaaaaaaaccatactcatttaatatagtaaataacgtatgtttaagagaagccatatacaaaatcactcaatatgattatgcagattaatccgtaaaacaatattcttggtaaactagtaaatttacttaattcactattccagaggtggctttcagtgtcttgatcttcgaagaactcacccacttctgcagaactgtcggtgagagagctgtgctgaagagcaaacacggatatatttttactgagcacgggatacagatccatgatggatttttgtgttcagaaaaatgtccattggtagcgtgtacagttcaaatcaagccataattgtgaactatgtgactttatttttagaagatatgttagcaaaaaaaaaaaacatatgtggaacaatgactaggaaaatgacttttgttcttgcttcagcaaaagcccctggcatagccaccttcccagcaatgataagtaccaagttacagattcccaagtaattttcctttgattggagtttgacatgttgtgtgacccaacctccaacatcatcagatactacatatcttgaatttgcagacataactgagactgtctgctctactcccccataaaagtaacactcacacttcccatgtacttcatttggaaacaagatgaattacaagccatacatacaccattggtgccattaatagtaggctcatttgtatttaacagtaatttccaatgaaaatccacctacataaagaagaacatttccttcactccttgtgaaagctcttagtaacatgactgagtctatgttcggatttgtttcaaacatccaaaaaaaaaaaaagccactatttatagcccatctgtcaagactgcattgttttgtaagatgaagtgtgttttaacatatagaggagtcattcttttgataagttgaattaaaaagaaacttattgtttaaagtgaaacaactttaaagaaaacttgctgagaaaaaattagaaaaaaaattaaatttctacttccttccataccccaaaggaaattccaaaaaagttctggacaaaaatgttgtaactatttataggctatgatggaggcctatttataagcctttctaaacacaaaaccagaggcagaatgcctatatcaaaaagttaaaatttagagaaacaacaaccaagaaaataaagtctattaatagtaaattaagaatctgggggccaggtgcggtggcttatgcctgtaatcccagcactttgggacgccaaagggggtggatcacctgaggtcaggagttcaagaccagcctagccaacatggtgaaaccccctctctactaaaaatacaaaaattagccaggcatggtggcgcacgtctgtaatcccagctactcagaggctgagacaggagaatttcttgaacccaggaggcggaggttgcagtgagcggatatcgtgccactgcactgcagcctgggtgaaagagcaattccaactctggaaagaaggaaagaagaaagaaagaaaggaaggaaggaaggaaggaaggaaggaagaaggaaaaaaggaaggaagagggaagctggggaaaactgaatcatatagaacaaatttaatagcattatataaatagcacttatatgtcaaaaagtaaaagataccaccaatggaaatatggacaaaaaatagaaacagatttacaaagaataaatagcaaaccaattaatgtattttaaaataataaacttcaaagaacttttaatagaaatgcctgtaattgccatctttaattcttcatctcattactcaacccctgtgacttccagccaaaccattgtgctatgctttcttcatcaggaagtccaatgaactttagtgttgctaaattcaacatccaccttttagtctttctctttttccatattttagcaatagtggacaataaggaccattcccttttttaaaacatttttgtgagtacatagtaggtatatgtttatggggtacatgagaaggggtacaggcatgtaacctaaaataagcacatcatgaagaatggggtatccatcccctcaagcatttaaccattgagttgcaaaccatccagttacactctttaagttattttaaaatgtatggttaagtcatttttgactatagtcaccctgttgtactatcaaatagtggatcttattcattctgtctatttttgtaaccattaaccatcctcacctctccctcacagccccccatgacacttaacagcctctggtaaccatccttctactatctatgtccatgagttctactgtttcgatttttagatcccacaaataagtggaagaatatgtgatgtttgccattctgtgacaggcttatttcacttaacataataatcttcagttccattcatgttgcaaatgactggatctcattctttttttactcccttttttaaaaagggttctcttcccttggcttctataacaccacattctgtatcatcctcaccctcattttccattgcactttgagccatttatcaaccacaaggaatcaaagccagaagacatctttatcatttaaatttaatatctattcaattcagccatttgttattaatagtcatactatcttccatggagcacaggggatttttagggcagtgcagctactctgaataatacaatagcgggcacatgtcattatacatttgtccaaacccacagactatacaacaccaaaatgaacaacttatgtaaactacggccttcgggtggtaatgatgggtcagtgtgggttcaccagtcacaacaaatgtactactctggtagagtatgttaatggaggagtatatacagctgtgggggtaggaggcatatgggaaatctgtgtactccagtctatttgatgtaaacctaaaattcctgtaaaaattaagatctattttttaaaaggggaggagagaagatctgtccctttccagatggtgaggcaataatatttgtattacaagagtcacctctggccttgttttcagccatgtggaggaagtcagtctgagataattagcttgagatataaagagaaggatagaaaaaagatgaataagagaagagaacaggaaagttggggagggggaaagatagagactcttaagagcattggagtcctgggtttctattctgctgagaggcccagatgaaacttctacttttcatgttttggttataagaatcaacaaattctccattttcctcaagctggcttgagttaaatttctatcacttgcaaccaaggagttctgaataacatacactgcaagccgttgtgggccacactgttgccttccatctgggctccccatacgtatccttgctctcttgtactcaattctcaaacttcaatcagaattatcttcttaaaatgaaacatctaaccctcaaaatgaagtcctcaatcttaacataccttccaaggccttatgggatctgacccctaactacctctcaaacttcattttgaatcattctgttatactccacgcactaaccaaactgttttcttctgtttctccagcatcggccagtccagaaagattttacttctgtgcctccctgcattgccctcctttcccaccttggctaacttcaattcatctgtaagtgccactttaggaggcttaatctaacaccctgaacctggaacataaccttaaatgctccttatcatcacccctttaattgctacttgtttaaagttgttagactttaagttccatcaaagtagaaacttgatctgccttgctcacctctcaatcacttccccttcccaacattcagtgactggaacagaggagatgcatattagtatttgctgaattaaaaataaattttgaaatacaaattagttgccgttttccaattatcaaattgtcaaagtgttctttattatgataggtaacattggtagagatctttcattcactgatgatgaaagtataaatatttcaatggcaattaagtagtaagcataaaatctttaaaaatgtatatagtcttaagacttatgtatatagtcttaagactataaagtcttaagttattctttttagaataacaagaaaaaaattgacaagagattgtacaaaggaatattcaccacagctttgttttagtaaagtacaaaaaaaaagagagaaaaaattaaatgtccaatattatggaattattttatacaaatacaataagaataaaatatggttatttaaagttacaaggtaaaacattattaatatggaaaagtattcatagcatgttctttaaaaaaaggcacacacaaaaatgatctgaatggcacattactttaaattgacatgcaaataaatacaaattaaaaagtaatgtttcaggccgggcacagtggctcacgcctgtaatcccagcactttgggaggccgaggcgggtggatcatgaggtcagaagatcgagaccatcctggccaacatggtgaaaccccgtctctactaaaatacaaaaaaaattagccgggcgtggtggcacgcacctgtagtcccagctactcagaaggccgaggcaggggaatcacttgaacccaggaggcaggggttgtagtgagccgagatggtgccactgtactccagcctggtgacagagcaagactctgtctcaaaaaaaaaaaaaaaaaaaaaaaaaaaaagtcatgtttctctgggaggtgaaattagattgatttttattttaatagttttcttacatatatttctgggtttttttaataagcatatactgcgtaacttaaaatctcttgttacttagtgttataaatgaggaactagagattcagatatattaatttgctcacagcaacaacacagcctgtattccaacccagtttgtcagtctctaaagccctggctcttaaccatcacactgtaataacatggtgcctaaatgtgtacaaggcactatggggaggcactgagtaaataagaagttagcagcttggaagccaatagataagaaatatagacaaatacgtgacatggcaaaatgtgttttgtaacctgagaggtacaagcatggaggtcacaaagttcaatgtttgcttggaataaaaaacaagtcagttgtcctgttttactagtgcagtttctccaagtgtggtctatagtccacctgcaacatattcctaaacagacctgttaaagaaaaatctccatgcagctcaagaaagttcaaattacctccaggagcatcatacatttggtgccttgcattttttttagatgccttataatacttataaatactactagtaaaattttaggacaggcgcagtggcttgtgcctgtaatcccaacactttgggaggccaaggcgggtggatcacctgaggtcaggagttcgagacaagcctggccaaaatggtgaaactccatctctactaaaaaatacaaaaaattagccgggcatggtggtgggcgcctgtaatcccagtgactcaggaggctgaggcaggagaatctcttgaacccaggaggcagaggttgcagtgagccgagatcacgccattgcactccagcctgggcaacaagagcaaaattccgtctcaaaaaaaaaaaaatcataaaaataaaaatgaaagtttaggaatagaccattattgaagggaatatacagtgtgccaagaccaggctttgttacgtttctaaatatctgaggtcagataaatactacacaagctcaccaacatcccctaatcctttgggtcccagtttagattgactttgaaattgcccttaggaggacttttcctgaatttcaaagaaggttaacagtgtgtggcataaacgaaatctcggaataaaatctgaaggacagattgaaaggaattcaagatgcctccagggtctcatactctcatggaaaatatcaaacacccaattgcatcacccccatactcactcaaaaggtctactattttatttcataggttgaaaggttagaattggatctcaccaagcatttcactacagaccaacatcccctaaactgaactgatctctggaaatgcgaagagaggaaaaactaggacaggtggacggcagcagttagacaaaattctatgaggtttgagccattaaaagccctatagggctttagtcttacaactccaatgtcatagtgtctgtaaaatctcaattaatctcattctatttttgcagtaactggcttattaccatagttcctcccttcacctgatttcaataagatcatctgatcgaggaatcctctaattgaacatttatttgaatcttcctattaatagtgctactacagctatgtgtggttgtgtctgaaaataccagccatgaatcaagagtccgtcaaggctgcctacatatgaacacactctttattaattaatacctgtcatctgttgtttatagacaaaactttgttgctctgggcctctgaaactcaaaatatttgttcagaatacacaagtgttggctcttccatccacagccaaaagcataatgcgagaaatatcttcaatccatttatgctgaaacattaaactaaaaaatgttttttccttgttgctttacatgtttgtttagttcattgtttggttgattgttcttgtaggaactgggggaagtacataaggtgtatgcaaaaatatctcagtaagcttggccagtttgtcccactcaatttacatttaaagtgaaaccactgatcttcaaagacacttttggcacaagttattaaactttcgaacagtggttataaaatagttagatttcaactttaattatatgctacctctctgagcagtgctacaacaaaataacagaatattcccccttaaataattataaggtctgtttaaacattcaaattcgaatcagaattcctttgactatacacattactgcttaaaacccctattataattttaatcaaacacagtattcattaccaagaatttataactaagagaaataaatatttggagcctgttaattttatcatatctacttaagttggaagttacttagcaggagatcaaattgcaatacaattcaaacataaacaacagaaagtaatagtatttttaaaatgttcctaaatatggagcaaaacaaaatatataaaaacagagtttcaaagagctaaagatcttctgaaccaacatgaacagtaatattgcatagagggaaaaaatgcttaatcctaagacttctactatatggaaggttcgtagcctctttctttatttttgggatggtgctcagaaaaaaaaaaaagaaagaaagaaaagaaaagaaacaaaaaggcaaagctcagtggctttggtaggagatagcagattgctgtgatgcacctgattatatcccgtttgttctcccttttggtttagctcacatgtgaaaatctcctgtggacaacttggtttttttcccagaagcttggtccaatccctgtttccaatgctgtcagcatgaaagggaccaggcagcagggccaagcagttgcagatctgtgtggatactgcttcaggtgatgaaagggacattgctgacaagtcagtagagaggagaaagccaggctaatggctattctcaagtggtcattcacagctatttgccagtgaaaattgaaacttaaatttccctaatttaccttccctagaacttcaatatttcttacagtaagtaattttttaacttctttataactctcccagcagtgtggcagctttggtgtgtgacaaatggaggttagattctcctgcttaccactttcgaacatgaatttgaaaaagttacttaacctctctaaacactcaaatgctcactgtaaaaggtaacattagggttgtttgaagattatgggagacattgcataagaatgttctaacacaattcatgacataaaacagattctgaataaactgatatttccaaagtccacgtccctcctccctaaaacactaatgtctccactacactcatgatcccagtacctctcagtcctctgcggacactgtgccgacaattatatttttcctcttctttcctggtggctactgaaaaatcaacaagcattcaatgaacatgtgtttagtaaaagccaggtatttttttacatgttaccttaacctacccctatcctctcctgaaggtattggtatttctcctttctgctgtgatgaaacttcttaaattaggtgacaataagtaaagccagataaagatagttgtcagaggaaatgtgaatatctagatattgcattcaatatttagattgtgtgtgcatgtgagcattttccagaaaaaaaaatcaattttttccgtcatagtctcaaaagatccctgactctcaatatgttatgatacattgaatctatattagtagttgttcaggactgtcctgctattccattgtatctgtttctgtccttacctgaaagcagtgtagctatggtcgtagggaaacttttacttttaaattcaaatttctgttttttagccttcatcctatgttatttatctttatcatgtaacactcataacaacctttctttctttgaattttttcttcatttgattgctgacactactcatatctcccaataagtcatctttgagcacttccatatctttctttggctcctacttctcagtatgactcatgaattctgatgtttcctgggatactctttgtcttaatttactgttgttgcacatgcactccttggattatatactctatgggcaaagctttgcacatctccaggtcagacctatcctaatatctacatctacatttccaggtaactagaaagtaaatggcacatatgttcaaaaatacactaaatcactactataaaaaaatcaacttaacacaaagatacaaagatactacttttctttatcatatgatccatgtatattattttattataatttcccgtgttggcaattttaagaagaccagagccactaaatcatttctagaggagtatggattattacgacctttatagagtagaatttgtctatatagctcagaagtctttaaaatgtgcatacacatcactatttcctgaagtatggctttatcctgaagagtcctcccactaaaagacaactagaacttagataagttaagacaaacatatttttatggctaagctcacagaaaggaaaagaaatctcgaagtgtgagggggtaggcaatgagctaaaatctgagcagagagccatgagtaatcaataagtgacaggaagttgttctgggagaaaatactgatacaaggcctaggatctgggagacctaaactttgagtctgtctcaaggttagggagctgatgtgagtttcctatattacccttaatcccccatggagctaaagtgatcctagatgttagggaattctgtatagtggcaatgcaaccaaatcttttctcagggaatatttccaacataaacacttaggattcttacagattaagttaaaaaacagatgatcttataaacaaaaatcaaactactgtaactgagagttctcagaaacaaaatacagattaagtttaaaagaaaatttgtatgctgaaattatcagatacacagtataaaccaaccatatataaaatggttaaaagattttaaaactgattatttctaattaaccaaaaaaggctacttaaaatggccaagaagtatttagaactaaactaacttaatctttgatattaaaatagtattgaatgagtaacagcatatcagatacagatgaaagggatgatttgtgaacttgaaaatagattttaagaaattatacaggattatcacaaaaggcatcaaataaagaccctgtataatgtagtgatagagaaaaaaattcaagaatcagaataaatttgaatcacagctctataagtaactagcgctgtgactttgagtatgttactaccgtctctgtacctcagtttcaccatatatttttaaatgatggtttatgtaagaattaaatttaaaatatttatatataattcttgaataaagtctggtaatattaagcactatggaataattatcattattaatatgacagaagtaagcccaaacatacctatgatattaagaaatatgcaggcttaatttacctcctaaaagaaagaacttttcagattaactcccaaaacatatctctattatatgctgtgtatgacagggacacactaaatacaaatttatacctaaagataacaatagaagaacgggcacagtgggatacaaaagaaaaaaagggagagagaaaaaggaaggagagaggtaagaaaaaaatgagtcatgatcataatatttgaaaaggtaacattcagagcttttgaaaaagcattaaatgtgacatagaaaagtagtttaaatatactaaagggaacaattcacagtaaagatatgagtgttatacatttctatgcacccaatgagtaaaacaacttcatgaagcagaaaacacaggagatgcaaagacaaacaggcagaaacatttaaataatagtagcttaattctcatgcagtccaagttctagtaaggtaaaaagtataaagaaggatttgtaagacttaaattacatttttaataaagtagattgtatggagatctatagagtagtgagaacttttgtatcttaaacagaaaatatgccttttccagtgctcgtggaaactttactgaaatagattatatactagattacaaatataaatataataaagtctcaaatagcaataatacagaaaatattgaccacaaaatagtaaaagaaataatttcactgagaaagatttacgaacaaaatctactgagctaaagaaaggataaaaacaaacaaacactatagaatgtccagaaaacctttatgggttgaactgtgtccctgcaaaatgcatctgttgaagtccaaatagtacctcagaatgaaaccacatttgtaaacagagttatttccaaagtaattgttaagatgaagtcatactgagatactttgagaccctagtataatataactggtggacgtataaaaaggggaagtttggtcacagagacacacacacagggataatgcctcatgggaatgaagacaaaaatcaggtgatgctgcttctccaaaccaacaagattgccagcaaactaccagaagctagaaagaggcatggaacagccctcagatagaaccaaccctgctgacacctaatcttagacttcttgcctccagaactgtgaaactataaatttctgttgtttaagccacatggtgttgcagcactttttgtcccaactggttggaaatgtcattgttattttcccatttgttgaccaaatctccaactggactatatgtaaggatttagcgtccaatagatgctctaagtattattgaatgaataattcaagcattatgggagagttaaattattcttaaggtttcttctaactcagcgattatttttcatttgtttctgtgtttattttttttgtttttatctggaggaatcatcaagcctttctaaagctcctaatctgtatgtctgaaacaagatctcaggagtccttaaaaaatgcattttcttttaaaatatgaaaacagtattagaaaacacatgttcttgcttaagaaaatttattgagaagtttttaaaatataaacatgcaaaccattaaataccgaattctccataaaagcacacaaagaaaattaagctctaagtgagagggcactgctcactcttactcagactttggtgggtgggtggcgtgaggtggggcagggtggagtgagttggtctcctgtctcttttcaaaactttactcacatgttttgaatctggtaaaaggagatatgaaaagagtgttggaataggcatttttcacttaataaacttaaaaatgtctgtgctacattttaaaggatggtagaaagaataattttttaaaagacaactctagattgttctctggcaaagtgaatctgtgatacaaagagatgaaagtatgctggaaaaaatcattaagcttgctaatttgcagctttttacatagaaaatagtgttctttaagcattcttagtggaatgaaatagaaaaagtattgtttgataccaaccagcacagattttaaaacacatatttttcctctccaaaaaatgtttcgagcaatactacttttaaactatgtggcaatccactaacgagatggttttaaaactatgtagcaacattaaaaatgcctagagaaatgtcatccatggcttagtactaacacaaaaagtattataatatttttgttttattttattgtatgcaaatattgtgtatagttctatcatcatatatagataattttgtgtcttatattttatcactagttaatacttttcaatttttagttcctttttaattttttataattaaaaattaactttgaaacatgaaaagaagtctacaaacaataaatgaacaatattgaaaaaattaaaagaaaaataaaaagcggtttgttggagatacttttaaaatataaagatgcaaaccattaaatactgaattctaatacataagtctaaatacctaccaaagccacaaagagattcctgaaggaataaacatgtaatctatacttcatttaaccatggcaatattaaaatgaaaacaaataaataaaaagaacacatgagagaggaaacaataacaggctgaagatattcacatatatttggaaggtggcaaaagactgaggagagataatgacttatcttcagaatcctatgcttagctaagacagcaatgttaacaggaagcaagctgctactccagtgtccctgcaagtctagggatttttagaccccagaaaactcagaagcaaggccatgggataagactaaaaactagaagatttttatatactttaagactatggactttaagaaagaccatccccgcatacttccttccaagcatccaggtaacaaccttctctaaccctaacaacagtttaatttctggataaattaaacttgatagactctaggtctgtggaaaccaatcaccataaagggaagaagaaaaacactagtttaaaaacagggaaaatcaactaaattataaaccctcttcctcaacttgactattcactccttgtgtaaaacattagtgaaaaaaaaaacacaaacctgaaatcgcctggctaaaagaaccacaaatactgatatttgggagtctcccagataaatggccttcttcctacccaataaccttgcaatgaaatccaccatttggcaagccatgtccatgcatgtaacacccaatcaacattgtagtgtctcactaataaatgtcaatggacttctaattagccaggcatggtggtgggcacctgtggtcccagctactcgggaggctgaggcaggagaatggcatgaacccaggaggcagagcttgcagtgagccgagatcgtgccactgcactccagcctgggcgacagagcgagactccgtcttaaaaaaaaaaaaaaaatcaatggacttcttacctctccttacatacttaaacaagagaaaagaagaagcatgtgtcaacacaaagacttgtacatgaatatttgttgcagctttatttgtaatagcctcaaactagaaacaacccgaagtccattaacaaaatggctaaacattttgtaatatattcacacaatgaaacactactccacaatttaaaatatgcacatggatacggaatgcagataaatttcaaaatcattatgctatgtaaaaaaaaaaagtcaggcaaaaaggaatacatgctatactatctcatctgtatagaattctggaaaatgcaaacaaatccataggaacaaaacacacagcagcagttacctgaggagtgggttggggagtagaaggaaatgaggaagtgtaacgagataaactaaaaaaggttacaagacaacattttagaaggatggaaatgtctgttacattgattgtggtgatggtttcaggagtgtgtgcattggccaaaaccagtcaaattatacattttaaatatgtgcagtttattgaattttgataatccctaaatgaaggtgtaaaacgacaccaatataaaaataaataaatgggccaataaggatcatcagatatttaaagaaagctccaataagaaatataaacatcagagggtggcaccaagatggccgaataggaacagctccagtctgcagctcccagtgtgaaggacgcagaagactggtgatttctgcatttccaactgaggtaccaggttcatctcactggggcttgccagacaagtgggtgcagcccacagagctgggcagggcattgcctcacccaggaagcacaaggggtgggggaattccctttcctagcaaagggaagccatgacagacagcacctggaaaatcgggacactcccaccctaatactgctcttttccaacagccttagcaaatggcacaccaggagattatatcccgcggctggcttggaggctcccacacccacggaggctcgctcactgctagcacagcagtctgagatggaactgcaaggcagcagcaaggctgggggaggggcgtccgccattgctgaggcttgagaaggtaaacaaagcagctaggaactcgaactcggtggagcccaccgcagctcaaggaggcctgcctgcctctgtagactccacctctaggggcagggcatagctgaataaaaggcagcagaaacttctgcagacttaaacatccctgtctgacagctttgaagagagttgtggttctcccagcacggagtttgagatctgagaaaggaaagactgcctcctcaagtgggtccctgacccctgagtagcctaactgggaggcacctcccagtaggggccgacagacacctcatacgggggatgcccctctaagacaaagcttccagaggaaggatcagacagcaacatctgctgttctgcaatattagctgttcttcagcctccgctggtgatacccaggcaaacagggtctggagtggacctccagcaaactccaacagacctgcagttgagggtcctgactgttagaaggaaaactaacaaacagaaaggacatccacaccaaaaccccatctgtaggtcaccatgatcagagacgaaatgtagataaaaccacaaagatggggagaaaccagagcagaaaagctgaaaattctaaaaattagcgcacctcttctcctccaaaggaacagagctccttgccagtaatggaacaaagctggacagagaatgactttgacgagttgacagaagaaggcttcagaagattggtaataacaaacttctccgagctaaaggaggatgtttgaacctatcacaaagaagctaaaaaccttgaaaaaagagtagacgaatggcagtgtagagaaaagacagtgtagagaagtccttaaatgacctgatggagctgaaaatcatggcacaaggactacgtgacgcatgtacaagcttcagtagccgatttgatcaaatagaagaaagggtatcagtgattgaagatcaaatgaatgaaatgcagggagaagagaagtttagagaaaaaagagtaaaaagaaatgaacaaagcctccaagaaatatgggactatgtgaaaagaccaaatctacgtctgattggtgtacctgaaaatgacggggagaatggaaccaagttggaaaacactcttcaggatatcatgccggagaacttccccaacctagcggggaaggccaacattcaaattcagaaaatacagagaatgccacaaagatactcctcgagaagagaaactccaagacacataattgtcagattcaccaaagttgaaatgaaggaaaaaatgttaagggcagccagagagaaaggtcaggttacccacaaagggaagcccattagactaacagtgagcgggtctctcggcagaaactctacaagccagtagagagtgggggccaatattcaacattcttaaagaaaagaattttcaacccagaatttcatacccagtcaaactaagcttcatacgtgatggagaaataaaatgctttacagacaaacaaatgctgagagattttgtcaccaccatgcctgacttacaagagctccttaaggaagcactaaacatggaaaggaacaaccggtacgagccactgcaaaaacatgccaaattgtaaagaccattggtactaggaggaaactgcatcaactaatgagcaaaataaccagctaacatcataatgacaggataaaattcacacataacaatattaaccttaaatgtaaatgggctaaatgctccaattagaagacacagactggcaaattggataaagagtcaagacgcatcagtgtgtggtattcaggagacccatctcacacgcagagacacgcataggctcaaaataaagggatggaggaagatctaccaagcaaatggaaaacaaaaaaaggcagggttgcaatcctagtctctgataaaacagactttaaaccaataaagatcaaaagagacaaggccattacataatggtaacaggatcaattcaacaagaagagctaactatcctaaatatatatgcatccaatacaggagcacccagattcataaagcaagtcattagagacctacaaagagacttagactcccacacaataataatgggagacattaacaccccactgtgaacattagacagatcaacaagacagaaagttaacaaggatatccaggaattaaactcagctctgcaccaagcggacctaatagacatctacagaactctccaccccaaaacaacagaatatacattcttctcagcaacacatcacacttattccaaaatggaccacatagttggaagtaaagcactcctcagcaaatgtaaaagaacagaaattataacaaactgtctctcagaccacagtgcaatcaaactagaactcaggattaagaaactcactcaaaaccgctcaactacatggaaactgaacaacctgctcctgaatgactactgggtacataacgaaatgaaggcagaaataaagatgttctttgaaacgaatgagaacaaagacacaacataccagaatctctgggacacatttaaagctgtatgtagagggaaatttatagcactaaatgcccacaagacaaagcaggagagatcttaaattgacaccctaacatcacaattaaaagaactacagaagcaagagcaaacacattcaaaagctagcagaaggcaagaaataactaagatcagagcagaactgaagtagatagagacacaaaaaaacccttcaaaaaataaattaagccaggagctggtttttggaaaagatgaacaaaattgatagactgctagcaagactaataaagaagaaaagagagaagtgtcaaacagaagcaataaaaaatgataaaggggatatcaccatcgatcctacagaaatacaaactactatcagagaatactataaacacctctgtgcaaatcagctagaaaatctagaagaaatggataaattcctggacttatacaccctcctaagactaaaccaggaagaagctgaatccctgaatagaccaataacaggttctgaaattgaggcaataattaatagcctaccaaccaaaaaaagtccaggaccagatggattcacagccgaattctaccagaggtaaaaagaggagctggtaccattccttctgaaactattccaatcaatagaaaaagagggaatcctccctcagtcattttatgaggccagcatcatcctgataccaaagcctggcagaaacacaacaaaaaaagagaattttagaccaatatccctgatgaacatcgatgcaaaaatcctcaataaaatactggcaaaccgaatccagcaacacatcaaaaagcttatccaccatgatcaagttggcttcatccctgggatgcaaggctggttcaacatatgcaaatcaataaacataatccatcatataaacagaaccaaagacaaaaaccacatgattatctcaatagatgaagaaaaggcctttgacaaaatttaacagctcttcatgctgaaaactctcaataaactaggtattgatgggatgtatctcaaaataatatgatctatttatgacaaacccacaggcaatatcatactgaatgggcaaaaactggaagcattccctttgaaaatgggcacaagatagggatgccctctctcaccactcctattcaacatagtgttggaagttctggccagggcaatcagggaagagaaagaaataaagggtattcaattaggaaaagaggaagtcaaattgtccctgttgcagaggacatgattgtatatttagaaaaccccaacatctcagcccaaaatctccttaagctgataagcaacttcagcaaaatctcaggatacaaactcagtgtgcaaaattcacaagcattcctatacaccaataacagacaaacggagagacaaatcatgagtgaactccattcacagttgcttcaaagagaataaaatacctaggaatccaacttacaagggatgtgaagtacctcttcaaggagaactacaaaccactgctcagcaaaataaaacaggacacaaacaaatggaagaacatttcatgctcgtggataggaagaatcaatgttgtgaaaatggccatactgcctgaggtaatttatagattcaatgccatccccatcaagctaccaatgactttcttcacagaattggaaaaaactactttaaagttcatatggaaccaaaaaagagctctcattgccaatacgatcctaagccaaaagaacaaagctggaggcatcacactacctgacttcaaactatactacaaggctacagtaaccaaaacagcatggtactggtaccaaaacagagatatagaccaatggaacagaatagagccctcagaaataataccacacatctacaaccatctgatctttgacaaacctgacaaaaacaagaaatggggaaaggattccctatttaataaacggtgctgggaaaactggctagccatatgtagaaagctgaaactggatcccttccttacaccttatacaaaaatcagttcaagtgggattaaagacttaaatgttatacctaaaaccataaaaaccctagaagaaaacctaggccataccattcaggacataggcattggcaaggactttatgactaaaacaccaaaagcaatggcaacaaaagccaaaattgacaaatgggaactaattgaactaaagagcttctgcacatcaaaagaaactaccatcagagtgaacaggcaacctacagaatgggagaaaatttttacaatctacccatctgacaaagggctaatatccagaatctacaaagaacttaaacaaatttacaagaaaaaaaacaaacaaccccattaaaaagtgggtgaaggatatgaacagacacttctcaaaagaagacatttatgcagccaacagacacatgaaaaaatgctcatcatcactggccatcagagaaatgcacatcaaaaccacaatgagataccatctcatgccagttagactggcaatcattaaaaagtcaggaaacaacaggtgctggagaggatgtggagaaataggaacacttttacactgttggtgggactgtaaagtagttcaaccattgtggaagacagtggggcaattcctcaagtatcttgaactagaaataccatttgacccagccatcccattactgggcatatacccaaaggagtataaatcatgctgctataaagacacatgcatacgtatgtttattgcagcactattcacaacagcaaagacttggaaccaacccaaatgtccatcagtgatagactggattaagaaaatgtggcacatatacaccatggaacattatgcagccataaaaaaggatgagttcatatcctttatagagacatggaggaagctggaaaccatcattctgagcaaagtatcacaaggacaaaaaaccaaacaccacatgttctcactcataggtgagaattgaacaatgagaacacagggacacagggtggggaacatcacacacacgggcctgccggggggtgggcgggggagggatagcattaggagatatacctaatgtaaatgacgagttgacgggtgcagcacaccaacatggcgcacgtattcctatgtaacaaacctgcacattgtgcacatgtaccctagaaccttaagtaaaataataaaataaaaataaaaaagaaatataaacattaaaagatattttttaacaaaagggatctgaaggaaatgaagaccacaacagaaggagaattttgaaaagaaaccagaaaagagaaagctgtaaatagcatcctcagagataacgatggatattacatcaatgaaacaaaagcaggatgctataaaagaagattcagaaagcaagatctcttgaaaattaaaaatatgattgtagaagttgtttttttatggaaaagttggtagattaggaaacttcatagaagttaaataattaaagagattaaaaatagtgaaaatatatataaacacaagattaataaaagcgttttgggagaggaaagcagagaaaatggagaggagacaaatatcaagaaaaaattcaaaagtacttttcagaactaaataacacaaatttatatattaaaagatacactgagtttccagctcagtcaatagaaaaagatccacaccaaagcatatcagcctgaatttaaatatatcaggaatacagaaaagatcctaaggacttctacagagaggttttaaacaatgaaatataaaaaatcaaaaactgcttttcttttagccacattagtggttagaatacaatgaaataatgcctttataattctgaataaaaataatgtgtttagaactatgctcagaaacaaaaggtctcagtctttcatgtgtccattctcaggaagctactgcagtatatgttccatcaaaataaggacataaatcaagaaaactagaacagtatttttaaaatggaagaatgatgggagtatttctcaatatgaaagcaaaaggataaaaacaactacgtagcaatcctagaaagcagtcagtttggagaaaagcagaaggtcagaggctataggagaaagatttccatgagaatgggcagtgagaggggaagttggaaataagaaggaaatattatcatatgaagagtggtcatatcatattttatcattctctgagacaatttgcaagcctaaaactgaacaatcgaaaaagaggcaaatgttaattagaagaaaaacaaaaggttaaataaaaaaggaaaatactcacagcatattactcagttcaatagtaatcagcatttaggttgttataaaatcacgccattcatcagaaattaataaagctatcaaagtaccgagactacaagacatagaaggcaactggaagggattcctgttgatccaacatgggataattttaatatgaaaaagacaaaggaaatcaaaatacatataaagtatatttcaaaaaaatgaaaaagaaaaatcatatatcttgcctttcatttaaaactacctcaaggtaatcaaatagttaacaagagatgttctctttcattgaagaatttcaactaataaatgacaaatgaatgacagaattagactagcactatttttcaacccctaataaaaaggatttcaggcaattatcagcaaagattgctaaaaccagtaaatgaaaggctgatagagaactcagaatgaacaacttgcctgctatctgaacccactgatcatttttaacctcataaaagatattatgtaccccttgatataatgcaataggaaataaacagcatcacgtgagacatattcttaccaaaataatggaagccgaatcatatcaagcctctagaccaaactacaagtatagaggaaatgcaaatgagaaaggaacgtgttaaatgataccacacgtatgccatcagcaaaatccaggatgtgggaaattctacacaacaaatgcccccattttttaaatatcagtaatgtgaaaaataacggacagaaaattgtaaattaaagagtcacacagagcaaccaaatgcaatcttgtttagatcctgaatccaacaaaccagttaaatttttttttttgtagacaactggaaaacgtgaatgctgaatgaatatttatattaaggaattcccataaattgtatgtttagatgggataatggtttcagagctatgttctataaaatgtccttatcttttatagcactaaaaaatgtacagttaaaattatgtgatctctaggatttgttttaaataatacagtgggaggtgggaggaaagtaggtaggaatatagagtgagcaagatagatcatttgttgataattgttctaattttatatacatttgaaagttcccaaaagaaacactttaaaatgtaaatagaaaaaagatgtacacctaatattgatataattcaaaaaatttattaaactattttacgatagtgatagagaagaaaagtgaggagagctgaatcttcttcttctaatatgggatatcaacatataaaatgtaaatttaataaatcaagagtgtccagagaagtaaatatttttgaaatgtagaaacagctaaaataaagaaatgtagaaacacctaaaatagttaaaactgtgtggagagcaaaatttatgggtgggcagaattaaggcaaggaactactgtgtttattattagtcttctaataccatttgaacacatacaaatttgataaaatgtaaaaattatttttaaaatgatatataaaacatcttttacttttaaaatgtgataggaagaagattaatacatattatgaattatatcctgacactcatgtttatcttcaatctcttctcatttcttccctttattcatgtcattgtcaaagcatgttatgattatgaatatgacttggagtcatttacttctctaactcctcagcaaccaccctggtctaaggcctcatgatctcactgacatcgtctgctaatagatttcctgtttttactcttgccaccctctaattcattccacaaatatcctgggacaggcagatgagaatttgtctttcactctgcacttaatagctctttcaccttaagcaagtcacttatgttctttgaatctcagtttcactatctataaattagagcagatgataaccaccgtagaggtgtgaagatgaagtgagatatcacatattattccacatccagactgatgttttaaagttgcgggacagtttttctccaactgtagtgtgtatgcaattgctaaggaaagatcatttttgaaatgcagattttgatagagtggatccaaggtggggcctgagattctgcatttctaataagctcccaggtgatgcaaaagctgccagcacctcattcacactttgacttagcaaggctagaggggataccaagataagtgacagtgatgcttgtcctttagaaaggagattatgcccttgtaaagataatctaaatatccacataccttcactttcattagtgctacagggagcatgtaaactctgaagctatttgagattgggatagatgttgattttactaaacattatacgagacagaccagcataaggtcacatctggctataacaaaatcattcaaggtgttgtaacaagatatacaacttagagaaagcaattagcaatttagaatatgaaaatatagatcatttttaacaaaaaaacaaatatcctggatcagacagataagaatttgtctttcattctgctcctgagtagctctgtaaccttaagcaagtcacttatattctttgaatctcattttcattatctataaattagggcaaataataaccaccgaagaggtgcaaagatgaagtgggatatcgcatatcaattttatgactgtgcctgacatatgatagtccttataaaataccaggtcttccttttcttttttttttattatactttaagttttagggtacatgtgcataacgtgcaggtttgttacatatatatacatgtgccatgttggtgtgctgcacccatcaactcgtcatttaacattaggtatatctcctaatgctatccctcccccctcccccgaccccacaacaggccctggtgtgtgatgttccccttcctgtgtccatgtgttctcattgttcaattcccacctatgagtgagaacgtgcagtgtttcgatagaagattttccttataacattagggtaagagaggatccattttgaatgttatgtttggcacccttaacatcttagagaaacaaaaaaggttatgaaaatagaataaataacaatgtaggtaataagcaagtatttttgtctaaatgaacactagaccatgagtcataaagctaagctttggtccaggattcagcattaactagatgtttgatgttgaactttatttaatgtcactggccctggtatgctttctacatcactgtatttaacgcagaacaggtgagacccaaactggggcttagccctcaagggttcttggctttgttcatgaaagagttcaggggcaagttggaggtagaagaaaacagctttattgaagaggcggtgttacagctctggcatttataactctgtgactgctcctgcagggcagggctaacccatatgcagagagtagcagcttacggcggttttgcagtcatatttatacccacttttaactacatgcagattaagggatggtttatgcggaaatttcaagggaagtggtagtaatttttgggtcatctggtcattgccctggaaagaggcagtaactcctgggtgttgttatagcaatggtaaactgacatggcacactagggggcgtgtcttatggaaagctgctttccattggccctgttttagctagttctcaatttggtctggtgttcaagccctgcctctggagtctagtcctgcctcctacctcatattcaccttgttaagtacattatcttcttacggaaatgcattatccttccatttcttttgattttttttcttttggaatatcagtaaatttcacagaaatattaaaattgtagaatcattgaataattagaacaaggattctaaacaagtttctttcctcctgaaatctctaccaaacaccttcaaacaatgttacaaagcttttaagaagtatatgaaatcaatgaactaatgtttctagttagagaacttcaatttttttaagattacacaggcatgcacattttcactgacaattgaaatttatttgctttacatgacactaagttgttctattaataactaagataccaaatataatttagaaatacaaaaaaagaggatgggtgcggtggctgacgcctgtaatcccagcactttgggaggcagaagtgggcggatcacctgaggttgggagttcgagaccagcctgaccaacatagagaatccccgtctccactaaaaatacaaaattagccatacatggtgatgcatgcctgtaatcccagctactctgtaggctgaggcaggagaatcacttgaacccgggaggcacaggttacagtgagccgagatcgcacccttgtactccagcctgggcaacaaagagtgaaacttcatctcaaaaaaaaagaaaaaaaaagaaagagagaaagaaatacaagaaaaagaaaaagcaatttggagaaaattttaaaaagcaaatcattttaaaagacaaactacaaagtactgtgtgagctaagccattcataatgttctcatggagctaatgggaaacaaatctgttctttcaaaataattgtaaaatttctgtgtaagaatgaatggaaaaggtcatccaaaaactacttgactacatatacctatggatctctatctaagtgctgaaaaatgaatttttttattcatttggttatgtagcatttgttcattctaattttgttttgttccctgtcatatctctggtacctagaataatccctaccacagagtaggtcttccattactcttatgcttttaaatctcccctcacctcattgtaaatgacttttgatttctcttttatgccctttttatacacctttcccttatatctccatttattcctgaagcttcatgggattcagccattgaggtcacttgggtttagatataccaaaagtctgtgatttctctgtttgcatatatgcacatttgttgttatccttacccttttctatcagttccttaccataacatacacttaattcttggaaattcactcatgtcttacaaagatggcaaattcaaacttctgctgtgtatgacacaccattaactgcacaaggacactgtgtatttgctacgttaatatttactgatgagttaatgtaataatgacccatccgcttctgctgcctgtgaggtactttctatctatagggatggaaattaatgacagaggctctctgagctgcctgatgtcagagctgagaaaggtgtgaggggtatataagagctggattactagttagcaaatgagggggtaaatattccagtggatacaagcttggactcttttcttgaagctttctttctatcagaagcatttgctgatattgctgacattgaaacattaaaaggtaaagaatttcctatttctgggaaagttttatttatttagagaaatgcacacttggtgttaaattcatggtttatttcaaagaaaggctaaagggagaatgtattacaatataaatgttcagattgcttagagaaggaaattgggaaagtaaaaatctcgaaattacttgaaaagtggacaatattaagggactgtatcaataaaaattttgatccttgtaaattacgttttaaaaagatgtttcttttaaaaactaagctctaatttaaaattacatcaattagaactgtaagaaatctcttgatttcagtgctggattattctttgcagaaaatttgagaagcaatgggcatcctgaagctgcaagtatttctcattgtgctctctgttgcattgaaccatctgaaagctacacccattgaaaggttggtaactttaaaatcctgtttctttgtaacttttgtaaagtgtgagaaaattagaattaaatactgtcaaataactacagccttagatttctgactatatcatacttaagaacagtaccttcagctattccattgttccttgaattctgtgttctttaaagaataacaccagtggcaaataaatatctttgatggaacttctgacagacaggaatggataattccagttttgtcaagaaatatactcttggaacttagaggggcaaagccagaacatgaagcgggaaaaaaatcaaaaggtagtaatttcttctatattaacctgatactgaaacaaaccagagaaacttaactaaagcatatatttttataccaagtggattctttttgtatatattacttagatttttgttttcctcagatgtctctggaaatgttaaaaacttttacatcttgtggaaatggaaatgtatagaaataatcaggagcaaattaatgtttttaagaaatgaaatctaaaagaagtagttaaaaagccatttgctgttgggggatttattctatattgctagctagctattctgtgagtgaaacagatttataaaaagttattcttcttattacttctaagctgctataaacttaatactttttaaaattactttcagtaggtagcatgtatgtcaggatttcctgggaagtcttattacgaaaggtttcatgtcatttaaatggtaattaaggacatctaacaactatgtcacgtaaaactcttagagtagttaaaattttcaaactgagattttaaaactgtaatttatttaaagggttattaagttcaaatatgtgcataagtcataaataacatagtgaggatttgtttgtgcctaaattagttttgctccatatagtcttatgggactgaacttacacactctttaacaccaaggagaattaagtttacctttgtaaagagtgtgcatgtcatattataattcttctcattagaatgatcgtcatcttgtctttgttttccttcgaggtagtttttcttggaagcccatagcaatatgcaaagatttctacagcacctacgtataataaatagcaagaatcattatcagaggctttttgtcatttcaaggcttatttagtttacagggtgttcttctcagaactgactgtaattttctatttgctttttcataaaaataacttttaaaatgacatgaagtttctgataagcagaatatctgaatgatgacaggaaaatcagtagtatttcctagtatatctgtttatatcttgatactttctttcaatagatatagaaatttactaagcacttttaccctctcttttttttattttattttgagacagggtctctctctctctctctctctgtctctgtcacccaggctgctggagcacagtggtacaatcatggctcactgtagccttgacattctaggctcaggtgatcctcccacctcagcctcccaagtagctgggaccacaggcacctgccaccatacccagctaattgttttatctttattttatagggaaagggtctccctatgatgcccaggctggtgtcaaactcctgggctcaagccttcctcctgcctcagtcttccaaaattctgggattataagagtgagccactgaacccagaccattatgtttttatagatgtttgtttattatgagagaaacttcacttagaaatagagcaatatgtaatataatattacttgttataaaattattttgatgttagtctcacaatctttaactttgaattattagaaatcttgtaaaacattcttcaaattgctttttaatatgttgcctgaaatgagtatgtttgaacatttgttaaagggagtatgatttgtcatgctgagatgttaaatcatgtactattctacatatctcacagaaagctaggaaaatctatggggaaaatgtgtcaaattttaaactctttttaaaaaataaaactaacattattcaatgtcattttcctcacaaaatttaatcatctcatttgagattttttcaatttgtaaatgtatgaaataggataaaaggatcacatactttcccaccaacttttttacactcccttgtaaatatctgcctggcaggtaatcaaaggatagttaaaaatataattacatagatgccaagatgcaatcactaggatctccctgcaggagctcacatacttccacagatgaatgttaaggctgagagcagggactcactttaaagtcattttgaaaactctggagagacaatttaaaagagaggcaatttaagagttatactttggcttattgtcatctctgtttaaactctcttaaagtcaagaatttccatgtgtgtatgtgcctgtaagtggtctacagctttaatgtttgttactagctcgtatgttacctgtccaggtagtcaatgagaaaaaaatgcctgaaaccagggaggtaatgccttttattaaccatttcagacaactttttccatcctaaagattgctttagatagaatcttatatatactgaatagtatatttagatgaaaagtcttttttagaaaagcaatttcacaaatatgataaaaacataaatgcttttactatttcttctaagtggaatgatggcccatctagctaactcaaataaggtaacattttatttagaacaattttaaattatattattgaccttccaaccaattatcaaaataccactcagcatttagcatataaagtatttcacactgtgcttcagtcatatgctaaacatatcttggaacagatattacctttgaatcttctcaatttgacccataattttcctttattactttttttgagatgtttggaccaaattccaatttttactgtttttcaagaaaagtaagtattttagaattcaatgcaaatgtatgaaattactagttcaatccttaaagcataaatcactcttttgaaatgtacattggtcatatttatggtaccttcaaaaataaataattgaacagatagtgtgaatgagattgatataggttaaataattagatcccaaagtggttttctttgcccagataatttgttcaaacatttgtcagcatacacttacattcaacaagtatccagttcacctaatgctgtaagaagttttctgtacttaggaagaaatatgggagtaaaatttaaaaaaaaaacagtttcacatgagattattaaatatttactcttaggctatctctacttagagatagagataatgaaatactccccacacaaggtaaacacaatgagataaatccattgcatttgagtcccagattatgcatatccactggctcctggacattgagtttttagccctataactatttcattttccatttaccctaagtttcaccaatattttgatttctatggagctgaaaactaaaacatttctctaactttcctaataatcagcaaagaggaagcaatgttattattctgcatccatttccgatatcgttttaaaagcacattgaaacaaaaggctgtcaaaaaaatagagttggtatacaaataaatgtcttaaataaaaacataagttaaaattaaatgaattatttaatgtgtggttatgatttctgagtttataagtattattatgcacttcttccaggtggctagaaaaatgtgatgaatattaataccattgacataaaaagtcttttggttttaacatttaacctagtcttatcattaaaattcttgaaagcataagatccaagcaggaaaatgtatttatgctaaaagtaataaaactctcacactgcaatagagtacctgaacaggtgatagatttgattcttttggagactttatgatattctctttttttgacatactttttatgacattattttttactttattatatttcattttattgttttaagaacaaagcatgatatctacccttttaacaaatttttaagcatgcaatacattattctggattatgtgcaaaatgttgggcagcagatctctagagcttagtcatcttgcttgactgaagctgtacacccaatggttagtaactccctatttccccctctcccttgcccctgataaccaccattccactctttaactcatgaatttgactattttaaatacttcatatacatggaaccaagtggtatttatctttctatgactagcttctttcactcaacctaatgtcctcaaggttcatccgtgtgttgcatattgcagaattcccttatgacatttcttgcataacactcctgattcaattatctcaaggaacttaaagactaagtaatgctgctttattcttattggaaagatgtagaaataattatttttaaatttcttcatatttcagattacatataaattttaccttctaaattctttttatatattaaaaataaattcttcaagatttttaaaaatgtaagacaaagacactgttattttgattatatgtaatatattctgaatttccaaaggaagacttttaactgagaaatgcaacattgactgtaatgaaagatgttgtatgattttcaattgttatttcaaggtgtcaaaaaaaaatctcagccatctaggtgtttgcaaaccaaaacactgagttacttatgtgaaaattgtttctttggttttcatcaatacaagatatttgatgtcacatggctggatccagctaaaattctaaggctctaacttttcacatttgttccatgttaccagtcatcaggtggaaaagcggaaatgcaacactgccacatgtgcaacgcagcgcctggcaaattttttagttcattccagcaacaactttggtgccattctctcatctaccaacgtgggatccaatacatatggcaagaggaatgcagtagaggttttaaagagagagccactgaattacttgcccctttagaggacaatgtaactctatagttattgttttatgttctagtgatttcctgtataatttaacagtgcccttttcatctccagtgtgaatatatggtctgtgtgtctgatgtttgttgctaggacatataccttctcaaaagattgttttatatgtagtactaactaaggtcccataataaaaagatagtatcttttaaaatgaaatgtttttgctatagatttgtattttaaaacataagaacgtcattttgggacctatatctcagtggcacaggtttaagaacgaaggagaaaaaggtagtttgaaccttggtaaattgtaaacagctaataatgaagttattcttgacatgagaaaatcagtaattggaccaggcgcggtggctcttgcctgtaatcccagcactttgggaggccgaggcaggcagatcacaaggtcaggagttcgagaccagcctgaccaacatggtgaaaccctgtctctactaaaaatacaaaaattagccgggggtggtgacatgtgcctgtaatcccagctactcaggaggctaaggcaggagaatcgcttaaacccaggaggcggaggttgcagtgagccgagattgcaccactgcactccagcctgggtggcagagtgagactcgtctcaaaaaaaagaaagaaaattagtaattgtaagtacccctgataagcaaattagtaattgtcaatacccctgttaagcaattcctttttgcagtatatttctgaaatgacagaatgctgttttaaaaacaaagaaataaaatcctgctcctgactcggtcaaaatattttttaaagtctattgtttgttgtgcttgctggtactaagaggctatttaaaagtataaaactgctttgtatccatgagggtttcattgtgtgttagcagcagtgagcttctattaaatgtatatgtcatttattttgtttaagtggctttcagcaaacctcagtcatattcttatgcagggtattgcgaaacaacttgtgttctattaatcgtgtcttcaattaaaagaccacagacttctggaaactctttgctgtataagaattatttcttttgtttaacaaattagacatttctggcagaggttatgtatatgatacactttttttgatagcagctgcaatgttggacagaagatgaaatgctttgctttgagtcagattcttatgaatatctgcttttccctgactttgagttaggtagctttggaagtagcattaattcagataaactgccatcatgctgcgttatgccatttctaaagacactcaacttgtacttttaaaaaaatagaaaaaataagcatttcaatctaagtggaaatttgactcattgacttacatttctaagttaaaatttccctttatgaagtgtgccttaggttaccaaattgtagaggctttcgttggtggtggtaagtggtagcggtagtgagtgtatagaggcagggaaatatatttataataaattctatgtcatgaattacatattgaaataaataggtgaatatacaaatttatatttgtgatgctcaattgttggtccttctttcaaagtggcctcaaacccaatatttcaaattgaataaggtacaattaaattataatctctcaaacttatttgaaaaatttcccacaatagtctacagttttattgcatatcacacctatatatgatataaataggtataacaaaatatgtaatttataatatgtcaagttataatatcaacattatatttaggtttataaatattacatatatggatttgttatttaacattataatttatttcaattcccccatctctctttctagtgttaacaaaattttaatgagtgcatatcatgttcaaggacattgcctatggtagcatacaattcccaggaattaaacaagaagaattatgaatagtaacccaacaacctctggtgctagagattaaaacatagttagagtgactctataacacaaaggttattatatggatacagcagatattaatcgaagattttattctgaagtttattcattcaatttcttacgaaagtgaaacatttaaacaaattcagcattatttccttagttaggttggtatttgcagctcagtaaggaatcaaatacataaagactgagaatacattactgccagggagcttactgagtgtattctctggtttctcacaactactttgggaaaaaaataatgagaataactaaattattgtaattggaggtaccaacagtaaaattttggtgactacgtttatcttaacctttctcattgtgtctaggtacatgaaatcataggtacccttgagtaacctgagtgagttaggcttccaagtgctagaatgggtagctaggcaaccatgagcagggaagagagggccccccaacccaacccacacccccatgcccccactgccccagcccccgaccaagaattatcaggcgactatcagctgatggtcaggtgattgttaaattgtctctctaaaataataactggtcgtagccagcaccagagaaaggtagactcccaataggtagaaaacacctaaaactgatgatcggcagcttccagataagatctcagaagttgggtgagtgggcttaagtatgtacactatgagaaaaaatgacagagtttaactggtatatgatcccaaaaataaatgcaacaaaaacaaaaataaataaatgggatgtaattaaactaaaaagcttctgcacagcaggagaaataataaacagagtaaacagacaacccacagaatcggagaaaatatttgcaaactacccatccgataaagaactagtatccagaatctaaaaggaactcgaacaaatcagcaagaaaaaaataaataatcccattgaaaagtgggcaaaggacatgaatagacatttacttaaaaaaagatatacaaatggccaacaaacatgaaaaaaatgcgcaacatcactaatcatcagggaaatgcaaatcaaaaccacagtgagataccaccttactcctgcaagaatgtccattattaaaaagtcaaaaaacaggctgggcgtggtggctcacagctgtaatcccggcactttgggaggctgaggcaggcagatcatgaggtcaggagatggagaccattccggccaacatggtgaaatcccatctctactaaaatacaaaaaattagccgggcatggtggcatgtgcctgtagtcccagctacttgggaggctgaggaaagagaatcacttgaacccgggaggcagaggttgcagtgagccaagatcatgccactgcactccagcctggctacagagcgagactccgtctcaaaaagaaaaaaaagaaaaaagtagaaaaacaatagatattcgtgtaaatgtggggaaaaagaaatgcttacacaatgctagtgagaatgtaaattagtacaacctctctggaaaagaatatggagattccttaaagagataaaagtacatctacaatttgatacagtaatcccagtattgagtatctaaccaaaggaagagcagtgattatatgaaaaacacacttgcacacatatgtttatagcagtacaattcacagttgcaaaggtgtgaagccaacctaagtgcccatcaactaatgagtggataaagaaaatatggtatttacccactatgggatactactcagccattaaaaggaatgaaataatgtcttttgcagcaacttggatggagctggagaccattattctaagcgaagtaacaacaagagtggaaaaccaaaaactgtatgttctcacttacaagggggagctaagctatcagttatgcaaaggcacacagagtgatataatggactttagagattcagaagcgggagggtgagagggggccaggaataaagaaccatcagtcagatataatgtacgcttcttgggtgacaggtacactaaaatgttaaaattcaccactatataattcatcggtgtaaccaaaaaccacttgtaccccaaaagctattgaaataaagaaatgataataaatttttaagaaagaaaatggctgatgcggtggttcacacctgtaatcccagcactttgggaggccgaggtgggcggatcacaaggtcaggagttcaagacaagcctggacaacatggtgaaaccccgtctctacaaaaatacaaaaattagccgggaatgatggtggaagtctctaatcccagatacttgggaggctgagacgggagagtcgcttgaacctgggaggcagaggttgcagtgagccaagatcatgccactacactccagcctgggcgacagaagaaactccgtctcaaaaaaaaaaaaaaaagaaagaaaagaaacgaaaaaagaaagaaagaaaatgagctgacttatctaagatcacatagtcaggatggattcaggattgaaactcaggtatattgactctgaagtgcagacaatttctctacatcatgtccaaataaaaatatttttcttttactcccactttgcactgtgttttattaaatgtcagaccatgccaaatcagtctgtcttgaaactggacacacaggtcaggcaaaagaagaatgggactaaaatagttattcactttgtctgatattgagaataacaatctttaccctacccattatgagatacttttgctttgttttattttgttttttaaggttttaactggaagaaagttaaaaaaaattcaatacacttactaaatatttccaacactgaaagattgctggtagcacatcttttttttcttccaaaatccaaatgggattgtcctattttctttgttccgtatacaactaagaacattttcttctatggttcaataaaacctttgccgactaagtagacccacatcctatagctggtcccttaacgtcctccccatggaattttggtctatattttcatctgcctcattactgcttcccttgtgcattaaccatcccataccccacactcacctgcctccacgttcttgctttatacaacttgctgccttgaaatatcctttcctcacctctgggatctacactgtaccctggttctgctcaaagaccacactgtccatggagcctatcatgattctttccgtcatacatagataagagtctcacacagataagagtctatgtaaatacaggtcctgaatttacatagacattccctcagtcactgaacatgtttagtgagcttatttttatatttgatatgatattagtggttgggattttgagaccacctagaagaagttcacgggttctaccttattttttggttatgtatgctcaagtgttatttccccatccagcctgtaaactaactgaggtgaaggatgtatgagtcatctctgtaatccccacaacatttaagcccattatgtgcctataacagatgcacaatacatattggttgaatacatttactctaggaataatgaaaaaacaaattattttaatataaatttataatacagtgtgattaagttgatagagtgtggcatcttatactccctttgtaaaacggatagtaatatctatcttgaatagttttcttgaagattagaaataaaatatgcaaagtatctggtatatttttaatgtccaatcagtgataactgaattaacaatgataactacacaaaccaaagaacagtatggtattacagtgggtactttctaaattcattttattaagaattttaaaagagacagagaagaaaaaaaagtcagtcacaaaagcgggtacaaaacaatgcagagaaagcttcaaagatgaacaaaaaggaaaatagaataatgaaattaatctacccaaatcctaaatgagatttgcataagtagataccttccctgctccaataacaaaatgacacaaagaaacttgtaccgcacaaccacatctagaattacgaaatgcttaaagaaccataaagatactggctctgaaaatccaccacttctctgtgggaacattccttatggtatttagaacaaaggttatcatcagtaggaagtggcacacaaacccttaaaaggatatcacagacaatatagaaacagcatatctggtaagtttatcagggttgtaagtagattagaatagcaggaagaaaatctaaaatactaaaaagatataatttaagtagttagaaatcttaccacatagataacaaactgcattaataaactttttaaaacttgaaatcatggaaaggcattataaaaagaaaaattaaatatatcaaaaaaatatgtccacttagtttttttttcttttttttttttttgagtcggagtctcgttctgtcactcaggctggagagcggtggcgcgatctcggctcacttcaagctccgccttccaggttcacgccattctccagcctcggcttcccgagtagctgggactacaggctcccgccaccatgccgagctaattttttgtatttttagtagagacggggtttcaccttgttagccaggatggtctcgatctcctgacctcgtcatccgtccgtctcggcctcccaaagtgctgggattacaggcgtgaaccacttcgcccggccagattttttttaaaaactcttttttaccttcatggacataatgccctgattatcatataaatatataaatatgaaacctctgcaattgaaatgctgaaaatttagtataagtttacgtgaaagctaggaggctgtggtcccacatacagctataactgttataaaactctcttctggtttctgatcactcacttctttgtattgactccatgcctccactttgtaaatacaaataacctgatcaagcaacagatcttgagcagaaactctgtccagaatttactccataaccttctataatttgaaattcattcttgtgcataagtgcttttcagttgaagaatctctcattaaaagacaaatccttcttgaaataaaaactctcatcaatatcaactaacagttgaagttagctaacagctggttaagagcaaagctctaagagaacaggataggcaccttaagcaagaacattggtagaggactggtaggggtaaactgtgaggaaagcaaaacggaaaaagagcaaaagagaagggcatgaaggagtcctattaccgtacaatgtctctggttgggctttgagacccatatacatttgcaatcacttttcttcacacagctgggtgtgataaggatttaaagcatctattccactctggttttgaaatcctaatatgttaacctggaggatgggtagaggaggctggcatgacaagacagggaaaggagcaagacaacagaaacagatttgtttttctgaagcttcatcagccttctgaaaacagtatttgatccttacgaggtgcttagaaaccatatttttccagaacccctcctgcagaaaagccactggaaaataaaagaggatatgaaccagaaccaagcccttggagtacccagatattcaaactcagttttcagagctttatttgatttcaagtttatgattattatctggctatgccaagagatattgtctaagtgttttcaactttcatattgaagtaaaatttaaaatgtaaagaatgtcctgctgtgatgccaaagagcaaaaagtcaataggatactgaaagatactatagtagggtcattggtgcaatgggaaagacaggatttttggaatcaggcagacctttgttaggatacttttttaaaactttgaatacatttcttggcttatttttgcttcagttttcttatttatatattaaaaaaacaatatctgccttgcaaagatatgaggatgaaataatgtataaaaagcccttagcatataacaatccctagtgatatggtttggctgtgtccccaccaaaatctcatcttgaattgtcactcccataacccccacatattgcgggaggggccaggtgggaggtaattgaatcatggaggtgggttattcccacactgttctcatgatagtgaataagtctcacgagatctgatggttttataaagggcaattaccctgcacttctctcttgccttttgccatgtaagacgtgtgtttgcttctccttcaccttctgccatgattgtgtggcccccccagccatgtggaactgtgagtccattaaatctctttttctttataaattacccagtctcaggtatttcttcacagcagtatgaaaatggactaaagcagtaaattggtaccgggattagtggggcactgctgtaaatatacctaaaaatgtggaagcaactttggaactgggtaacaagcagaggttggaatagtttgatgggttgaagagaagacaggaaaatgtgagaatgtttggaacttcctagagacttgcagggctttggagacaggaaaatgttggaaagtttggaacttcctagagacttgttgaatggctttgatcaaaacaccgatagtgatatggacaatgaagtccaggctgaggtggtctcagatggagatgaggaacttcttgggaactagagcaaaggtgactcttgctatgctttagcaaagagactgctggctttttgccccggccctagagaattttgaacttgagagagatgatttagggtttctggtggaaaaaatttctaagcagcaaagcattcaagagatgacagagcataaaagtttggaaaacttgcagcctgacattgcagtagaaaagaaaaacccattttctggggacaaattcaagccagctgcagaaatttgcgtaagtaacaagaagccaaatgctaatcaccaagatgatggagaaaatgtctccaggacatgtcagagaccttcacagcagcccctcccatcccaggccctgaggcctagggaggaaaaatgatttcctgggccaggtccagggccctcctgctgtgtacacccttggaacttgatgccctacatcccaggcactccaatcatggctaaaaggggccaaggtacagctcaagcttggcttcagaggatgcaaactccaagccttggcagcttccgtatggtattgaccctacggggcacagaagtcaagaattgaggtttgggaacctccacctagatttcagaagatgtgtggaaacacctggatgtccaggcagaggtttgttgtaagggcagggccctcatggacccctgctagcgcagtgcagaagggacatgcggggttggagcgcccccacagagtccccaatggaatactgcctagtggagctgtgagaagagggccactgtcctccagaccccagaatggtagatccaccgacagcttgcaccgtgcacctggaaaagccacagacacgcaacaccagcccataaaatcagccagaaagagcactgtatcctacaaaaccacagaggtgaagatgcccaaggccatggaagcccacctcttgcatcagcacgacctgtatgtgagacatggagtcaaaggagatcattttggaatgttaaggtttaatgactgcccattggattttagacttatgttgggcctgtagcccctttgttttggccaatttctcccatttggaatgggtatatttacccaatgtctgtacccctattgtatctaggaagtaacttgcttttgattttgcaggctcatagacaaaagggatttgccttatctctgataagactttggacttggacttttgagttaatgctgaaatgagttaagactttgggggactgttggaagggcacattgtgttttgaaatgtgaggacataagatttgggagggaccaggggcagaatgatatgatttggctgtgtctccacccaaatctcattttgaattgtagctcccataatccccatgtgtcatggaagggacccagtgggaggtaattgaatcatgggggcggtttttcccatgccgttcttgtgatagtgacatttcacaagatctgatgattgtataaagggcagttcctttgtacttttctcttgcctgccaccatgtaagatgtcctttgctcctccttcttctgccatgattgtgaggcctccccagccatgtggaactatgagtcccttaaatctctctttatttataaattgcccagtcttgggtatttctttatagcagtatgaaaatggactaatacatctagcaatacaacactaatttttaactgtaatcattactaaaattctagggtactgtggcattgaccaaagcatgaaatattaaaaaatattatgccacttcactactttcatatatggccctttcttgattctaagacttctgaaaaaaaaataagaaaatatgtaagcccacaggttaagatatttaggagattctaatagctgcaactggtaaaatgctgcaaatgtaggatttgtcttccagagtatatgcaaacatagacctagacccttttgtacctcatcattgtaaataccataatacagcaatccaatggatgcttaaatgtgactatttttaagacacaatgtactgagcctcttcaatagctttaaaatctcacacatctgtggtacatgttgccctgtcaatatttgcgagcttaggagctgaataacctaaaatgggtaatgtactaccttacaaccaaatatgagttagggtcactgtgaccagtaatctgaggtaaactgttttttcatctataataaaggaaggcaacaagatatcaatttacttgtcaaaaatagttataattattacaggtacattgtactatatgtttgtatctggaaattagcctctgcaaagcttatgttattactgcctacacgtttttctttctcacttttcttagaaatatatatttaaaacttaacttagtctgtagaaatacccacaaatatggtcaaaatgttatgcagataagacatattaacaagctaagatccagatgcagataagacttattaagtcttatccaatgcagataagacttattcacaagctaagatcttaagttaacaaatgatcaatgtcccaactggaaaccagaaactcaaaatacagtctaacctctgcactcttatgtatccatatgaagaacttattttttcatgtaaatggaacaaaatatagcaaaatcaaagattttttgacatgacattatagttcatattgaatttagatattagacagaccaaccaatgggtcccatctaggatggattttaacaccaagatttacagcataaagagtaggcacacacatacaaatcacaaatggcataagtgccactaagaaatgaagaaaaagactcatgcacccacagagatacaagaaagaaaatgagtaggaaaaataaactatctggtttcttcttcaaaataaaatgcttcctatgggtttttattatataattctattatattactaattatattatataattatagtatattactaatatacttttatgttaaaattaaattgcttttaatggcaaaaagacacaattacttttgcactagcctaatatttacatactgcttcttcattttaaaatgcaaataaatgtatactgttacgctagatcaccatgttatattcttataaaaatagatggaattatacagttactatcaaaaatgtgtaacttgtaagacaaaaatgttggtgaactatgttcacattaccaactatttactgctagagttttatagaaaattttaaataacagaaagatatttgtagtgtcaggaggcatctgaccatatggccaaacttaaataaacttacatagatatgagtttctaaattactgttgcatactttattttactcaacgaacattgtcatatggaccttaaacagtgtctaatgtccacaaaaaggaaaagaaggtaaacttttgaaagatagccttttaaaaatctgaaatacaaatatatttatagttaaaatgatgataaggtttgtaaaatgtggttgtggaagaataaagatactattttcttgtccttcaacttctcaattcccccaacacatttcctagtctacattttcctattttttttcctgtcttgcaaacatttacatcatatactgtacttggatgacattttggaacacccaagctgctactgcaacaatggaattgatactaacttttaaacccaaataacagaaatatttctgatgctttggtgattgccaaggggccatcttggtagatctcttaggcttcctagaattgactcaaataggagatatctaaatcttcttttgctgaatcctaaaaagattagatatccacatagcatataaaaaaatgagataaattatgtaaagtccctcttagagagcctgaaatgttataaatttcaataattggtagctcctgctgctagacaaattcactgaaaagttgtcagccttcagctctgtcttgtctttgttctgcctctgagtagctgtattaagtaacccctaagccacattctattttctgtcctcatttcaaaggtgggacatgtctttgaacacttacttgttttctgtcttacaagaaacaactattttgagagatttaaaatgtgtaaatttctgaaattttccatgtaaatgtaacaacatatcacagcaaaatcaaagatttttctgacattatagttcatactgaatttagatattagacagccctaccaatgagtcccatttagcatggattttaacaccaagatttacagcattactataagtgatgaattctcctttaaaaatacccatttatagaggagcccaaatttgattcaaatgctttgactgtccttatcaatttcagtctcgtggagctgatgacatgcctctgaaacaaaatctattgtatgattcatgaagttgtctgttagttaaatggcaaaatatatatataagctgaaaaactagtaacagcatgctgaagtgaaagaagagttgcaggaaggaaaaattataatcctggtgtctttctgagcataatgtattattgaaaaatactcaaaagttgcgataatgtactgttgtactcccaaggaatatttacatttgaaaaggatagtaagtgcaggtaccttgaacaaatgggatttatgtggtgacatcagaaaagaagctagttcttcctccactgcctatcaaattcattttataggtccattttttttaaattccactgacactgtaatctcaaacaggctgcactactttccgttgacattcaaaagaaaaaaaaaaaagcaaaacaccctctggtcacttttagttcccccaaaaggtgcagttctggattaatatgtctagttcactttgcactttacgtaaaccaaatctccttccctcccactacatcaggtccaaagcctacatttgagaaagaaggtctaggttatttctctatttttcatcctagtttctctccttctgccttcctttttctcccacaattgaacaaagctgctctatctcctctagagttgaaatttaaaggggaagagttaatgaaggaagaaatgtcttccttgattcctttgcccagagcagtatttaaaactgactctttctcttaaggccactttcttggattctttggagattccacccctcattcatggtctgacatctgcagtatctttggtggggtaaatgcatcgcctctgactaatcacatacaatttctccctgcaactttagatattcaacatacacttttagcctctttctactaaactctcatcaccactccatatgatccaatcattctagatgtaagagccccaaagtagctctgggtaacccatcgctggctggggtgaagctccttttcaaatgtagccctctcttcaattcacctcctggcaggtggatccagccacagcctttttgccttttaggcttcttaaatttcctaagtatgaattggacaccagtcccctgtgtctcccaaactgcagaggacaaatataaagcactctgagcaaacttaaagtcatgctcactaggctttaaatcagaagaaagaatagcttacctccccctaacagaagtgaaagtgggacacacagcacaactctctctacagaaacgacttttatttttatctctaccctttgatctctagtgcacctctctacctctacaacctgttacacatgctggcaatgagagttttcataaaacctcttcttgtacatttcttttacaagttccctaggtggtctaaaataggttctccaaaccaaggtatatgaatatttagaatgcataaaattttccaatgggtacatgaacatgaatagttttaagagaagtcactttcaattcttcattttccatgtagacccttttgaaaagccaacctctctgaaaatgtatcttaagtttagtcatcatgctagtccttctttcccaacccttgacccctgcataatttcctttccaaatgttacaaaaggaaggacttatctctcacctattctaaatcttactgtggcacatttcatcctcctctcctattatcaataattcatgcctcctggagcagaatcacatgagaccatatttctctaagtctcttgtttagcactggccaaataccttaggttttgtagttaattttctaacagaagatttcattgtacatttaaaatcagaatatatatatatgtatatgcagataaagatcaagatcacataataagaacagaaccgataataaaccttctatcaatctagcaataagtagaacacagccatggttcacactgcacagtgattttcattgcatccccaaaagcaatctaggtaacaatgcactaaaccttagaaaaccagtttcctttatttaagattaattactcctgttcagagaatgatatacactgattctattagatgcataataagaaacaaccattttcaattgtgaaagaaattctaatcaatatagatataaaattctcaaaaatatttatttctgttgctctgtcaagatttttgaagctgcttagagaccagccggattaaaaatttttaatttggcaaagataaataaatctttgctcagcttatcaaagaaaattctgcaatagacaatgcccaatttaatttttttaggctgatataatctacttgtagcttcaaaaaccaggtgactgtaagagataaacagatacggttactaatccttttttcaatctagataaaattgtaaggtatatatctcagaaattggcaaaatgaaagattctaataactaacatattcttctgtaaaaattttgattgttttcaacaaacttgaaagaaaaccaacttatcaattgacagtaatttttgatattgcaacacaatttgaattttgacatgtaactacagagggttcaaataaccaagcgacattactgtagtaaaatgccttccttcaacaacatcttcatgtaaacatatttcctagtgcttacctctataaaacaataacagaactgataataaaccttgtatcaatctagcaataagcagagcacagccatggttcaatattgcacagtgaccttcatagagacaagataaaactagggtttctgtaagtgaaaactgcctttccagatcaggtgctaatagatttcaagaaagaaacacgggcccatgaacaagacagtgcttcaaaagacactgtctatgtatgtctttcttcccattctggtcagcttgccttagtggctcagcaacaatatgaaatgttgggtcagtgcagtgggctgtgatcccagcactttggtaggccaaggtgggcagattatttaagtccaggagtttgagaccagccttggcaacatgatgaaaccacatctttacacacacacacacacacacacacattagccagaagtggtagtgcatgcctgtagtcccagctactggggaggctgagatgggaggatctctttagctcaggaggtagaggctgcaagtgagctgtgatcgtaccaccacactccagcctgggtgacagagagagacactgtctcaaaaataacacacgcacacacacacacacacacacacacaacaaaaaacaaaaaaaaaagaaaaagaaaagtgcagggagacatactgcagttagagcaagctattcctgaacaaggtgatacggccacctccacaaaatctactgtgcacagagaagaaaaagtgcttagaatgctggtcctggggaatagtaaattatcccatcgagaggcttgtataacagtttttttcttcagatatttagatatttctcaacacctgggagtgggtggtacactcaagccaataatatcaattgctaaaaagattaattcacataaaataacagatccttccactactatttcactaacaattgcttaccatcttgtcaggaagatgatgatagtaacatagcaggcacttcacaaagcaccgtaagtgtgctgtgaaataaccaaggtagtcccattaaaatcaggaacaaggggagaggagccaagatggccaaataggaacagctccggtgcacagctcccagcgtgagcgacgcagaagacgggtgatttctgcatttccatctgaggtaccgggttcatctcactagggagtgccagacaatgggcgcaggtcagtgggtgcgcgcaccgtgcgcaagccaaagcagggtgaggcattgcctcacttgggaagctcaaggggtcagggagttccctttctgagtcaaagaaaggggtgacggacgcacctggaaaatcgggtcactcccacccgaatactgcgctcttccaacaggcttaaaaaacggcgcgccacaagattatatcccgcacctggctcggagggtcctacgcccatggagtctcgctgattgctagcacagcagtctgagatcaaactgcaaggcagcagcgagactgggggaggggcgcccgccattgcccaggcttgattaggtaaacaaagcagctgtgaagctcgaactgggtggagcccaccacagctcaagaaggcctgcctgcctctgtaggctccacctctgggggcagggcacagacaaacaaaaagacagcagtaacctctgcagacttaaatgtccctgtctgacagctttgaagagagcagtgggtctcccagcacgcagctggacatctgagaacgggcagactgcctcctcaagtgggtccctgacccctgacccccgagcagcctaactgggaggcaccccccagcaggggcacactgacacctcaaacggcagggtactccaacagacctgcagctgagggtcctctctgttggaaggaaaactaacaaacagaaaggacatccacaccaaaaacccatctgtacatcaccatcatcaaagaccaaaagtagataaaaccacaaagatggggaaaaaacagaacagaaaaactggaaactctaaaaagcagagcgcctctcctcctccaaaggaacgcagttcctcaccagcaacggaacaaagctggatggagaatgactttgacgagctgagagaagaaggcttcagacgatcaaattactctgagctacgggaggacattcaaaccaaaggcaaagaagttgaaaactctgaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaacggtatcagcgatggaagatgaaatgaatgaaatgaagtgagaagggaagtttagagaaaaaagaataaaaagaaatgagcaaagcctccaagaaatatgggactatgtgaaaagaccaaatctacgtctgattggtgtacctgaaagtgatggggagaatggaaccaagttggaaaacactctgcaggatattatccaggacaacttccccagtctagcaaggcaggccaacgttcagattcaggaaatacagagaacgccacaaagatactcctcgagaagagcaactccaagacacataattgtcagattcaccaaaggtgaaatgaaggaaaaaatgttaagggcagccagagagaaaggtcgggttaccctcaaagggaagcccatcagactaaaagtggatctctcagcagaaaccctacaagccagaagagagtgggggctaatattcaaatttcttaaagaaaagaattttcaacccagaatttcatatccagccaaactaagcttcataagtgaaggagaaataaaatactttacagacaaacaaatgctgagagattttgtcaccaccaggcctgccttacaagagctcctgaaggaagcactaaacatggaaaggaacgactggtaccagctgctgcaaaatcatggcaaaatgtaaagaccatcgagactaggaagaaactgcatcaactaacgagcaaaataaccagctaacatcataatgacaggatcaaattcacacataacaatattaactttaaatgtaaatggactaaatgctccaattaaaagacacagactggcaaattggataaagagtcaagacccatcagtgtgcagtattcgggagacccatctcacgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatgtgcacccaatacaggagcaccaagattcataaagcaagtcctgagtgacctacaaagagatttagactcccacacattaataatgggagactttaacaccccactgtcaacattagacagatcaacgagacagaaagtcaacaaggatacccaggaactgaactcagctctgcaccaagcggacctaatagacatctacagaaccctccaccccaaatcaacagaatatacatttttttcagcaccacaccacacctattcctaaattgaccacatactgggaagtaaagctctcctcagcaaatggaaaagaacagaaattataacaaactatctctcagaccacagtgcaatcaaactagaactcaggattaagaatctcactcaaaaccgctcaactacatggaaactgaacaacctgctcctgaatgactactgggtacataacgaaatgaaggcagaaataaagatgttctttgaaaccaacgagaacaaagacacaacataccagaatctctgggacgcattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccactagcaagactaataaagaaaaaaagagagaagaatcaaatagatgcaataaaaaatgataaaggggatgtcaccaccgatcccacagaaacacaaactaccatcagagaatactacaaacacctctacgcaaataaactagaaaatctagaagaaatggataaattcctggacacatacactctcccaagactaaacaaggaagaagttgaatctctgaatagaccaataacaggagctgaaattgtggcaataatcaatagcttaccaacaaaaaaagagtccaggaccagatggattcacagctgaattctaccagaggtacaaggaggaactggtaccattccttctgaaactattccaatcaatagaaaaagacggaatcctccctaactcattttatgaggccagcatcattctgataccaaagccaggcagagacacaacaaaaaaagagattcttagaccaatatccttgatgaacattgatgcaaaaatcctcaataaaatactggcaaaacgaatccagcagcacatcaaaaagcttatccaccatgatcaagtgggcttcatccctgggatgcaaggctggttcaatatacgcaaatcaataaatgtaatccacatataaacagagccaaagacaaaaaccacatgattatctcaatagatgcagaaaaggcctttgacaaaattcaacaacccttcatgctaaaaactctcaataaattaggtattgatgggatgtatttcaaaataataagagctatctatgacaaacccacagccaatgtcatactgaatggacaaaaactggaagcattccctttgaaaactggcacaagacagggatgccctctctcaccactcctattcaacagagtgttggaagttctggccagggcaattaggcaggagaaggaaataaagggtattcaattaggaaaagaggaagtcaaattgtccctgtttgcagatgacatgattgtatatctagaaaaccccatcatctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacaaaacagagccctcagaaataacgccacatatctacaactatctgatctttgacaaacctgaggaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaagctaggcattaccattcaggacataggcattggcaaggacttcatgtctaaaacaccaaaagcaatggcaacaaaagacaaaattgacaaatgggatctaattaaactaaagagcttctgcacagcgaaagaaactaccatcagagtgaacaggcaacctacaaaatgggaggaaattttcgcaacctactcatctgacaaagggctaatatccagaatctacaatgggctcaaacaaatttacaagaaaaaaacaaacaaccccatcaaaaagtgggcgaaggacatgaacagacacttctcaaaagaagacatttatgcagctaaaaaacacgtgaaaaaatgctcatcatcactggccatcagagaaatgcaaatcaaaaccacaatgagataccatctcacaccagttagaatggcaatcattaaaaagtcaggaagcaacagatgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaacgactataaatcatgctgctataaagacacatgcacatgtatgtttattgcggctctattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgtatattctcactcataggtgggaattgaacaatgagatcacatggacacaggaaggggaatatcacactctggggactgttgtggggtggggggaggggggagggatagcatcgggagatatacctaatgctagatgacaagttagtgggtgcagctcaccagcatggcacatgtatacatatgtaactaacctgcacaatgtgcacatgtaccctaaaacttaaagtataataataaaaaaaaagacaaaaaaaaaatcaggaacaaataaaggttcccagctaatatcattattattcatcactgttgtggtatttcttgcattagctaatacaagaaaatgagaaaatgaaaataatacataaatacagtaaattaaaaacaaaatatatttaattatagacaattactaatacttgtaaatcacaaaaaagttcctatattgtaattaataaaagaatttgatacagcaacatgatacaaaatatataaaaccaaaggcttttctttatgctggcagtataatacaaaaattaaaataaaaataaaatatcattcacaataacaatcgaacaataaagtaccccagaaaactttaacaaaaatgtgcaactgtatgaagaagaatacaaaattttatattgaaggtcatcttgcatgaattaagaaaaattatcatgcttactggaccaaaaaacctccataatattattaaaacctttatctttcctaaataagtataaatatgtaatgcaattttaatcataattttattgagatactaatttttatttggattttcctttataattttaaatgatttttaattttaatcattttatattttgtttatttctacttttttgtttgacttaaaattttatatggaagaataaatatgtaagatttacctaaaaatattgaaaaagatgatcggtacctgacataggatactaaagccttctgtgatattaattggattacaataacatgttatgaccacaaaaaatgtactagttactgtacaaaactgagtttataactgtatccaatataaatataaatgaaaatgtattatatgataaacacttcagcagaaatatacatatacataataaatatataatagctcagcagagaaagtatagcttctttagtaaatgattttataattataattagatcttcattcagcaagaaaatagtaatattcctgcataatccatgtttaaagatgaaaaagagcaatggattagggattttaatgttaaaataaaatgtaaaaattatgtgaaaaataagagtaatgttaggttaaagaaaaacttttttaaaaaagacaaaaaaaaaaaaccaagaaactataatggaaaaaaattgtggagtctacttctttaatagtacagatttatacaaaggcaaaaagtaccataaataagtttttaaaaaatagagaacatgtttgaaacgtatatgagaggtgagctttataaccctaatgtaaaatagagaacttctgcaaattgaaaagaaaaagcaaacatgggtaaattgtatgaactggggtttataagagaggaaaatgcaaatagacaaaaattattataatctttttataaaagatgctaaatctcactggtatttaaggaaatgcgattgaaaagtagcacaatacccttatttttgcatacagttaattaaaaattttttgaaagatttatcacatacaatggaatggggtggagaagtgatgggattgcatattgcagtacacaatgtttctggcattccacttttggaaatccattctgcagaaatagatattcttatctaaggatttagggactaaccatgatttagatatacatgctgacctagagggatgtccatagttcatagttaaatgattacagcaacaagtccacatatgtaggtaatgatgatcctgtatttgtgactaagggttgtgggggagcatatgtgtataattacataaatcatgtatgttttacatgagcatagaaagaaatgtaaaaagatacgcccaaaattgacttttttatatactcttctgttacttagctttgaaaaaataatgttctcatttttgaattttaaaagaaaactccagtagaatgtgtatatgtgagtgttaagtgtgtagatatgtatgttatagacaactaatgttctgagatttccagagagagagagacatgtgaagaacacggggcttgatcagaatttgaacgatggttgtggaagaactggataaacaaaaagggactttccaggccaatgacaaggcaggaggaaaacaacattatccggaatcatttaaatgtacttctaacgctccaagccacttgtaactacatatttgaaaactcaaaatgtaaatctgtatctgtgcatgcataaacaaacaatattattactaccgcacaaaacaaatcctgcattaaatacaattgtcattgctgtcaggaatgtataaacaagataattagaaaacccaaagaatcttatacttataactaagcattaaatctccttatatttttccaagtacaaatgactaaattgcaacccacaacaacccaaataaatgaaggacttttaccttagcattcaccaacatcaccattcatttttgcttccatactgtaagaccaacagattttttaaaaaattacatattgagtagccagtatgaataaggcacctcaaacgtgtaagctgcagcttcttgttcatcagagaagcagagttgtaaataaaagaatctttgtttatgtaagttttaaacctttggttaagtttctttggctctgatggttgcataaagcaggttataatcttgggaacaggttctaagattactgtactcacttggaaccagaggctcctccttgctttttttttttttttttttttttggtggttgttttttcaaacagttaactcttacgtggctttggctccaataccctgttgaaaaacctcagttaatggcactaaactttgctgagcctcaattttctcagattttttctttcgtgattaaggcacctttaacaagtgtcttgtaaatcaaatataatatgttaatgtactcattgagtaaactgacacacatatatttgagcatgagttcaactttcagtgtagctggatatctaagaaaaaatgacaccaaaacgggaataagcttgaaaacagagttgatgcggacaaggatattcatttctatgggatgccactgacatttttgaacagtagactgagatgcgaaaaccagtgtctacagattattgtatcagtaactttctagctggatgggatgagtaaaagattaggggctatgtaaagtaattaggtggtcatatccaggtgtaatttgtaatggagtggataagatagttggatttatttattttattttattttattttctattccaggatacatgtgcagggcatgcaggtttgttacataggtaaaaatgtgccatgatgatttgctgcacctatcaacccgtcacctaggtattaagccccacgtgcattagctatttatcctgatgctctccctccctgctccctgacaggctcaagtttgtgttggtcccctccctgtgtccatgtattctcattgttcagctcccactattagtgagaaacatgtggtgtttagttttctgttcctgcattagtttgctgaggataatggcttccagctccatccatgtccctgcaaaggacatgatctcattccttttcatggctgtgtagtattacatggtgtatatataccacattttctttatccagtctatcactgatgggcatttgggttgattccatgtctttgctattgtgaatagtgctgcaatgaacacacacatgcatatatctttataacagaatgatttatgtttgtttggatatatacccactaaagggattgctggctcaaatagtatttctggttctagatctttgaggaattatcaccgtgtcttctacaataattgaaccaatttacattcccaccaacagtgtaaaagcattcctatttgtccacaacctctccagcatctgttgtttcttgactttttaataatcaccattatgactggcatgagatgatatctcaatgtggttttgatttgcatttctctaatgatcagcgatgttgaactttttaaaatgtttgttggccgcataaacatcttctttcgagaagtgtctgttcatgtccttgggtcactttttaatggcttttttttttttgtaaatttaagttccttgtagagtctggatattagacctttgtaagatgcatagattgcaaaaattttctcccattctgtaggttgtctgttcactcggatgatagtttcttttgctgtgcagaagctctttagtttaattagatctcatttgtcaatttttgcttttgttgcaatttcttatgacattttaatcatgaaatctttacccttgcctatctcctgaataatattgcctagattttcccctagggtttttatagttttgggttttacatttgagtcttaaactatcattaacatttttcacagaatttgaaaaaaaactacttcaaaattcatatggaa

SEQ ID NO: 1182 - DNA, 82510 bp, Homo sapiens
tcagaagggaacataaatatatccacccacctctcaaacttctagcacagacattaagggattattttcccttgaaacaccctaaaaaacaaaaaaagaaaagaagggatggatggagggagagagggagggagggaaaaaaggagagagagagaaaagagaaaggaaaataaagaaaagaaagagagagtgagagtatcgggttgtgagggatttttttagataggagtggggagacttcttttaaaaatcattaaaatatgcatatattccaaaagcataaacagatgttggaggaggattaagaatttagcaatttgctattttaaaactttagtcctgtctatacaaggcttttgggggagagagagagagagagacagagagagagagagagagagagaattggatctaaactcagaataggcagctgggtggcatggccagaacattaaaataaaagtagggtttgttctaaacacagaggaaaatgtttagaataatagaattatactcagcaaagaaataagagcacagctgttacatattcatatttgaaacacattactgctttggggtttactttttactggactttataaattgcaaaactcaggattaattgcctttctacttgacaatgattttgttcttttgttaaaacacagcagcttttgctcacagagaagttctcaacagagcagtcagctcctgaaagttgatcatagcctcaccggctccagtacaacacagtgtattaagtatttaactagaaaagcaagtttctttgtccataatcctaccgaagctgagtaaaagtggaaaaataatggtacccacctcttaaggttgttgtgagaatgaaatgggttatcagctgtgcagcaaatggctctgtgtctgacacaaaataggcacccaataaatgctagctctaaccttacttctgtctggctactctatttcaaaattcttcaagaccattcacagcattttccaacacttcctacaaaagtggaaaatctcagcaattggaaattataaaatctctttttaaataattttttaaactttttttgagacagggtcccacctcagccccctaagtagctgggactacaggcatgtgccaccatgccaggcttttgtttgttttttggtaaaaaggaggccttgctactttgcccaggctagtctcaaactcctgacctcaaatgatccttctgccttggcctcccaaagtgctgggattacaggcatgagccactgcatctggccatcatcctaaaatgtcacatatcccataggaaagtgaaaagtctaccatatcggagagctttaagcagtgtacatgcacaagtatctgtaagcaaatcatccagaagaaaataccaaccaactgtctaataaactgttcctaaactccatcacatttatctcaagcatcaaaaaggaaaattctttttttctaaaagaaaatagcttttttgaaaataagccttccatcaaaagtctcctgttttaattattattattattattttttgagacagagtttcattcttgttgcccaggccggagtgcaatggcacgatctcggctcactgcaacctccgcctcccaggttcaagtgattctcctgcctcagcctcccaagtagctgggattacaggagtgtgccaccatgcccagctaatttttttttttttttttttgtatttttagtagaggcagagtttcaccacgttggccaggctggtctcaaactcctgacctcaggtgatcagcccgcctccgcctcccaaagtgcgggaattacaggtgtgagcaacagcattcagctaaattcttaatttcaaaaaaagaaaagcagtaaactcttcttacagttatccaatgaaataagctaagacatctgaaagacatattgtcttaatctgttttgtgctactataaatttaccacagactgggtaatttaaaaagaaaagaaattcattctttttagttctggagcatgggaaatccaatatcaaggtaccagcatctggcaagagccttcttgctgtgtcagcctatggtaaaagggcaaagagagggtgagaggagagcaagaggggactgaactcatctttttataaggaacccattcccacaataatggcattaatccatttatgaaggcggtgcccccatgacccaaacaccttccattaggcctcacttcccaacaccactgcattgggaatcaaatttgcaacacatgaacgttgggggacacattcaaatcatagcagatacactgaaatttctcttgcatttgcacaaatctcttctatctatttacccaggggaatgtttttctcacatgggccattaacatgtgaggaagaaaaaggaaagaaaacaataaatgcgtaagttgaaacaaaacgtataatgtagaaatgcaaatatttgaaagtccgctgcatttaaaaagctgtattgtgtatagatggagatttttctttactccactttctcctcaccaatatatgatgcaatatttttcattcaatgttcacaaagtaatttatcatcagattgtcaagtccttcaccagcctaccatgaggaatttgcaactgcgcattctgaatttggagaatcttataaaccgatgacaggagactatgatcatacaagcaaagagacagcttagatttaagccaaccagggggatgaacaaagaaacagcttagacatcaagtcactgtgcttcagagcctctaactcctctggctcttcagatgctcccaaatcttcttcctcattgtggtatttatcttaactgatttaaaatatgaaagaaatattccagctttttacaatatttaaaatagaaaaaaatgaaagagcttgaacacaaaaaaattgaagaatagttaaattatggttcaccaccccagttgagtaccaggaagacatttaaaatgatggtgattgatacagtttggatatttgcctcttccaaatatcatgttgaaacataatccccaatgttagaggtggggcctggtgggaggtgtgtgggtcatgggggcagattcttcatgaatggcaaggtgtcatccccttcttgatgagttcacacgagagctggtagtttaaaagagcctagcccctcctcccctctctcttgctccttctctcaccatggatatgccgggcttccccctttgccttccgccatgattgtgagcctcttgagccctcaccagaagcagatgctggacctgtgcttcttgtgcatcctgcagaaccatgagccaaataaacctcttttgtttataaattacccaatcgcaggtgttcctttatagcaaagcaaaatggactaatacagtgataaagactatggaaagtgggaaaatcagagcacctcacaccttgggacgtgtgatggccatagtctggaaacacagacaaattaacataagaaatgatgtattgatgttacattataatacacgaagtgtgaaataacgtcacatattatgttcactttgtttcctgtcaccgtgatatgcaatccatcacagtgcacacagtgctaaggctgcatttccacctgtacctgcatcggtgatgcactgcctcagatgatttctgtctgatttttatgacgaaaactgtgctgggcacagtggctcacatctgtaatcgcagcacttcgggaggccaaggcaggagaatcacttgagcctgggagtttgagatcagcctgagaaacatgatgaaactctgtgtctacaaaatatatatatttttaattagccaggcacagtggcacatgcctatagtctgagctactcaggaggctgaggtgggaagatcacttgagccacgattgtgccactgcactcctgcccagataataaagtgagaccctgcctcaaaacaaaaagttaaattaaaattaaattaactaaaattttaaaagcctgtgcttttatctcattatagaagtaatcaagggccttcagatctagcaagcatggcaccctctccagttggccacatcattcaccagtttgggaaattaatcatctcaccactctggcataatgggtgctgtacattcctgttaaaatcatttcaaatgactttctccagacatttaaaaacaggcattaggatcacttgaggccaggagtttgagaccagcctggccaacatggtgaaacctcatccctactttaaaaaatacaaaattaaccgggtatggtggcgcattactgtaatctcagctactagggaagctgaggcacaagaattgcttgaacccaggaggcagaggttgcagtgagttgatatggtgccattgcactccagcctgggtgacagaacaagattctgtccaaaaaaaaaaacactggcattaattgaccactttaaagggatcaaatacattggatgattgcctatattatcagactttatggggctgtctattgacccaaggattctgacatatctcagtgtggcttcagcactcttcagggactcacaagcctcctggagaaagacttatccttaaggagaaggaaatcagtgttcagagcttggcgaaagaaaaactccttagatttaaaggaaggtgcagttatgaatacagcccctctctctaattgtcctccaaagagctctcaagaacagactttcttgagacctaaagagaacagggccttgaataaaattgacatctttatgaaaatcctggggaggtactgagacacagctgtcttcagatcatgtaaatggggcagatccattgcccctctgaaacaatggctccaaacgtccttgggtaatgaacaagaagaatcacagagaccatctggctggcggaatcttagaagaagcatattatgagagtcaagaaatatttgagggtttcttacatcgtttgtgaactccaaaattacaataacgtcctccaccatcttgcacatatttcatcgtcatctcaatagacactgtgactatgaaaggcacaggacaggtgcttacagatatcatgagcatataatttatcacccaacccaggaaatttctgaagttgtaaaaaagatgctatcaagaatgattccaggacggcaggtgtaagccaggactgacaaagggatgtcagtacacaggatcaccccatgaatctacaggctgcagagagaaagctttaatctttaactttagccttttgttctcatcagttttttttttaatcctctcagctcttgctcttgtatgcatatctttagtcaaagaaaatatgcaggctggccgggcacagtggcttacgcctgtaatcccagcactttgggaggccgagatgggtggatcatgaggtcaggagattgagaccatcctggccaacatggtaaaaccccgtctctactaaaaatacaaaaattagctgagcgtggtggcacgtgcctgtaatcccagctactcgggaggctgaggcaggagaatcatttgaacccgggaggcagaggttgcagtgagctgagatcatgccactgcactccagcctgggagacaaagtgagactccgtctcaaaaaaaagaaaagaaaagaaaaaagcaggctttcctagacatcttaacctgccaaactagaaaatccctaaatagtagtcctatatacatacattatttttattttttaaaattttttattcttattttttgagacagggtcttgctctgtcacccagtttggagtgcagtgacacaatctcggctcaccacagctttgacctcctgggctgaagccatccttctgccgcagcacccccaagtagctgagactacaggtgcacaccaccatgcctggctagttgtagagacggggtttcgccatgttacccaggctggtctcaaactcctggactcaagcagtccacctgcctcagcctcccaaagtgctgagattacaggcataagccactgcacccagcctgaaaaaacaaacaaacaaacaaacaaaaaacagttcttaaacgcaaggcaccatcctagatgttgaggaacatgtcacttggctcttggagcttgcactcagggaggcagatgatgactaggtggcaaataaatcattgaagaggtgcctgattaaggtattacctctgggcatggaagagtctatttatttatttatttttatttaattttttttgagacggagtcttgctctgtttcccaggctgcagtgcaatggcacgatcttggctcactgcaacctccacctcctgagttcaagccattctcctgccgcatcctcccaagtagctgggattacagatgcccaccaccacacccagcaattttttgtatttttagtagagacaggtttgccatgctggccaggctggtcttgaacttctgatgtcaggtgatccacccgcctcagcctcccaaagtgctggattacaggcgtgagccaccacacctgactggaaaagcttacttttaaaaagaaaggtcaggaaagacatttctgagaaggtgacatttgagaatgtgacatttgacctgactgcaggacagcactgaccagtctgacaaaccccttccacaggcctacagtagttttgtttccagccctacaccacttttcctgtttcctccctgctttcttagatctcatggagtgatggcagtagaagtgacccttcaatggtttcctcatgagatggagtgaatacagacaaaaacaaaagagctttccgttgcaggcttaggaaaaccttggggaatagaattatcactaccaatcagcattgagcagccataggggtgcctggaatgagatgcgcctgagtttgcttttaatcatctacaaaattatcatgatcttccaggagtccttcgctttgagatcagtaaaggaaatttatactcagagaaagagggaggacagactgtcctgacctggacttaagtgatcacagtattctctcaactttgagttcatgtttacactgaagccagtgtgtctctgaccccataagactcctagcactattcctagcctccgttggccacaggtcccactgacagatacgttcttgtggtaagatattcctagtggtcaatatgattcctcccgcaggcatattacattgcagtttcttatcccactgttcatggctaattagaataatcaatgtctctctcttccaaatgttagccacatggggtcaagtcagcatcaagctagttttttatcacaaattttccatattcctcttttcttccacataccaggtcaagattgctacacccctctcaactttttccaacatgtgaattttggaaacgtaacaagaaggaagagtgaatagacttttcaactggggaccagcaagagccaaaggaaatggaataatgaagcatgttctgctattgagcctgggtctgtgaccatgtccaaatgaggcttttgctttttataggatgcagatcatatcattcactcatgctccataagaccctaagatttatccatgagacttatccataatatttgccccaaaagatttatccataatagactattctactccccactttctcactcactctttccccctttctctctgtgaaccttctactcaaagccaggttttcataagggcacatttatgaggctattgttcacagatgatttacccaatttttctttattaattctcctttgattgctttcagatgttgtctcctatttttccagataggtaatatgtttttcaatcctcatccacacagtaaaatattgtcatttgccatattatttggatcctcaatagatttttttcaggtatatttactactacttgacatccaggcaatacccaataataatagtaaactcttaaatagtatttactgtcttccaggcactgttttgagcactttacatttattagctcatcagattccccaacagccttgtgaagtacgtggtgttataacaatttacagatgaagaaactgaagcacagagaagtcaagtaagttgcccagtgtaaatcccatacaggtctattgtgtttgttccttggcactcaaacttagtaaaattgcgtaatgtttttgtctgtgttaatttatcaaattcctatgtatctcttttctgaaacagaagaaataggtcagttcaaaataatcattaggccaggcacagtggctcatgcctgtaatcccagcactttgggaggccgaggcgggcagaccatgaggtcaagagatcgagaccatcctggctaacacggtgaaaccctgtctctactaaaaatagaaaaaaaaaaaaaaaaaaaaattagccaggcgtggtggcgggtgcctgtagtcccagctacctgggaggctgaggcaggataatggcataaacccgggaggcggagcttacagtgagccaagatcaggccactgcactccagcctgggcaacagagccaacctccatctcaaaaaataaaaattaaaaaaaaaatcattaccagtcaaaatggaaccagacatctttttctgattgactgattaaattggattggttgtagctctgctcttccaggagaatggatgggtagctcccttgtagggaaatgactctgattagctttccaggccactgagctaactcattaacatttaggatattttttctgtcccaattctatagcttggcaaagtgcacttttcatgacctgcctccagcttccttccttctttttttttttttttttaaataatttcagcttttattttagattcgggggtatatgtgcaggtttgttacctgggtatattgagtgatgctgaggtttggggtacaactgatcctgttactcaagttgtgagcatggtactcaatagtcagtttttcagctcttgccctccgctccatctccccactctagtggtccccagtgtctattgttgccacctttatatccatgagtacccaaggtttaggtcctacttataagtcagaacatgctatatttggttttctgttcctgcattaattcacttaggataatggccttcagctgtatccatattgctgcaaagaacatggtttcattctttttacggctgcataatattccatggtgtatatgtaccaaattttctttatccagtccactggtgatgggcacctaagttgattccttgtctttggtgaatacagcactatttgatgaatagtgctgtaatcccagcactttgagaggccgagacaggcagatcacccgaggtcaggagttcgagaccagcctggtcaacatggtgaaaccccatctctacaaaaaatacaaaaattagccgagcatggtggcgcacacctgtaatcccagctacttgggaggctgaggcaggtgaatcactgaaatccgggaggcggagattgcagtgagctgagatcactgcactgtactccagcctgagtgacagagtgagacttggtgaaagaaagaaagaaagaaagaaagagagagagagagagagagagagaaagaaagaaagagaaagaaagaaaaagagaaaagaaaagaaaagaaaagaaaagaaaagaaaagaaaagaaaaagagagaaagacaggtcaggtgcggtggctcacgcctgtaatcccagcacttcaggaggccgagccgggcacattgcttgaggtcaggagtttaagaccagcctggccaacatggtgaaaccccatgtctactaaaaaattacaaaaattatccaggcgtggtggtgggaacctgtaatcccaactactcaggaggctgagacatgagaactgcttgaagccaggaggcagaggtcacagtgagcctcagctcactgtgattgcaccagtgcacactccagcctgggcaacagagcaagactagtcaaaagaaaaagaaaaagaaaaagaaaaacagcagtcccctgccccattttcccacccccaagtcttagctactttcaactcttaattgtgtcttctccatatttctaaacaatatgtttgttaaatgaattaggattatgttcatttgcaagtaacagaaacccttctacagtgacttaaacaagtaaagagtgtatttgtcacacacaaaaagaaacccaggcatgaatcccaacagggccttcagaagccaagctcctttcacctttctatgatgccattcttggcttgtgacattcattggcatggtcacaaggtggctgctgtatctccaggcattgtgtccacatcccaggaaaaacacaatggggaaggacaaaggcatctttcctagaaaagctctgtttttagtttgaaaaggaatacccactgcaaaaactcctgcctgtgccttctttagtcttttcaagattgcaagttgttggggcttgtgggtggggtgggggtgggaggaagagttttctgctcctttgtatagcgtctctatttcctccaaattctttttttctgtttgttcatgtctttgccatttgtttcttactgatctgtctctaatgttcaaaactttccccgaagtcttgtgatctttgcctcctcactcacgtttaagagtaaatctcagacaaagtggttggaattactacgtgcttggacaggacatgtggacagaggttttcactgcagggagaataagtgtaccgttttactggacatacactgttgtcagtatctgtaggcctttcacttgggctgctcagtctccccagagagaactcctccagtatcccgctggtgacctaggagtctggttgacatcgtcctaaacaatgagtggggaagggtttaggggatctcaccattagcagatctctcaccttaactgtgtctggcgtccctgagtccagagttcttgtggtccagtctcttcacagagaaccacagtcttctgccaggagaaggaagggataactatctgaccacactggaccaagggacccacttacttctgcagactttcaaccagtcccccagcttcagccccacctgcgtcttcagaggatcctgggtctctgggtcctgagcctctccaggccctgctgcatgggcagctttcgcctgggcttccttccccgctgctatatctgctctgctaggtcactttgcactcatccagaggttttctggcttccagaatatctcagcttcctctctactcctgctttctcatttgcaatttaaagcttttcaaaatcgctatgtggttgtttgaatgggaattccagagaaaggagaggtgcatccactaagtttatccagaagtcactttttccatatcatgaatgcagtcatcgctcgaggaccagtgcaaatgtctgctcctctgtgaagctgtcaccaaatttctttccatccttctccaccctaaaattaatcccttcctctcttacatttccacagcactcagcacaattctcccgtcctccctctgatcacatcacatcacatcaggattggggatgttagcccccagctagagaacaacctcgtaaaggcaaacacattttagcagtcatctttgtatccctacctcctgcctgcgtgcttgacctaagtaacttcttaactttctgttttttataaattaaaaaacgctgatataaaaaataatggactagggccaggcgcggtggctcacacctgtaatcccagcactttgggaggccaaggcaggcaaatcacaaggtcaggagttcaagaccagcctgtccaacatggtgaaaccccatctctactaaaaatacaaaaattagccaggcatggtggcacgtgcctgtaatcccagctacttgggaggctgaggcagaagaatcacttgaacccaggaggtggaggttgcagtgagccaaaaccacaccactgcactgcagcctggtaacacagcaagattccgtcttaaaaaaaaaatggactaggaggcaagaccttcaggatttcaatcccagctgctgtgctgagagttattatcactttgtgtgcattctcctggttcaaagccagtgctcagtaaatgatattattcttattgtcagtctctctaaatggcgcaaatgtccgtttctcatagtaagtataataagacagacaacacacttaccaggaaggggaattctaagattaggaagacacagcaggtagctttcagccaatatctcaagaatagaataggaaaaattctggcatcagagctggcttgagccctaagatggccagttatttttatttttcaacagctttctgtgttgtaaattaaaagtaatgttcacttttagtcagtaggtttttctttagcctaaattacagtcttttaattaaaagtattagcatgccttccttaaaattattactagttagtgacttcagttataagaaattttatgtaattatttctatgacacactagtcttgtggatggcctcattttacaaaagaaatacaaaaggcaaaagcggtacctcagtggccaggatgtacagaaacagacatgcccagcctctcgatgcaaattctttcctctaggtggcactggggtacgattgtattctaggagctatatctcatatttttagtaatggggttcatgagcacttgttattaaactgaacaatcacactcatttacaagtgataaggaccagaactgatatcaactgattaaatattgtgcttaccctaaaaaccattccaggaaaacgatatgaagtgatttgagactcgttggttccagttttatatgccataatactctcaattcacttccactataattgagctcacatattcaaataaagaagaaagaacaactgggcatggtggctcacacctgtaatcccagcactttgggaggccgaggtgggcggatcacttgaggtcaggagttcgagaccagcctggccaacatggtgaaacctcatctctgctaaatatatgaaaattagctgggtgtggtagtgcgcgcctgtaatcccagctactcaggaggctgaggcagaagaatcgcttggatccaggaggcggaggttgcagtaagctgagatgacaccactgcaccccggccgactctgtctcaaaaaaaaaaaaaaaaaagtcacagaaaattgagctctttcactgaagtttcaccagctattacaatgccataaaatgacggatcgcttagcccacactctctgaggataatgtttggacttccagttgagatccctcatccgcattctttcttcttcaaatgcatagaaatctgggtaaagttagttattcactagtatatacccaagctcagaagcaagaaagagaaagtgctagaagaaagagaaaagaaggaaccttacagagtgggcaggttggaggaaatctccagctggcctgtaagggaggaagcagaggcagatggagaaacaccctggggcaggccacccaaaggcagaaactgaggatgaaagagccaaggagtgcaagctcctgaagtgggcctggcccagggtggggaattactgttactacttcagcaagaagaaaatttagcccagaagggagaagagtgcatgaagcaatgagcttaaaacaaacaacagaaaacttggaaactctaaataaacacctatctcaaatataaaaataacaactccttttgagattacaaacaaatgtggaactaaaataatagataacaacatggaagatgataagtggattcaaagggaagttacagcattctaaggtcgctgttcatgagtaggataaagatatttattaaccttagactttgttagaaaaataaaaattatatatatgtgaatagaaatagaacttatattaataatttctaaatccacagaagaataagggaaactttttataaaaagaaaggaaagagaaagagagagaaaaaaagaaaaagctcttttagttcaatagaatgcagtaaagaaaaaataagaacttggccagcatggtggctcatgaatctcagtactttgagaggctaaggcaggaggattgcttgagcccaggagttcaagaccagcctgggcaacacggcgaaactctgtctctacaaaagataaaaaaaaattagctgggcatggtggtgcttgcctgtggtcccagctactcaggaggctgaggcgggaggatcacttgagcccagaaggttgaggctgcagtgagctgtgttcacgccactacctttcagcatgggtgacagagcaaaatgcaatctcaaaaaaaaaaaaaaaaaaagaaagaaagaaagaataagaaccaaagaaaaacatagttgacacaaaataaaatgatagaaagaagtccaaatgcatagtaattatagtaaacataaatatattttgactcactagttaaaagacagaaactcccagaggttttttatagaatatctaggctttttattcaaaaactgggcataaaaatttgaaaataaggccaatttaatagtattaatttagtcaaatagaattaaggccaacaatactaataaagataaaaagggagctaataataaaaagaaaacataactaataagatgtagaaatcataaatttgcttcacctaacaaaatacccttgaaatacatacgccaaaaattaccagaatgtaaagtacaaattgacaaatacacaatcatagtggtttttttcaacacatctccatcagaaactgttccattaagcatgataagagtgcaaatgattcaagcaatacaatcaatagcttgatatacatcccaataaatacaacatacagtcttttgtgaaagcaattctcaatgcagttcaaaaaaaattatatcacataaaccaggttctgtaattgcaataacattacaaacaatagtagttttttaactgaaaaaataaaaatacctttagaaattaaaaggcagatttctaaaataatttatggtttaaggaaaagctcacatgaaagttacaaatatttagtactaacaacaaaaatgtaagatatcaacatttatttgatgccactaaaccaggaagcatattttaggaaacaaaaaagccaaaacaatgagataaaaatcttcaatcaaaaagctagagaagtcacaaactgaaaaaaatatttgaaaatcacatatatggctgggcacatataatatatataattacacgcctgtaaccccagcactttgggaggccaaagcaggtggatcatgaggtcagaagttcaagaccagcctggccaagatggtgaaaccccatctctactaaaactacaaaaattagccaggcgcagtggcaggtgcctgtaatcccagctactcaggaggctgaggcaggacaatcgcttgaacctgggaggtggaggttgcagtgagccaagactgcgccactgcactccagcctgggcaacagagtgagactccatctcaaaaaaaaaagaaaaaagaaagaaaatcacatatatgatcaagtatttacatctagaaaatataaaggactctcaacactcaataataagaaaacaaacaacccagtgaaaacacttgggcaaagttgaacaaatgccttaccaaacaggatacacagacagcaaatcagcatgtgaaaagatgctcaacatctttgatgctgttttaattagcatacctaattaaaactataatgagagcctgggcaaatggcaaaaccccatctctacaaaaaaatacaaaaattagctgggcatggtggcacacgctgtagtcccagctactcaggaggctgaggtaggattgtttgagcctaggaggtcaaggctgcagtgagcagagattgtggcactgcactctggcctaggggacagagtgagacccccatctccaaaaaaaaaaaaaaaaaaaagcctataatgacatgtcactatatactaaattaaaagaattgatcattcatagtgttggtgatatgtgaacaagtgttggcagaaggtttctttaggagtcattccatgactagatatttatttatccaagagaaattaaaacatatgtccaaacaaaacttgtacataaatgttcatatcacctttctttataataactaaaaatctagtgaatgagaaaaaaatattttcagcccacgaaagtttgtagttaggccaggtgcagtggctcacgcctatgatccccacactttgagaggccaaggcgggcagaacacttgagaccaggagttcgagaccagcctggccaacatagtgaaaccccatctctactaaaaatacaaaaattagccaggtgtggtggcacacacctgtaaacccagctactcaggaagccgaggccaaagaatcgcttgaacccgggagccaagaccatgccactgcactccagcctgggcctcagagcaagactctgtttcaaaaaaaaaaagtttgcagttgggacagacttttgtaaccaaagacagattaacaagagaaaaagaaattactaatgtgcgcagtgcctcagtggaaagtgacttaggcagtagtttaggtgtgtggcttatatagtatatctaacaaaaaaacaatacattttagaaaagtgacaaaacaaaatagaacagtcccaggcttccaaaggcaggaaactgtgggaaggtaaatataggagaggacaataatggagtaaagtctgttcacaggtttctctagcgccatatctgagctaataagggtttatctaataaaggagaatgtacatcctatctttaggcagaaaagttggggaaggggaatagaaagaccttttgtctgtaaatttctgtcctgtctttttttttttttttttttttgagatggagtctcactctgctacccaggctggagtgcagtggcacaatctcagctcaccgcaacctccgcctcccaggttcaagagattctcctgcctcagcctcccaagtagctgggattacaggtgccttccatcacacccggctaacttttttatttttactacagacaaggtttcaccatgttgatcaggctggtctcatctcctgacctcaggcgatccacacccccttggcctcccaaagtgctgggattacgggtgtgagctgccacgcccagcctctgtcctgcttttaagcagagagaaagcagagaactgtcctgcatcttaattgtctttagctcaaccatcttttatattttggagagttatatcctggtctctcacaccataaacaaccctaatgtccatcagtaaatggatcaacaaactgtggtacatccatacaatggaatactgctatgcagtgaagaggaatgaattcctgatacacacaacagcatggaggaatttcaaaataattatgccaagcaaaataatctatacaaaaagaaacgcctactgtatgattccactgatacaagttctagaaaatacaacctgcacagtgatggaaaatgctggaactcagagaatgatatccaaagtatgacactttgacatgctgagtgctttgaactaaagaagcagcctcagaaccaaggtctctctgacctttctccaccctgctgtctatcctctttctctctcaaagtatgagaaggggctctctctgaagttttctttctctgactaagggaagttcctccagaaggagtgccattgtcatgaattccttccctgaaatctgcattaaccagagaagttgaacttgtattgcaggagaggaggcaaaaggtctccatccaggtcacatgcccagactcttcacctatttttctgaaggcggctacctgagagattgcctgcataataagacagcctttgtttgcagtgtagttcctccccctattctcccatagcttgtcaccatcgctctccaggagcctccaagccccatttctttctgtatctcaaaatgctatttaagcttcaaccatctggcccatttttgagtctaatattctgtgtggttgctgtgcacatgtgcacataataaacttgtatgccttttctcctgtttgtctactgtcagttgattccagagacttaaattattgaacctttagagaatggaaggaaaggtccctccaccactatgaaagcaaatcatcagttgctgggatctggagttgggagaggcagaaggaagggattgccaggggcatgaagaaactttcaggggtgatgatgcggttgtgattgtggggatggtttcatgggtatataaatcaaaacttatgaaactgtaaactaaatatgtgcaatgtattgtataattaacaattatacaatatgtgcaatgtgtaactgacaaattatacctcaatgaaacttgtttgaaaaaacagcttggtgtctgtgcaagtgttgattaaaaaaagatcagtgaatcagaacagtgagcccataaattgatctgtatatgtataaatataaatatataatgtatatgttatatataaatatacatatatgtatatttagaaacttggtataggagaaagatggtattaccgacagtggagaactgatgaatcattcaagtagtggtattaaggcagctggcttttcttattgaaaagttaaagtagatgcatacttccaaaataaataccaggttgatcaaatactcaaatgtggaaagaagaggttaaaattatcagtaaagatgaggagcaatgacgcatgcctgtaaccccagcattttgggaggccaaggcaggagtatcacttgatactcgtggctggccatgagttcaagaccagcctgggaaacatagcaagactctgtctctacaaaaaacaaacaaacaaaattaactgggtgtggtgctgcatgcctatagacccaagttactcaggaggctgaggagggaggatcccttgatcctaggagttcaaggttgcagtggactatgatcacaccactgccctccagtctgggcaatagagaaagaccctgtcttaaaaataaaaaataaacatgttcgtgactaatccttttccccaggccaatgcagagtgaatgtttaggggaaaaaatctaagttggcaagtttctcacttttctgcagtttttgttctctctttagttttcctttgggactttcaggattagttgatccagaaggcaaacaaaaggatttcgatagaagataatataactgattcccaggaaataggacagagacatgcatcagagtttcagctggccttgactttcagctgagagcctcttgagcaccggcaggtgacaaaagcacagggatgagttggtgtcatcttactcccacaccacctccttctttcctgcagaagcacttttctgcacctgggggagcaggaccactaagtctccgttaatagaaggactcacatgccctgaggtcacatttctgatttattgcagtgccctctatgaatcagatccctgctgggctggcctgcccataattcaactcttattttaaaaacttacaaatcaataatacaaagaaaaactgcccaataaaaatatgccaggcaataaatgggcaaacttcttgattttcttttagccagaacctcccaacacagccaagtgcaagcagcagggtagccagaacaaggcatctggaagcacctcagttgtcacgtgcaaactaaaggagaggcctcctctgggtggataaggttcagggctggactccacagcagctgagctcagcaccactcaccctctctgccaggtgccaggtgccttttggccatgcagaaacgtcatcattttccattgtatccctggtcagaatccctcttcctcagcttacagaccattcattagcccagtttttctcatttgccacccttctctcaagaagctttttagacatttttttcctaatcactccctcccataaagtggtaatgatacaagagatagaaattatttaggcagatagtgagggcaaaatagtcctcagcaaaacttcccttcttacgaaaaagcagcccaggaaatcattttcctcttacaaagagcagccagaaagatcgagctccaaacatagatacggaagctggtagcttgcacgggggaatgccagcagctgcgccaatagaaaaaaaactacctggggccaggcatgtccactgtggaagctccaccttcccttttttgttagcatgtgtacagtaaggaagaaatgggcaacatagagaagctcaggcagagaacccacctgcataacaaaagattggggtgggggctgccagagattcataccctatgtagttggcacatctggttctagccacctccccactagctcatctataaaaacccctgtatttccctgaggatcagcaaccaattttttcccagacccctctctgtagcagagagctagtcactttctttcacctattaaatttccacttttaacctcaccctttgtgtgtctgcatccttgatctccatggccatgagaaaacaaacctcggatgttgcccagacaatgaggctgcttcagtaatacacagatatactgcatattggtcatggactgaaggactttagagggccataaaccattggcatttccaagattttttgccccaacttttgaataaacttttgcccccatagggtgatgtcaccctgttgagagttcatgcattagctgttagctgtggagcctgtcctctgtcactggaggaatccactcacctgcagtgaggttgaacacagccttcacactgatggcactaagacaactagctggtacgctccaagaccaggcacccagtaacggtcctctggtaccacctgcaggcagcaggaacctggcatagaccccaccgcctgctgtgcccactcctcatgctccctccacctcactaacctccactcttacctggttttcttctattctcacacactgcttcctggtttgcagggagagagagagagagagagatattcagctcacaagagaatctcatgatttttgaatgcttgatgaacaaaacctcatagtctttaaactggccagctgataaagtaacaaattcattcatgtgctaatttgctcattcaatcaatgacagcagaagaagaggaccctgtgctaggctcgaggctgtgtgtgggggaacaggaagttgtcccgaaacacaggacagtggggtgtgagaggtgcagcgtcaactgcagaaagagctgatgcttgagcacagtcttgaggaatgagcacgacttggtttagtgaataattggggacctttgtgcacagaccaggaaagcagatgggcttgggaaactgtatcataatacaacagccatggtgtggagtaaaggcatggaaactgagggactgaggatggtggcaacgggctgggagacgcaggctgtgcccagttggtttgtgttactaaatggataagaaaagatgtggtggctcttgacaagtgatgcctcaggctgtgcccacagagaggggcaggactcctgggcctgcaagagttaagcagggctctgctggaggctgcagagagagagatagcctgtcaggctcagatgggacaggacaggtttacagggagacaattagaccagaatccatccagacccatggggcggatgaagcctgagggtctaagcctaatgcactgtctgattttagtaagttcaggaagtcaaataggcatatgcacttgaaagtagatttgagcccatcaagatttaggaagaaaagacacagaaaccactggccaaaggcctaagctgattctaatatgtctggtatttaagcagcgactgtgcaggaaatcatcagagttcaaatggacaatccatcttcagaccagaatggaggagcagtgggaataaccagcagccagaatgagcacatgagcttccaaacaacagctttctgcatcctcctcaatagggaaagaaaaagaatgaaaagaaatgaagtgaaaaataaagtctgggtcttcagttggatttgtgccttttgctaaagagtagtattctatctttccttctttccctccccatgctgcagcaaatacatggagagagggttgactcccccactgtgttgcaatagcatgatttgaggggttgataccagctccatggatggactctgtggtctacactaaacaattgtaatttggtcctctaagtagagattggttcaggaacctaggcctaagcccgttagggaatggattgattcagaaacgggcatgtggctcaattcaaaccaacgcaatgcaagaagtctgggtttctgggtttctgctcttcagagaaccacaagacataaaactctctcccactggatgtgaacagagaagcacggagtcctgactgagctgcagccaaaccacgactcctcagaaagctagtttgtggatgaaactgatattgcagatgtcagaagatacctggatgcttgaagaccaaccacactgagctgctggatcaaacagccccggagtgcaccataaccttggatttctgtatgcgagtcatttcattttctcttaaagctgactttagtggagtttctttttctttgcaattaaaacaccctaatggtcccccctcaatttggacgaaccctcagtctcatggttcagcatgcttctcactcaatgttcacctaagtgcgggtgcttgtctattagcaccttaaaaatgcaaaatgtgaattgaaatttctaacatgatatttttaagtttgttcttttataatctacaatgtttcaacaaattagtgttgcacacaataaaaattgtgcaattgcaagtacacaaacacacaaatacattattccctccaaaacgttgatttttttttcccctcgttaagattacactaagtagacagtagggctctagtaaaaacagtgagcaaaaaccatagtaacaggcatgacaccaaggatatcacaatagcccacattctacatgagtaaatagtctgtttgctgcgctactctgtggtcaggtctgcgcaacgctaaacatctggttgaaaactaatcaagtaataatgagggtctccaaatagtcatggctttcgaatatgaaatagaattttatatgttaaagttttcatcccacaatctacctataacacagtttgttggaattaaattaaaatctaaatgttaacatttgtgtactttgcaaattaagagttaacatattgtattcctcaattactccatagaccagaactagaaaataaaacataaaattgaagtccctgtacttttccttaataaggtcatctaaattttgagactcctatacattttccagatgtagattccacattaatttcacaatttaattttgaaacatacatttatttcaagtgttcacagatgttagaattcaaatactcatatttaagacacatacattctctggcagtagtaaatatatactatatttttgaagaattcacagaacacttcaaaaaatgtttgtgtaaggtcgaagaaaaaagtaacgacattttaactgaaatctgcctcatgacaattatgaaagaacaaaagcagataattaacctgtttattgtaatataaacaccagtaagttttagataaactatctaatgaatggtctagaatataacaatatggtaaacatcatctccaaacaaatttttaaatatttgacttaagtggaaaataaaaagcaatagtattggcatttgcccaagacactcacttgcaggttcctgtattgattttctagatctacagagtatctttcatctcgagaattccaatgtaatgtcaaaaatcttgaaaataaccaggggctaacacactgcctagttctcctcaaaaaactccctaagcgattatatatccatcaacatgtaagaatcagcttaaacaattatatttaaagaataactcttggaggccaggcacggtggctcacgcctgtaatcccagcagtttggaaggccgagacaggtggattgcttgagcccaggagatcgagaccagcctgggcaacatggcgaaactctgtctctacaaaaaatacaaaaaattagccaagtgtggtggtgggcacctgtagtcccagctactcaggaggctgacgtgggaggatcacctgagccagggaggtcaaggctgcaatgagctgtgatcgtgccactgcactccagcctgggtaacacagtgagaccctgtctcaaaaaaaaaaaaaaaaaaaaaaagactcctctctctccctcctcctgtctttctctttctttctctttctctctctgtctctcacacacacacaccccacacacatgaccacatacataaagaaaaaaataccaaattgattatttggatctgaataaataggcagtaactaactatttagcctaatgtttttaagctactatcatctgatatatttttggagactctcaaattttctgcctagattattaaattttcacttcttcatttcagtaataatctaacatagtgaatgcaagcatgctctgggttatttaggtgtctgatttcatttgtggttgtgcttcttgattacatggtcatcaggtaacatcactttaagtttggtgggctatgcatagatagacttaatagatcaaggttttttttttttttttttttttgagacagagtctagctctgtcactcaggctggagtgcagtggcgccatctctgctcactgcaacctccccctcccaggtcaagcgattctcccacctcagcctcccaagtagctgagactacaggcatgtaccaccacacccggctaatttttttgtattttcagtaaagaaagggtttcactatgttgaccaggctggtcttgaactcctgacctcaagtgatccacccaccttggcctcccaaagtgctgggattatagacatgagtcaccgtgcccagcctaaggattatttttaactcagtgaaggtaaatttccttgcagaccacagaagaaatacatattttgcaatattctgaataaagaaaagagttagcagaattgcatcgcctcaagagcggagcctgccaaagaccacagaggaggggaggggcagacaggaagattgtcaaggttaggtgcaaatttgtttcactgatgctgttaatttgaattagattggtttcataactttgtttggattaaatgatacattaatcttattttacaattgaagaagatctgtgtaaatagagatgtataggtttgtatttttacatattcatattaaatacaataaaaaataatttaaggttaaaaaaaaacagctaattgagtctcctgaattctttcatttacacacacacacacacacacacacacacacacaataggtttcttattaaaatttaccatttctctgaaatttcaccacaaattagcagagtgggaaattccagacaactgctaaatcatggcctaacccaggctccatggcctgcatcttgctagcacaaaatgcagtcttacgacatattcttaaatacacagattttcatccaacaatatgtctgcttatagctctccaaacagaggtttcataacataggttctggcattaagggaataaaaaaataaaaatagtcactctgattcagttcattcattcaaccaatatttattaagtgtacagtacactgtagcaggttctggggatacaatgctgattttcttttcttttcttttcttttcttttcttttttagacaggatctcgctctatctcccaggctggagtacagtggcacgattacggctcactgcagcctcgaactcctggactcaaattattttctcacctcagcctcccaaatagctagtattataggtgcaccatcatacccaggtaattttttttttttttttaagagaggatgtctcactatcttgctcaggctggtctcaaactcctgggctcaggcagttctctcactttggccttccaaagtgctgagattatacgcatgagtccccacactcagccacaatgctgattttcgaaacaacagcaaggcttgtgccttcatgaagcttgtgaccaagtggaggaaatagctattaaccacacaatcacataatcaagaaggtaatgactaactgtggtaactgctccaaggccacctagtactttgagaaagttatacagacaaccaagtcaggcttcctcaatctagcagtctattgccaaaaaggagcccttgctttgatctaggagttgatttagactagctttctggctgacaacacaatgaacacagctttagaaatcacacaagtcacactttaaataatctttcataatcttctctctcaactctcaggaacacagctgacccttacattgcaatttaaggaaaaaaatttcatgttgatccaccaggagaaggaaaaagagaggaagaggaaaatgaaggggaagaggaagaaaaaaaagagagagagatgaagcctggccaacatagcaaaaccccatctctactaaaaatacaaaaaattagctgggccgtggtggcgcacacctgtagtcccagctaccctggagagtgaggcacaagaatcactggaacccgagaggtggaggctacagtgagctaagatcacaccattgcactccagcctgggcaatagagtgagaccctgtctcaaaaaaaaaaggggggagagagagagagagatgaaagaaaaagaaggaaaaaggaaagaaaggaatggagggaggttaaaaggaagcaaggaaggaaagaagaaagggagagggtgggcgagaggagagaaagggagaaagggagcggagagagagaaggaagaaggatggaggaaagcaagggcagagcggaaagaagaaagctgtgatatacaagctgagcaacgcactctcaactcacaccccatccaatggctcccatctcatcagagcaaaagccagtggccctccagaggccaataagtcctcagggaaccacttccctagacaatctctccaccttgagccctgagtggggatggtcttccctagatatctgtgtgtctcaccccaactttcttcaagtgttcgctcaaatgatgcctcagggaggcctaccatgcacccttcgtataatgccccctcttccccacagtctcgctctactctgctccatagcaccctcgccctctcctgtattcagtcatttccttaatttattatgtttcctgcctgctcacccaatgtcaactagaatacaagcttcttgagggcaggggttatttaatgttttgttcattgctctatcaccagcaagttaaattacgcctggcatgtaatagtcaatcaacaaatacttattgaataaatgaatgaatgaacattttggcaacagccttaccataataccacaagggacccctgtcttacaatgttacccccatgcaggccaaggacagtacacaaatgtgcagttaataactatgttaaaataatttttaaaaatacattaaaatatatctcagctgggtgaggtggctcatgcctgtaatcccaacacttcaggaggccaaggcaggaggattgcttgagcccagaagtctgagaccagcctgggcagcatggcgagatgggatctcgccatgtatagatatggagagagagagtacttactatgggccaggcactgtgttaagtgctgtccatgaattatttgtttcatcattgccacaaccctgtcaagggtatctttaacccatcttacagatgaggaaactgaggcagagaggtcgggtaacctgccagcggtacacggctggcaagaggaagagccaggatcagagcagggttcagatcagggccgttggtctccacagcccaagcactcagctactttcttctccccacctgttcagtgaatggaggcctacaaaaggccgcaataactcaatgcacatgggcagcagcccaatggtctgcccagttcaagaataatttctagagcatctagcaaagtccagagaacagatagaatttatcatcattataaaaaagaagaggaagcccatgttgagggtggggagagagcaaaatctatcatttatggattactgtgtaatgtactaggcagtcatgcttcagacaaattcctataagtattatttcctaatttgtataaatattggtcagcagtttggggttttgctctgacaattatccaaagtaaaattacagtatatgttacaaattacggacaggtctaccctcctcgtgaaccaatagggttgaggcagggtctccagaataaactacaatgtgccattcactccacaggaggtggcccgggatggcagccagaggcagagccatcatttcccaggggatggttccagaacccctaaacacacaaatggacccttgaagtccaagctgtaggccattaaggatacccacaataattcttaccaggcaagtgtttttaaatgaattttaccaaatactatttgtagctgggtttttttaatcttagtaaggagccagaaatgtctttaaacatttttacttttcagaagcttaaataaactgaaccaatcatgcagtgtgcttagcaatgagccttcagaatgacagtcgggctttggaaggggctaccttatgttacactccctgatgatcatgagatgtctatttagacaactccttgttattcataataaagccatcagcatatggggtaatgctttctagtctgttttcctcaactaaaaatatacgccatcttaactggtaaaaacgatgtactaaaataaaatgtgagaaggaaacactcaaggagagaactgttaggttctaagtattccccattttaaattgacacgcgctaggcgccaagccctgcgataagctttcaggacacagaagtgaataagagccccattcccaccctgagaaacttgaagttgtggagaaaacagacctagaagcagattaaaccagcaagtaccagaaagagggaggagcagagggagtgatcgatttggcctgggacctcaaaaaaaggcaccgttacaccgaatcacagagaataaggggattttcccagacagaaggcacaagagaaacatttgaggaatcaggaattgagaattataacttacacaaatcggattaccttcttgtgggaagaaactcccaggcaggaagtgaagggaataaaataaatacacaccatcatgattggcattcgcacgggcggttaccctactgccccttcacatgtccgaaaactgactgcgacaacctgataacctaagtaagtcagaacaaaggattcagaaaaaaaagaacttgaagcacgagttcttgccttaggaaatgttttctagatgggtaagagaaaggagaactataccagtgcattcaaattggcatatgataacaactgatccctggcagattgaggctgcctgtgcagtactgcgtatgtaagctaaatactctactcaaatgtatcgtacaaggcaaatggaaagagtgtttttccatggttcccacttgcacgggtcatgtcacgggtcatgtcagcatctaatgcaggtttcaagccggttttagtccaggttgttggaggccagagccaaggccagcttcttagacggcgggacctgtgcagatgcacagggaccatacacagaagatccttactttgtttaatgctctactggcaccatctgcaaatccttaataattttatctttgaacttgtgttttggacttgaagtccaacacgacacagaacatgtgaatgagcagaggagacaggcacaatgcccatgtctgcagttcccagatgtcacatgcataacattggcgatgcccaggagcacagaattcctgtagcccatgatgagtggcattcggtgacacccaaaccaagtacacggcaagtacatgccacatttgtgtcagagtaacagggcaccgacagctccaggagccacactctgcatttcaactagaacctttttccaaagtaatgaaaggaacacaaaagaccaaggaaccctatcatgttcgttatgactcgtgttattttgttttaaccagccagctacacagaaaatagtgaggtagaaggaaaagcaaagagagggctccacatcattccttgtcctttccatcctcccttactcatcagtaagccaaaggcagagagtgtcatagaatgtgcatacatcaggaggaaataaaaacaggtgagttagtgctgtacggtgtttccacctttctggtaggaacaaaatactcctgtacgatctgcaaattatgcattgtgtcattatcagtgagtccccatatgagttaaatgctcttatatttgcattgaaaactagcattacggcaaggcgctgtggctcacacctgtaatcccagcacttgggaaggctgaggtgggcggatcacctgaggtcaggggttcgagataagcctggcctacatggtgaaaccccatctctactaaaaatacaaaagttagctgggtgtggtggcacacgcccgtagtcccagctacttgggaggttgaggcaggagaatcgtttgaacctgggaggcagaggttgcagtgagccgagatcgtgccactgcactccagcctctccagcctgggcgacagagcaagactccatctcaaaaaaaaaaaaaaaaaaagaaaagaaaagaaaagaaaactatcactgcacaacataaagatgaatgttaaaattaatgctagtaatttaaattttaaattattctttccttagaatggcactaaatagcaaacaaaaatactgtgaaaagctaagagaggctgtgaaaatacagcaaaggtctatatttcagtacctttaatggccctttttttctgctttttgaacaagggacaccacattttcattttgcactgtgccttgcaaattatgtacacagctcttgtgtgaattcatggttttcaatatatataaatatagaaataaatgtagctgtatttgtctgatatatgtatatatgtatacatatgtatatctatacatatatctatgtatgtatacatatgtatatctatacatgtatgtatgtatacatatgtatatctatacatgtatgtatgtatacatatgtatatctatacatgtatgtatgtatacatatgtatatctatacatgtatgtatgtatacatatgtatatctatacatgtatgtatgtatacatatgtatatctatacatgtatgtatacatatgtatatctatacatgtatgtatacatatgtatatctatacatgtatgtatacatatgtatatctatacatgtatgtatacatatgtatatctatacatgtatgtatacatatgtatatctatacatgtatgtatacatatgtatatctatacatgtatgtatacatatgtatatctatacatgtatgtatacatatgtatatctatacatgtatgtatacatatgtatatctatacatgtatgtatacatatgtatatctatacatgtatgtatgtatacatatgtatatctatacatgtatgtatgtatgtatacatatgtatatctatacatgtatgtatgtatgtatacatatgtatatctatacatatatgtatatctatatatctatacatatgtatagatatacatatatgtatatctatatatctatacatatgtatatctatatatctatacatatgtatatctatacatatatgtatatctatatatctatacatatgtatagatatacatatatgtatatctatatatgtatacatatatgtatatctatatatgtatacatatgtatatctatatatgtatacatatgtatatctatacatatatgtatatctatatatgtatacatatgtatatctatatatgtatacatatgtatatctatacatgtatacatgtatatctatacatatatgtatatctatacatgtatacatgtatatctatacatatatgtatatctatatatgtatacatatgtatatctatacatatatgtatatctatatatgtatacatatgtatatctatacatatatgtatatctatatatgtatacatatgtatatctatacatatatgtatatctatatatgtatacatatgtatatctatacatatatgtatatctatatatgtatacatatgtatatctatacatatatgtatatctatatatgtatacatatgtatatctatacatatatgtatatctatatatgtatacatatgtatatctatacatatatgtatatatgtatacatatgtatatctatacatatatctatatatgtatacatatgtatatctatacatatatgtatatgtatatatgtatacatatgtatatctatacatatatgtatatattttgtatatgtatacgtacatataaaaatatctgtaagtatgtgtgtatatgtatatatgtatagctatacatatatatctatataggtatttagctctgcccatcaaaaagacccacaagcaatgatactctaacagcaaggagctcactcgaaaccactctacacaaaaagacccagggctctgaggagaaatggctgctttgggatcagaggaaatacaatttgaactttgaacatgttgtaccagaaattattgatgggcatatcaaaaggtcataaaagacatctcgaagtactttccactgactaaatctgaaacaatttgagcatcaaaataacctattgaaagaaataaaaattcgtcagtctataaataaataaataaataaataatttgaaagtttgataataaacatgatacatagtctcaaagtaactcctcacaaaagtcctattagctacaaagggaaagagaatctgtttccaatggagaaggctggcagacacgaggagaatcaagtgatcaaagttaacatcactgataatgagacaaatcaacacggtgtgccatctgatggtatgcaataagatgtctgccaaatatgcgtaacttgaatctgatattacaaaatttagacaatcccaaattgagggatatgctacaaaataatgcgtgtaatctcaaaagtatcaaggtaatggaagacaaggaaagactatggagccagtccagtttgaaggatggtaggagatatgataagtaaatactcggggtgattgtggactgggttttgctacaaagagcactactggaacaattggtgaatggtatctgaatggcatctgaggattacaagatggtaaggtatcagcgtaaatttcctgattttgatggccatatggtggctatggaggagaatggccttgtttgctggaaatgcacataaagtattaagcggtgatgggacgtcacgtcagcaacttacaccccagtgactctggaaaaactaaggttcttgtactataattgcaacttttatgtaaattttagattgtctcagaataaaaataatttaaaagtttgataatgaaaataaagtaaaagattatcagttctcagtgaacaacaacaaaaaagttctgggtagagctcctgtaatctctagggattacacctgtaatcccaggtactcagaaagctaaagcagggggatctctttagcccaagagttcaagaccagcctgggcaacacagtgagactctgttttatctaaacaaacaaacaaacaaacaaacaaacaaaacaaaacaaaacaaaaacttctgggtaatatgtgtcttagcagaactcctttaagactgttccaacaccctgaacccactctgcttttaggtaaatcctataacgtgaaaggcagaaaagtgtagaaatactgccacctaccggttatggaacaaatatatttaagttaatagaaaaaaagaattctgagatttacttggttgatggaaaatggagcttttaagggacattaaccttagaagttgttggagagcaatggaaacagaggtcttttaaccttgaggcatgcctaggaattcaatctgaaactcagagcagatggcagatggttttttgattttcagatgagccccagggcatactctagaatggggagtttaaagagaagaggttcatctagagggtataataaagacaaaataatttttcactccccaccccaacctcaacagccttggcaaagatgaattccctagaaaagagaagaaatgggagtagggtaccaggccaggactcaaggagggagaagactgctagcaaggcctaagctaactcgtggggcaacattgtaagacccagaagaggaagaatatcctcttcctccgagcaggtgcagctccacgggagaagtttctgaccttacctggaactgagtcaatttagagagctgagtgaattacaggggtagaagaagcagcggaaaggcgctgggagctcactggcccccaagcaggccattcctgcctggcaccaccaggcaccttcgggagggtggccagaggcatggtggaggtgggggaaggatgccacggggagaaggaagtctccagctgaactttgtaacaatttgaactgggtgagaagcctcctgcccagaactcgggggagggtgcgaatctggtgtgcagactccacaggcaaggaaagaaccaaacccttttctttcacagctgggaggtgggtagcctggggcaagttctgaagccctgctggggctgttggcaggggcactgtgggagtgaaaccagctcttcggattgcatgggagctgggtgaggcctatgactcccggctttcccccgcttccctgacaacctgcatgactctgcagaggcagccataatcctcctaagaacacaactccattgacctgggaacctaactcccaacccccacagcagcagcagcaagacctgcccaaggagagtaagctcagacactcctagccctgcccccacctgatgggccttccctacctaccctggtaactgaagacaaagggcatatgctctgaggagttctagggtcccgcccaccgccagttcctctccatactaccaccgctgacgctctctagaaagagctacctccagcaggagaccaaccagcacaaaaatagaacattaaaccaccaaagctaagaaccctcacagagtccatttcagccccctgccacctccactggaacaggtgctggtatccacagctgagagacccatagatggttcacatcacaggactctgcagacaacccccaataccagccggaatctggctagacccagaagagagataaaaattactgtagctcagctcacagcaagccacatccataggaaaagagggagagtactacattaagggaataccccatgggacaaaagaatctgaacaacagccttcagccctagaccttccctctgacagaacctacccaaatgagaaggaaccagaaaaccaattctggtaatatgacaaaacaaggctctttaacacccccaaaaaatcacactagctcactagcaatggatccaaaccaagaagaaatccatgatttacctgaaaaagaattcaggaggttagttattaagctaatcaggaaagcaccacagaaaggtgaagcccaatgcatggaaaccaaaaaaacacaatacaagaagtgaagggagaaatatttaaggaaatagatagcttcaagaaaaaacaatcaaaaattcagtaaacactggacacatttatagaaatgcaatatgctctggaaaatcttagcaatagaattgaacaagtagaagaaagaaaatcagatctcaaagacaaggttgttgaattaacccaattcaacaaagacaaagaaaaaagaataagaaaatatgaacaaagcttccacaaattctgggattaagttaaatgaccaaacctaagattaattggtattcctgaggaagaagagaaatctgaaagtttggaaaatatatttgggggagtaatcaaggaaaactggccttgctagagacgtagacatccaaatacaagaagcacaaagaacacctgggaaatttatcgtaaaaagatcatcacctaggcactttgccatcaggttatctaaagttaagatgaaggaaagaatcttaactgctgtgagacaaaagcaccaggtaacctataaaggaaaacgtatcagattaacagcatatttctcagtagaaaccctacaagctagaagggattggggcccaatcttcagccttctcaaacaaaacagttatcagccaagaattttgtatccagtgaaactaagcatcatttgtgaaggaaagatacagtcttttgcagacaaacaaatgctgagagaattcaccactaccaagccacgactacaagaactgcttaaaggaactctaaatcttgaaacaaatcctggaaacacatcaaaacagaacctctttaaagcataaatcacacaggacctataaaacaaaaatacaagttaagcaaaaacaaaacaaacaaacaaacaaacaaacaaacaaaaacaaggtatacaggcaacagatagcatgatgaatgcaatggtacctcacatctcactaccaacattgtaaatggcctaaatgctccacttaaaagatacagaactgcagaatagataagaactcaccatctgctgccttcaggagactcacctaacacataaggactcacataaagtaaaggggtggaaaaaggcatttcatgcaaatggacaccaaaaatgaccaggggtagctattcttatatcaaaaaaacaaactttaaagcaacagcagttaaaacagacaaagagggacattatataatggtaaaaggccttgtccaactggaaactatcacaatcctaaacatatatgcacctaatactggagctcccaaatttataaaacctaatagacctaagaaatgagatagacagaaacataataatagtgggggacttcaatactccatggacagcactagacaggtcatcaagacagaaggtcaacaaagaaacaatggatttaaactatagcttggaacaaatagacttaacagatatatacaaaacatttcattcaacaactgcagaatatacattctattcaacagcacatggaactttctctaagatagacaatatgataggccataaaatgaacctcaataaatttaagaaaattaaaattatatcaagcaccctttcagaccacagtggaataaaactggaaatcaactcaactccaaaaggaaccttcaaaaccatgcaaatacatggaaattaaataacctgcatttaataaatgagcattgagtcaaaaacaaaatcaagatgaaaattttaaaattcttcaaactgaacaacaataatgacacaacctatcaaaatctctgggatacagctaaggcagtgctaagaggaaagttcatagctctaaacgcctacatcaaaaagactgaaagagcacagattgacattctaaggtcacacctcaaggaactagagaaagaagaacaaaccaaacccaaaccctgcagaagaaaggaaataaccaaatcggagcagaactaaatgaaattgaaacaacccccccgaaaaaatacaaaagataaataaaacgaaaagctggttccttgaaaagataaataaaattgatagacaattagcaagagtaaccaagaaaagaagagagaaaatccaaataacctcattaagaaacagaatgggagttgttacaactgacaccactgaaatccaaaagatgattcaaggctgctatgaacacctatatgcacataacctagaaaacctagaagagataaataaattcctggaaaaatacaaccctcctagcttaaaccaggaataattagatacagaccaataacaagcagtgagactgaaatgataattaaaagcttaccaacaacaacaacaaaaagtccaggaccagatggattcaaagcagaattctaccagacgttcaaagaaaaattggtaccaatccttttgactctattccacaaggtagagaaagagagaaccctccctaatttattctatgaagccagcatcacccaaataccaaaaccaggaaaggacatatccaaaaaagaaaactacagaccaatattcctgatgaacatagatgctaaaatccttaacaaaataatagctaaccgaatccaacaacatatcaaaaagataatccaccatgatcaagtgggcttcataccagggatgcagggatggtttaacatacacaagtcaataaatgtaatacaccacataaacagaattaaaaacaaaaatcacaagattatctaaatagatgcagaaaaagcatttgacaaaatccagcatcacttttttttttttttttgagatggagtctcgcactgttgtccaggctggagtgcaatggcacgatcttggctcactgcaacctctgcctcctgggttcaagtgattctcctgcctcagcctcctgagtagctgggcttacaggtgctcaccaccaggcctggctaattttttgtattttttagtagagacagggtttcactatgttggccaggctggtctcgaactcctgacctcgtgatccacccgcctcagccttccaaagcactgggattataggcgtgagccaccgtgcccagcccagcatccctttatgattaaaactctcagtaaaatcagtatacaagggacataccttaatgtaataaaagccgtctaggacaaacccacagccaacataatactgaatggggaaaagttgaaagcattccctctgagaactgaaacggggcaaggatgcccactctcaccactcctcttcaacacagtcctagaagccctagtcagagcaattgaacaagagaaagaaataaagggcatccaaatcagtaaagaggaaatcaaactgtccctgtttactgatgatatgattgtttacctcaaaaaaccctgaagactcctccagaaagctcctagaacttataaaagaattcagcaaagtttctggatacaagattagtgtacagaaatcagtagctcttatatccacaacagcaaccaaacagagaatcaaatcaagaactcaaccccttttacagtagctgcaaaaaaaaaaaataaaatacttaggaatatacctaatcaaggaggcaaaagacctctacaaggaaaactacaaaacactgctgaaagaaatcacagacaacacaaacaaatggaaacacagctcatgctcatggataggtagaatcaatattgcgaagatgaccatactgccaaaagcaatctacaaattcaacacaacccctatcaaaataccaccatcattcttcacgtaattaaaaaaaaacaattctataattcatttggaaccaaacaagagcctgcatagccaaacaagactaagcaaaaagaacaaatctggaggcatcacactacctgatttcaaactgtactataaggccatagtcaccaaaacaacgtggtattggtatgaaaataggcacacagagcaatggaatagaatagagacagcccagccagccaccccatccgggaggtgaggggcgcctctgcccggccgcccctactgggaagtgaggagcccctctgcccggccagccgccccgtccgggagggaggtggggggggtcagccccccgcccggccagccgccccgtccgggagggaggtgggggggtcagcacccccgcccggccagccgccccgtccaggaggtgaggggcgcctctgcccggccgcccctactgggaagtgaggagcccctctgcccggccaccaccccgtctgggaggtgtacccaacagctcattgagaacgggccatgatgacaatggcggttttgtggaatagaaaggggggaaaggtggggaaaagattgagaaattggatggttgccgtgtctgtgtagaaagaggtagacatgggagacttttcattttgtgctgtactaagaaaaattcttcttccttgggatcctgttgatctgtgaccttgcccccaaccctgtgctctctgaaacatgtgctgtgtccactcagggttgaatggattaagggtggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctctgttcacttgtttatctgctgaccttccctccactattgtcctgtgaccctgccaaatccccctctgcgagaaacacccaagaatgatcaataaaaaaaaaaaagaaaaaaaaaaaagaatagagaacccagaaataaacccaaatacttaaagccaactgatatttgacaaagcaaacaaaaacataaagtggggaaaggacacccttttcaacaaatggtgctgggataattggcaagccacatgaaggagaatgaaactggattctcatctctcaccttacacaaaaatcaacacaagatggattaaagacttaaatctaagacctgaaactaaaaattctagaagataacattggaaaactccttctaagcattggtttaggcaagaatttcatgaccaagaacccaaaagcaaacgcaatgaaaacaatgataaatagttgggacataattaaactaaagaacttttgcacagcaaaaggaacagtcagtagaggaaacagacaactcatagagtgggagaaaatcttcataatctatacacctgacaaaggactaatatctagaatctgcaacaaactcaaacaaatcagtaagataaaaacaagcaatcccatcaaaaagtgggctaaggacatgaatagaaaattctcaaaagaagatatacaaatggccaacaaacatatgaaacaatgcttaacatcactaatgacaaggaaaatgcaaatcaaaaccacaatgtgataccaccttactcctgcaagaatggtcataatcaaaaaatcaaaaacaatagatgttggcctggatgtggtgatcaggtaatacttctaaactgctggtgggaatgtaaattagtatagctgagagatgaagccacttgagcttctgggtcagatggtgacttggagaacttttgtgtctagctaaaggattgtaaatgcaccaatcagtgctctgtgtctggctaaaggattgtaaatgcactaatcagcactctgtaaaatgcaccaatcagcactctgtaaaatggaccaatcagcgctctgtaaaaatggaccaatcaggaggatgtgggtggggccaaattagggaataaaagctggccacctgagccagcagtggcaaccccctggggtccttttccatgctgtggaagctttgttcttttgctcttcacaataaatcttgctgctgctcactctttgggtctgcactacctttatgaactgtaacactcatcgcaagggtctacggcttcattgctgaagtcaacgagaccatgaatccaccaaaggaacaaacaactctggacgcgccacctttaagagctgtaacactcactgcaaaggtctgtggcttcactcctgaagtcagcgagaccacaaacccaccgggaggaacaaacgactctggacacaccatctgtgagagctgtaacactcactgcgagggtccgcggcttcattcttgaagtcagcaagaccaagaacccactggaaggatccaattccggacacacagccactatggaaaacagtgtggagattccttaaagaactaaaagtaaaactaatgtttgatctagcaatcccactactgggtacctacccagaggaaaagaagttattatatgaaagagatacttgcacatggtttttttttgtttttgtttttttgagatggagtttcactcttgtttcccaggctagagtgcagtggcatgatctcagctcactgcaacctccgcctccaggttcaaccaattctcctgcctcagccttccagatagctgggattgcaggcatgcaccatcacacccagctaatttttgtagttttagcagagacggggcttcaccatgtgggccaggccaattttgtactcctgacctcaggtgatccacccggctaggcctctcaaagcactgggattacaggtgtgagctaccatacctagcccaaacacacgcatgtttatagcagcacaatttgcattgcaaaattgtggaaccaacccaaatgcccatcaatcaatgaatggataaagaaactgtaatatatatatatatactggaattacaggcatgagccaccacacccggcccaagcacacgcatgtttatagaagcacaatttgattgtggaaccaacccaaatgcccatcaatcaatgagtggctaaagaaactgtgatatatatatatacatatattccatcatatatatatatatacacatcatatatattccatcatatatatattccatcatatatataccatcatatatatattccatcatatatataccatcatatatatattccatcatatatatattccatcatatatattccatcatatatactatcatatatattccatcatatatatattgcatcatatatattccatcatatatatagtatcatatatattccatcatatatatattgcatcatatatatattccatcatatacatatatatattccatcatatacatacacatatatatatgtatgtatatgatggaattctactcagccataaaaaggaatgaattaacagcatttgcagtgacctggatgagattggagactattattctaagtgaagtaactcaggaatggaaaaccaaacattgtgtgttctcactgatatgttagagctaagctatgaggatgcaaaggcatgagaatgatgcaatggactttggggacttggggggaagggtgggaggggagcgaggaataaaagactacaaatacggtgtcgtgtatactgcttaggtgatgggtgcaccaaaatctcacaaatcaccaataaagaacttacataacaaaataccacctctaccccaataatctatggaaattttttttaaaaaaagattaaatgaagtcataagagtagagcttgaatctgataggactgtagctcgctctctctctctttctcgctctctctctcgctctctctctctgtcgtgtgaagaacacagcaaaaagttagccagctttttgcacaccaggaagagagtccttgccaggttcttggatgtccagcatcaagaactatgagaaaataattgtctcttgtttaagccactcagtctatgatattttgttattgcagcccaagctaagacaaacactgttgacttcctgttggaaaacttattccatggagacagctacaactccaaaagacatggctatatatctgtcactccaacctacatgatattaattgagatatcgcatttgatatgctttagttcaggagaatcataaaccctggaatcaatagggaccatagacaatttctagtctggggatttcaaactgcattgttagaacctctcagggcctgccacaggcagaggagagtttgtatttgagcaacgactacgtactagacacagtgcctggagagtcagctatggtacaaggttcctgtcatcttgaagcttacattctaatggggagagacagataatagacaaataaaagagtaaatagccaagataatgatagactgtcctatgaaggaaataataggttaaataggatggtcaggggaggcctcttggggaagtggggccatgagaagaaagaggagtaacttcttaggtggagggaacaacaggttccaaggcccaaatgtgcaaaaaggctgcaggtggcctgggaaagatggaatccagaatacctagcacatacagagcaaaggggagagggtgtgagatgagactgcagaagcaggcaagagccagcccatgcaagaccgtgaacatcttggtagaggattttagactttaagagcaaaagaatgacactggacatttttcaagcagaagaatgcacaactgtaggattctcctggttgctatgtaaggaatgagttaaggggaggcaggaagggaagctggaagaccatttatggggcctttggagaaatgcagttgagagagtatagggaggagaaggttatattctggaggtagacttgctgctaaattggataaaggaagggaaagaaagagaagacttaggagtaacctaggccgagcgcggtggctcatgcctgtaattccagcactttgggaggccaaggcgggtggatcacctgaggtcaggagttcgagaccagcctgaccaacatggagaaaacccatccctactaaaaatacaaaattagccgggtgtggtggcacatgcctgtaactactcgggaggctgaggcaggagaattgtttgaactcggggggcagaggttgtggtgagccgagattgagccactgcactccagcctgggcaaaaagtgaaactccatctcaaaaaaaaaaaaagagtaacctaaattctgagttcaatcaattaagtgttaccactcactgaggagaaagactcagagatgagcagatttgggaactggcagaatccagagttcactttggagcaagcgagttttgaatgcctattaaacactccagtggagcagtgagatagggtgtatgaactacgaagtccaaagagtggaggctgcagctggaactggagtggggaagagtgtaagtcagtactcttttgactgcaagagacaaaaattcaactcaagtagcttaagcaaaataagtaactaaacaaaaattgaatacaataatattagtgaactttcagctcacataaccagtaaacccaaggatgggcttcaggcccagctggacccagagactcatataatgccatggatgatgcctctctccattgcttggttcttccttcctcgatatactggatgaggtggcaccatctcataggtcctctacacaggagtccagagaaaggggaaaacactttcccacagcccatatgctgaggcttcaggacaattctcattggcacaaattgagtcataagcccatctctgaacttatcatgcattcaaaaaataaaaggagaacatgactagtgtgggttgtgagccagtgcaatgggtcaaactggggaaaggaagccacagagcacagagataaacaatcttaccaacctctgatgaagggaaaagtagttgctccccaaaagaataagtagggtactttatcagacagtggggatggctgctagatgatgagtaacgttagttattgtaacaagcaaatcccaacatttctatgtctgaacacattaaaatgctatttcctgctcacataatttttcttttttgagacagggtcttgctgtgtcacccaggctggagggcagtgacatgatctcaactcactgcagcttggctcttcctggctcaagccacactcccacctcagcctcctgagtagtcgggaccacaggcatgagccaccatgcccaaccactcacgtaatctgcgtgttcttgatcgggaagctttctttgaagcagtgatttgaggaaacgggtttcttctcttctgtatctgtgccagcttcaacaagtggcttctaaatttctaacaataagccaggcatggtggcttatgcctgtaataccagcactttgggaggctaaggcgggcagattgcttgagctggggagttcgagaccagcctgggaaacttggcaaaaccccatctgtatgtaaaaaataagacaaaaataaaataaaaagttaaaaacaaacaaaaaaataaaatagtagcactcactcctctcaagccagcagaaaggggtgaagaagattaagaagacacacccatttcttcacctctggtcacatacagaactagccatgcggccccactatgtgaaaggaagtcttgcaaaagtcatacctggctgggcaacagctcccagcagccactctgcacaatgggagggaaacctaagcctttggtggacagcagccatgtctcccacaggtgctgagcagacaaggagcagatgtccatctctagcatccatccagcagtcctgcacaggacgcagagtgatcagcctgggcttactccgtgcttttctgggctggtctctctcacagtgaagctccatgtttatgattcttggccctagatgtgtattagaatcacttgttgccgggcgtagtggctcatgcctgtaatcccaacacttgggaggctgagatgggaggatcacttgagctgagttcaagaccagcctgggcaacacagataaacctcatctctactaacattaaaaaaaaaaaaaaaatcagctgggtttggtagcacatccctgtagtcccacctacttgggaggggtgggctgagatgggaggataacttgagcccaagaggttaaggctgcagtgagccctgattgtgccactgcactccagcgtgggtgacagagcaaggcccatatccatgttcagactgattgaatcagtctttcatgggtagagcctggcatcattatttgggtaaaactcctttgaagtggctctaatgtgtacccaggaatgagaaccatttggcttaaataaaagaaagacatttggctgggcacggtggctcacgcctgtaatcccagcactttgggaggccgaggtgggcagatcatctgaggtcaagagttcaagaccagcctgaccaacatggagaaaccctgtctctactaaaaatacaaaattagccaggcatggtggcacatgcctgtaatcccagctactccggaggctgaggcaggagaattgctggaacctgagaggtgcaggctgcagtaagccaagatcgcaccattacactccagcccaggcaacaagagcgaaactccatctcaaaaaaaaaaaaaaagaaaagaaaaaaagaaagacatttaatagttctcagtaataaagagaggaaccaactgtcttttaaaattgtagtcttaaaaatttgaaggaagaaacccagtgaatcccatcttgggacaggtggccatcactataccggggaccatagcaaaaaaaaaaaaaagaaaaatgtgtcagacaaaactacaaatgttcagcacggtgttcaaacacacactgggcgtggcagcaagatcagaggatgggagatgagaaagaagggggactgaagtctacacgttcaaggagtttgtctcagaaggaaactgcaaaataaagaccatccctgacatgttgacattgatgctgaaagggagagagagccctgaaggccgggcgtggtggctcacgcctgtaatcccagcactttgggaggccaaggcgggcgtatcacctgaggtcaggagttaaagaccagcctgaccaacatggagaaaccccacctctactaaaaatccaaaattagttgggtgtggtggcgcatgcctgtaatcccagctactccggaggctgaggcaggagaatcgctggaacctgagaggcggaggttgtggtaagccaagattgcacctttgcactccagcctaggcaacaaaagtaaaactccacctcaaaaaaaaaaaaaaaaaaaaaaaaaaaggaaagccctggaggagtgactcttgagacagaaggtttgacacactcaaagtgagaaaattgatcattcagtatacaccatgcaaaggcccgaatctggccccaaatatctcattttgtctgaaaaaaatgaaaatgtcacttttgacaccccccaaccaaaatctcaatttgtttacaagaaccacataaggaatcttattccttaaccatttgatggttgagttccccaaaaatagaaattaaagccacacactgtctttcatctaccctctttgcaggggtacattcactttgggctcatcccaggcattcttacagaaaagcttaaccaaataaaaataagctttttagggggtaaaaaactgttttgtaaacaatgatatactttgggactaaggaggaaatgaaaggatacatttaaaacatgtatatcaagaagtaaataaaaacatcagtggaattactttattaaatcagaaaattacagcatttttgtacatgaaaaagctttccccctacaactaataaggtacaaataaaaggcgttctgtcggaattatcatgcactgtggtggaaagaacactaaggcaggaagtgggttccagaactagtctggtgaatgttccatgtgctgatgaaaagaacgtgtgttctgcagctattagagtgttctgcacctattagaatgttctgtaaatgtcaggtccatttggtgtaaagtgcaatttaaatccaatatttattggttttatgtctagaaaatctgtccaatgctgagagtagagtgaagtcctcaactactattgtattagagtctatttctccctttaaatctaataatatttgctttatatctgggtcatccagtgtggggtacatatatatttataatgataatatcctcaggcctggcacagtggctcatgcctataatcccagcaccttaggaggccaaagcaggaggactgctttgagacccagagtttgagactagccaggcaacatagcataaccccatctctacaaaaaaattttcttaataaaaaaatatgattatatcttgcatgaattgatccttgtttcattacataatgacttttctttttacagtttttgacttaaagtctattttatctcatgtaagtatagttatttctgctcttttttggcttccatttgtatgcaatatctttctccataccttcacttttggcctgtctttacaggtgaggtttcttgtaggcagcatacagtcgagtcatgatggtggtttttaatccattcagtcaatctatatcttttaagtgggagaatttaatccatttacattcaaagttatcatcaatagaggtgcagactttttaaacaaatctcttcccaggagaatcacttgttttttgagagacaggatctctttcacccagactggagtgcagtgtagactcacactgtaatcacagctcactgtagactccaactcatgacctcaagggatcctcccaactcagcctctcaagtagctgggactatagggatgtgccagcatgcccagctaaattttaactttctgtagagatggggtcttgctttgttgcccaggctggtctcaaactcctggactcaagagatcctcctgcgttggcctcccaaagcacagagattacaagtataggccaccacactcagccttgataggtgaagacttacttgtgtcattttttaaattgttttctggtaaaaatgctaacagtaactaggagctaaaagattcatttgtttttttcctccaggcatccactctgagccccagtgaagaatggtggcagctgtaagcactaccagcaagtataccctactggttggagaactttgtttaaaggatataagttgtgtgccttctgtaaatgacgatttaataatatcaatatccatttatcctctataatcatagtcaatacacagagaaaaccaaaaaatgccagacttgggttgggttccaagatggccgaataggaacagctccagtctacagctcccagcgtgagcgacgcagaagacaggtgatttctgcacttccaactgaggtaccaggttcatctcactggggcttgttggacagtgggtgtaggacggtgggtgcagcccactgagcatgagctgaagcagggcaaggcatggcctcacccgggaaggcaaggggtcagggaattccctttcctagccaagggaagctgtgacagacggcacctggaaaattgggtcactcccaccctaatactgcgtttttccaatggtcttagcaaacggcacaccaggagattatatcctgtgcctagctcggagggtcccacgcccatggagccttgctcattgctagcacagcagtctgagatcgaactgcaaggtggcagtgaggctaggggaggggagcccaccattgctgaggcttcagtaggtaaataaagcagccgggaagctcgaactaggtggagcccactgcagctcaaggaggcctgcctgcctgcctctgtagactccacctctgggggcatggcatagccgaacaaaaggcagcagaaatctctgcagacttcaatgtccctgtctgacagctttgaagagaccagtggttctcccagcacagagtttgagatctgagaacggagagactgcctcctcaagtgagtccctgacccccgagtagcctaactgggaggcacccccaagtaggggcagactgacaccccacatggccgggtacccctctgagatgaagcttccagaggaatgatcaggcagcaacatttgctgttcagcaatattcgctgttctacagcctccactgtgatacccaggcaaacagggtctggcgtggacgtccagcaaactccaacagacctgcagctggcggtcctgactgttagaaggaaaactaacaaacagaaaggacatccacaccaaaaccccatctgcacatcaccatcaccaaagaccaaaggtagataaaaccacaaagatggggaaaaaacagagcagaaaagctgaaaattctaaaaatcagagcgcctctccccctccaaaggaacatagctccttgccagcaacagaacaaagctggacggagaatgactttgacgagttgagagaagaaggcttcagatgatcaaacttctccaagctaaaagaggaagttcgaacccatcacaaagaacctaaaaaccttgaaaaaagattagacaaatggctaactagaataaccagcatagagaagtccttaaatgacctgatggagctgaaaaccatggcatgagaactacgtgacgaatgcacaagcttcagtagccaattcgatcaactggaagaaaggttatcagtgattgaagatcagatgaatgaaatgaagtgagaagagaagttaagagaaaaaagagtaaaaagaaacgaacaaagcttccaagaaatatgggactatgtgaaaagaccaaatctacgtctgattggtgtacctgaaagtgacggggagaatggaaccaagctggaaaacactctgcaggatattatccaggagaacttccccaatctagcaagggaggacaacattcaaattcaggaaatacagagaacgccacaaagatactcctcgagaagagcaactccaagacacataattgtcagattcaccaaagttgaaatgaaggaaaaaatgttaagggcagccagagagaaaggtcgggttacccacaaagggaagcccatcagactaacagctgatctctcagcagaaactctacaagccagaagagagtgggggtcaatattcaacgttcttgaagaaaagaattttcaacccagaatttcatatccagccaaactaagcttcataagtgaaggagaaataaaatcctttacaaacaagcaaatgctgagagattttgtcaccaccaggcctgccttacaagagctcctgaaggaagcactaaacatggaatggaacaaccagtatcagccactgcaaaaacatgccaaattgtaaagaccattgaggctaggaagaaactgcatcaactaacgagcaaaataaccagtgaacatcctagtgacaggatcaaattcacacataacaatattaaccttaaatgtaaatgggctaaatgctccaattaaaagacacagactggcacactggataaagagtcaagacccatcagggtgctgtattcaggaaacccatctcacgtacagagacacacacacataggctcaaaataaaaggatggaggaagatctaccaagcaaacggaaaacaaaaaaaaaggccggggttgcaatcctagtctctgataaaacagactttaaaccaacaaagatcaaaagagacaaagaaggccattacatgatagtaaagggatcaattcaacaagaagagctaactatcttaaatatatatgcacccaatacaggagcacccagattcataaaccaagtccttagagacctacaaagagatttagactcccacacaataacaatgggagactctaacaccccactgtcaatattagacagatcaacgagacagaaagttaacaaggatatccaggaattgaattcagctctgcaccaagcagacctaatagacatctacagaactctccaccccaaatcaacagaatatacattcttctcagcaccacatcgcacctattccaaaattgaccacatagttggaagtaaagcactcctcagcaaatgtaaaagaacagaaattataacatactgtctcagaccacagtgcaatcaaactagaactcaggattaagaaactcactcaaaaccactcagctacatggaaactgaacaacctgctcctgaatgactactgggtacataacaaaatgaaggcagaaataaagatgttctttgaaaccaacgagaacaaagacacaacataccagaatctctgggacacatttaaagcagtgtgtagagggaaatttacagcactaagtgcccacaagagaaagcaggaaagatctaaaattgacactctaacatcacaattaaaaatattagagaagcaagagcaaacacattcaacagctagcagaagacaagaaataactaagatcagagcagaactgaaggagacagagacacaaaaaaaccttcaaaaaatgaatgaatccaggagctggttttttgaaaagataaacacaattgatagaccgctagcaagactaataaacaagaaaagagagaagaatcaaataaatgcaataaaaaatgataaagtggatatcaccaccaatcccacagaaatacagagtacacagagaatactataaacacctctatgcaaataaactagaaaatctagaagaaatagataaattcctggacacatacaccctctcaaaactaaaccaggaagaagtttaatccctgaatagaccaataacaggctctgaaattgaggcaataattaatagcctaccaaccaaaaaaagtccaggacaagatggattcacagccgaattctaccagaggtacaaggaagagctggtaccattccttctgaaactattccaatcaatagaaaaagagggaatcctccctaactcattttatgaagccagcatcatcctgataccaaagcctggcagagacataacaaaaaaagagaactttagaccaatatccctgatgaaaatcaatgcaaaaatcctcaataaaatactggcaaactgaatccagcagcatatcaaaaagcttatccaccatgatcaagtgggcttcatccctgggatgcaaggctggttcaacatacacaaatcaataaaagtaatccagcatataaacagaaccaaagacaaaaaccacatgattatctcaacagatgcagaaaaggccttggacaaaattcaacagcccttcatgctaaaaactctcaatgaattaggtattgatgggacatatctcaaaataataagagctatctatgacaaacccacagccaatatcagactgaatgggcaaaaactggaagcattccctttgaaaactggcacaagacagggatgccctctctcaccactcctattcaacatagtgttggaagttctggccagggccatcaggcaggagaaagaaataaagggtattcaataaggaaaagaggaagtcaaattgtccctgtttgcagatgacatgattttatatttagaaaaccccatcatctcagcccaaaatctccttaatttgataagcaacttcagcaaaatctcaggatacaaaatcaatgtgcaaaaatcacaagcattcttatacaccaacaacagacaaacagagagccaaatcatgagtgaactcccattcacaactgcctcaaagagaataaaatacctaggaatccaacttacaagggatgtgaaggacctcttcaaggagaactacaaaccactgctcaaggaaataaaagaggacacaaacaaatggaagaacattccatgctcatggataggaagaatcaatatcgtgaaaatggctatactgcccaaggtaatttatagattcaatgccatccccatcaagctacccatgactttcttcatagaattggaaaaaactactttaaagttcatgtggaaccaaaaaagagcctgcactgccaaaacgatcctaagccaaaagaacaaagctggaggcatcacgctacctgatttcaaactatactacaaggctgcagtaaccaaaacagcatggtactagtaccaaaacagagatatagaccaatggaacagaacagagccctcagaaataataccacacatctacaactatctgatctttgagaaacctgacaaaaacaagaaatggggaaaggattccctatttaataaatggtgctgggaaaactggctagccacatgtagaaagctgaaactggatcccttccttacaccttatacaaaaattaattcaagatggattaaagacttaaatgttagacctaaaaccataaaaaccctagaagaaaacctatgcagtaccattcaggacacaggcatgggcaaggacttcatgtctaaaacaccaaaagcaatggcaacagaagccaaaattgacaaatgggatctcattaaactcaagagcttctgcacagcaaaagaaactaccatcagagtgaacaggcaacctacaaaatgggagaaaatttttgcaatctactcatctgacaaagggctaatatccagaatctacaaggaactcaaacaaacttacaagaaaaaaacaaaccccatcaaaaagtaggtgaaggatatgaagagacacttctcaaaagaagacatccatgcatccaacagacacatgaaaaaaatgctcatcatcatgggccatcagagaaatgcaaatcaaaaccacaatgagataccatctcacaccagttagaatgtcaatcattaaaaagtcaggaaacaacaggtgctggagaggatgtggagaaataggaacacttttacactggtggtgggactgtaaactagttcaaccattgtggaagacagtgtggcgattcctcagggatctagaactagaaataccatttgacccagccatcccattactgggtatatacccaaaggattataaatcatgctgctataaagacacatgcacacgtatatttattgtggcactgttcacaatagcaaagacttggaaccaacccaaatgtccatcaatgatagattggtttaagaagatgtggcacatatacaccatggaatactatgcagccataaaaaaggaagagttcatgtcctttatagggacatggatgaagctggaaaccatccttctcagcaaactattccaaggacaaaaaaacaaacaccgcatgttctcactcatagatgggaattgaacaatgagaacacttggacacaggaaggggaacatcacacaccggggcctgtcgaggggtggggagaagggggagggatagcattaggagatatacctaatgtaaatgacgagttaataggtgcagcacaccaacatggcacatgtatacatgtaacaaacctgcatgttgtacacatgtaccctagaacttaaagtataatttaaaaataaataagtaaaaaataaaatgccagagttggcaccttaagatcctctttcacagcaaaggagcaggactaaaaccaggcatcttgaccaatatcccacaggtgctctggtaaaatctccaagaccaggacccaggtcttccagtacctaattcaatgttctttccatgcccacacaaaggcaagcagcagaaggaggagcaagcataaggccttcccagtcaccacagccatgctgtcaaacctctctgtggatatgctgtgttaacttctgagccttggggatacccatatttacaatatgataaatacattaagtcacattgtttaatatttggatatgggcccagacgcacaaatgaacaagaacctcatgtcctgggacttcatggagcacaaattatagtgggcagagaggcaaacttggaatcaccgtgacgctgggcatcgagactactgggtgcaacaatgggacacactgaaagatgactagcatgtcataggaacttgaaagcattcgtgctccttccttttcacaaactgagaaatcttaaattttttttaacgtgtcccagaagcatcttgacaacagaagcactctcattactgtaaagcccacaatgaatagcagacagcatgacttcaccctagacaggtcatgccaacttcacatccctttccaaatagtatgccagtactataccaaatagtataccactttaggaagagtggtaccaggtggtaagctcctatattccaatgaccagagtaaaatatcaccagaactttatgtaaaatacatcttgtaaaagtatgattactttatttttcagagttaaggcaataatctgtggttggttaatgttctaagatgttacaagaactttaagagacagggtctcacactgtcacccaggctggagtgcagtagcacaatcatagctcactacagctgcaaactcctgggcctgtgatcctcctgccttagcttcttagtagctgggatgataggtgtgagtaaccacaaccagctattatgagaaatatataaaatactatttgtgatcatgttatttataagaaatatatatattgtctcaatccttgcttggtctcttggctcctaaaccccttgaagtatctttggtttgccaatgaaatgattggtggctgggagcctctaggtagcttcaggacggggggctgcttaccagaaagaccaaggcaagattggagggtttggactcccagcctcaacccccaacctccagaaaggggagagaggctgaaggttgagttaatcgccaattgccaatggtaatgctgacataatgaagcctccgtaaaaccccaaagggtcggggtccagatgagcttctgggtagctgatgacgtggagagagcatgaaagctccataccccttcccacatgccttgccctgtgcatctcttccatctggctgttcatctgtattctttgaaatatcctttacaagccagaggcaatggctcacacctgtaatctcagcactttgggaggctgaggtgggtggatgacttgaggtcaggagtttgagaccagcctggccaacagagtgaaaccccatctctactaaaaatacaaaaattagctgggcatggtggtgcacacttgtaatcccagctacttgggaggctgaggcatgagaatcgcttgaactcaggaggtggaggttgcagtgagttgagactgtgccaccgcactccagcctgggtgacacagtgagactccatctctaaataaaaaaataaataaatgaaatatcctttacaataaattagtattgtaaccaatatgtagttttaataaagtaataaaattaaaaatgggtaaacataagtagagtgtttctctgtgttctgggagctgctctagcaaataaatcaaaaccaaggaaagggtcacgggaaccccactttatagccagtcagaagtatagggacttgcgattggtatctggagtgggggcagtcttgtgggctgagccctccacctgtgggatctgactccaattccaggtagacagtgtcagaattgaattataggacatccagctggtgtccactggacaacctggtgtaaaagtattgagtggtatgtgacaacagcaaaaacactttggttttgtcgtatatccctaatactatgcttttaggttatcagatgatgttattacagatatgactggagatacaggtcttggtcttaagagtaatatttcaactacccattatttactattcctttcccatggaaactcagtgaaaatgacagaagattataggatttttaaagtttttgacatgcaagcataatgcagacctctttgatggttgacagattcttttattaacagtcaaaaacttcacacaattggaaaataaatgtttcttcaatgaataatcaaacaaaaattatccaggaccttatagggttttcagtatgtaccaggcttgatgcacatcttagaagacaggacattatcttgctgggatcattagggtatgactgaaagtgagaaacagtaatttgtaaaacatttacctaataatagctttcccaaacagtacttcccctggaattaaaacaggaaatacaatttatgtttatacgtggttttagatatgactcaatatacatagattttaactttatggtttggtattacttttttaaaggcgctcaatagaaattcaaatctcactttaagaccatgaatttcaagttgcaatgaagtgtacaataaagttgtgatttctcaacatcaaagtttaattattacaaaatagttcaagcaacagatagaatttcaaaaacagtatttgctttgcttccttgttttgctccaacactaatcatgctgaggtttttgaagcacagctatgactagggcaggcactgctgattcagtcacaaaaacccttcttggatgaacaatacttgttcttttcagaagaaaagcaattttaccttttctatttctattatgaaaaacagagctaaacaatttttgtatttttagtagagacagggtttcaccacgttggccacgctggtcttgaactccttcaagtgttctgcctgccttggcctcccaaagtgctgggattacagatgtgagtcaccccgcccagccctaaacaatcttaaagtctccttttccaccagatgactaaaatctttagtttgtaaattcccttagtctcttaaaatcaatctatccagaagacaagaaagacaaacttagtgaaggaaagaatgcttcctcactctctcaccagaaagccaaagcaaaaatagagccccacagaaatttcaacattgaacattttttaaatcttaaagcttagtaggaatcaaaaagctttatataagtcagcagatctgcaaaccttgttagttcaatacaaaccatgatctagcagacaacttatattcaaaagctcatctttcaaaaggttccaccttgcccgtctatttaaacagtcacgaccttccttagagaggcaagcagtaatcttacatgacacataaaagctgtttcactgtgacacatatataatgaaaagtaatcagtctccaaagtttttccaatccacaagcatgcatacacacacacacatacacacaccgctttggtactcttgtctctaataatttttaaagcctacttttctaactgaattttaaaagtaccttgaatttaaattttttttaaacttcagtcttcaatattgaaactgctaagttaccccatttttccatgaaaaaaaaatagaaaaataaacttggggaaaaaattaaaaataaaaaataaacttgggaaaacattactaaataggtttaagaaaaaagcctatataggccaggtgcagtggctcacacctgtaatcccagcactttgggaggctgagccagacggatcacttgaggtcaggagttcgagaccaccctggccaacatggtgaaaccctgtctctgctaaaaatacaaaaagtagccaggcatggtagcatgcacctgtaatcccagctattcaggaggctgaggtgggacaatcacttgaacccgggaagtggaggttgcagtgagctccggtcgcgccactgcactccagcctgggcaacagagcaagactctgtctccaaaaaaaaagaaaaaaaaaaaacgcctatataaagaaaatattccaataggagataaacctatgtacacagagttgctcaccccagcattatctgtagtaacaattagaaacaaatgaaatattcaaaaacagtaaattaggcagatgatgaaacaacatggcaaatgtatgatgctaagccaaatatacaaaaagatccctgtgagacggagcagggacccctctttggggtgtgccagggggattcccacaagcacagaaataaaggagaatcttgagtttccttcaccgaaaactccaggcacccagctcgccccgagaaggaaaccagcaagctgataagcaagaaggtcataacagtttcaaacaatagccagggaagttagagtcacctagagacatccttaacacgtgcccctgagctacttttcagaaacccagacccccaccaaatggattcacacagacgtcagataagggggaacaccagggactaaactctgacctccattctttgctctcagtttcttcctgaggggcctggccagaccttaatgttcctttctgcggaccccaagtttttagacaaagctttgcttccttaaccaatcacaaatcagggagtctttgaatccaccataacctgtaagcccgccccctgcctaccccacttcacctttcaggccaaaccaatatataagcttcatgtagtgatttacaattttggtatacagccataccaccctgaaggcacccgatctcgactgatttacaattttgcctttaacttctgctttcctgaaatttaccactgcctttaaatactctagcttgtaggtcatcatggagattgggtctcaagcatgagctgcccaattctccttgcttggcgccctgcaaataaacatcctcctttctcctactgcaaaaaccacctttttgcagttttgctgttgaagtttgcctttactgtgcaggtgagcaaaccccagttcagttcacctgctacatttaaacagtatacagctctatttgcaaaaactatacaggaacatttgacctaacaaaaaccactgggtgacatctaccagaagtatcactgcagaggattactcgacaaaaagtgcaattttctatagaaagccgagtgtttcccttgggaaagtgttaatattttatttttaagtaactggggcaaaagactagattttctataactgcaatagaataggactagaaaggcatccctacaagtccccaaagtatatggatggaatatttttgatggttttataaatgacaattgtaatttagctctctgaagaaaatgtccaatcagattcaatcacacaaagcatttactattttcaatcacttgcccaataacaaaatgtttagtaagaaattattcagaacattaagttgtttatgaaataagtgactaagcaacatcaagaaatgctacaatagagcagcttactgtattctgcagtactctataccactacaaaaacagtcataaagagcttaacatactcagcataacgatcgtggtttactttttgcaagccatgtatctttcagttacattctcccagttgattacattccaaatagcttttagataatcaggcctgacatttttatactgaaggtagtaagcgtgctcccacacatcaatccccagcagtggaataaggcctgttagaaagaaggggaaaacaaaccaaccatcagtttcagtctaaaacattgcatcttctcaatttcaacttttattattctactcacacaaaattaccctttgtaacaatctcattcacttgtttttttatataagtaggaaatctagataagaatgaatattcctataaaatatttttaattcactgtttacaaagaaaatgtgacaaatactaacaataaaatagacttgggaaaattaacaacagtactttaatagctattcttaaaaataccaacaaattaattcaagagccaattcccagccttcctcatggtggtcttaggagcagcaggaagggtgggttacatctgtgggagcaggcaaaagcccactgagaacctcctccaaagggtctgggcactcacaggggtttacgaggaaccagctctgctccccaaggctaattttaatctttgggaatacagagcagttggaggacacagtgttttcagaaattaagtgaggtaaatgaagaatttagttctatctgtaaaacatccatttaaaaaaacttttggtctgggcgcagtggctcaggcctgtaatcccagcactttgggaggccgaggcaggcagatctcttgaggtcaggcgttcgagaccagcctggccaacatggtgaaaccccgcctctactaaaaatacaaaaaattagcctggcgaggtggcaggcgcctgtaatcccagctactcaggaagctgacgcaggagaattgcttgaacctgggaggcggaagttgtagtgagccaagattgcgccactgcactccagcctgggcaacagagtgagactccatcacgcacacacaaaaacactcaaaataaattatagctctctctacaaaaacaattcttaaccagtatgtcttgatcagttgtgagggaggtcactagtaatttattattaataatttcaagtagcaaaatttattaatgatttttataaacaaaaggccatgacattccctcattttccttctaatgtgctttccacagggagaggaaggagtgtagctgggactcacttacaaatatcagcctttctggtcatgcagctctacaaataacctgactctacagatcggtgcttacaaattttttgtggcttttacaaattgttatgccatgtcactgtcccaaaagagctgttcagattctgccaaaatctgggtctatcctgtgaagtgagccacagatcaagagtattccaatgtcaggggtagaagaaggggcagagaatgactgttgttgatgtgaaggtatcactttaagttcaaagtcccaaccctctgccagacaactcatggctctatttcccatactcttcagtgacattttttaaatccaattaggctcaacagcaaagtatttggtgagcccagcctggcacttccaagccgaatattttcatatactctaccaaagagccccagaaaggcagaaggtctggaaacctgagatctagtcccagtttaacctcaaatgctcagcagaggaggtaacagtacaagctctgaaatcagtctctgcttgtatttcttttcctcactcttgttctatagctaattttttttttattttagtacatataattatctaagctgatattaattctctgtagaatgaagcagggttaataagtaaaacatttggctgggcatggtggctcatgcctgtaatcccagcacttcaggaggccgaggcaggcagatacctgaggtcaggagttcaagaccagcctggccaacatggtgaaaccctgtctgtactaaaaacacaaaaattagctgggcatggtggtatgtgcctgtaatcccagctatttgggaggctgaggcaggagaatcacttgaacccaggaggcggaggttgcagtgaaccgagatcgcaccactgcactccagcctgggcaacagtgagatctgtctcaaaaaaaataaataaaaataaaacatgtttgttaatgtacctataaaattacgtgtacttaattttatgaaatatcaggacttctaaaacatttttacttacacaagactctgggtgttatctgttaagatttgcaaattattacatgttcttaaaacactgttagttttccttatttctagttgaatgctttacagtagagcatctctcccaaatgaaatcacaatttttaaatctaacctgttgttccttgcagtggatcctgatttggacaagcagcaatttgtaagtgtccccgttccttattgaaaccaagccaaccccaacctgagccttggacaccaacagatgcagccgtcagcttctccttaaacttgtcaaaggaaccaaagtcacgtttgatggcttccagcaactcccctattaaaaaaaaaatccaaaaccacccacaaatgaacagatttcaataattacagtaaaatgttatattacatgtattaaaatatttttgtcatagggcccaagaaattagacaacatcagaatgcgacacctggatctaagtttcacaattttaattcacgtttttgttttttataacttcaactttttttttttttttttttttttttcattttttaccttttgagacggagtttcactcttgttgcccaggctggagtgcaatgccatgatctcgggtcactgcaacctctgcctcccaggttcaagcaattctcctgccttagcctcccgagcagctgcgattacaggcacgtgccatcacgcccggctaattttgtgtttttagtagagacagggtttctccatgttggtcaggctggtctcaaactcccaacctcaggtgatccacccgccttggcctcccaaagtgctgggaatacaggcgtgagccaccgtgcccggttcaaattttattttaaattcagagggtacacgcacaggtttgttacacgggtatcatatgatgctgaggtctggggtgcaattgatgccatcacccaggtagcgagcttagtatacaacagttttcaccccccgtccccttctttctccctccctgctctgtcctcagtgtctgttgctgccatttttatatccataagtactccatgtttagcttccacttgcaagtgagacatgtggtatttggttttctgttcctgggttaattcgcttaggataatggcctccagctgcgtagttcacattttttaatgaatcgtgttagagggatttccccactcactgtactatctttgttaggaaagaaatactactttctgttagctttttcttttccctgaatagaaaattttcctttgacttctaccctccttcttctacgcctccatttgggaataaagtcattgttcttctccaaggcagcccagctcttcctgtcttgatgggcagttttctctacgactgaactaagggtatactttaagagctgtaatccttttattctgtagtaatacagaatataattctagattagtcacatcaactaaatcaactgggtcaaaatctcacttctcttattctacgggtttaaaagtaatcatctttataagcacaaatgatggaatgtggtacagattaaacaaaaatggcagcataccaaaaccactggttgcatatgaatatatctgatattctggtaactgacaaaacttcaaaagtattaaccgatagtctagaagactgaactcagaaaaaaaataagttggccaggcacggtggctcacacctgtaatcttagtactttgggaggccgagacaggtggatcacctgaggtcaggagttcaaaaccagcctgaccaacatggagaaactcctctctactaaaaatacaaaaaaattagccgggcatggtggcaggcacctataatcccagctactcgggaggctgaggcagagaatcacttgaacccgggatgggcagaggctgcagtgagccaagatcaagccacttcactgtagcctgggcgaaagagctaaactccatctccaaaataataataaataaaaacaaaaataaagaaaaagttgcccagtttcccaagcttactctcctcattcatcattaccttaaaatgaaattgcttatttcaagtgcataagataggctgccttccataacactgattaaaaatgaacaataaaaccacagaaacttagggtgcatatccggagcccagaaacaagagacaagaactacatttacgcctcatgccctccctgggtgaagaagataattaaagtcatctgggcctccacaagctacacaggaagtcaaggaaacagtgatagcgaacaagaccatctagccctgtactctcctcattccctgaacactttttaaaaatacccagaaaacctaatttcctggaacaactgactttttatcagttaggaaagagtgaaaaatagcaaatgacactataatttaattctcaaaacaacaccattgttatccctgtatcacatagatgaaaaaaggtacagacggttaactatctaatccaggccctagaaactagtagacagaaagttcatcttttctagactggcgcggtggctcacatccataccacagcactttgggaggccaaggtgggtggatcacttgaggccaggagttcgagaccagccccgccaacatggtgaaaccctgtctctaccaaaaatataaaaattagccgggagtgatgccacatgcctgtaatcccagctacttgggtggctgagacacaagaattgcatgaacctgaaaggcggaggttgcaatgagccgacattgcaccactgcgctccagcctgggcgactgtaagactccgtctcaaaaaaaaaaagttcataaaatgaagtctctcagtctttccctaatatgaagtaccatccagaaaccagaaggtggagttgatgtgatattctatgttggcgtgaacataaaatcttatgacataaccccatgaaagcattctccattcctacttgtgtccttttgaaagttacaacttttatcatactcgttgttatgaaaaatatgccactatgatacctctggtaagaataaggtaacttaggccaggcacggtggctcatgcctgtaatcccagcactttgggaggccaaggtgggcagatcatgaggtcaggagttcaagaccagcctggccaacatggtgaatgaaacctcatctctactaaaaatgcaaaaattagccaggcgtggtggcgggcgcctgtaatcccagctacttgggaggctgaggcaggagaatcacttgaacccaggaagcggaggttgcagtgagccaagactgcgccactgtactccagcctgggcaacaagagcaaaactcttgtctcaaaaaaacaacaacaaaaaaaacaaaaaacaagtataaggtaacttcagtaaatcaacaatcgattcctactgtgcacaaaatgtagataagggtgcaccaatatataccaacctttgggttctccaccaccgttagggctgaggtttgtccagaaaatgctatgattgatatgaccaccaccattgaacttcagtgcaggctgaagagctatctgggctgtaacatctcctgaaaagttaaaatgcaaacacatttttttgtaactcctactttttcaaccactgtatacattatatttttttctttgtaagctattagataatgggaccagcttatctataacatccgtttgtcctaaaattcagcacccccccgccccaaaattatttgtcccagacatgctgaacaactgatgaaggacctagcagaggtggaaaagctagaaaattcactcctggctgctaggctcagggatctcttagatagaagagattttaggaaatgaaacaccaaagaggacaatcaaaataatagaatgctaaaatgtatggctcaacatacagactgtacagaaaaccttcaactctcactttcaagacagacgacgattcattgggaaatatctccaagtcacattaacaagaaactcaacatactcaaaattgaactcctgatgttctaccccaaacttactcctcctattgtcctccacgtctcagtaaatgccagctctgtccctcaggacatccttgggaacctgatgtcatttttgactcctctcccttcaccccacatccaatccaccagcatatccattagcaaagccagctctacctttaaaatacatccaatctatataaaagcacacagagaaaaataaaagaaaaaaataaaacacaagcagaacctaatcccttctccctaactctactgccacctcattgggacagaggaccagtatttctcactgcactggtgccactatcccctcagttttggggggtgggggtgggccttgccccctccaaaggctccccttctcactggagcgaaccctaggtgtttacactcagctactcttactaccaagaggcgctgcacttgaccccgtcattgagcacgtgctcacgcagctgcagcctcactggcctttttgcactcacatgaccaacttggatgttcccctcaaggctagctgagcactgctgcctctgctgaacactcttccccaagacagtctcatgctgcgttcctgttcctccttcaagtctccactgaaacatcaaccccatcagtgaagccttctctagccaccatacatgaattagcaactccctgccacccctcccagaccctttactccttctcaataggccctgtaactcctggcatactgcatgggtaccttgccaaataagtaggcaaaataaaatagtcttttctatgccttcaagaagctacagactaaatgaactattaatattagaaaaaaatggaaatcctcttgtttaataaatattttgtgcatattatccacaagataccaagagaagcaaagtaaaggacacagagacccactgagagctttgctctcaaggagcttacattttggaaaaagttctcaactgctgttctgaaagtgtacgttaagaacatatgtctgggccgggtgcggtggctcacgcctgtaatctcagcactttgggaagccgaggcgggcagctctcttcaggtcaggatttcaagaccggcctggccaacatggtgaaaccctgtcttcactaaaaatacagaaattagccaggtatggtggcgcgtgcctataatcccagctactcaggagcatgaggcaggagaatggcttgaacccaggaggcagaggttgcagtgaaccaagaacacgccactgcactccagcctgggcgacagggcaatactccgtcacagaaaaaaaaaaagaaagagaaagaaaaaaacatacatacaaggccaggtgaggtggctcacgcctgtaatcccagcactttgggaggctgagatgggcggatcacttgaggtcaggagttccagaccagcctggacgacatggaaaaaccctgtctctactaaaaaacccacaaaaagtagccaggcgtggtggcgtacgcctgtaatcccagctactcaggaggctgaggcaggagaattgcttgaacccaggagacggaggttgtagtgagccgagatcacatcactgcactccaacctgcgggacagactgagattccgtcaaaaaaaaaaaaaaaaaaaaaagtatgtctgactaggcacggtggctcacacctgtaatcccagcactctggaaggccgaggtgcgtggataggggagcccaggaattcaagagcagcctgggcaacatagtgtgaccccgtctgttttttttagacagaattaaaaaaaaaatttttaaaaggaacatacgtagacaatgctgctttctgaaacaagctccagttgtttagcgattcagaaaggagagaaccaactgatatctgaatacacagctaatctcaaagggttttttaaagacaccaactttttttttcctttgttaggtttacaaacagttttttatagatctgtgtttcccttattaaattttcttgagagtcactctaaaaatagatgtaacttttctattgttttttaataaatcaatagtaactgaatttttaaaatgggaaagatacatgcttaatgagagataatttaataatcttaacatcttacagtttgcttactcattttaaaattaataaaaattgagggcttaatatctgcttttaagaacacttttctgaaattcaacattttatttggtttcagtttagtttttgcctcaaataataataaaagtcaaatgctttttgttgaaaaatattcatattagtcagttaaatgtgatgagattatgacattgttttatcttttttccccaagttttcaaacatgaaaatctttttaataatttttaaaatatgtttaagtaaaagaaagctctgcaggtactcaatcacttataaacaatatagtacaatacaataaaaagcttttttccagtgggttgtattacataagtaaggctctgattccacaagtaaaggactgaaattaagttgtttttaaaatactgaagagaaaggttcctggtgtcagatgttgccttacaggaagtactttcacaactggggtattccccagtctctccccattacatgtttcccaaatttgttatttcctaaatcacggggccttttcccgtaattcaaggttcgtctgtctcaagtaaatcttccagaatgtggtaacttcctcctcttttaatcatttacttcaaacacaatcaggctgaaatactgcatttttccactagatgcctccagtcaacaagatgtgactgtctaaaaattactcaacaaatttcataaccccgaaattcaaaacatttaaggaaaagtaaacattttttactacgtagcttaccaagcaatacagagagtctaaaaaacatgactatcgattatcttccttgtgcaaaccactaacgaataaattaaaaagacaatactattttgtaaaaaacgttaaaacataacattcccatacacacccccaaaaggcacagactcaaaaagtccacatacccctggttttatcaaccgagctcttgagaaaaaaaaaaaaagttaacaacatatattttaattgcattacaaatatgagtaaatagtaaataaaaacaagcctgtttcagtttcccactaaagggctattttccttgtgaactttgacccctaagggaaatcaagaaaagtatcaagtctaaagatcctgaactgttccacagttaggttactgcttttttggtaacgcacaccacaacggtgtgcctcctcctctcccacctgaagtcaagtgggctcagtgaagtttcacctgcagggtagctggggatgcagggagtctccaagtcctaggctggagtcccgaccccgtttgctctcaggaagatgacaaggaccatggttcctagcacggagtagtgtcctcctgtctcccaccttcagtgtgacctggcagtaagacaccactcccacttctatcaggaggtgaccctgacactcagagacacctgcggacccgatgatgtctggccaccagtggacaggcgctctcagccctcctgcaaacggctggcacacctacctgagagaccaaacatttccccaaagcacattatacaacaagaacaatttcaatttgcaaaaaaaacgagtgacacagtagagctttcttttcaggccctacaattcaccagtgctggcaatatgtgtaacggaatgtggctcacaacagtaaggcaagctccttcgcaggaccccaagttccctgagatgacagaagtgtgttcaaacccatcgaggcactccttctacaatgaggtagaccatgtgtttaaaagagagactatcgtgcctggaaaactcggaaccggtacaaatacgaagcgagttctcctccacggagaggcccgtccgtatggggcctggctccctggggtcgcctctgccggggactgcctcccgccgctcagcctggaacctacccttggccaacgcctcctggtacttctcctcggtgacgttcaggttgttcacgtaggccgcgtggtgcttgctgtggtgcagctgcatgatctgcgcgttgatgtgaggttccagggcgccgtagtcgtagggcaggtcggggaggctgtgcttctgcctggagcccagataccccaaaaccggagccagctgcctgctggtgctgaagacgagaaagcacagcccggtcagtcagcgccgcgggaccgtctacgcaggctgggctgccgaggaacggcagcgcgcggcgtcccccgagtccccgcgtcccctccctgcggatccccgctccagccgccgcgccgggcactcccgggagaaccgcctgcaggtgccccggtcccgccaggcccggtgcggccactgtcgccattgccgcggaggccctgcccgccgcgagccccttcgcccttggggccgtgaccgggtcccctttcttctcacccgcacactgcccggctcaacatgctgctagtgctggtgctaccgctgatgccgccgatctgctgaagccgctgccgaagccaccacagccacgagtgccgctcctgcgccgcccgcgggccttaagaaagcgcggggagcagggccgcgaccccagctgcgccgcaagggcaccgccgccccgccccccccccccgcgggccccgccccgcgcccgccgcgcccaaccccgggggtgccctgcgtgcctgtcccgcccgcccgcgcttgccgtacaccccgcgcccagggcacgggagaaaggaggctgcaggctagcctcggcctcggcaacctcgctgcctgtctgccgtacttgagtggcgcgcggccgaagggaggcggcccctgcccccgtggagttggtacggcccgaaggccctgcctccggctccgcccctgagggtgccggcggggatctggctgcactaggcggctgcggcgcctgcccctgagttttggttgcgctgccggggggccgcggggtccagaggcctcactgcaaaaagacattcataccctcccagggcccccgtggccgttcctagggaagacggggcctagctgctggtcagcgccgcccagccggcctatgagctgagggtagagccagcgcccttccaacccgtattcagtactcttgcgccgtacccttgctttgcaagtaagccgaccttgggacctattccaggacaggaggcacacagactttgtccccaccggctgcctaagaacagttcttggacacccacgacgtgcccgagactgcaggcaggatttgcacacatttatctttatttttacccctagggttggtattattgattctagtaatagtgaaatcctttgaggttaagcagcttctcctgggcacagttaactgagtcaggactagttcccaccttcctcactactaagccctggcagtcatgttttgtgtgtttacagtaactctgtgaaccaactgttcaggataacataaaaggacaacagaggattctttcctgcgctgtcttgtagcctagtaagctgttaagtatcaagtgctctctcaacagttaaacaacaatcctgaatggtgtgaatcttccatgtgtagaggttaggaaatctacactgccattggcgggagttgcccctttattgaaaagaatatgatggaaggtagcaggtgctgaaccgtttccgttgcttcttgcaacccccgtacagccctccgaaggatgactaggcttccggtaagtggaatgggaaaacagtcaggcgaagaggaaccacctgaacttggcttcacaacaggaagggctgggcttgtttacagacgtcagaagaatgtaactagggctacgtgttggggtgaaaaaggaaattcaggctgggaccaggttatagatactcttatttttttaatttattatttatttatttttgagacacagcctcgctctgtcgctcaggctggagtactgtgtcgcgatgtcggctcactggaacctctgcctcccgggttcaagcgattctcctgcctcagcctcccgagtagctggaattacaggcgtgcacctccacgccccactattttttttttttttgtatttttggtagagacggggtttcactatgttggtcaggatggtctcgaacgcctgacctcaagtgatctgcccgcctcggccttccaaagtgctgggattacaggtaggagccacggcgcccggcctatagatacccttaaaacgcagacaagagcaggggtttgatgtgattgttaattggaagctgagaaacatttctgctgaggtgagacacactgaaagtggtttttcaggcaaggtggtctggcactgacttggggggatgaagggagtgcaggctagttaggaagctggtacattcgtctcagcaggaggtactgcaggtcacttttagggcactagctatgagaactggaagaaaagggcattttgaaggatgaatccacaggattcagagacagatcagtcattgtaatggaaagacttgatctagtgataatgaaatattcctattgggaggctgagctcaggctacttacttgcacttcttgtttgtatagagagtgatactttgagagtttaaagcgactcctaggacatgccctttagaacaagcaccaaacgttgggggctggtaggactgatagcagcagtcaggtagaagaatctccaacatcacacctgtcatcagctacatcattacaaaacactaccatgactgtgagcacatccaaggttgtgggatatgggaggtaaagaaaagtttaccttgtctaccacacccagtgaacaggctccgttttctttttctttttgtcgcccaggctggagtgcagcggcgtgatcacggctgattgcagcgacttgctgggctcatgtcattcttccacctcagcctcccaagaagctggaactacaggtgcataccaccatgcctggctaattttttttattttttgtagaaacagagtttcttcatgttgcccaggctggcctcaaactccttggctcaagtgatcctcccacctcagccttccaaagttctgggatctatataggcttgagccaccacacctggctgccttttttttaggtggccactgtagagggtactgaatggcctcagaagttagattacagtcgattgacctgtgtcccaagttactccagccagctcaggatgtcctctgcaacatcaggacaccatgaatatggatttcccatagataaacttcctaaggctacatcacagccatcctgagacccaccacagtacagacctatatattgtttggaagaagcaaccaatgtgggttgagatgaagtcattttgagccagttattaactgcattcatattccagtaacagatccaaccacagtttcttaaacacagaagagtgtattccctcatgtaacaaagatctggggcagtcagtcctgggttgggatgaaattccattgagtcatcaaggatgcaggctttctgtcttcaaagctgcctcatggtccataatagcttccacagcaccagcaacctcatctcccttctaggcaaggggaaggacaaaagtctgggctcccactgtctcccccaacctttttttattttttctttccgaatcaagagtcttgctttgttgctgggctggagtgcagtggtgcgatctcggctcactgcaacctccacctcctgagttcaagtgattctcctgccttagcctcctgagtagctgggattacaggtgcgtgccaccatgcctggctaatttttgtatttttagtggagatggggtttcaccatgttggccaggctggtctcgaactcctagactgaagtgatctgcctgcctcagcctcccaaagtgctgggattacaggcatgagccaccatgcctggccccactatctccattgtaaggatcctttgtggtagattcatccaacaaattccacttgctgctcactggtcaaaatttaggtacaaggctacctagcacagcctagccacaaaggaagctgagaaatgtagtcaggtatggggccaggtgcagtggttcatgcttgtaatcccagctctttgagaggctgaggtgggaagattgcttgaggccaggagtttgagaccagcttaggcaacatagcaagactctgtctctaccaaaaaacagtagctgggtgtggtagcatgtgcctgcagtcctagctacgccaggaggctgaaggcaggaggatcacttgagcccaagagttcatggctgcaatgagctatgattatgtcaccttactccagtctgggcaagagaaggagaccctgacacacacacacacacacacacacacacacacacacacacacacacgcagtcagctatacacatttgaagtcagaaaaaacttgcaattctgtacctacaggagaaaatgagtttaaaaaaatcgttgttgctaaatatcctcctataaggcattatttccacatgctttgacataaactgatcattaatggaattaccttagctacattctcttgtttttctttcttcctgcctgtggtttgtggggtttttttctgcttttttaaaatttggggtcacaaatcttatccaggcaggaatctgagaattggttgtaacctgtcctttgcaagagtggtattgttaataggaccaaaagtagtacttaaattgccaaaatgaagtgatctaggctaaaagagaaaatgattatagagctatattaaggtttcaatgtgagcttaatttttttccccacttcgggcaaaattacgattagattgcatcctcaaagaacacattaactactggaaaggaaaggaggagcttggttcagaacaaaagtgttctgttaaacaaagggataaagtgggcatgtgtcgcaggtaatcatgagttgattacgtccataaagggcaaagggagtcggcatcattgagcagatcctccatgttgctagctactaagtcaaatgctttattcctgctgtaagcaaagacagtgacttgaccaaggtcacacatagagctagtaggtagtaagggggatatgaatgtacagttgacccctgaatgatgcagtgtcaggggtgctggtcccttcacagtcagaaatctgcgtatatgcccagcaccatggctcacgcctgtaatcccaacactttgggaggccgaggtgggcggatcatctgaggtcgggaaatcgagatcagcctggccaacatggtgaaaccccatctctactaaaaatacaaaaattggcagggcccagtggctcacgcctataatcccaggactttgggaggctgaggcaggtggatcatgaggtcaggaattggagaccagcctggccaatatggtgaaactctgtctttactaaaaatacaaaaattagctaggcgtggtggcacgcacctgtagtcccagctacttgggaggctgaggcagaagaatcgcttgaacccgggaggcggcagctgcagtgagctgagatctcgccactgcactccagcctgggcgacagagtgggactcagtgtcaaaaacaaacaaacaaacaaacaaaaaacaaaacaaaaaaaacacttgaacccaggaggtggagactgcagtgagctgagatcctgccactgcactctgcactccagtctggggaacagagcgagactccatctcaaaacaaacaaaaaattagccaggcatggtggcaagcacctgcagtcccagttactcaggagactgaggcaggagaatcgcttgagcctgggaggcaaaggttgcagtgagctgagatcgcgccactgcactcctgcctgggtaacagagtgagaccttgtctcaaaaaaaaaaaaaaaaaaaaaaaaaatccaataaaacatttagaaaaaaaaaaaaacaagaaaagaaatctgactgtaacttttgactccccaaaaacttaaccactaatagcctgctgttgaccggcaataacataaagtttgtacatcacagagaagacaataacaaagttgattagcacatattttttatgaatattgtgttcttaaagtaagctagagaaaagaaaaaaataagaaaatcaaggaagagaaattatatttactattcattaagcagaagtggatcatcataaaggtcttcatcctcctcatctttatggtgagtaggctgaggaagagaggttgatcttgctgtctggggggtggggggcgggggtggaggcagaagaaaatctacatagaagtggacccatgcagttcaaacccatgttgttcaagggtcaagtgtattgctgttaaacctgtgtagctccgtgcctttaaacagctgccactccctctcccacatttttcacacccaaaagaattgggcccagccttatctaattggagcccaagatttgaaactttcttcctccttctgtccctacacaacttcccaacttatccctatctcctcaaatcctgattggcctgctgtcccatctcttacacgactctggtcatcactcttggacctaaagcttgacattgcttctatgccctgaccttggtccatctgccccttagatggcatttgctttgtagcctcagtgaagacccagcttcctggagtttcccttcacaatggcccagctcattcttcccaacctagtctagtgaaagactcagacttgctggggacccaggaggccaaaagagaagggttgtcccatattgagagtccggcagagccctccataagatcctttcatgaggacttcctgcaacatcctgcctcctttatggaaatggacaccacctcttccccattactactccacgagaaaaaaaaaaacaaacatggtcactgcattctatgtaagggtgggatctgtcattattaaactgccaacttctagttcatatcccaggatttgtcatggagtaagattgatttcaggtgcacagttccaagaatgactctcaagggctactcaagctactaaagagtagcccagaccactgagggctgtgagcaagcataaggatcttggctggctgaatctctgggccagcacaacccaggggctgcactccacactgtacatctactcggagcagccaaaataggtacacaggaggagtggcctcgcataccacccaggtccatgccagattgtggtccactgagaacagtattgatatcacagtatttctgggaacctatgtcccatctcaggcaactcccaggactcaatccatcttggcctgcatcaccctcctctcgtgccagcttacatctgcatttaccctctggtgagaaattagataaaatcgcataaaataaaacttcattttcatgctaaagatatttagtttgaggaactagtcagctatatgttggtacactagaggtgagccactaaaaatgatcactgttcagttagatgtggacaaaacatatttaagagtgggacaattattaaacatttaagggatcagattggtttccaggtgtctttaaatgccactccactttagagaattaatggaaattagagacaacacattactagtgtggtgatgcagtagctccagtaattttctggttcttcatctgaattcatttacatggtttaagttaaaatgcattgttggccaggcgcggtggctcacgcctgtaatccgagcactttgggaggccgaggtgggtggatcacaaggtcaggcgatcgagaccatcctggctgacacagcaaaaccccatctccactaaaaatacaaaaaattagctgggtgtggtggcaggcgcctgtagtcccagctactcgggaggctgaggcaggagaatggcatgaacccaggaggcagagcttgcagtaagccaagattgcgtcactgcactccagtcttggtgacgtgcgagactctgtctcaaaaaaaaaaaaaaaaaatcaatgcattgttaacatgtgtggcatgttttccaactcccatttttttgatggcatggataagacttagtctctaagtactaaatgaagaacaaatatctctctgagtgcactttgaaagtaatgcttaaatgtctggtctctgggacataacatctatctttgttaaactctgactttttactgacctgattttcatttaggttcagtctaagctttccaaatcaagcagagacctaattttcttaagcttccctggaacacaatgtaggatctcggcttttagactgaactctaggagacacaaattctcagtgatggggtggtctccaaaaccatgagaaggagtccacttaaagcaactgtcaggcaagacaatatgtaagatttccctgtattccacccacatgccaccactgtgagcaatataaatataaccccacacctgcttcctctccaggccaatccctggagatttgagaaaccatggttagcatgctcaaagatgagcagcagcagcagaaggcaagacgctagagaaggcacctgccagctgccaacatctttctccctctgtaggctgctggcctgctagaggcctgtgatgaagttttgactttaaatcactttcagagttttgcttctcacatgggagcattttggatagtgaattgagcctgtgttctaacttaaagtgattataagactttttattactaaagaacatatattttttaaaaggtcacgggaccaagctgggcgtgatagcacatgcctatagtcccagctacttgggaggctgaggcccgaggatcacctgagcccaggagttcgaggttgcagtgagccacgatcatgccactgcactccagcctggtgacagagtgagaccctgtttcaaaaaaaaaaaaaaaaaaaagtcatgggaccagcatttgatccagggacgaaggaaaaacaagcccatgaagcaaatttaatgacctattgggcaataaaggaatatcacttcatgatctcatccatgagtcattgttactgttaatagtcacacatcagtgctatggtagaatctcaaaatctcccacatttttggtatttgaatggtacccaacatttccagcttgaatgtggacttttccccagcaatttgtatattctatgagtcatttcagtggggattttaggagagaacctgtgctcattccccttcttgccagaggatcacccaccccgtcagcccaagtgtgacctttacagttagaaagtgctatacacagctgcttttctctcactttttcctagagaacaagaacaaaatctccctgccttgtatctaaggtttttcctactgagaaagagacttgttattcagttcaatggtttatgggcataaaatatggatgccccaaataagggaccttactttatcatataaatctgatgagcttaaacatactttagattacattctctgtagttagttgtgcctttatgctgctacgcatttgtagtggctaacacctgtaatcccggtgctttgggaggctgaggcgggaggatcccttgaagccaggagttcaagaccagcctgggcagcaaagcaagaccctgtctgtataaaattttttttttttttttcttgagactgagtctcactctatcacccaggctggagtgcagtggtgcaatctcagctcactgtaacctccgcctcccaggttgaagtgattcttgtgcctcagcctccctaggagctgggactacagacgtgcactgccacacccagctaatttttgtattttaagtagatggggtttcaccatgatgaccaggctggtctcaacctcccaacctcagacaatctgcccacctccgcggcctcctgaagtgctgggaatacaggtgtgagccaccctgcccagcctataaacaattttttaaaacctcagccagcagcaatacagggaagctctatctctccaaaaaaaaaaaaaaaaaaaaaaaaagaaagaaagaaagaaagaaaaaaaagccaggcatggtggtgtgcgcctgtagtcccagttactgagaggctgaggtgggaggatcacttgagcccagaaggcagaggatgcagtatgttgtgatggcaccactgcactccagcctgggcgacagagcaagaccctatctcgaaaaaaaaaaaaaaaaaaaaaaaagccaggtgttgtggtatttgcctatagtcccagctactcaggaggctaaggtaggactgcttaatcccaggggttcgaggctgcagtgagctctgattgcaccactgcactccagtctggccaacagtgaaacctcatctttaaaaaaaatggcttccggccaggcatggtggctcacgcctgtaatcccagcacttttgaaggccgaggtgggcagatcacctgaggttgggagttcgagaccagcctgaccaacatggagagaccccgtctctacaaaaaatacaaaattagccaggcgtggtggcgcatgcctgtaatcccagctacttgggaggctgaggcaggagaatagcttgaacccaggagatggaggttgcagtgggccaagattgcgccattgcactccagcctgggcgacaagagtgaagggcttctgtttttgta

SEQ ID NO: 1183 - DNA, 78654 bp, Homo sapiens
ctatcaagcccagatacaacgcttttcccatggtcttcacaacccacagaccaggagattcccttgggtgcctataccaccagggccctgggtttcaagcacaaaactgggtggccatttgggcagacactgagctagctgcaggagtttttttttttgtttgttttgttttgtttttgtaccgcagtggtgcctggaatgccagcgagacagaaccgttcactcctctggaaaaggggctgaagccagggaggcaagtggtcttgctcagcatatcccatcctacagagcccaacaagctaagatccactggcttgaaattctccctgccagcacagcagtctaaagtcgacctgggatgctccagcttgatgaggggaggggcatctgccattactgaggcttaagtaggtggtttgcccctcacagtgtaaacaaagctgccaggaagttcggactgggcagagcccaccacaatgccaaaaagccactgcagcagactgcctctctggattcctcctctctggataaggcatctctgaacaaaaggcagcagcctcagtcaggggcttatagataaaactcccatctccctgggacagagcaactgagggaagaggcggttgtgggcacagcttcaacagacttcaacattcctgtctgccagctctgaagcgagcagcagatctcccagcacagcacttgagctctgctaagggacagactgccttctcaagtgggtccctaatcctagtgcctcctgacagagagacaccttccagcaggggtcaacagacacctcatacaggagagctccagctggcatctggcaggtgcccctctgggacaaagcttccagaggaaggagaaggcagcaatctttgctgttctgcagcctccactggtgatacccaggcaaacaagatctggagtggacctccagaaaactccagaaggcctgcagaagaggggactgaccgttagaaggaaaactaatacaaagaaagcaatagcgtcaacatcaacaaaaagaacgaccactgaaaaaccccatgcgaaggtcaccgacagcaaagactaaaggtagataaatctatgaagatgaggaaaaaccactgcaaaagggctgaaaattccaaaaaccagaatgcctcttctcctccaaaagatcacaactctttgccagcaaaggaacaaaattggacaaagaatgagtttcacaaattgacagaagtaggcttcagaaggtgggtaataacaaactcctctgagctaaaggagcatgttctaaaccactgcaaggaagctaagaatgctgataaaaggttagaggaattgctaactagaataatcagtttagagacgaacataaatgacctgatgagctgaaaaacacagcacgagaacttcatgaagtatacacaagtatcaatagctgaattgatcaagcagaagaaaggatatcagagattgaagaataacttatgaaataaagtgtgaagacaagattacaaaaaaaaaaaaagaatgaaaactaacaaacaaagcctccaagaaatatgggactatgtgaaaagaccaaatctacgtttgattggactacctgaaagtgacaggaagaatggaaccaagttggaaaacacacttcaggatattatccaggagaacttttgcaacctagcaaaacaggccaacattcaaatttgggaaatacagagaacaccacaaagatactcctcgagaagagcaaccccaagacacataatcatcagattcaccaaggttgaaaggaaggaaaaaatattaagggcagccagagacaaaggccgggatatccacaaagagaagcccatcagactaacaacagatcattctgcagaaatgctacaagccagaggagagtgggggtcaatattcttaaagaaaggaattttcaacccagaatttcatatccagccaaactaagctccatatatgaaggaaaaataaaatcctttacagacaagcaaatgctgagagactttttcaccaccaagcctgccttacaagagctcctgaaggatgcactaaatagagaaagaaaaaccgttaccatccactgcaaaaacataccaaaatgtaaagaccatcgacactatgaagaaactgcatcaactaacgggcaaaataaccagctagtgtcataatgaaaagatcaaattcacaaataaaaatattaaccttatatgtaaacaggctaaatgccccaattaaaagacacagacttgcaaattggataaagagtcgaggcccttttggtgtgttgtactcaggaggcccatctcacgtccaaagacacaaataggctcaaaataaagggatggaggaagatttaccaagcaaatggaaagcaaaaaaagcaggggttgccatcctagtctctgataaaacagactttaaaccaacaaagataaaaaaagacaaagaagggcattacataatggtaaagggatcaatgaaacaaaaataaagctaactatcctatatacatacacacccaatacagaagcacccagattcataaagcaagttcttagagacctacaaagagacttagactcccacacaataatagtgggagactttagcaccccactgtcaatattagacagatccaggaggcagaaaattaacaaggatattccggacttgaacacggctctgaaccaagcagacctaatagacatctacaaaactctccatcccaaatcaacagaatatacattcttctcagcaccacatagcacttatttttaaattgaccacataattggaagtaaaacactccttagcaaatgcaaaagaatggaaatcataacaaacactctctcagaccacagtgcaatcaaattggaactcaggattaagaaactcactcaaagccacacaactacggggaaactgaacaacctgctcctgaatgactactgagtaaataatgaaattaaggcagaaataaagaagttctttgaaaccaatgagaacaaagacacaatgtatcagaatctctgggacacagataaagcagtgtttagagggaaatttatggcactaaatgcccacagaagaaagcaggaaagatctaaaatcaacaccctaacatcacaaaaagaactagagaagcaagagcaaacaaactcaaaagctagcagaagacaagaaataactaagatcagagcagaaatgaaggcgatacagacacaaaaaaaccttcaaaaaaatcagtgaatccaagagctggtttttttgcaaagattaacaaaatagatagaccactagccagattaataaagaagaaaagagggaagaatcaaatagatacaagaaaagatgataaaggggatataaccactgatcccacagaaacacaaactaccatcagagaatactataaacacatctatgcaaataaactagaaaatctagaagaaatggataaattcctggacacatacacccccccaagactaaaccaggaagaagtcgaattcctgaatagaccaataagaagttctgaaattgaggcagtaattaatagcttaccaaccaaaaaaaagctcaggactagatggattcacagctgaatcctaccagaggtacaaagaggaactggtaccattcctactgaaaatattccaaacaacagaaaaacagggactcctccctaactcattttatgaggccagcaccatcctgataccaaaacctggcagagacataacaaaaaaaaagacaatttcaggccaatatccctgatgaacattgatgcgaaaatcctcaataaaatactagcaaactgaatcaagcagcacattaaaaagcttatccaccacaatcaagtcggcttcatccctgggatgcaagctcattcaacatacccaaatcaataaatgtaattcatcacataaacagaaccaatgacaaaaaccacaggattatctcaatagatgcagaaaaggccttcgacaaaattcaacagcgcttcatgctaaaaactctcaataaactaggtgttgatgggacatatctcaaaataataaaagctatttatgacaaacccacatccaatatcatactgaaagggcaaaagctggaagcattccctttgaaaactggcacaagacaaggatgccctctctcaccactgctattcaacatagtattggaagctctggccaaggcaatcaggcaagagaaagaaataaagcgtattcaaataggaagagaggaagtcaagttatctctgtttgcagatgacatgattgtatatttagaaaaccccactgtctcagccctaaaactcctaagctgataagcaacttcagcaaagtctctggatacaaaatcaatgtgcaaaaatcacaagccttcctatacaccaataatagacaaacagagagccaaatcatgagtgaactcccattcacaaatgccacaaagagtacaaaatacttacgaatacaacttacaagggatgtgaaggacctcttcaaggagaactacaaaccactgctcaagcaaataagagaggacacaaacaaatggaaaaccattacatgctcatggataggaagaatcaatattgtgaaaatggccatactgcccaaaatagtttatggattcaatgctatccccatcaaactaccattgactttcttcacagaattagaaaatactactttaaatttcatatggaactaaaaaacagcccatatagttgagacaatcttaagcaaaaagaacaaagctggaggcatcatgctacctgacctcaaactatactacagggctacaataaccaaaacagtatggtactggtaccaaaacaggtaaatagaccaatggaacacaatagaggcctcagaaataacgccacacatatacaataatctgatctttgacaaacctgacaaaagcaaccactgaggaaaggattccctatttaataaacggtgtggggagaactagctagccatatgcagaaaactgaaactggaccccttccttacaccttatacaaaaattaactcaaggtggattaaagatttaaacgtaagacctaaaaccataaaaaccctagaagaaaacctaggcaataccattcaggacacaggcatggacaaagatttcatggctaaaataccaaaagcaatggcaacaaaagcccaaattgacaaataggatctactaaagagcttctgcacagcaaaataaactatcctcagagtgaagaggcaacatacatattgggagaaaaattttgcaatctatccatctgacaaaaggctaatatccagaatctacaaggaacttaaacaaatttacaagaaaaaaacaatcccatcaaaaagtgggcaaaggatatgaacagacacttttcaaaagacatttatgcagccaacaaatacatgaaaaaaagctaatcatcactggtcattagaaatgcaaatcaaaaccacaatgagataccatctcatgccagttagaatggtgatcattaaaaagtcaggaaacaacagatgctggagaggatgtggagaaataggaatgcttttacactgttggtgggagtataaatgacttcagccatttgtgtgtggcaattcctcaaggatctagaaccagaaataccatttgacccagcaatctcattactgggtatatacccaaaggattataaatcatcctactataaagacacatgcacacgtttgtttactgtagcactattcacaacagcaaagacttggaaccaacccaaatgcccatcaatgatagactggataaagaaaatgtgacacatatacaccatggaatactatgcagccataaaaaatgatgagttcatgtcctttgcaggaatatggatgaagctggaaaccatcattctcagcaaactaacacaggaacagaaaaccaaacactgcatgttctcactcataaataggagtctgcatgttctcactcataaataggagtcaaataatgagaacacatggacacagggaggggaatatcacacaccagggactgtcagggcatgggtgacaaggggagggatagcattaggagaaataccaaatgtagatgacgggttaatgggtggagcaaaccaccatggcatatgtatacctctgtaacaaacctgcacgttctgcacatgtatcccagaagttaaagtataatttaaaaaattagcctgtaaaaatttacaatctattgtaaatgggatttcttgatttcttttttggattgttcactgttggcatatagaaatgctactgacttttgtatgttgattttgtatcctacaaatttactgaatatatatatctcagttctaatagtttttttattcagtctttagatttttccaaatataagatcatatcatctgcaaacaaggataatttgatttcctttccaatttagatgccctgtatttctttttcttgtctgatcactctagctaggacttctagaattatgttgaataacagtggtgaaagtgggcatccttgtcatgttccagattgtacagaaaatgctttcagtttttccccattcagcatactagctgtctgtcagtcatatattgctttcattatgttaaagtatgtttcttctacaccaagttttttgaagacttttaccatgaagtgatgttgaattttttcaaatgctttttcagcatcaatttaaatgatcatatggtttttgtccttcattctgttgatatgatgtatcacattggttgatttgtgtatgttgaaccatccttgcatcccagggatatatcccacttggtcatggttaataatatttgtaatatgttgttgaatttaatttactagcattttgttgaagatttttgcattaatattcttcagagatattggcctggagttttctttctttgatttatctttgttattggaatcagagtaagactggccttgtagaatgagtttgcaagtatttcctccaccttgattttttggaaataatttgaataaaattggcatttgttcttctttaaatgtttgctggaattcagcagtgaaaccatcaagtcctgggcttttctttactgggagaccttttttttttttgagatggagtctcactctgttgcccaggctggagtgcagtggcacgatcttggctcactgaagccttcgcctcccaggttcaagtgattcttctgcctcagcctcctgagtagctgggattacaggcatgcacaatcatgcccagctaatttttgtgtttttggtacagacagggtttcaccatgttagccaggctggtcttgaactcctgacctcaggtgatccactcgcctcagcctcccaaagtgctgggattacaggcatgagccaccacgcccagccagactttttattaaggctttgatctcattacttgttatttgtctgttaaggttttggatttcttcatgattcaatcttggtaggtagtctatatctaggaatttatccatttctactagattttccaatttattgacttatagttgctcatagtagcctgtaatgatcttttgaatttctccagtatctgttgtaatgtcacctttttcatttctaattttatccatcttctgttttttcttacatgtttgactaaaagtttctcaattttatcttttcaaaaaaatcaactatttcattgatcttttgtattttttccttaaatttccatttcatttatttctgttctgatttgtattgtttcttctcttctactacttttgggttagatttgctcttgcatttctatttaagatgcattattaggttatttgaagtttttcctcttttttgatgtaggtgcttataactataaacatccctgttagtagcactttcattgtgtcttgtaggttttagcatattgtggactattatcatttgttttaagaaatttttcaatttccttcttaatctcttttttgacccactggtcattcaaaagcatattatttaattttcatgtatttatatggtttccaaaattcctcttgttattgatttctagttttatttcattgtggccacagaagatatcatttcaacttttcaaatgttttaagacttgttttgtgacctaatatatggtctgtccttcagagtgatccatgtgatgaagaaaaaaaaatctgtgttctacagccattggataacatgttctgtacatatctgttaggcccatttggtctatagcacagattaaatatgtttttgattttttttttttttttgtctggaagatctgtctagtgctgaaagtgaggtgttgaagtctccagctactattgtattggaggctatctatctctttaatactagtaatatttgctttatatatctgggcactacagtgttgggggcatatatgtttacaactgttacatcgtctcgctgaattgacccctttattattatataatggccttctttgtctcttcttaagtttttgtcttaaaatctattttgtctgatataagtatagctacttctgctcttttttggtttccattgacatggagaatctttttccatcactttatttttagtttttgtgtgtcattataggtgaagtgtgtttcttgcagccacagataattgggtcttatttttttttttatccattcagccagtctatgttttttgattggaaagtttagaccttttacattcaatgttattattgacaagtaaggagttactcctctcattttgctatttattttctgattgttctgtggtctttgctcccttctttccttccttcctgtctcccttttagtgaaggtaatttattttctctggtggtagtatttaatttcttgctttctattttttgtgtatctgttgtatgttttttgatttgaggttaccatgaggcttgcaaatattatcttgtatttattatcattaattattttaagctaataacactgcttgcataaactaacaagcaaaaaaaaaccaataaaaattctacactttaacttcatcccccagctttttaactttctgttgtatctatttatatcttattgtacagtctatgtcttgaaaagttgtaattattatttttgatttcatcttttagtctttctacttaagggtactttccactctacagttacagtgtcataattttctgtgttttcctgtatattgactactaccagtgagttttgtcccttcggatgatttcttattgctcattaatgcccatttcttcctgattgaggtgctctctttaggggagtacttgtaagacaagtcttgtgttgatgaaatccctcagcttttgtttatctggcaaggtctttatttctccttcatgtctgaagaatattttcactggatatactattctcgggtaaaagtcttttgtcttcagcactttaaatatgtcatgccactctctcctggcctgtaaggtttccactgaaaagtctgctgccagatgtattggagctctagtgtatgttacttgtttctttttcgtgctgcttttaggattctttctttatccttgacctttgggggtttgattattatatgccttgatgtagctttctttggattaaatctgcttggtgttctgtagccttcttgtacttggatagtgacatctttctctaagtttcaaaagttctcttttattatttattcaaataaactttctatccctatctctttttctacctcaactttaaggccaataactcttagattttcccttttgaggctattttctagatcttgtaagcatgtttcattgtttttttattcttttttcttttgtctcttctgactgtgtattttcaaatagcctgtcttcaagctctctaattctttcttctgctcgatcaattctgctattaagatactctgatgcattcttcatcagctgtgtagcctggggttggtgaggcgggacaaagagggagaggtgcaagcactcttagcttccccagctggtatcttaataggtcacacgtcccaccctccaactcaatctactggctttgagcccagctcaataccaggacttgcataagaattgcagttcttgtggcctaaactgcccctcaagttcacttagggccccagtgcctccagcccacagtggcaagccttgccagaactcaagctccaattgctggaatgggcaattaccctctgccttgggccggtccaaatgccccctccatgggcaggcatcagctgagtacagctcagtttgctttctgctgtgatggggcagcactgagtctaatgcaaagcctcatgaccgctgtgctccccctctctgaagcacagagattctctccaacagggagctgctgctggggaatgggggaggagacagggatggcatcagcaatttaagactgtctttcctaccctctttggtgcctctttcagtcatgtgaaatcaaagccaggcactgagagtgctcccttgatttttggttcctatgaagattactccctttgtgtagacagttgtcaagctaggtgttcctgagaaggaatgattggcagagccttctattcggctatctcactccgcccctcccctggaatcactttttaaaatgtttgtcagttgcacgttacattgcttgaataagatttgtaggtaatattgccttagcatggctgctttcctcacagggatggagcttaaaactttcctaaagccccctctagtgacaaacagcaaattattatccattatttcatacctccaagctctaaatacctccaagctctaaagttccattttctcatttagttattagatgaatcaattgctacattatttcaattagagaatgactgagaaatagttaatagctcaaattctcaagcattcttaaatcactgaaacctaagcaattttgttttgagactgaggtcagcacagtgcacatttaactctataattttactctgccctcatacatataatttttaaggattccctaaatttccttcatttttgtctttcaggaactttaagggttaaaatatgttcgcaataactcaataaatagaaaaatgttgttttgaactttggcttcttgttgttttcactgtatttactggaacattttctaaacacacaaatataaattccaggaatcctctgaattatgaaactaagggtcatccataaagacatagattaaatatataataataacataatgcttaaaataataatatataataaaacagaataaacaataaactatatattatttgcataactataggttatggtattaaaatatatagtttatttcacttatataaaattgaaatatattgtatatttcaaatatataaaagcccatttccaaagggcttagagctcatccaataagacaggcctaattaaaccattaaaagaagaagtcatattcctaataaagggaattaacgagataaatttttaaaaggctatgaatatttatttcaactgagcacaaatcttagttttgaggttcctgtaagctaatacaaaaaaagaaacccagtaattgattagttcatgccaattcattaagggaaacaaagtatttccgtctaaaacacacatatgggtcaggcacagtggctcatgcctgtaatcccagaactttaggaggctatggcaggtggatcactttaggcctggagtttcagaccagcctggccaacatggcaaaaccctgtctctactaaaaatacaaaaattagccaggcatggtggctcacgcctgtaatccagcactttgggaggctgaggcgggtggattgcctgagctcaggagttcaagaccagcctgagcaacacagcgaaaccccgtctctactaaaatacaaaagaaattagctgggtgtggtggcatgcacctgtagtcccaattactcggcaggctgaggcaggaggattgcttgaatccgggaggcggaggttgcagtgagtcaagatcacaccaccgcactccgcctgagcgatggagcgagatttcgtctctacaaaaataaataaataaataaacaaacaaaaacacatatgcagatttctaaatgtcaataacaagattatagcattggaataatttcagaacatgaaattcaggtgtaaacatatatattcaacaaaaggtcttcagaatgcctactctccaaggccattgcagctggtgatgattttcccaatagaagggtgtttcttgggagctcaccctataataaactcataccagctgtatccatcacccatgatcatgaattatttcctgggaatagcaaccagaaagaatcttctctcttgtttacatacatagagccaaagcaaaggacaaattaaattgcacttaggataacatgttcattgctaaaatttgagagacatagaccctattatgcacacattcttgaaataattggaacaaaatattgaaagggaaataatgaaatagatggcttcagacaaagttgggtaccagacaatatggtctccagaagtttctcccattctgctgccctctccagatcacgcacccccccgttctacttgaaaacaaaatctacttgtcatcctaaagtctacttttctaagaggagctggtatcaccttccctgagtcaagtcactgtgttgcttatcccaagggtgtttgccttgggttccttgtttctaattcaatttaacaaatgcttactggaggcctattatatgcaaagtatttgctagctgccagtagtgaaataaaggccttcatgatcttagaaatggatttcaggcaataatgagtacctaggaaggagtttttgttctctgcatgatatgatttggctctgtgtccccctccaaatttcatgttgaactgtaatccccatgttgggggaggtacctagtgagaggtaattggatcatgggggtggattttccccttgtcgttctcatgatagtgagttctcatgagatatgtttgttaaaacatgtgtagcactttcctcttcgctctctctccctcctactctgccatgtgaagaagctacttgcttcccctttgcccttccaccatgatagtgtttcctgaggcctccccagccatgctttctgtacagcctatggaactgtgagtcaattaaacctcttttcttcataaattacccagtctcaggtagttctttacagtaatgtgagaatgaactaatagactgcataacatctgactccctgcccctgtatccttccaaattacttttgttgttggggccacagagccatcacacacacttcaacatgcctccaattttgaatcattgtctgcctaccctgggttttaggaaaacaggggttcaagcgttattataaccgggtttctgatttatttctccttccttgttacagagtttctgacttactccctcaagcctgaattccctgatacccagctctgctgagataggaatctcagaagagagaaagctaacatttattgaatacattcttttatttgccaggcactgttaattcttttaactataaaattagtagcatcattttttcatcccaagcaacagagaggtagactgttgatgaaaagagtcaaactctgtaaaatatttttagagatttattctgagccaaatatgagtgaccctcaggaggtcctgagaacatgtgcccaaagtggttgaggtgcagcttggttttatacattttagggaggcatgagacatcaatcaaataagaaatacattggtttggttcagaaaggtgggacaactcaatgagtatgtaaatttaaacatttcctggttgacaattggttgagtttatctgaaggcctgggatcaataaaaaggaaatgttggggttaagataaaagattgtggagaccaagtttattgtgcagaggaagctctcagtatagcagacctcagagagagagcagattgtaaaatttgtcttgtcggacctaaaagggtgcctggctcttagttggttatctcctggatttggaaaggaaagaaggaaaacaaaggggaaaagagattctctatagaatgtggttttttcccacaagagattttgcagggcaatttcaagatatggcaaggaaatatatcttggggttaaatattttgatttttttttccttgtctcataatattatgccagaatcagattggaaagtaagtcatggtatatagagtcaaataaaacccatctgataagaatttatggtttctagggcatgactccctagacaccttagataggaatttgggcaagataaaaaaattagagcttagtcctcaactctacagaagaaaatgacatttacccaggaatgggcattgcaataggaatatgcgtgccatggcaaactgtttgcatattcaaggaattaaaggaaaaaaaagtttttttaaaaaataaaaaaaggagaggattacataattgttttgaggtaattagccttggctccaagcatcaataacaagggtgatgtcagttcaaggttggacagacaattgctggacagatgtcctcatagaagtatctttttgggtaaggtggaggtctttgtgcaaggttgtggttttcgcagtattttgtgatagttttattatcaggcattcatggatgagaactctccttcatggccttctccagttccacttgtcaggttttctaacacatgtgactctatttttgattctgacaactttcacaatctacattagaaaagagaaaactggggctcagaaagttttagaaactaattcaagatcaagctggtaagtagcaaaaaatttagaattaagttctacatatctggttccaaaaccaggactcttttcattacagcagtggttctcaacagagttgcgattttgccccccagggaatatttcacaatgtctggagacatttatgactgtcaggattggaggtggagtgggtggggtctgcttctgagaagctacttgcttctagtaaacggaggacagggatgctacaaaacagttcatagggacagcacccccacaacagagaattatacaaccagcccaaaatgtcaatggacatttgggctgagaagtcttacatgacagaatgcttcctaccctgatctgacgttatttccaaggattcaaaggtaactgcttcaaaattaaacaaattatagaaagccatcaataaatcaaccccttattcatgttgcagctctcttccattataaataaaaatggattgaaacttacgataaaagggaggcagggacaggagcggggaagcttggcgagcagaaaggaaattcaaacttattattaaggttaagaattaagatgtaaatatgtagatgtttttcacccctaggattttcactaatccaaaagttcacggactgctttgaaatttaattatttggaactggttaaatgttaccctgacctcagctaacatttgtgtttcacttttctccgggacccaggggacgtggatgccagatgagtccacctcctctccctgctcttcccgcagggacagagcctgccaggtgctggtgactcggatcctgacaggaggtcgctctgcggaagactggcaggatcccagagcaacagactggggctcgatgccccttccccgccaggtctctccgtccgcaactgtcctcctagtaccgggtatcccgcaggcggggctgcggaacgcacgtcccctgcgccgtgacgtcacaatagcgactcactggacccagcccttagcaacggcctggcaacggtttccctgctgctgcagcccccgtcggctcctcttttccagtcctccactgccggggctgggcccggccgcgggaaggaccgaaggggatacagcgtgtccctgcggcggctgcaagaggactaagcatggatggcagccggagaggtaaagggcagctgtcaggggctaccgccgcctcgcccctcgctccaggcggcgctcccagcctcgggtccgggcagctgagtgcaaggccgccccttggggcgcttcctacccctggctgagtcgccagtgttgcctggagctgcccaggcctgcgcaaaggaagagggagagcctgcttgccagcctcgcaggtccgcttctttgccctgaatttgtcgccctgacaccaggggcccctgtctcctgaactcagggtcgtgcagcctttaaaacctcagtagctcccaggcagaggaaccaggtttggtctttggagtcagacctccccgggccccaaatcaaacccctctgctctccatggagacgaccctcagttttcttatctcttgaacgtgagggtcaaatacccaggccatggagttcttgaggattaaatgcagataatatagagaagatcctggcgcatttgaagtggtcagtaaatacgaaatctcccagtaacgaactacctcccccaaagctactgagtaacccagggtttctgtaactttctgtgaataggaatcccctcagggtcatgttaaaatgcagattatgattcagtaggtcccttgggggtggctgagattttgcatttataataaattccaagtaatgcggtgttgctggtcagcggactgcagttttagcagcaatccgtactcaccatatacacctgttctctactgatttcttgagtcaggtggacatcatgtggtggggttgggggtggggaaatacaatcttaaatatctacaaatcggcccaaaccaaataatttgcattttcacactttctgagccagtatcattctttcctcgagtcaaatgaggcaatctttatagactccccgcccctcccaattcagtgtttttatctatttaaaagactgcctttaaaccaagctgctagatgattccttgatgtctttctttgaatgagtctgcctttattatatagtcattgatcaaaataagtgctactccgaatgtaggagataactattcattgatcagcaaactattctgacacttcaccaacctaggtttcagaaaaagcaaatcaaaacgctttatgatcttaagaaattttgcatataaactaacattaaacccttgctatgtactaggaactatttccaaattatctcatttaatgtacaaaaataccttgataggcattagccttatttcatagtgaagaaactaaagcaaaagatcacaaataacttgccaagatcacagcggcagaacaggatttgaatctaggtgaagaatataaatctgaagccaatgcatttacttactatcccatggtagggatgggcagggggaaaggataaatgtaacatttagagtatggtagatttagtaagttgtcagtatttgtttattgaattattttaaaaattgggttcatgccaaatgtaaaaaggtttatatttttacaacttgcacaatttaattagcttcatttttaggaaataatatatgataatgtcaaatactgttattttgaatttttaaaataaatgtaatcaccaaataaccagggcagtcagctttcatgtactgtaaattaataggaaaccataaataattttagacacagctaaaataattgagaataaatttcttagatttcattaggaggtgcttttagttatttcagagcataaaatattaaaacatctaaagaaaaattatcttttgtcatgctcttactgtaatcacgttttagacattcttttgtaaggcaagccttctaaatggtggtatagtacagcaccagactgaaaaacggttagtcttgtttgtaatctttgtttcctactaactaactaggtaatcttcagcatgtcactgtacgtccctgggcctcagttatttataaaatgggggcttggactaggtatatataaggcatggtttccagcttcctatgggggaaggtgaagaaaagattgagaataacaaactgccattcactctaatatcaatgacctttaggaaggagaggagacaacctattagtatattactgaaagtaacttgaaaaaaaattttttcccagcactctgggaggctgaggcaggtggatcacttgaggtcaggagtttgagaccagcctgggcaacagaattaaaccctgtctccaccaaaaaatacaaaaattagccaggcatggtggcgtgcgcctgtagtcccagctactcgggaggctaaggcaggagaatcacttgaacctgggagggggaggttgcagtgagccaagatcatgccactgccctccagcctgggcaacagagcaagactccatctcaaaaaaaaaattgttttgatctgttggtctcatagagacacttatcaatggtagatttccaaacctttggttttccagagaaaccttgccacaagaaacactttcatctttcctcactggactttcttctggctattttaatcaaattgtgtaggaaaatgggctgctctcatataccagtgaatttcaccactaagaccttcaatctcattgacaagattttagtcctaatagttagagaatgatgttcttttccttggcatttggtttgaggctacttctccatgcccctttggctcattctgggtccagtccagtcaggagatagaaaccatacagtgatttttatacaaggaaaagttaaagaattgttatactttcataaaagagtaactataagatgtaaggggctgggcgtgtcagctcatgcctgtaatctcagcattttaggaggctgaggcaggagcatcacttgaggtcagtggtttgtaatcagcctgggtaacatagcaagaccctgtctctagtatataaaacaaattaatgaattaattaaaaagataagaaaactgtatttggtacctagaattacgggaaagtactcaaagaaggacaatttgaaagagagtttctcccaaagactggggttcagacctcattagagaaggcgtgattgtgcacttgcccaaagcttcatcaccgaggagtgatatcggaggcttcacattccatgggaaatagactttgataaattgcttagccaagtcactaaacaaacaagtgaacaacaatgaaaacaagctcaggagaggattctgtatctagagttgctgcaatatattacctaaaatgttaacttttcaacaaaaagaaattgcaagtcatgcaaaaaaacaaaaacaaaaaaacaggaaaatgtgacctatacacaggacacaaaggaggaaccagaaactatgagagggtagatgaattaaatcgtcttatttctcccctcaattctgttaggtttttttttttcctttctctttcttttttcttttttcgagacagggtcttattctgttacccagactggagtgcattgcagcctcctgggctcaatcatcctcccatctcagcctcctgtgtagctgggactacaggcacacaccaccacacccagctaattttgtatttttttgtgcagttagagtttcgccatgttgtccaggctggtctttgaacttctgggcttaggtgatcagcctgcctcagtctcccaaagtgctgggattacaagcacgagccattgtgctcagccctaattctgtcatttttaatatgacatgtatctataggaatattagaaaccaatgagtatatgccttggtgtacgtctgatggtaaatagacaagggaacatagacatcaaggaacatctaaattccatgtttgttcttatcaccatcttatgctaaagagcagctggattgattcctggggccaaatattaaccaccttgttcacagctgtcacttacagatgggtggggaagcatttctatccagagcattatcactaggttccagccttttttcattctcttttcatcctttcacacttctctgggtatacctgtttttcctttttctgtgacctatagtgaaacatacatagaatagaatggaatttggagggaataaactacatacagctgagatatcttcttggtctgtttcacatgatttagtagcttagaacatggttcaagtactgagcagtttatattggtcaagatagtgtaatgattaagacccaggaaacagactgcttgggttcagatcccaaatctgtcacattcttgtgtaatctttggcaaattacaagtttaacctctgtgcttcaattaccctcatctataaagtagggagaattatagtattgtaaggattaaatgaatttataccagcaaagtgcttggagcactgcctggcagggttaccactcaataaattagccttttgactacaaatgaagaaatcaactcatactggtttaagctaaaatgggaatttttttttttttttggctaatgtaaagaaacgtctagggaaggaagagcttcaaacatggttggcctcaggtactcaaatgatgtcaccaagaaatcgctttctatcttggttccacttgactgtgtaggcttcattctcagacaggttcctttataaggttcaggatggccaccagcaatacagggcttgcttagacccttcactgggtttagcaagcccagtgaaatgaaagtacctttcctaatagttcctgtcaaaggcccaggattgtgtatctcatgttgggacttggatcgcatagcattgctgacgctgtcaacacagctgtccacatttgggttttatgcctaaccctgacagtggggtcagctctatttgaaccacctgggctaagagtaagggaagagtcgcccaaaggaaagttgagttgtcatttccaggtgaagaggcattgaattctggacaagaaaaaagtcacagttctttctatctggagaaatgaggtttttctgagagtttgttggtattttttcttatgtttaggtcttaccctccttctttcttggtagaagctatgctcatttcatgactatcttttttcccagttcagatggcatcaccttgacttgtattgtcctaaatatttttttccttcctgcactctgacctgtgacatagaaagagcttcatagatattctgacctcagtttgtttttctgttttaatctattctgacaagctttgttctctggtcttagattttagttctcctagctcgatacttcttttttctatatttagtcatccatatatcttctagactttctatgtgtcctccttgttatagcttttaacagcccacctgatagcaaactagccatcttaccctcttaaaacatctctgtttgggggataaagcatttatattttgcatattaaattacatttaatgctgtaactcagacttcctgttttggagattactactaaaaacgcaatcaccttttaggaaagaaattattttgtgataaatttattatttaaaaaatattgaatattgttgtttttgtaaaagttgtgtttcatttatcctaatttatgatttttttttcttgttaaaagtcagagcaacctctgtccttcccagatatggtccaccgtgcctatttaaaggacacttgagcaccaaaagtaatggtaagtgaggtgcttaaaacggcagctttgttagaagattgtctgagtgtttcctttactggcaaattatatgacatgatggaaaaattgtttcatttgacgaatatttgaacttcatattattaattttaatgaaatataggcgttcttgagattagagaattttggagtctatgatttcaaactattattgtgccctggatgtggacttggctgtctcctgctcccagctgctacagcagcccagctctacttttgccaggaaactaccctgatttaaggcatacctgccttgttaaaatggtgagtagcaggtattaaagacgcaagcactgaaaaggaaaagctgtgcagagaaaaagagcacttgaataatacatttcctattaggagcaaaggcctatgggcctctttatccaactggatttctaggtgctgtgatatttttatattttaaagctttcaaggtacatttttaaggtaggttttaaaataaatttttgtaattataccttagaagtataagtctatgtccttaggcaaaataattaaagccttattttccttatttacaggaaaaatctttgatactgttacctccaaatgtggtggaaggatctcattttcagttgcctcacttatttctttgtattacagtgtattttttaaagtttatgattgtggctatgtatgtatgtaacatatatatgtatgtaacatagccataatgataaactttaaaaactaaattttaaataaaaagttaaaactagatttaaaatatacatacatagaaatcaggataaagaacaatatgtaaagtttgctaactttcttttaaagaatatatatatagagctggtataggtatggtggttttaagtatgaggctgccttggatcacatggaagctgcatcctttatcagcagtgtaaccttgaagatgtaactcatatctctgtgcctcagttttcacttcgattaaatgataataataatgactagataagtttatacatataaagagtttagaacaatgcatggtaaatggcatttattcagtaaatatttttagtagtggcatcaagctcgtaattattgcataggcttgtattatgcacagagtctctggaaggatgcatttaaacagtaacatagtatatttctgggaagggagactaaaggtcagggtagagaaatcacttctttttcaaactccatatgccattttagctgttgaatttttttaaccacattgcgtgtattacttctcaaaaactgtttttaatgtttaaaaaagctttgcctatatttatattttatacttgtgtgtaagtgcttaactatttctaagatttcttttaaacagtttgaatgaggaccaaggagtttaatgtcatggaatttctttgcgattacacttgttataagatagttttagtacttcaaaaagaatgtagtaaactggtatgtagatcttgttttcaggtttaagttagaaatttgcttcttggaatataatttttgtatgtagggttttgggatttggtagtcattgaatttctgaaattccgttgattaagtattaacaatggtaactaattaagcaagcagctaaacatccttagttagaagattgagagctgtcaaaaaaaaaatagttctgtaaatgtaatgacagatcatatcctagaatctcttccccagagtctcaggcttgtaaaattttattctcaggaaggtttgaacccaaatggtcaatagctcattggcattatcagtgcaagattaaagcttcacatcacaatgtcatatatcaatatctctggttgaatttcagaacattttataagaatgagttaaataatcagtgccttgtttatctcatgatttttatattagttttaaatatataatgattatgttttaatttttagctttttgcactgactcctcttctctcagactaagcactctccagctggtcaagaatcacatggctgttcactataataaaatcctttcagccaaaggtaaaaatgtgcaaatgtgaactctctgtactcaatttaaacctccagcttcacttctcattaaaatatatctatagcaaaaatgaataccttatatatatgagaggatttgtatttgtttggtttagtgtgatacaaactattgactctaggtacttagcaaattcatacccatttttgttaactatatttgaaatctatatattgcctattttatttcgttttttatctctattgctaataatattttgttagatattgcttttaatatgaaaatatataatctgcttttttgtttacacatctatggaagttgcacaaagaagatgctatttttctgtttaatttttttcttttgtcagctttattgagataaaacttacattataaaatgcattgattataatgtgtacagataaatattttgaaaaatgaacacatttgtataaatactactacaaccatgctgtaaaacaggaatcagctaactacaccgttcaggccaaaccctcctaccacctgtttctgtacagcccatgaactaagaatggtgttcatatttttaaatggtagcaaaaaatttaaaaaaaagtattttgtgacctgaaattcaaatgtagttatccatagacaaacaatcattttcaatcttttacatattgtctgtggcagcttttacactaaaaagcagagttgaccagttgtaacagactgtatcaccctgcaaatcctgaagcatttgctacctggccctttgtagaaaaaatttgccaacccttgatatagaaaaagtccattacctcaaagagttccccctagtcctttgccgtcagtcccctcctgacaaatccctggcaaccactgatctgctctttcgcctatagttttaccttttctataagttcatagaaatggaatcatgtatcgttttgggtctggcttttttcagttatcttaatgatcttgagactaattcacactgttctgtgtaccaccatttattcttttgtattgttaaggagtatttcatttaatgaatagaccacaatttgtttatgattcaccagttgttaaacatttggattgttttgactcacttttggccattaggaataaagctgctataaacattcacatataattttggcgcatgtgtttacgtttcactcgggtaaatttatgtgtcaggagtagaactgtgaggtaatatattaagtataagtttaattttataagaaactacagttttccagagtgaatataccatttacatttccattacttctgcacccttaccaacccttggcgttgacagtccttttttaaccattctagtgaatatgaaatagtatcacttcatagttttagtttgcatttccctgatttctagtgatgttgccttattacttcccatctgtatatcttctttggtgaaatgactgttcaaatcttttacccattattaaaaatgggttgtttgtctctttagtattaagttgtgagtttctttatatacagattctatatcagatatatgttttgcagatatttttttcccaatctgtagctggtgttttcattttcttgttaaaattcgtattctggagaaatttttagacttacataaacatttaaaaattgtatagggagttaccatataccctgtactctgctcttccactaatgttaaaaatcttaaaaaccgtggtatagttatcaaaaccaggaaatcaatattgatgcaatcccattaactacagaccttatttgaatttcaccaatttttgactaatgtcttttaaatttttattttctcatttaaatagctaaagtttttaaattttagtttatattttatgatgcttatatttttaaatgactaaaaaaacaaaagaaaaatattttgtgacatgaaaatcgtgaagtcgtttagttttttagttttataaactaaacaggttatttcataacctgttcaagaaatatttgcctaaccttaggtcactcagaatttcttaatatgttttcttctagaagttttaaagttttagcccttacatttaaatttgcgatccattttgagttagtttttgtatatggtgtgatataagggttttgaggttttttgtttgttttgtttttttgcctcttcatatccaaatttcccagtaccatttgttgaagaggttatcttttctctatttaattgtcctagtactttttgaaagtcagttgaccatatgtgtgggtctgtttctggacttaactccttggttctgttgatctatatgtctatctttaagccccatgccacactgccttaattattgtagcattacagtaagtcttgaaatcaggtagtgtaagtcttccattttgcttttttttccccaagcttgttttgggactacattataagtatgttaagtctgtttcattttgagtagtttatattgctatgtcttcaagttcactagtattttcttctgcagtattgaatgagttattaatcccaacagtgtatttttaatcaaggatcttgtgttttccatcgctagaagtatgataaacagctgcaaggtctggaacattttgtgatttccacatttggtatttgtcatttataaatactgacaatattattaaactattacctttctctttcagctgcagtagactgctcggttccagtaagcgtgagtaccagcataaagtgtaagtaatttttggacattattacctttttaaaaaaaaattaaggtaaatatacataacataaaatttactgtcttaaccatttttaagtgtccagttcaatattaagtacattaatattgtggtacaatgataactactacctccagaactctctttatactgcaaaactgaaattcctgtgccacataaacaataatttcctcccataggccctggaaaccaacattcttttctatcactatgaatttgactactgtcaccattgtacttactatctctatgaatctattttaggtaccttatataagtggaatcatatcgtgtttgttctgttgtgactggcttatttcacctagcatgatgttctcaaggttcacccatattgtaatgagtcagaatctcctttttaaaggctgaataaaattccattctgtgtatataccacattttacttatgcattcgtcagttgatggacacttgagttacagtcaccttttggctgttgtgaataaactatactgctatggacatgagtatacaaatacctcttcaagaccctccttttaaagattttgggtgtatatttagaagtggaattgctaaatcatatattctatttttaattttttgagaaactaccatactattttcttttcttttcttttttctttttttttttttgagacagggtctcactctattgccctggggctaaagtgcagtggaacgatctcacctcactgtaacctccacctcctgggctcaagcaatcctcccacctcagcctcccaacagcctcccaagtaggtgggactacaggcgcaagccaccacgcacagctaattttgccacagcctttttacatagagacagggttttaccatgttgcccaggcttgtctcaaactcctgagctcaagtgatccacctgactcagtcccccaaagtgctgggattataggcgtgagccactgcacccagtgaccatattgctttctatagcagctgcaccattttccattatgactaatgatgctcaagtattcagatttccccatgtcctccccaacacttgctttttcctatttgtttaatagtagccatactaaaaggtgttgacacattgccttttgagaaagcatttctaacttaaaaattatccaaaaatacccaggcacagtggctcacacctatgggagacagaggcaagtggatcacttgagcccaggcatttaagagtagcctaggcaacatggtgaaaccctgtctcttcaaaaaatacaaaaattagctggatgtggtggcatgcaactctggtcccagctactcaggaggctaaggtgggaagattacttgagccagggaggtcaaggctgcagtaagccatgatcatgccactgcactctggcctaggtgacagggagatgctgtctcaagaaaaaaaaaaaaaaaggaaaaagaaaacccataatgttgacacaggatatatagaatccttatatatctaccctttgaccaggttatcttcatttttaaatcatcagaccaaaaatttgaaaaccctgtttaaaaatttctgaagaataccatttgaaacctttgtttttgatttcaattaagaaatgtatactttatgggaggccgaggcaggcggatcacgaggtcaggagatcgagaccaacctggctaacagggtgaaaccccgtctctactaaaaaacaaaaaattagctgggtgtggtggtgggcacctgtagtcccagctactctggaggctgaggcaggagaatggcgtgaacccgggaggtggagcttgcagtgagcagagatcgcatcactgcactccagcctgggcgagagagcaagacaccgtctcaaaaaaaaaaaagaaatgtatcctttaaaaataggcaaaaaacatggctgtcacagcctttgattgtcgtattaatcatataaaaatcagtgttatacgtatgtttattgcagcactattcacaatagcaaagacttggaaccaacccaaatgtccaacaatgatagactggattaagaaaatgtggcacatatacaccatggaatactatgcagccataaaaaatgatgagttcatgtcctttgtagggacagggatgaaattggaaatcatcattctcagtaaactatcacaagaccaaaaaactaaacaccgcatattctcactcataggtgagaattgaacaatgagatcacatggacacaggaaggggaacatcacactctggggactgttgtggggtggggggaggggggagggatagcattgggagatatacctaatgctagatgacgagttagtgggtgcagcgcaccagcgtggcacatgtatacatatgtaactaacctgcacaatgtgcacatgtaccctaaaacttaaagtataataataaaattttaaaaaaagataaaaaaaaatcagtgttataaattttaagtttagtgttttctaagtttctaagttttctaagttaatatttgaatttatgtagagtttgagaacatttctacattaaaaaagtaaatatcagccaggtgcagtggctcatgcctgtaatcccagcactttgggaggctgaggcgggcggatcacgaggtcaggagatcgagactatcctggctaacacggtgaaaccctgtctctactaaaagtacaaaaaattagctgggcatggtggcaggcgcctgtagtcccagctgctcgggaggctgaggcaggagaatggcgtgaacccaggaggcggagcttgcagtgagccgagatgatgccactgcactccagcctgggcaacagtgcaagactccgtctcaaaaaaaaaaaaaaagaaaaaaaagtaaatatcaacctaaggttaattcatgctaaatgataaatgaataaaagcatacatagggaaatgccttttgggtgcaatctaggaaagatcacaaacagtaggaatggttaactcatctctgcttgtatatcttagttgaagagatagaaggtaggggagaaagtaactaccagctataggtcatagctacaaacacagtgtctgtctcaggccttgtgcttgacactttgtattctcccttttctattctttttatgtttgcaacaaaccttcgtgtaggctgtcatatttttgaaggaaaattagattcaaataattttaaaggaggaaaaaaggcatgttaggcaagagtagagacttcttagtacatatttttaaagaccagtttggtcgctacatacaagttatatgggcaagtcattttacctctgaccttccttttttgtgaaatgaaaggtaattagatgatttctaaggacccttccagatttttaatttctgtgctttacatttttttcttctgtatcatattagtaacttttttgtagcacaaaactggttcagtgtttacatgctttaaatatctggatcatttgaattaagttggttgggattacaggcgtgagccaccgcgcctggccttaaaatgatctctagagacaatgacagccattatataatttttaaagggtcaacttaacaggaagatgtaacaattatctacatacccaacatcagaactcctaaatatatcatgcaattgtggacaaatctgagggagaaattgactttaatacaataatagaagacttcaataatccactttcaatagtggatacatattataagacccagacagaaatcatttaaaccgctgacttgaacaacataatagaccaaaggaatttaacagatatatacagacctttataccctattgaagaatacgcactcctcaagtgcacatgaaaccttcttcagaatagatctcatattaggccataaaatcagacgtaacatatttaagaagataaaaatcatttcaagtatctttttcaaccagaatggaataaaactaataattaatagctgtaagaaaatgggaaattcacaaatacatggcaactaaacaacacattcttgaacaagtattgagtcaaagaagaaataaaaacagaattttgatatcttgaggcaaaggaaaacaaaaccacaatataccaaaacttacagaatgcagcaaaattagtactaagagagtggtttatagtgatgaatacttacattaaaagaggggatctcaaacaactcaactgtatacctcaaggaactagaaaaagaagaataaactaagcccacctcggtaaatccctagaaacatacaaccttcaaaaactgaatcaagaagaaatatcctgaatagactaatagaaaaaaggagattgaatcagtaatcaaaaacttcccaacagaggccacatgtggtggctcatgcctgtaatcccagcactttgggaggccaagacaggcagatcacttgaggtcaggagttcaagaccctctggccaacatggtgaaaccccgactctactaaaaaatacaaaaaattagccagatgtggtgttgcacacctgtaatcccagctactcaggaggctgaggcaggagaatcacttgaatccaggaggtggaggttgcagtgagctgagatcatgcccctgcactccagcctgggtgacagaatgggataaaatctcaaaaaaataaaattaaaaattaaaaaaaacttcccaacaaagaatagcccaggaccagatatcttcataggtaaatctaccaaatattcaaagaaaggatagcaccagtccttcttaaacttttataaaaatagaagtgggaatacctccaaactcattttatgaggctagcaccaccctgatgccaaaaccaaacaaagacaacacaagaaaagaaagctacaggccaatatatctgattgatataagtgcagaaatcttcagtaaaataccagcaaactgaattcaattgcatgttaaaagagtcaaacaccatgaccaagtcagatttatccctgggatacaaaggtggttcaacatatgcaaatcaaccaatgtgatataccacagtaacatagtgaaagattaaaaaccacacaatcatctcaatacatgcagaaaaaccatttgacaaaattcagcatccattcatgataaactctctcaacaaaataggaatagaaggaacttacttcaacagcatgaaagctatatatgaaaatctcacaggtaacatgatgcttaatgaagaaaaacaaagcttttcctctaagatctggtataaggcaaggattcctcacttttgccacttctgtttaacatagtattggaagtcctagccagagcaattagacaagaaaaagaaataaaaggcatacgaattagaaagaaagcagtagagctgggtgtggtggttcactcctgtaattgcaatactttgggggaccaaggtggagagatcacttgaggccaggagtggccagcctgggcaacatagtaagaccatgcctctacaaaataaaaaaactaaaaattaaccaggcatggtgacacatacctgtagtcctagctacattggaggctgaggcagtaggatcacttgagcccaggaattcaaggtcacagtgggctttgaccgtgccactgaattccagcttgggcagcagagaaagaccctgtctcaaaaaaaaaaaaaaaaaaaaaaaaaagtaaggttacttctgtttgtgatgacatgatatatatgtagaataccctaatgcccaataaaaaagaactgttgcaataaattcaatatagttttaggatacaaaattaatgtacaaaaaccagtggcatttctgtacacaaacaactgtctgaaaaggaaattaagaaaacaatgccatttgcaacagcaacagaaaggataaaatgcttaggaataaccttaaacaaaaaggttgaaaacttgtacactgaaaactataaaacatcaataaaggaaattttagaagacacagataaatggaagacatccatatttatgaattggaataattaatattgttataatttttgtactacccaaagtagtctataaattcactgcaatccctatagaaatcccaaagacattctttacagaaatagaacaaacaatcgtaaaattcatgtgggaccacaaaagaccacaaataaaacaatcttgagcaagaaaaacaaggctggagaaatcacactttctaaatttcaaaatatatttcaaagctacaataatcaaaacagtatggaactggcaaaaaaaaacacataccagaccaatggaaaagaatggagaacccagaaataaatccatgtgtttatagtcaacttatcttcaaaagggtaccaaacacacacagtggggaaaggatagtgtcatcaatgaatgactctgggaaacctggatagtcccatgcagaaggatgaaaatggactcttaaaccatagacaaaaatcaactcatacaaaaatcagctcaaaatggatttaaaaacttaaatataaggtcctaatccataaaactactagaagagaacatagaaaaaaagcttcttggctttagtctgggcaataatatttttggatatgactctgaaagccaggcaacaaaagcaaaaatagacaagtggaattcaccaaactcaaaagcttttgtacagcaaaggaaacaatcgacagagtgcataggcaacttacagaatgggaggaaatatttgcaaaccatgtatctgataagaggttaatatcccaactgtgtaagtaataagtacaactcaatagcaaaaaaaaaaaaaaaaaaaaaaaacccaaaaccttgctataaaaatgcatgaaggacctgagtagacattctcaaaggaagacatacaagtggccaataagtgtatgaaaaggtgcttaacattactaattatcagggaaatgcaaatcaaaaccttaatgagatatcactcacacctgtgagaatggctatcaaaaagacaacatgtaacaagtgttggcaaggatgtggaggaaagggaacacttgtgcactgttgctaggaatgtaagttggtacagccattaggcaaatcaatatagaggctcctcgagaaattgaaaatagaactaccatacgattaagcaatcccacttctgaatatatatccaaaggaaatgaaatcagtatgtcaaggagatatctgttctcccatgtttgttacagcattatagcaaatagtcaagatatagaaacaacctaaatgttgacagatgaatggataaagaaaatgtggtatgtgtataaagaaatactacacacacatacacacaacccacaccacatttataacatacacagacacatgcaaaacccacaccacatagcctttaaaaagaaggaaatcctgtcatttctgtcatttgtgacaacacagatgaacctgagggttcattttagcttccacatataagtgagatcacgtggtacttgcctgtgtctggattattaaacatgtgtatgtgcaatctaaagtgggcaacctcagagaggcagagagtagaatggaagttgccaggggctacaggaaggaggaaatggggagatgttggtcaaagagtacaaagttttagttaatgcaagttgagtaagttctggagatctaatgtacagcattaattagagttaacagtactgtataatatacttgaaatttgctaagacagtacatctgtgttctcaccacaaaaaaaagaaaaagtagcaactatgttaggtgatagatgtattaattatcttgattatgatcattcacaatgtatatcagaatatcaaattaaatgcctgaaacatatacagtttgtctgctataccttaacaaagctgaaaaaattattacctaagcaacctgatatatatataaacttaaatagaatggccatctggtcatgactggaaagaatatattaaccagatatatttggttaatgtattgactggaccaaaagaaaaggcatatcttgttataagatagaaagactctatataatgcaaatatattgatacatactttttaaagtattgatactttttaaagtaatttctaaattcaatgtgagctcaattaagatgccaaaaatcagtattgttcatacactacttgacaaaatgttccaaaattaacctacatatatatgagaaaatagccagaaataatctgaacatgaatagaaaagagtagtagagtagccctactaagtatttaaaagtattttaggtcaggcgttgtggctcacgcctgtaatcccagcactttgggaggccaagacgggaggatcacttgaggtcatgagttcgagaccagcctggccaacataatgaaacccgttctctactaaaaatacagaaattagccaggtgtggtggcatgcacctgtagttccagctactcgggaggctgagacatgagaatcacttgaacccgggagggggaggttgcagtgagccaagatcatgccattgcactccagcctgggcaacaagagtgaaactctgtctcaaaaaaaataaagtcaaaatcacaaatttaaaatggtcatttaatttattttgctagagtaacaaaataacatttaatttagtttgctagagtttattcattgatttattcagcatatatttattgggcccctgctatgtgctagacattgttctaagggctgggactaaagaggtgaacaggacaaatttcctgcttttgtagagtttacattgtagttggagaagacaaacaataagcaaatacaaataaataaagaatatgtcatatggtaataaatgcaatggaaaaaaaatgactgagagtcccttggaggagaagcccttgctgataaggtgacaattgagcagagacctgaaagaattaaggaagaggcatgtggctatctggggaaaaagcaatccagacagaggaaacagcaagtttaaaagccttgaaatggtgtcatgattggtgttttcaaaaaacagcaaggagggctgtgtagctagtatggaataagccaactgaagagtaatagatgaagtcactgagatgggacagagggatgcagagaataaaaggcagtggccattgcaaagactttggccttcactctgaatgaaattgcaagccattggagggtcttgaagagaggagtagcagggctacttttacttttaaaagcatccctttggcttcatagttgggaatagtctgaagcagaatgactagttagaagacagtaaataatccagatgagaaataatggtgactgggaccagagtggttgcagtggagagagattgaaataatcagattctggaaacatttcaaatgtgtgtccatagtatttactgatgggttggatgtagatgtagtgtgagagagaaaagaggattgggtcaaaaatgacttccaagacttagaacctctcagccaaaaggatggagttatgatttactgaagtgagcaataccataggaaaagattgagaggagaaagcaaagcagtagttcagtgttggtcattacatttgaaataaatgcctattacatagccagttggcaacccttaggaggcagttggagtgcaagtctggaattcaagagacaatttcaggatagagctaaaaatgtgggatttgacagcatatagggggtatttaaagaattgcttgcactttttgtttttaaaatgtagatttagctagtgcttatttatccatggtattttctgcttttagtcaattaaggcaggaatttttcctttttgctacataaaccaaattgtgatggcttagagtaattgcaaatattataatcaccaagttaagtgtaattaataatcattcttcattatatatgatttttcattataatgaatttggcttagaaacaggctttctagacacataaaaagagaagtctctggatttgagccatctctgtttttataagctactctgtacttttctgtcatagcagactactgacttgatcagttcctaacctggaatatagtttattgaattatttaaataatttaatttttatagaagttttattgaaaaataatttacatactataagattcactgattttttactaaatttacagaattgtgcaaccacaaaccaattttagaacattttcatcattttatgaagatcccttgtacccatttgcagccacgctgcaaattcctacccctagccccaggcaaccactaatctactttttttttttttttagcattctattttttgttattgggaaaagaagaaattctattaaataaatatatttacaaatcaaaatgatctttaatcaatttgtaactagtttccacaattgcatttgtatacagtttctttagagaagaaaaatattgactaaaaaatgtccaggtgttctttttttattattattattatacgttaagttctgggatacatgtgcagaacatgcaggtttgttacataggtatacatgtgccatggtggtttgctgcacccatcaacctgtcatctacattaggtatttctcctaatactatcccttccccagtcccccaacaggccccagtgtgtgatgttcccctcctggtgtccatgtgttcttattgttcagctcccacttatgagtgagaacatgcagtgtttggttttctgttcctgtgttagtttgctgagaatgatagtttccagcttcatccatgttcctgcaaaggacatgaactcattcttttttatggctgcatagtattctatggtgtatatgtgccacattttctttatccagaaagaaatatacccattgatgggcatttgtgttggttccaagtctttggtattgtgaacagtgctgcaataaacatatgtgtgcatgtgtctttatagtagaatgagttataatcctttgggtatatacccagtaatgggattcctgggtcaaatggtatctctggtcctagatccttgaggaattgccacacggtcttccacaatggttgaactaatttacagtcccactaacagtgtaaaagcgttcatatttctccacatcatgtctagcatctgttgtttcctgactttttaatgatcgctattctaactggcatgagatggtatctcattgtggttttgatttgcatttctctaatgaccagtgatgattagctttttttcatgtttgttggccacatcagtgtcttcttttgaaaagtgtctgttcatatccttcgcccactttttgatagggttggttttttcttgtaaatttaagttccttgtggattctggatattagccctttgtcagatggatagattgcaaaatttttctcccattttgtgggttgtttgtccactctgatgacggtttcttttgctgtgcagaagctctttagtttaattagatcccatttgtcaattttggcttttgttgccattgcttttggtgttttagtcatgaagtctgtgcacatgcctatgtcctgaatggtattgcctaggttttcttctagggtttttatggttttaggtcttacatttaagtctttaatccatcttgagttaatttttgtataaggtgtaaggaaggggtccagtttcagttttctgcatatggctagccagttttcccaacactgtttgttaaatagggactcctttccccattgcttatttttctcagatttgtcaaagatcagatggttgtagatgtgtggcgttacttctgagacctctgttctattccattggtctatatatgtgttttggtaccagtatcatgctgttttggttactgtagccttgcagtatagtttgaagtcaggtagtgtgatgcctccagctttgttcttttggcttaggattgtcttggatatacgggccctttttttggttccatatgaaatttaaaatagtttttttctaattctgtgaagaaagtcaatggtagtttgatggggatagcactgagtctataaattactttggacagtgtggccattttcacaatattgattcttcctatccatgagcatgtaatggttttccatttgtttgtgtcctctcttatttccttgagcagtggtttgtagttctctttgaagaggtccttcacatcccttttaagttctattcttaggtattttattctctttgtagcaattgtgaatgggagttcactcatgatttggctgtctgtctgttgttggtgtatagaaatgcttgtgattttttgcacattgattttgtatcctgagactttgctgaagttacttatcagcttaaggagattttgggctgagatgatgggggtttctgaatatacaatcatgtcatctgcaaacagagacaatttgactttctctcttcctatgtgaataccctgcatttctttctcttgcctgattgccctggcctaaacttccgttactgtgttgaataggagtgatgagagagggcatccttgtcttgggccggttttcaaagggaatgcttccagcttttgtccattcagtatgatattggctgtgggtttgtcataaatagctcttattattttgagatacattctatcaacacctagtttattgagggtttttagcatgaagcgctgttgaattttgtcaaaggccttttctgcatctgttgaggtaatcctgtggtttttgtcattggttctgtttatgtgatgaattatgtttattgatttgcatatgttgaagcagccttgcatcccagggatgaagccaacttgatcgtggtggataagctttttgatgtgctgctggattcgatttgctggtattttattgaggattttcacatcaatgttagtcaggaatattggcctgaaatttttttttcttgtgtctctgccagggtttggtatcaggatgatgcaaaatgagttagagaggagtccctctttgtctgttgtttggaatagcttcaaaaggaatggtaccagctcctctttgtacctatagaggaattagactgtgaatccatctggttttgggcttttttgggttggtaggctattaattactgcctcaatttcagaacttgttatgggtctattcagggattcgacttcttgtttagtctcaggaggatgtatgtgtccaggaatttatccatttcttctagattttctaatttatttgcatagaggtgtttatagtattctctggtggtagtttgtatttctgtgggatcagtggtgatatcccctttgtcgttttttattgtgcctttttgattctctattttcttctttattagtctggctagtggtctatctattttgttcatcttttcaaaaaaacagctcctggatttattgattttttgaagggtttttcacatctgtatctccttcatttctgctctgatcttagttatttcttgtcttctgctagcttttgagttagtttgctctcgctcctctagttctttaaattgtgatgttagggtgtcgattttagatctttcccactttctcctgtgggcatttagtgctgtaaatatccctctaaacactgctttagctgtgtcccagagattctggtacattgtgtctttgttctcattggtttcaaagaacttatttatttctaccttaattttgttatttacccagtagttattcaggagcaggttgttcagtttccatgtagttgtgtggctttgagtgagtttcttaatcctgagttctaatttgattgcactgtggtctgagagactgtttgttatgatttccgttcttttgcaattgctgaggagtgttttacttccaattatgtggtcaattttggaataaatgtgatatgctgctgagaagaatgtatattctgttgatttgggatggagagttctgtagatgtctagtaggtctgcttggtccagaactgagttcaagtcctgaatatccttgttaattttctgtcttgttgatctctttaatattgacagtggggtgataaagtctcccactgttattgtgtggcagtctaagtctctttgtaggtctcaagaacttggtttatgaacctgggtgctcctgtattgggtgcatatgtatttaggatagttagctcttcttgttgcattgatccctttaccattatgtaatgcccttctttgtcttttttttatctttgttggtttaaagtctgtttttttcagagactaggattgcaacccctgcgttttttgttcccttgctggtgaggagttgtgatcctttggaggagaagaggcgttctggtttttggaattttcaacctttttgcactgttttttcctcatcttcgtggatttatctacttttggtctttgctgttggtgatctttggatggggtctctgtgtggatgtcctttttgttgatgttgatgctattcctttctgtttgttagttttccttctaacagtcaggcttctctgctgcaggtctgccgtagtttgctggaggtccactccagaccctgtttgcctaggtatcaccagcggaggctgcagaacagcaaagattgctgcctgtttttccttcaggaagcttcgtcccagaggggcacccgccatatgccagccggagctctcctgtatgaggtgtctgtcaacccctgctgggaggcatgggggtcagggacccacctgaggaggcagtctgtcccttagcagagctcaagcactggctgggagatccgctgctctcttcagagctggcaggcaggaacatttaagtctgctgaagctgtgcccacagccaccccttctcccaggtgctctgtcccagggagttttatctataagcccctgagggaggctgctgcctttctttcagagatgccctgcccagagaggaggaatctagagaggcagtctggctacagtggccttgtggcgctgtggtgggctccgcccagtctgaacttcctggcggctttgtttacactgtgagggaaaaaccacctactcaagcctcaataaggtggatgcccctccccccaccaagctctagagtcccaggtcaacttcagactgctgtgctggcagggagaatttcacgccagtggatcttagctagctgggttctatggggtggaatatgctgagctagaccattcgcctccctggcttcagacccctttccaggggagtgaatggttctgcctcactggcattccagttgccactggggtatggaaaaaaactcctatagctagctcagtgtctgcccaaacagccacccagttttgtgcttgaaacccagggccttggtggtgtaggcacctgagggaatctcctggtccgtgggttgcaaagaccatgggtaaagcatagtatctgggccagagtgcacaccgttcctcacaggatagtccctcatggcttcccttggctaggggaaggagttcccctaccccttgcgcttcctgggtgaggcaacaccacaccctgcttcagctcaccctccgtgggctgcacatatacagtatttcatcctgtatatgtaccacattttctttatccaattcaccattaatggacacccaggttggttccatatctttgctattgtggatagtgctgtgttggatatgagggcatgtgtctttttggtagaatgattttttggggggggtttatacatggtaatgggattgctgggttgaatggtaggtctatttttagttatttgagaagtcttcaaactttcctcagtggctcagtcttcagctttcctcagtggctgaactcacattcccaagaacagtgtgtaattcctttttccccgcaaccttgccacatctactattttttgacttcttagtaatagccattctggctggtatgaaatagtatctcattgtgattttatttgcatttctctgatgattagtgatgttgagtacttttttatttgttggctgcttttatgtcttcttttgataagtgtctatgtccttttctcactttttaatggggttatttgtttttcttcttgcttttttttttttttttaagttcctcatagattcttgtattagggttctctagagggacagaactaatgaaatatatatataaaggggagtttattaagtattaactcacatgatcacaaggtcccacaataggccgtctgcaggctgaggagcaaggagagccagtctgagttccacaactgaagaatttggagtccgatgtttgagggcaggaagcatccagcacaggaggaagatgtaggctgtgagagtaggccagcctcaacccttcacgtttttctgcctgctttatgttcgctcgcagctgattagatggtgcccacccagattaagggtgggtctgccttccccaacccactgactcaaatgttaatcttctttgtcagcaccctcacagatatacccagtaccaatactttgcatccttcaatccaatcaagttgacattcagtattagccatcacaattcttgatattagttttttgtcagatgcatagtttacaaatatattctcccattctgttggttgtctgtttactctgttgatagtttcttttgcattgcacaagctttttaatttaattaggtctcacttgtcaatttttgtttttgttgcaattgcttttgaggacttggtcacaaattctttgccaaggccaatgtccagcagagtatatcctaggttttcttatagaatttttatagttttaggtcttacatttaaatctttaatccatcttgtagccttgtagtgtagtttgaagtcgggtaatgtgatgcctccagttttgttctttttgcttaggactgctcttttttggttccatataaattttagaatagtattttcaatttctgtgaaaaatgatgtgagtagtttgataggaatagtgctaaatctctagattgctttgggcagtatggacattttaatgatattgactcttccaatccacgaacatggaatgtttttccgtttgtgtgtgtcagctctgatttctttcagcagtattttgtaattcttttagatatccttcacctccttagatattttcctaggtattttattttgtgtgtgtgtaactattgtaaatgagattgtgttcttgatttggctctcagcttgaatatcattggtgtatagaaatgctactgatttttgcacattgattttgtgtcctaaaactttactggaatcgtttattagttcaagaagccttttggcagcatctttagggttttctaattatagaatcatatcatcaggaaagagataatttgactactacttttccaatttggatgtgttttatttctttctcttacctaattactctggctaggactccagtagtatgttgaataagagtggtgatagtgggcatccttatgctgttccagttcaaaagaggaatgcttccagcttttgctcattcagtatgatgttggctgtggacttgtaatagatggctcttattattttgaggtatgttcttttgatgcctaatttgttgagggtttttttttttaatcatgaaggattgctagattttattgaaggtttttgctacatctgttgagatgatcataaggtttttgtttttaattctgtttatatggtgaatcgcatttattgatttgcatatgttgaaccagcctttcattccaggaatgaagcctacttgactgtggtttattaactttttgatgtgctgttggattcagtttgctactatttgttgagcatttttgtgtctatgttaatcagggatattggcctatagctttcgtttttggtgtgtctttaccagattttggtgttagaattatgctggtttcatagattgggtttcatagaatgagttagggaagagtccttcctcaagtttttggaatagtttcagtaggattaataccaactattggtatgtctggtagaatttggctgtgaatctctctggtccagggctttttatggttggtaggttttttttattactggttcgattttggaactcagtatttctcttcagggtttcaatttcttctgaattcaatattgggaaattgtatgtttccagaaatttatctatttcctctagatttcctagtttctatgcataaaagtcttcttaatagtctctaaggatcttttctatttctgtggggtctgttgtaatgttgcctttgtcatatctggttgtacttatttggatcttctcttttatctttgttaatcttgctaacagtctgttgatctgtttatcctttcaaaaaaccaactttttgtttcattgaacatttatatggattttggaatctcaatttcaattatttctgcttttagataattattttctactactagctttgggattagttcttgttattctacttcctctagttgcaatgttagattaatttgagatctttctgtcttcttgatgtaggtatttagcactgtaaacttgcctcttaacactgcttttgctgcatcccagaaattttggtatgttgtgtttctgtttttatttatttcaaagagtttttttgtttttttttaatttcaccttctgttgtttacccaaaagtcattcaggagcaagttggtttaatttccatgtaaaattatgtggttttgaggagtactcttggtattgatttctacctttttttccaccgtggtccaaaaatatgtttggcgtggtttcaatttttttacatttattgaaacttgctttgtcttcgagcatgtggttgatcttagagtatgttccacatgcagatgagaagaatgtttattctgtggttgttgggtggagtattcttctgtagatgtctattaggtccagttggtcaggtgtcaaatttaaatccagaatttctttgttagttttctgctttgagggtctatctaacactgccagtgggatgttgaagtcccccattattaatgtgtggctgtctaaatcttttcataggtctagaagtacttgtatgaatctgggtgctccagtgttgggtgcaaatatacctaggataggtaagtcttgtggaattgaatccttcgtcattatgtaatgcccatctttgtccttattgctgttggtttaaagtctgttttatctgatacaagaatagcaacccctgctcttctatttactgtttgcatgataggtctttcttcatcactttacttcaggcctataggtgtcattacatgtgtgatgggcctcttgaagatagtagaaggttgggtcttgttttttgtttttttttaaataaaatattattttattttttaaataaaaaaattaaaaagtggttcttgccactctgtgccttttaactgggtacatttagaccacttacattcaaggttaatattgatatgtgaggtttgatcctgtcatggtggtgtttgctgtttgctttgtagtcttgattgcgtatttgctttataggatctgtgaacctctgtatttatgtgttcttttatggtagtgagtatcattcttatgtatgcatgtttagaacttccttgagcatttcctataggctaggtgatgtagtttgggtatttgtccccacccaaatgtcacattgaaatgtaacccctagtgttggagttggcgcctgatgggaggtgattggatcatgtctgtgaatttctcatgaatggcttagcgccacccccttgatgctgtccttgtgatagtgagtgggttcttgcaagatctggttgtttaaaagtgtatgcccccacagccttcccctctcgttcttgccatatgaaatgcacattccctcttcgccttccaccacgagcaaaagcttcctgtggtctcccctgaagcagatgctggcattgtgcttcctgtacagcctgcagaatcatgagccaattaaacttcttaccttataaattacccagtcttgggtatttctaatagcaatgcaagaacagtctaacacactaggtctagatataacaaattcctttagcgtttgcttgtcaggaaagactttatttcttctttgtttgtgaagcttagtatttggtgattacatagtcataaataacatggttaagcatttgtaaccttcatatctctgtgaataactgctaagagttgctttcttatgcccttaggcttggccagtttgtcatatcttgttggcattctttttttttttttttttttttggtaactacacaaatctcactatattgtttgtattatttaaatagttaatccatttagaatttctataaattaaatgtgttagttaatatctagaggcacatgtgaaataaataatttttaaaatgtgttagtaactctttatataggaaaataaatggatttttatttacatatcataacattttaacaagaaaaatgttccatttattactctaacaagaccaaaaaaccaattttctattttgttccatattttgaaagatttgttttcccttttagatgcagaccaacaacgaagagagaaactcaaaaaggaattagcacaatgtgaaaaagagttcaaattaactaaaactgcaatgcgagccaattataaaaataattccaagtcactttttaataccttacaaaaggtaagatagtatttttattttttaaaagcaaatgtttctaaggtacttctttagtggtacaatctgactttgtttactatagtttagggtcagcaaatttttcctgtaaagatccagatagttaatattttaaaaggctgttcaggcctctgtcacaactactctgccattggaaggcagacatagacagtacataaataaatgagtatagccgtgttctgctgaaactttattaactgaagacattgggtcagatttggcctgaaggttatagtttgcagaccccagttataggttttttgtgataccttcgaacatctggttaaataagttctattcctagtttgtgaagttttttttttccctttctcctgaatggatattaattttatgaaatgcttttttgcatctcttggaatgatgatattatgatataatttttctcttttaatctgtggggtttttttttttttatatatatatatatagtctcactctgttgcccaggctggagtgcagtggcatgatcttggctcactacaacctccacttcctgggttgaaacaattctcctccctcagcctccccagtagctaggatcacaggcacccaccacgactccagctaatttttgtgttttcagtagagatggggtctcgccatgttggccaggttggtctcaaactcctgacctcaagtgatctgcccacctcggcctcccaaaaagtgctaggattacaagcatgagccactatgctgagcctcttttaatctgttaatgtaatgaattacaaacaattgactttaatgttaaaccaactttgcattcctgttgtaaacagaacttagtcatggtacattaccttttttattcattgctagatttacttactaatatttgtttagaattttggcatctgtccattattgatactggcctgtcattttctttttttgtactccttgtgtctggttatgctatcctcataaaataaactgggcactatttcttctttctgtactctagcttgtgtacatttggtttatttgttccttaaatttggtggaactcaacattaaaattgtctaggcctaaagtattttttatgagaagattttgactactgattcaattttttaagtcattatagaatgatttcaatgttagatttatgtaggaagttgttcattttatgtaaatttttggcagagaattgttcatactattctcttaatctcttctgaatatgtattatttccccttgttattcctaaggtagtttatttgtgccttcattcttcttcttcatcattctcatcagagattgagtcagtttttttaaaggacacactttttattgtgttagtcttctctattgtattttgttttctgttttgttaatatctgtgtttatctttatttccctctctctgggtttattttgctgtactatctctaattttatttaatttattaattctctgccttacttctttgctagtgtaagcatttttaatgctataaattttccaccaagtacagctttagctgcatcccacaagttttgataggtggtatttttattatgtttcaattcgaagtattttacaattttctttttgtttgtttgtttttgttttgttttttgagataatgtcttgctctgttgcccaggctggcatgcagtagtgtgatctcggctcactgcaacctccgcctcctgggttgaagcaattctcgtgcctcagcctcccaagtagctgggactacaggtgcctgccaccatgcccagctaatttttgtgtttttagtagagtctagtttcaccatgttggccaggttggtctctaactcctgacctcaagtgatctgcttgcctcagcctcccaaagtgctgggattacaggcgtgagccaccatgcccggcctacaattttcattatgatttttttatttaacccagaaatcatttagaactatttcttaatctctgtatctgctttttccttagtatctgtttgttacagatttctagcctaattgtactgtgattaggaaacatctatattatatccatttcttgaaatttattgagcacttgttttatgtcccagtaggtggacaattttttaaaaatgtcctgtcattatatgtttgaaaataaaatatattctatagtttttgcatgtagtatttgatatatagtatattcattaaactttgtattttccagatattcaaatcttttatatcatattgattatttttgtctggttaatctatcagttattgagagaaatcttccacatacttacatatttagctatttctccttgtggtactattaatttttgatttacatattttgaatgcatgttattacattagagatattagagatacagaatacagatttagaaaatcctgaaggaggtagtttcttggtgaactgaacctgttatcactgtgctttgaatttctttaccttaatgctttttctattaatattttctgatagtgatataattaaattagctttattttgactagtatttacttggtatatcattttccattttttgatcttaatgttttcttctttttttttttttaatgtcacttgccaatctcaatgttttaggttagtatttggtgggtcagattattcaatctgataatcattgtctttttttttttttgagacagagtctcgcttttttacccaggccagactgcagtggcgctatcttggctcactgcaagctctgcctcccgggttcacgccattctcctgcctcagcctccgagtagctgggactacaggcacccgccaccacgcctggctaattttttgtatttttagtagagacggggttccaccatgttagccaggatggtctcgatctcctgacctcgtgatctgcctgcctcggcctcccaaagtgctgtgataatcattgtctttttaatggggcatttaatatgtttttatttctggcttcttatttcataccttctatttgactcaatgtggtagacaaaatttgaagacaacacccccacagtgacccacacccttaagcaatcccctcctcttcagtgcaggtaggacctgtaacttgcttctacccagtagaatatgggaaagatgataggatgtcacttctgtgattctgttatgtggcaaaagtgaagggatattttcccctgcagattaaggtttttgttccttaaaagagaatggaaaaataagtctgggaagattttccacagtgactgctgtttctctccccaagccacaccaagagaaggtgggaaagggattctctctactcttccctataagcttcgagtaggtttcctggaggaaaagcctgcaagaggtacaaactccccaagtcctcaggtccggtacagacctgagcacatcactagtccacactcagtctttaggaaattaacaaatatttataacataatcttatcaatttatgtggcattccatggcatctttcccaagtaagcaagtgctgggatacttatctctctccatatttcaggttagttgtttgctctgtgacctcagttctctcattagttcaagaaaaatcattaatgtgcagatcgttcagcttttttcttcttgtaatggtgagagctgtgttctttccatctctatctctcagctgaaacagtaagtttgttttatttttatgtgtggtttcattttttgaacttttaaattttgaaaaccttagcatttacaaaaatatagtataataagcccacatgttcctatcacctaggttgtagcaatgatcagctcagagccagtgttatttcacctatatgcccactcactctcctaggttgttttgatgcaaaccccagacaccatataattttatccataaatatttgagtatatatctaaaagatagacttttaaaaccacaacaatactattatgccttaaaaattaataacaggctgggtgtggtggcccacacctgtaatcccagcactttgggaggccaaggtgggtggatcaccaggtcaggagatcaagaccatcctggccaacatggtgaaacctcgtctctactaaaatacaaaaaaaaattagccaggagtggtggtgcgcacttgtagtcccagctactcgggaggctgaggcaggggaatcgaacccaggaggtgggaggtctcaatgagctgagttaacgccactgcactccagcctggtgacagagcgaaactccgtctcaaaaaaaaaaataattaattaataacagttctttaataataaatatctgatgtttagatttccccactgtctcctttttgagtttgttagagttggtattagaaggccagcagtctccttcaactcagtgccagggttcaggatggggaagtttccttgcaagtcatctagttgaggagtagccattgagagaatcccagattctcaagcatgatctcttaagagctttgttttctgcccctagcacccatgatgtggtttaaaaaaaactatggactgctgggcaaaagccagattgactgctctgcttaccaaataccaaggctgtaataatgagtctggatttttttccttgagaaatgctgggagccatagaccagtttttagttgggaagttatgtcatcatactgacactacacagactacactgacaacagtggaggacagttacgagacagttgcagtaatctgggaagcagtaattaagacatgattctatgacagcagagagagcataaggaatacatttaagaaataattagaaagtagaatctcggccgggcgtggtggctcatggctgtaatcccagcactttgggaggctgaggcgggcggatcacaaggtcaggagttcgagaccagcctggccaatatggtgaaaccctgtctctgctaaaaatacaaaaattagctgggcatggtggcatgcacctgtactcctagctactcaggaggctgaggcagaagaatcgcttgagtccaggaggcggggttgcagtgagccaagattgtgccactgcactccagcctgggcgacagagcgagactccatctcaaaaaaaaaaaaaaaaagtagaatctgcaggacttggtgactgagtggatgatgtgaagagtaagaagcaggagttaaaatcctaagtttctgccttgggcaactgggagaatagtaatatatcattcacagaaatataataggatgaggtgcaggttttctttggggctggaggtaataagagataggagtttattgtttggctgtgtttgatttgagatgcttttggaacatctagtatatttagtagacacttggatataagcatctgtgtcagcaaagaggtctgggctgaaaatagacttgggagtcatcaggggaagcagtgaatatgattgagagccccagggctattatgtagataaaaagaccagcaatagagctgcttcctttagaataaatctgttatctgctctgtattatactttgctatctgggattctgttcctcaatatttgaatcacaggtgtattttcatttttagtgattgtactttttaacagaaaatttaaaatttgtttctattattcagcatgagtataaattactaattaaattttgagataagaatggggtttcttgaaaatacaaatcatatattttaatatatctttttaatgtattttatatatctatttatatataataaagtaaaaatatatattatttacatattatatatttttaatatatttctgtaaatgttagatgttttcatttttccaatagcaactataaccctatataactttttgcctccataaagttgttaatttattattttatctgtatttttattgactccatttaggattcatagtaacttgcactttgcctacatttttgataagccctgataataaatattttagatacactcagattgtcttaagagccttattttgggtagtatattttgataattgaatgggtgttatggttaacagacacctgttatggttataatttgtattcactgtaaaggctgctatagttaaaatgctggctttaacctctgaatgtattagccctttatatacattataaaggtcatatatcaaaaaccttttatgataattgcccaattctcttgccacttttcttctcccatactctgactcacatgctgtcaccctcagaaccctcctaagcccttccagtcttcaccctgtaactcttgagtcattcactacttagtcaatgctcccatactactcgtttgcttcactggtgtagcacttactgtgtgcttttaagattaagtgaatatgtgggtgtgagctttatttctgaataaatctagaaaagaggcgggagcagtggctcacacctgtgatcccaacactttgagagactgaggcagacagatcacttgagcccaggagtttgagaccagcctggacaacatggcaaaaccccatctctacaaaaaaaaaaaaaaaaatacaagaaaaaaaaaaaagccaggcatgatggtgtgtatctgttgtcccagctactcaggaggctgaggcaggcagattaattgagcccaggaggtcgtggctgcagtgagccatgatcaggccactgcactccagcctgggtaacaaagtaagattaaaaaaaaaaaatctgggaaactttttaaaaacagtacaaaatagtgaaaatcaagagctatatttgttttataaaatataatttgaaacttttttgcaaacagatgttagattttaaaataattttttttttttttttttttttttttttgagacggagtctcgctctgtcgcccaggctggagtgcagtggcgcgatctcggctcactgcaagctccgcctcccgggttcacgccattcccctgcctcagcctcccgagtagctgggactacaggcgcccgctacccatccaattctacaattgaattgactcttcaagtgtttaaaaatccgacaattggaaaattattgtaggttatgtcttctgacatccttaaaaaagattgatttagtactgagttctgtattgtaaaattcttgacatgaaagtatgatgagtatataaactatgttatggttattactttacataaatcttgaaatcacagaaacagtgcacaacaaacctcgtaaactaagaataacctaagaaagtgagtgttcagggtaccaccagactctttgctccattggcacataattgatgaacccttttctgatttcagaactttacagtgatctgctgttcatgttttgggattctaccagtgtgttacatatattctgcacaaatatctttatccaagtttcatgatattcatagctaaaggaaacaagatgcagattggtacagtggattttatactgtagtctactggtttccaaggaaagaaaaaataggatacaaggtagaaattataagatacaaaaatgggaaaagtttcatgctttctataagttcagaagcaatttttccatcccatttcagagagatagcttaacatatacttctaccttttaaaaagactttcttcagtgtttcattttgtttattaaataaccattaccgataacatttctttacaggcaatcataatggcttatgcatttctttctccttcctctgatctcagtttgtgctgttcttctaagtgtaaataattcctgtgcttattaattaattgccctataggatatttttagactgtacttagaaatttcttctttgagagctaaactcttctggtacataagctgtagtgtgagtatcatttaggactacttataaaaactaacatcttgaagtcatttaccaaatagtaccctagtgactcaaaatttaatgccagcatacttacttgctttgagtaatgttgtcttgtatttggaataaggttataaaacagttggaaaggaaaggtgatttgacatattttagatagtagtcacaatgtccagttatctgcaatttttttgctttgataaatcagcactttaggttagctgacttatttgttcccagaaaaagagttaaaatcagtttaaaattttttatgctgtaaaaaaaatctaaaatcatataattttcaaataagtttttaagtagacaatatgataaagtggcaaagaacatgggctctgcctctgttcaaatctgtgagacactgcacctcagagcagtgtttttatctacaaaatagggtaataattgtactacctctcagaagttgatgttaggattaaatgagctatacatgaaaatgagtacagtaccttgcacatagtaagcacaccatacatattagtagcagtgatagaagttcttattattcctcttctattcaatgtcaagagcagtacctttcatacaggaagcctttttccttactcaacttgtccatcttccccttgttattcctcccaatgaggtaataagacagatataattggctaaatcctagcgatttttaacctcaatttctgtaacctccatgtaatttcccctctacctaatgaaagtgcctcagagttttgcaaaggatatacagatgtgtccgtaagggctgaagtcataggcaaagcttcttagacattttcagtttataaaacaataaaatactatctgtgtttttagactttacaaataacctgtagaaatggttttcctaaagtaaagccaaaaagaaatggagcaagtcaaaatgcctcccttttcatagtattacccccaccccaatgaaaagaagttgagaaatatatatgaaattattatggaataaatatttattaattatatttaaattatcaattacctaaatcagggctccatacattatgaggagaagttccttttcgtttctttaaaggcttaacatcacaaagggatggcttacactgcactctccaataatgacaagacaggacagtgaggatgatgtcactaatagtggttgagaagggcattggtgctcacaatttgtgtggaagctttcagataaaactgacatctcccaataaatcttaatatgcaagttgaagatcccaaatatagatatgttattcatctttttttcgtttcagaaaggaaattgattgctctattacttatatttggaattaaatgttaatatcttagtttaaatacttgactagaacttcagataaaatattaacatcttcaggaacatatcagttaattttgtaaacccttgaggctatcatttttttaatgtataatctcaaaatccccaattacatgaattcgtaatgcagttgatgactgtcatatcgaatgttcttagccctcaggcgaaccgcaaattgaggatgacatgttaaaagaagaaatgaatggattttcatcctttgcaaggtcactagtaccctcttcagagagactacacctaagtctacataaatccagtaaagtcatcacaaatggtcctgagaagaactccagttcctccccgtccagtgtggattatgcagcctccgggccccggaaactgagctctggagccctgtatggcagaaggcccagaagcacattcccaaattcccaccggtttcagttagtcatttcgaaagcacccagtggggatcttttggataaacattctgaactcttttctaacaaacaattgccattcactcctcgcactttaaaaacagaagcaaaatctttcctgtcacagtatcgctattatacacctgccaaaagaaaaaaggattttacagatcaacggatagaagctgaaacccagactgaattaaggtatgacacatcagcaaccaacagtaaatccttcaggaaattaaatgaaaattaatgaattaatattccttgttttctgctgccagccttaagatctgatagtgcccttttgattggaatgagatgaatgtgacttttccttttccatgtatcactagaactatcagagtaattgctgaaaaatagctattaaactggtcaagcaccttatgcgtatgaattacatattttattatttcaagcgtggttcaagaattgtgtatgtttttaaatattatactttcagagaattcttaaaataggtcatcagacagcatttgtggaaatatgcatattgattcatgttaaaagtggcgaaacaatgggctatagaggggaagaaactaaccctttatccatctaaccctctgctccatttcctgcagatattccggccagtcttcatagcaacaactgccaagaataattttaaattgggataatttctagaaattaagtataatttgcctcaataatgttttcaaatacagtagtgcctggcacaagatgaatgttcaataaaagtttgccagatgactaaagaaaaaaacaaatcttgtcaagttttgagatttagcagatttgtgattgtgattgtttttctagtattacataaacaatttatctggcagtaggttttagttgttttagaaagtaaaaacaatttaagattagtatttttttctttgaatatagataagtacagtgatatcagatgagtctgcagatatttaatcaaataaaatcaaataattcaaaattatgtattttataagaatagatgggtctcattctttttgagtttattttttctagccagtaaaccttgttaccacagtgcttatattttgaaggattaacaattatttattttaaattattacagctttaaatctgagttggggacagctgagactaaaaacatgacagattcagaaatgaacataaagcaggtaataagtatgaaatcttttggtattgctacatttgaattacagatgtttttcagtaaatagaatatgtacagctatttagactgtgaagaataatctgttggtggcacttatcatacatgatatagccagtatacagaaggtctgcctatttacaaatggttatagctctctctgaatggccaggtggatcctgccaaatctgggaagtcatttgttactaacatctttcctagatgattggttggctggctggacaaatggaaggatcagtaaaataccttaagtattgttttcaaagatgcagacctggattactagaggagccagcagagtagtgcagaagttgagtttttataccttttttttttttgtaaagaattgccacatattatataattggaaattatacattttataagaataagtagctgttattctcttatgtttgcctctgctttttctagaccatgaagctgtttattacagggtttatattttgaattcttagcatcatttcttttaaaatattgcaactttgagtctgattttgagataaattgttttatttttggagtttcagtcttgcacttgtgtcctgacttaaatttgttgcttataaaaatggtttgtctattaaaatgtcaaacacagatccagagatagaagaataaaatataatcatactcaacttcccccttcccttctgaaaatgggtagaaggtggtagttttccatctcagctattaatcgctgtttgacatagggccctgccacttaaggcccaaggacaaatcacttatcctctgagagctgaatttcctcatctagaaaaactgtacttaacttgcaggattattaggaggagtaaatgatgtaggcaaagtgcctagcctggtaagggcttaataaatgatagctattactagcttgaaatttttggaaagagttagctttgcagataactacgtaaacatgaaaaaatatttatttacaatcctgcaagaaaatgtgtgtccccatattccatagatagtgccatcagtacttgacttgaagaagccagtagagtattaactgcagtagatccatattttaacagcacctttaaaactgtaaagcactatacataaattgtcattgtaaagattgaatctaatgatgtgagtaaatgcttggcacagtttgtggtgtgtagtaaggagtctataaaagtaagctgccattatttttgtttgttaatattattgttcatgctgccagcgctaccactgcttctacatatttgacatgttggcatttaaaacagatgagctatttgaatttctgaataatgagattttgttccctcaaacttacttaaaagttgaaaatttgcttcatttttccctttatatgtttatttgtggcaatttcttaatgtcatttaaatgccactcattaaaatacaagaaataagtcattttatctttaagtttaagaaaaaagtgctggatggatagaaaaattattctaaaatattctttgtcgtactgtataatttttatctactggatatctctgttcaatcacttaaaatttgctgtgttatattctgctttcgtaatgtatttttaagcaaaaataaatattttttttattgcatccccaggcatctaattgtgtgacatatgatgccaaagaaaaaatagctcctttacctttagaagggcatgactcaacatgggatgagattaaggatgatgctcttcagcattcctcaccaaggtaaacagttcacaggagaaataatttcaactgtctttaattgccttcttgtataacagacatatagtatttgccgcataagtactatttaattgcatgctccaatctattttggtgttatgtaattcaataacagttttagttttaccaaggaaattttacaaattgaagtgcttagtaaaagttgaaatgaattaattttgctaattcattagtaaaggaaaaaaccacaccaacttgtattatttattatcactgttcattaaaaaaatgattttccccaagacaagtcctctggcagtgatgctaaccagtttacatgccacaaatagtactgaagagctttaccatttgaggagtcataatttgtgattttgaatattcatcatatcctagtgcttgaccaatctgtgctatatgaagacactatttatttatttatttatttatttatttatttatgagacagtctctctctgttgtccaggctggagtgcagtggtgcggtctcagctcactgcaatggaggcactctttaaaaactactcatcatgttgagtaattaaggaatattatacattaattagcaggtagtagaaaacctaaaagatgcctcgatagtttcagttgtcaaatgtatttccagtgtcagagagtggatatgaaatgccggtggaaggggtagaagaaaggaaggagtagagattaaaaagagggcaagaataaggtgttagtagcagaccactagggaagtacacacaatcccctcaggctctggcttctccctcaggcctttgctagggagatctcacctgctaaggccatggagagttcattgttaactaccctgtctttgaaatttctgatgtttcaacacatataacttattatttattaatataactgctcttgagccagtcttcattgaatattaagaatgacttaaggaaaggaatatttatcttttctaatactttctaaaagaagtaaagtagaatagtatagttgagtatacctgaataaaatttagcttcaaattaattattggtaacataactgaataataacaaaatttatcatgatgaccacctttaaaaatattttcataataatgtatctatatccagcattatctatacattaaccttagtcaaattgtcattgtttatactagagaagtgccgtagtgtagttttaaaaagaattgtgaatttatacctagaaaagtagtttaaaaacctgtctttgctgcttactaacattaaccttggaaagttacttagcctttctgacccttggtgaactaatcagtaaatgggaaaaataatacacagcccacatgcctgactgggttgtttagaagattaaattagatatgggtatgagagtgctttaaaaattgctgaaacatgtaattacaggttgagcatcccaaatttgaaaatctgtaattcaccatactccaaaatccgacatgatgcccaaaggaaatgctcattggaacatttttggatttcagatttttggattgagatgctcaactactaagtatataatggaaatattccaaaatccaaattctgaaacacttctggttccaaacatctaagataagggctattcagtgtgtactaatatacaatgttattgagtacttattgtatgccaaccactgttttgctcaactactttaacttcctctttctagggcaatgtgtcagtattccctgaagcccccttcaactcgtaaaatctactctgagtaagatcttttttaagtcttcgttttgcatagtggaatcaaggattaagaatcaaagaaaccatattaaataagtcaggattgaacaataatctctttttttaaaactggcaagtaataaatgtacatattcatggagtacctagtgatattttgatacatatactgtacagtgattagaacagtttaattagcatatccatcatctcgaacattttatcatttctttgtgttggaaacattgagtatccttcttctagctatttgaaactatgtattattgttaaccatggtagtcatcctatagtggtatagaacactagaacttactcctcctatctagctataattttgtatcttgtaacaaatctcagcttgtccctcattcccgtctacccttcccagcctccagtaccttctgttctactttctacttctatgaaatcaactgtttttagcttccacatatgagtgagaacatgcgatgtttaactttctgttgctggcttatttcaccagcatccatccatgttccatccatgttgccacaaatgacatgattttatttgtttttatggctgaatagtatttcatggtgtatatatacattttctttatccattcatctgtgaacactaatctctcttacaaccagctttgggatatcaatcgtataatacatactaaatttgagaaactgacctgaataattttctcgaatttttttgagaaataataacaactttctggaataattatcaatcacgtcatttttatctccagtagaaatttgtccccaggtattacctgatactttttaataatcagtatccatgattcttacttattttttaagtaaaaataataaaataataaagaagagttttagagaaatgcagacttttaatagttcaggatactctttccagaggtttctaacctcagcagttctttgcagatattttatttgtagattttaatgttgttttaattaagttactctttttagggaaaataatttataaaattttatttattttcaaatatgctgtttttaaataagcaagaccctgtgaatcagtttgaaagtgtaactttttattaaacatttaaatctattatttgatttgcttattaactcttcccttatatttgcttattcagtaatttagttacttgctacttacatttggtattaattcactaatttcagctaattaaaatcaaacgtacaataatatcctaattttcttgtaatagctactaaaatatagttataatagagaagtgtgttcaagtagttaaaaattaccacaagatttatgttcacaaattttcctatgagaatttttcgtctccaaacgttttgagagaaaaaataaatttttctgcttagtaaatttctcaaccttaaaacaagatgctggcctagggctaggagaggacttcttagttgaagctcctgcttctctggacaactttcctcttccttcttgcaaatgctttgcagagggacttgcacctctgctgctggacctggtcaggagcaagaggaaatttaaaacattcctcgggagtgcttgctcccagtggattgcatttgattgcgccttgtccttcgttgctttctttttgtgttgtttaattctgcttgttttttactgctatggatgttgcagatatctgtgaaattttactctattaggtcatcacctttagtaaatatttatccttgcataatttgagaaggtagacatgtttgttttgtaatattccccttagtaatatgagatagaagtacattggtaatggtagagatagatatttctaattaggtactaatgtttcttacagttttcagaataagtaaggaataatttttatgctatatattgccttccttttacagtgaagaagaactgttgtatctgagtttcattgaagatgtaacagatgaaattttgaaacttggtttattttcaaacaggttagtttttttaatggtgttatgttaattcaggagtacattaaatattcttcatatttcttcatatgatgttaaaattttaaagttattttcccatattaggaaatgaaaaaatatattgctttcttggaaacttattattataattgatagcaagttgtaaagaatgtttaattcatactctaggggaagttcaccacttgggagaattaaagaatagagcttttattcattttaatattatatcccttgagttataagtgactagtgaaggaagatctttatcacttatttgcaaagctccataatcccattttactacctaaaattgtcatgagaatcaaaagcaagcatttttggtgcaaccattattagtattagatctagtaaaatgagaacaaattaagagctaggtttgcacgctgtaagttaaatggaaagtttgcaaaaccagattagctattgcatagcttaaggaaactgtgtgtcctgaattttgcttgaacatttatgtatctaagattcattgagcactgagctctactttgtgttatgtaacctaggaccctattatgtatactacttgctttctctgtcataataatatgccaagcatagacatttttaataaattatttctatcctctacatcaagttttttaaaaaattaaagcaaacattttcattattggtataaaaaggcatatcaaaaagacctaagatttttggcattaattctgttgacccctttcattttaaaaagttggttaataatatttgcataatatgggtaaagagtttcaggatacataatgaaaagttttggcaatctgtatcacaatatgaatatacctaacactgctgaatcgtgcacttaaaaatggttaagatgataagtttggttagtttttgccaccacaagaaaaaaagtacacatacaaaatcatatgtatttatgcttaaaattttatgtttttctcaagattataagactgtttattacagcatttttataattgtaccaaaaaccagaatcaacctaaatgtttaatggtaaatgtttggttgaataaactgtggaatatatatgaaatgtgaggtctgtttagggattaaaaatgatgttgaagtgaatttacagatatagaaagatgttaaagatatatgtcattgattagaaaaaacaaaatagggctgggcgcagtggctcacaccagtaatcccagcactttgggaggctaaggtgggcggatcacaaggtcaggagttcaacaccagcctggccaatatggtgaaacctcatctctactaaaaatacaaaaattagctgggcgtggtggtgcgcgcctgtagtcccagctactcaggagggtgaggcaggagaatcgcttgaaccccgcaaggcggaggttgcagtgagctgagatcgcgccaccgcactccatcttgggcgacagagtgagactctgtctcagaaaaaaaaaaaaaaagaaaaagaaaaaagaaaaaacaagatagatacccaaatagtatgtattgtttaattacaagttggtaaagaaatacaaatgaatagaaaaaatgcctagtagtgaatattctaaaatgttaacaatagttgtaaaaagtagaatacagatttcttgggttttaataaaaaattgtgaaataattcagaactactaactctgaggttggttcataacttcactgatgctagcaaatgataacaaaggaaattagttgttttttaagaaactgttgatacattcctgtgatagagaggtgagcatggtgttctagaatgaagaaattctgtggagccagacacatctgggttaaattctcctaaaggcttttgacctcaggggagaggaaattatcatcttagagatgtggctttctcgtctttaaaatggtttttacactatctttccctccctacattggtcagaactagaggtaaaatgattattatgactagcacagtagcacttaatggaaattaataggtgataacttttaaattattatgtggatttaccatcagtgggagtttttaaattttttaattattttttaaaattttgtgaggtacacagtaggtatgtatatttaaggggtacatgagatgttttgatacaggcaagcattgtgaaataagaacgtcacggagagtggggtatccatcctctcaagcatttatcctttgagttacaaacgatcagattacattctctaagttattttaaatgtacaattaagttactattgactgtagtcaccctgttgtgctgtcaaatggtcttattcattctttctatgtttttgtacccattaactaccccacttaacctgcagccctctactacccttcccagcctctgttaaccatccttctactctctatgcccatgagttcaattgttttgatttttagatcccacaaatacgtgggagaatgcaatgtttgtctttctgtgccaggctcatttcacttaatataatgatctccagttccgtccatattgttgcagatgacaggatctcacttttttaatggctgaatagtactccatggtgtatatgtactacgtttttttatccattcatttgttaatggacacttagttgcttccaaatcttagctgtcataaacagtgctacgacaaacataagagtgcaggtatctcttcgatatcctgacttacttccttttgggattgctggaacatatggtagctcaatttctagttttttgagggacctccaaactgttctccatagtggttgaactaatagtttacattcttaccaacagtgtgcaaggattcccttttctccacatcctcaccagcatttattattgcttgtttttgcatataagccattttaactggagtgagatgatacctcattgtagttttgatttgcattcctctgatgatcagtgatgtgtggaataccttttcatattcctgtctacaattcgtatgtcttttgagaattgtctattcaaatcttttgcccattttttgattgggttattagatttttccctataaatctaatagtaaatagttgtttgagctccttatatattctggttattaattccttgtcagaggggtagtttgcaaatattttctcccattctgtggattgtctcttcactttgttggttatatcctttgctgtgtggaagctttttaatttgtgatcccatttgtccatgtttgctttggttgcctgtgcttgtgggatattactcaagaagtctttgccagaccagtgtcctagagattttccctcaatgttttcatttagtagttccatagtttcagaacttatatttaagcctttcatctattttgatttgatttttgtatgtggtgagagataggggtctagtttcattcttttgcatatgggtatccagttttcccattaccatttattgaagagactgccttttccccagtgtatgtatgttcttggcaactttgtcaaaaatgagttcactataggtgtgtggatttgtttctgagttctctattctgttccattggtctgtgtctgtttttatgcctgaccatgctgttttggttactgtagctctgtactgtaatttgaagtcaggtaacatgattccaccagttttgttctttttacttaggatagctttggctattctgggtcttttgtagtttcatgtacattttaggatttttttttctatttctgtgaataatgtcactggtattttgatagggattgcattgactctgtagattgctttgggtggtgtggacattttaacaatattgattcttccaatccatgaatttggaatatttttccttttttttttttggtgtccttttccattttgttcattggtgttttatactttaatataggaatttttaaaagtataatttaggaaggattataaaatatctctgtaagaggtttttctttagggtttggttgtgtgtgtgtgtgtgtgtgtaaatatcggggtagagaggctttgggtgtttgcatatgtctgtgagagaaaaacagctttttggtggtggggtgagaaaaaggagaattttattcaaagaaataaaagtagcatacagtctttcagaaatatgtaatgtgaagcaaatgcataatggaagaacttagaacaggaaaggattagtcttcagctttacagagaaaaagaaaaatctgaaaaacatttttcaacctttgtagtttcagtgttacgtagctagtttatatttagatgattttctgattttgagacattaacatttttgtttatcatttgtaggtttttagaacgactgttcgagcgacatataaaacaaaataaacatttggaggaggtttgtctttccttataacttcattagaaaaattataatgtaaaaataattgtatggtttttttcataccttcaaacaatacattaaaagcaagtgctttttttttcccttgaacttttttgagggtggtggtgggagaagtgaaaggaaaagtattaatcctgtgagattttcagcactgcagtcaaaatttaatttgactcaattaatgtaattagtctcatcttttcttaatcctaggaaaaaatgcgccacctgctgcatgtcctgaaagtagacttaggctgcacatcggaggaaaactcggtaaagcaaaatgatgttgatatgttgaatgtatttgattttgaaaaggctgggaattcagaaccaaatgaattaaaaaatgaaagtgaagtaacaattcagcaggaacgtcaacaataccaaaaggctttggatatgttattgtcggcaccaaaggatgagaacgagatattcccttcaccaactgaatttttcatgcctatttataaatcaaagcattcagaaggggttataattcaacaggtgaatgatgaaacaaatcttgaaacttcaactttggatgaaaatcatccaagtatttcagacagtttaacagatcgggaaacttctgtgaatgtcattgaaggtgatagtgaccctgaaaaggttgagatttcaaatggattatgtggtcttaacacatcaccctcccaatctgttcagttctccagtgtcaaaggcgacaataatcatgacatggagttatcaactcttaaaatcatggaaatgagcattgaggactgccctttggatgtttaatcttcattaataaatacctcaaatggccagtaactcaatattacttttcttccttttttaaaatgtatgtataagatttctctattggttttctgtgctgcaataataagttaccagaaacctagcggcctaatgtgccacacatttattatttatcccacagttttgtggatcaggagtgtaggcacagcttagttgggtcctctgtcctgggtctcacaaggctaccccacaatcaaggcagtggctggggccatgttttcattaagaggcttgttggcagaattatcctccttgcagttatagatttgagggcttcgttgtcttgctgaccagtggctagaggctgcctatagttctctgccacttggccctttccttagggaaattataacgtggctgcttgcttttttaaggatatcaggaaaaccagagagattctgctaacaagatggagtcttatataatgtaacataatcacaggagtgactttctatcacctttaccgtgttcttttgggtagaagcaagtcacaggtcttgcccacacttaagggttgggaatatatacaagggtgtgaatgccagaacacaggaatcactggggtcatctgaggacctgctggccacaatttctaaaatcacttttcagaggaaaacatattttacctatattttcagaggaacatattttacccagacataagcggttttgtaggctatgggaaatggtttatgatctggtgtgagtcttgaagcgttggaccttgtctgcaatatctttaattttgtttttctcacttttcctgcaatatctaaagcctcaaggacctttcagttgtcagtgacccagggaattctgtcagctggctgagatgttgtctcttgttgtgagtgcaaacatttagtcagacctgtctgaagccctctcctacccttgtagctcatgaatgagacccttactattagaacatggcccagcagattcatctctaattatacctttttaactatttacaataatataattgaatatttgtgtgcccattatgtacaaagtttcatgcctagatactgtggaggataaaaacaataacccattttgtttttataagctatattttaattttatatttaaaaaaatacaacccaggtattcttctaaaaacttaacagtgacttccaagtatcctgttctttaactcgggtttttatcatcctttggccatagcagtgtttcccaaagggtggtacttaccactggagacctgagagttgattttagtggtatgtggatgacaggtccatctcattcatgggatgctgaccatcaccactgtcttcaggataagacacaggtacaacctgcaaagcacaatatggtgggactgagcacccaacccacttttcacctccactgtcggaatccccaactcaccctgctacaacccttttttggcacaccttcccctcagccctcacctctggacttcttccctttaaccctgtaagcaacaccgtctatcccctcttgcagtcctcttaaacctcctgaaataaccttggctctattcttggtccccagcctgggtctccccatctgttagatctttacccctctagttgcttcttgggttctgttgttcctcagccccagggttcctttcttcagtcccagcctcactctttcacaaaccccctcttcccattccccatgtaactaccccagacctactggcctggcccaaattttccttccttggctggagctaccatctgtctttccggaggcattctcagaaactatctcctggctgctgttctccaacactttggtccaagccccagacctgccctatttgacattcagtcttcatgctctaactctgggtacagcttcttgtctctggggccatgacccatcctaatttggatacctattaggacaatttgttgttatcctttagtttccctttaagttttaaaaggtgagttgatttaaagaaatattaaaaatggttcttgaatgtggcaaaagtattatagtatgaaggtaggatgtgggtggtaagtttgggaaacagcacttaaactcttctagcagcatctttttttatccctaagacatcttgttacagcatcaagcaacatctttatatcttcccctcttccttctcacacagcccatcaactgaggctgagaggcatgatgaatgcgagtgtgtcttctgagccaggttgcctggatttgattccttttgagctgtgactttgagctgggttactgagcctgtgtgtgttttctcatatcttggagaggggtaattatagagcctttatcatagaatacaagaattaaatgagcttgcatgataaatacaggctgctgctacttttttttttgctatttattttttatttcagtaggattttgggaacaggtgatgtttggttacatgaataagttcttcattggtgacttctgagattttggtgcacccagcacctaagcagtgtacattgtacccaatgtgtagtcttttatccctcactccccgcctaccctttcccctcagcccccaaagtccattgtattattcttatgcctttgcatcctcatagcttagctcccacttatgagtgagaacatacaatgtttggttttccattcctgagttacttcacttagaataatggtctccaattccatctaggttgctgcaaatgccattatttcattcctttttatggctgagtagtattcaattgtgtgtgtgtgtgtgtatatatatacacacatcacattttcattatccacttgttgatcgatgggcatatgggctggttccatatttttgcaattgtgaattgtactcctataaacatgcgtgtgcaagttatcttttttgtataatgacttcttttcctctgggtagatacccaggagtgggattgctggatcaaatggtagatctacctttagttctttaaggaatctccacactgttttccatagtggttgcactagtatacattcccactaacagtgtaaaagtgttccctgttcaccacatccacaccaatatctactatttttttattttttgattatggccattcttggaacagtaaggtggtatcgcgttgtggttttgatttgcagttccttgataattagtgatgttgaacattttttcatatgtttattggctatttgtatatcttcttttgagaattgtctattcatgtccttagcccattgttgatgggattgtttttgtttcttgctgatttgtttgagttacttgtagattctggatattagtcctttgtcagatgtatagattgcaaagattttcttcactctgtgggttgtctgtttactgattatttcttttgctatgcagaatcattttagtttacctaagtatcatctgtttatctctgtttttgatgcatttgcgtttgggttcttggtcatgaacactttgcctaagccagtgtctagaaaggcttttctgatgttatattctagaatttttatagtttcaggtcttagatttaagtctttgatccatcttgagttgatttttccataaggtgagagatgaggatcgagtttcattcttctacacgtggcttaccaattgtcccagcaccatttgttgaatagctttgttgacagtcagctgactgcaaatatgtggctacatttctgggttgtttattccattcctttggtctatatgcctgtttgtttgtttgtttgtttgtttgtttgtttttgaggcagagtctcactctgtcacccaggctggagtgcagtggtgtgatctgggctcactgcaacttctgcctcctgggttcaagcgattctccgacctcagcctcccaagtagctgagattacaggcacctgccaccatgcccagctaatttttgtagttttagtttgtagtttgtaattttagtagagacggggtttcaccatgtgggccatgttggccaggctgtctcaaactccagcatagaaggtatgttccttctatgctgattttgctgagggttttaatcataaagggatgctggattttgtcaaatgctttatctggtctattcagatgatcatgtgatttttgtttttaattctgtttatgtggtatatcacatttattgattttcagatgttaaaccatccctgcagccctggtatgaaacccacttgatcgtgatggattatctttttgatatgctgttggattcggttagctaggatttcgttgaggatttttgcatctgtgttcatcagggatgttggtccatagttttgtttttttgatatgtcctttcctggttttggtattagggtgatcatggcttcatagaatgatttagggaggattccctctttatcttttggaatagtgtccataggattggtaccaattcttctttgaatgtctgatagaattcagctgtgaattcatctggtcctggaatttttggttttttgttagtaatttttttttttttttttttgagatagagtctcgctctgtcacctaggctggagtgcagtggtgcgatctcagctcactgctgcaacctctgcctcttggtttcaagcaactctcctgcctcagcctcccaagtagctggaattacaggtgcctgccactgcgcccagctaatttttgtatttttagtagagacatggtttcaccatgttggccagactggtcttgaactcctgacctcgtggtccacccgccttggcctcccaaagtgttgggattacaggcgtgagccactgtgcccagcctatttttgttggtaatttttaaattaccatttcaatctcactgctcgttattggtctgtttagagttttctgtttcttcctgtttaatctaggagggttgtatatttccaggaatgtatccatctcctctaggttttctagtttatgcatgtaaagctgttcatagtagccttgaatcatcttttttgtttctgtggtatcggttgtaatatgtcctgcttatttcttgtatttatttatttatttattattattatactttaagttttagggtacatgtgcacaatgtgcaggttagttacatatgtatacatgtgccatgctggtgcgctgcacccactaactggtcatctagcattaggtatatctcccaatgccatccctcccccgaccccacgaccccacaacagttcccagagtgtgatgttccctttcctgtgtccatgtgttctcattgttcaattcccacctatgagtgagaacatgtggtgtttggttttctgtccttgagatagtttgctcagaatgatggtttccagcttcatccatgttcccacaaaggacataaactcatccttttttatggctgcatagtattgcatggtgtgtatgtgccacattttcttaatccagtctatcattgatggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgactttcacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatatctctgatggccagtgatggtgagcagtttttcatgtgttttttggctgcataaatgtcttcttttgagaagtgtctgttcatgtcctttgcccactttttaatggggttgtttgtttttttcttgtaaatttgtttgagttcgttgtagattctggatattagccctttgtcagatgagtaggttgtgaaaattttctcccattttttaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcctgaactgattttcgtataaggtgtaaggaagggatccagtttcagctttctacatatggctagccagttttcccagcaccatttattaaatagggaatcctttccccattgcttgttttcctcaggtttgtcaaagatcagatagttgtagatatgcggcgttatttctgaggcctctgttctgttccattgatctatatctctgttttggtaccagtaccatgctgtttttgttactgtagccttgtagtatagtatgaagtcaggtagtgtgatgcctccagctttgttcttttggcttaggattgacttggcgatgcaggctcttttttggttccatatgaactttaaagtagttttttccagttctgtgaagaaagtcattggtagcttgatggggatggcattgaatctgtaaattaccttgggcagtatggccattttcacaatattgattcttcctacccatgagcatggaatgttcttccacttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatccagagactttgctgaagttgcttatcagcttaaggagattttgggctgagacaatggggttttctagatatacaatcatgtcatctgcaaacagggacagtttgacttcctcttttcctaactgaataccctttatttccttctcctgcccaattgccctggccagaacttccaacactgtgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagtatgaaaggttgttgaattttgtcaaaggccttttctgcatctattgagataatcatgtgttttttgtctttggttctgtttatatgctggattacctttattgatttgcgtatattgaaccagccttgcatcccagggatgaagcccacttgatcatggtggataagctttttgatgtgctgctggattcggtttgccagtattttattgaggatttttgtatcaatgttcatcaaggatattggtctaaaattctcttttttggttgtatctctgtccggctttggtatcaggatgatgctggcctcataaaatgagttagggaggattccctctttttctatggattggaatagtttcagaaggaatggtaccagttcctccttgtacctctggtagaattcggctgtgaatccatctggtcctggactctttggttggtaagctattgattattgccacaatttcagatcctgttattggtctattcagagattcaacttttcctggtttagtcttgggagggtgtatgtgtccaggaatttatccatttcttctagattttctagtttatttgcatagaggtgtttgtagtattctctgatggtagtttgtatttctgtgggatcggtggtgatatcccctttatcattttttattgcatctatttgattcttctctctttttttgtttattagtcttgctagcagtctatcaattttgttgatcctttcaaaaaaccagctcctggattaattaattttttgaagggttttttgtgtctctatttccttcagttctgctctgattttagttatttcttgccttctgctagcttttgaatgtgtttgctcttgcttttctagttcttttaattgtgatgttagggtgtcagttttggatctttcctgctttctcttgtgggcatttagtgctataaatttccctctacacactgctttggatgcgtcccagagattctggtatgtggtgtctttgttctcgttggtttcaaagaacatctttatttctgccttcgttttgttatgtacccagtagtcattcaggagcaggttgttcagtttccatgtagttgagcggttttgagtgagattcttaatcctgagttctagtttgattgcactgtggtctgagagatagtttgttataatttctgttcttttacatttgttgaggagagctttacttccaagtatgtggtcaattttggaataggtgtggtgtggtgctgaaaaaaatgtacattctgttgatttggggtgaagagttctgtagatgtctattatgtctgcttggtgcagagctgagttcaattcctgggtatccttgttgactttctgtctcgttgatgtgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatgtttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttgccagtctgtatattttaattggagcatttagtccatttacatttaaagttaatattgtaatgtgtgaatttgatcctgtcattatgatgttagctggttattttgctcattagttgatgtagtttcttcgtagtctcgatggtctttacattttggcatgattttgcagcggctggtaccggttgttcctttccatgtttagcgcttccttcaggagctcttttagggcaggcctggtggtgacaaaatctctcagcatttgcttgtctgtaaaggattttatttctccttcacttctgaagcttagtttggctggatatgaaattctgggttgaaaattcttttctttaagaatgtcgaatattggcccccactctcttctggcttgtagagtttctgccgagagatccgctgttagtctgatgggtttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgctttgctagattggggaagttctcctggataatatcttgcagagtgttttccaacttggttccattctccccgtcactttcaggtacaccaatcagacgtagatttggtcttttcacatagtcccatatttcttggaggctttgctcgtttctttttattcttttttctctaaacttcccttcccgcttcatttcattcatttcatcttccatcgctgataccctttcttccagttgatcgcattggctcctgaggcttctgcattcttcacatagttctcgagccttggttttcagctccatcagctcctttaagtacttctctgtattggttattctagttatacattcttctaaacttttttcaaagttttcaacttctttgcctttggtttgaatgtcctcccgtagctcggagtaatttgatc

SEQ ID NO: 1184 - DNA, 25875 bp, Homo sapiens
aaaaaggagctcatattctcatgtccaatcgaagtgtaagactaaagagttttacttcatttcattgaatatatacttgtatctcttttatgccaaaaatctacttactggcattaatacaatatatttgctttatccttcaacatagctatacaggccataccttggagacactgcaggttcagatccagaccaccaataaagcaaacattgcagtaaaccaagtcacagaaatgtttttgtttcccagtgcatataaaagttatattgacactatattgtagtctattaagtgtgtaataagcactgtgtctacaaaaaagatgcatgtaccttaattaacatactttattgctaaaaaatgctaatgattatctgagccttcatggagtggtaacctttttgctggtggagggtcttgccttgatgtagacggctgctaactgatcagggtggtggctgctgaaggttgtggtggctgtggcaatgtcttaaaattagacatcagtgaagtttgtcatatcaattgatgctttcacaaaagattcctctgtagcatgtgacactttgatagcattttacccacagtagaaagtctttcaaaattggagccagtcctctccaattctgctgctgctttatcaactaagtttatggaatattctaaacccttggtttcatttcagtgttcatagaatcttcaccaggactagattccatctcagtaaactactttctttgctcatccataagaagcactcctcatcagttcaggtttcagcctgagattgcaataatttggtcccatctgcaggctccacttctaattctatttctcttgctgtttccaccacatctgtagagacttcctgcactgaagtcttcaactcctcaaagtcatccttgagggttaagatcagcttctcccaaactcctgttcatgttgatatttgtatgtcctcccatgaatcatcagtgttttgaatggcatctggaatagtgaatcctttccagaaggttttcaatttactcgtccagattcatgagaggaatccctatctgtggcagctatagctttacaagatgtatttctcaaatagtaagacttgataattgaaatttctccttgatccatgggctgcagaatggatgttgtgttagcaggcatgaaaacaacagtaatctccttatacattttcatcagagctcttgggtgaccagctgcattgtcaatattgtcaatgcatagtaatactttgaaataatcttttttttttttctgagcagtaggtctcaaaagtaggcttaaaatattcagttagccatgctgtaaacagatggctgtcatccaggccatgttgttccatgtatagagcataagtggaggaggtttagcataattattaagggccctaagattttcagaatggtcaatgaggattggagtcaactttaagtcaccagctgcattacccctaatgagagagttagcttgtcgtttgaagctttgaagccagacactggcttctctctagctatgaaagttctagatggcatcttcttccaatagaagactgttttgtctacatttgaaatccactgtttagtgtagccgtcttcatcaatgatctcagctacatcttctgggtgacttgctgcagcttctacatcagcacttgctgcttcaccttgttctgttttttttttcccttaaacctcatgaaccaacctctgctagtttcaaacttttcttctgcagctcccttacctctcttagccttcatagaactgaagagaaagccttgctctggattaggctttagcttaagggaaggttgtgtccggtttgatcttctatctagaccactcaaactttctccatatcagcaataaggctgtttcactttatcatttgtgtgtttactggagtggcactcttaatttccttcaagaacttttcttggctgggcacagtggctcatgtctataatcccaacactttgagactgaggcaggaggattgcttgaggccaggagtttgagaccagcctgagcaacatagcaaaaccttgtctcgacaaaaaaatacataaaaaaaaaattagctgggcacatgcctgtagtcctagctagtttggaggctaaggcaggaggatcccttgagcccaagagttcaaggttacagcgagctatgatcatgccactgcactccagcctaggtgacagagcaaaaccctgtctcaaaaaataacaatacttttttctttgtattcacaacttggctgactgtttggcacaagaggcctagctttcagcctatctcagctttatgttaatcatttctagcctttgattgcaagagagagatgatggctcctcctttcacttgaacacttagaggccactgcagggttacttgttggcctaatttcatattagtatatctcaggaaatagggagacttgaggagagagagagaaatgaggcaatggacagtcattggagcagtcagaccacacacaacatttatctactacatttgccatcttacgtgggtatagttggtgacgtcctaaaacaatttcagcagtaacaacaaagatcactgaacacagatcgttataacagatataataatgataaaatacactgaaatattgtggcagttaccaaaaagtgacacagagacatgaagtgagcacatgctgttggaaaatggcgctgacagacttgctcaattcaaggttgcctcaaaccttccatttgtaaaaagcacagtatctgcaaagcacagtgaagcaaagtgcagtaaagtgggggtgtccacaagaatttccaaagagccacaccaacatttgctgctatcaaaaagactacgaaatgccatctaagatttctttgccattctctttcgtcttttcccggggacatacgcacaaaaacaccatttaaagttattgaagtaattattttcatataaagtatatttcatttgtgtcagtttgttttcaatatttgcagtttagtcattttgcctctttaaagttcactatttttatttttgattatgtaaaatatttacatggctcaaaaataaaattatatgcaagaaaagaaagaacagatgagacaaaataaaaatgaaattggtagatttaaatctgatgatatcaattaagtccattcgatgtaaatgacataaaggcagagattatcagaccagtaaagaagcaagactcaaataagtaatgtctacaagaaactggcttttaaaaagatattccatgcaaactctaatccaagaagtaggagtgccaatattaatatcaggcaagatagatttttaaataaaaggagattactggagataaaggagcatttcataatgataaatgggaactatcttaaatatatatgtacctaataataaagcttccaaattttatgaaacaaaaattgccagaattgaaggagaaagagatacatctataattatagttggagatgtcaacaatcctctattagtaatataacaaataaagggaagtcagtaggattagtgaagacctgaacgatgccatcaaccaatgtgacccaacttgagcaaactaacattagtgaaacaccacactcaggcatgacaggatgcacagggaatatttgccaagataggtcttacttggggctataaaatagtatcaataaatttacaaggattgaaatcatacaatatgttcctgaccataacttaattgaattagaaatcagtaataaaacttatatgagaaactgcaaatatttagatattaaacacagttttaaataaaccatgtatcagagaagatgtcacagggaagataggaagtattttaattgaattgcaatgaaaatatatttcttttgtggtatgcggctaaagcaatttataaagggaaatttatgcctttaaatacctgtattgagtttgagaccagcctgggcaacatagtaagatcatatctctattttaaaaatttaaaaattagccaggcatgatgacatgtgcctgtagtcccagttacttgggaggctgagataggagaattgcttgaacccaggaggcggaggttgcagtgagctgagatcacgccaccgcactccaacctgggtgacagagtgagactctgtctcaaaaaaaaaaaaaaaaaatgcttgtattagaaaagaagaaaagtttaaaatccatgacctaaacttctaccttaataaactacaaaaagaaaagcaaattaaacctaaagtaagaaggaaggaaacattaaagattgatggaagaaaaagtaaaagtaaagtgtggaaatcattgaaacaaaatgaacaaacactagagaaagctaatgaaactaaaactcgttctttgaaagatcaataaaattggtaagtctgatcaggggagaaggagaaaaaccacaagttaccaatatcagaatgaaaggggatatcgttataaattctacagataataagagggtaataaagaaattttatgggccagtgtggtagctcatgtctgtaatcccagcatttcgggagactaaggaagatggatatgacttgaggagtttaagaccagcctggacatcatagtgagaccttgttgctacaaaacaataaaaatcagctgggtgtggtgggggggtacctgtagtcccagctactcaggaggctaaggtgggaggatggcttgaacctagaaggctgagactgcagtaagcagtgactgtgtcactgcactccagcctgacgacagagggataccctgtctaaaagaattttgtgaatgagttgtgccaatacatttgacaatttagatgaaattgacaaattcttcaaaagcacaaattacaaaaactttcacaagaaaaaatatttttaatagcctaatcaatctaataaagaatcgaataaataaattttatttgtaattaaaaactcctcccacaaagaaaattctaggcccaatggcctcactggtgaattctgtgaaatattctataaaacgtttatgaaaaagttaatatccatttttcacaaagtcagagaagagagcacttggattcattttatgaggtcagcattatcctataccaaaattatactatgacattatagaatctagtaataaatgtatttggaactgacaattccctgtgcttttaaacattctgtggttaaaaatttgcccagttatttgaatttgggtgtttgttttttgggggtttttgtttttttgagaaggagtctgtatcgcccagggtggagtgcaatggtgcaatctcggctcactgcaacctctgcttcctgggttcaagcaattctcctgcctcagcctcctgagtagctgggattacaggcatctgccaccactcccggctaattttgtatttttagtacagatggggtttcaccatgttggccaggctggtctcaaactcctgacctcaagtgatccacccatctcagcctcccaaagtgctgggattacaggtgtgagccaccgtggccggccagttatttgaatttgtgaacctgaacttccagcttaggatttgttttcctcggccctgctgatcagctctcactttaccgctgcttttcagcttctctaattttgctgttatttttttctccatctttggggaatttatacttttgttattggagagatttaaaataatttgtattaccattcctcaaatctcagaccatccttttgggataattttcctccaccctgaacaacatcctttagaagtttttcagggtaattatcttggtattaagattcttcagtttctgttaatctgaaaatgtctgcattttgctctcattcttaaaaggtgttgctgagttcccagctgtgggttgacagttaatttctctcaacatttcaaaagttattatctgactgccttctgactccctttgggctgttaggaagtagctgtcattcaatagatgttccttcataagcaatctgtacattcctctgggtcctttgaaggttttttcttgttttttttttttgttttttgtttttttttttttgagatggagtctcactgtctcccaggctggagtgcaatggcgcaatcttggctcactgcaagctctgcctctggggttcatgccattctcctgcctcagcctcccaagtagctgggactacaggtgcccgccaccgcgcccagctaattttttttgtatttttagtagagacagggtttcgtcgtgttagccaggatggtctcgatctcctgacctcgtgatccgcctgcctcggcctcccaaagtgctgggattacaggcgtgagccaccgcgcccagcctgaaggttcgttctttgtgtttagtgttcaccagtttcaatatactgtgtgtgggcgtggactgctttcacttctcctctttggaatacattatgctttctgtttctggagacagcttctaattttaaccagtgctgtaaatttgcactattttctctttaaatattatctcttctccactctccctattatctcctttagagtctctgatttaaaacattttagaactttccatcttgtcttccatatctttgtgaaatttcccatttcctgtctctctgtgctgcattctgcctgatatcttcagctagatcttccagttcactaattctttgttcagctatgctaattagctctccaactcactcaggcttcctcattttataatttttcctttccaaatgtatctgtttgtttctaatttcccttgttggttggtcatttttgttctatttgttttgtattacatttctgacaagttaattatctgagatcttgggtgtctgaatctgttggttttttttttctggctttcaattatagcgacttgttttcttgtttatttaatctttgtgttgtgctcgttgcctgattttgattgttggggctcacactagggactgggaaagctcctgaggagagaattgctcctgtcctttcctatatcacagggcattgctggcctcgagggtccctctccatgtggggtgctgggttcaccttttcactctgctgctagccaagctcacagcagccctcaggagccctgtctctcccagctgctcatgagcttgtttctttggcctgacaccacctccttgctccagcctcaatgtgtgtgtttacttatttttagaagtgggggtagaaagtggagtcctccctgcatcttatgaaaggggcagtgtctcagagctgtatccatcccgtttcgccattctgtgggtggagggtgtcccctgagagtgccaaggtaggcgtctggattgtgccatccacacaccctcttctacagctccaatggagtatggtgggagtggagttaggtgtcagtgctcagttcctcagcctaccatctttgccaggaactccctgcccatcgcttctccatgttctaccctttgtcttcctcccccagtgccacagacccctcagccccagtccccatggcctgtgtgttgttgctgagcacagtgggccattccatgattatcctcctatggctcggacactgtggactgccgaccacttctcagcacagtgggctggaccaaccctcaccctgtaggcccagcagcaccctggagcccagcgtatccacatcccactaatatgaggggcatgcagtctcagtgtagttgtggagcccctccttctggcccaggtgccccccgtccacctgtggcagcacagtgtgcagggggctacagaccacgaatgggtccctcaggtgtgaacttgccctcacttgctcactgcccccctggctccccatgctgacccagttgggacaaggccttcctgaaactgggatggggtcaactgcttgggtatctctgggaggcatgttaaacgcaggtctgtaagtattcacgttgcgttttcatcaaaacaaacccagactcatccatttcttcccatgtccacgggtgtctctgaggcccaaacctctctcttttgggactattgcaggggcttctcctctccattttcctgtctatacccactactcactgctgtcaagatggcggccactgatgcagtgctgtttctgcactctgcgccttcccgtgctccccacctcattcaggagagggcagccacataggtcctgtctgatccaccctccggccaggcggcccctgtgggattcctcacacagcattccattaccggatggcgttccccattggtctccttcaaatctcaatgcctcagcacaacagtggccgtcctagtggcgtgggggccccagagacttctgtgatggcacccacgtcaacacatgccctggggccccagagacttctgtgatggcacccacgtcaacacatgccctggggccctggagacttctgtgatggcacccacatcaacacatgccctggggccccagagacttcagtgatggcacccacgtcaacacatgccctggggtccctgaggccaggaaagcacaatagcctctcacctgggcagtaaatgttctggccccaaagtgacgcctgtcctaccccagggacccccagctccatgctccaggagggagggcaggtggatccaggtgtctgcaggagtctgcaccacaaccccttccccagcctttcagtgatcctacaggacttcacaggctccacagtagcgcatggttctgtgagtctgctcttgcagtctctgccctttgactggagtgttgtgtccgtctgtcgaggcttcaatgcaccaccccattgtgctgctctggtgtctttgagtttagagctcctggcgaggttaactcggtcagcatcttctcctggtcatgccagccccagcggcccggtggctctgaccgtggagtttgccatgtgctctgactcaggagcatcaaggctggtgttctgtgcgttttatgggttctgattgtgggttcatgttcctggggatcctcttgagttccaagtacacagtgtgatctctacacaggatttacggccattctttcaggggcctcctggcattgtcagtcccaggaaccttaagaaaactttaagccaggggtttttcagatctccacgtcacctcagagctcatgcgcccgtgagcttgggcttagttcattgttttcaaggatggtgggcggggatggcgtgcagggtggtgggagctgggcctggggtctggttctagaagcatcagggctggagggccttagacagttacgaggaagggtcgtctaccaggcctcggtgagagaagtgagcccccaccttccagtcactgggagaggactgaagaagcagccatcccccaagcatctccatcctcaaaccacacagagctcccgcccaggcactgagagggccctggggttccaccaggtgagtggcactggtggggaggcctggggacccctgctgcagaaagggccacgacagattacagtgagcccctgaggacatctttgaggttggggcctctgagctcaggtctcaggaggtgtctgctggtggcctgatgggctgcgagggtcttggtggtcagtggcccccccatgaacagcagcaatgcaagctgctcccacagaggagggggcagagtgagggcttctggggcctcgtccggatctcaaggtgccccttgtctgagcttctgatcgtcctgtgggcaggcgcgtgcctgccgggtttgtggatgcatctgacatgccatttgctgtgtcttctgaaatcctgtatgggccaggggtggcgtctgttgtggggagatctgtaggtctcaggcctgcctcccacacacacacagagcacgtgcctcatggccctgacggcagcaccaggcgccttctgaatgtgtgtccccaattagcgcacaccacgggtccctgcactgcacggggcccagaacaagtgtggggacagccagggacatttgtgagcaacagagatagtctttattcaaacgcagagagatccataacatggaaacactgacgcttccgaaaccgccccatttattcacttctcaagtggcccccgcttggatgcgccctcgggagagtgggctcagcacagcctagagcaccaggtctgaggtatctgcaaccacgtgggagccaggcccctggacgatgaaggacaatctcctggagcagcaataacttataaggagacataatttagagtagctggagccttggggatgactttatcctgcaggaggaggaggctgagagcagacgggacacgggggcccctaagaagcaaggttgggaaaggaggaggctgtttcccaatgcccgtgccggccaccagagggcccttcagtgcagagatggtcggcgcggcctcaccgcggtcaggagcagcgcgaaaccccctgtgccctcggccgcctgcagcatgagcctgcacaggagcccccgacaccccatggctccggggggccccaggggctgcggggctctggtcttagacgcagttatcagggacgcactcagcctcttcttcgagctcggggcaggggctcccgttgttggcgggctggacccggacgtagcgagtcctgctcttggtcccgagcctcccacagtggcctccgcacagtccccaggacgaccacagggagacctcgcagtccagcggcgtttctggaactggaccaagcaaaggggagaccgaggtgaacgctcgcgtgaagaggcgcttcgtacaaacggaagccacctcccaccaacgtgtgcattcatcagaggccacgcccacccttcgggggcacttgcgtttctccgcacagtcgcagagtgagcggcaagatgggatggcaccatagcaacctcggacacaacctagggactggagttgcgcgtttctacgtaagagccggagctgccgctcaagtccctgtggtggtggaactcccacatcgtggcagagtaaggggcccctgggaaccccgtgggaaccccgggagagggcggacacccctgctgtagaaagctgctctgcccgagcctggacccagctgctacatttacccgaataacagacaggggcacctgattagctgtcttgcgggacctggaccccccacaggactcagaccttttcagtatcgttctcgtttccctgtgtcccatctggttccataattttcataaatttaaaaatcatcatttggtgttatggttaagtcacttggtaatttccatgtttccaaagcaaagtgaaaacacctcttttgcaccccacaggccaagccagccagatggacagtgtttctctggctgtgtggcccagagcgggcagcccctaaggaggccaggagccccgcctcactctgccgtgcacgggaggacagtcagcaagggctcggctctcctcacaaatctgcgagtaccctgctgccagctttgtggctactgaaggatgagagagagtggagaagggggtcaatgtgcaggtgcagtgcctggactggtctggaagccctggccaggcccacacctggagcagccctctccagagatgcaggaacagggcttgcaaagaccttgggcgctgaggcttcgcaggggcactggtgtagaagccagagagccagggccccgggcagcccacctggggagcacacagagctgctggcagatcccagcaccccccagcttcctgactgaaaccgaggtggtgggagcgcccctgccctggctgcaatgaggagtcagtgagcactggcagtgcctgttctacagcgagggccccaccacaagcctctccaatgctgcagagccctgtcaggaggcctggggacaggcatccagcgtgtgagcaggaagccagagctgagccaggctggcttggcgtggacctggcggagcctcctgggtgccagccgccacatgcccatcccagcctctgccctcgggaagccagaagtcacaggagagacccttgtgggcggtggtctgtgctccgtccccactgcccactctggtccctcggctggcacagctggctctgtccgtctcccacccttctctccatgtcctgcctcctgctcagagctcatagcacagtctctccccacccttcccctgcaatactgcttctgcttggccacagctgactttatccctctcctagcccagggcactggccatgtgctcccctgcccactgtggcccagtgcccccaaatgtggggcaaaccgcacctctctggaccctctgcccacgaggggctcttcccgccagaccagttgcacaccacgaacagtgctggcacgtctgcctgttgggtaagtggctcggggacatctgcttggaatggggcatccgcgtggacaaatgagtgaggagcccaagcctgcactgggcaggggcagcaccgaggctggcacagggaggcccagttcatcccaaatgaggagggacccaggactgggcacagtctctgtctggggagtggttcccgccagccaggcggcctcctgtctgacctgacctggcccttgcttccagggacggctgacagtaagcttgtaattactgctgctcctcaagacgacatctgtccctaccacatggcttggggggcaggtgtggggcggccccgtacctgcctcaactccagccagcaacatggagggtggaggacgacggggcccatggccaggttggtgggctccagttcctcctcgggaaagtctgaagtccgctgttgtctggggcctacactgactgtcccacacccatatcaggtgagacccagagacccagagccaacaggccctgacccacgacccagcaatgcgctccagaccacaggcgctccgtgaggccagtggctgccacccagctgagtagggagggaactgccactcggccccagcgttcccagcctgccctgtccagcaggtgcctggaagagctaggagaatgctcatcagcacctgccccgccccaggccaaggcgcctgtgagcagagccccgagctgtgtggtggctgggtcccgagacccccacaggtgccctgcagcatagctgtcacccggtggccacacagggccatcctagcaagcttccttgtcagctgtgacacacaggtcacctgtgggtgcgtgtctgacaggacagagtctctcaggtactgtctggagcctcctttcattctttcctctgggctgtggccctgtaagatgctttcaactgcaaataatgtgcaagagtcacatcttcagtgtgtgaatcaacagaatcctaaatcttctaggcaccatcttgcagtacgcactacgaatccctacttggaatttctcagagccttaggttcgggtttggtggtcgccctgtggcagggttcggggctgctgtgtgtcccatgtgacctgtatgtccgttacctgaggcgctgtctacaatctcattgtccctgctgggcaggactggggcgggagggatgaaggccctggggctctgtcgcagccgcaccagtgtcaccctggcgatgggaggcagggccttcagccgcgggtagtagaaggagttggccgggtggctgggagaggaggacgttatctggggaggaagaagaggaggttggcctggggtccgagaagcccaccttctggtatgcgtatggcctcactggggccactgcccagcgtccagcgtgccctctgcaccactgttggggacagggtcccatgtactcctctcagccatcccacggaacacgggctggaaaccgaggccaggaaggggcagcctcctcgggacgcgcgtcccgctgtcctccctgcggtgctgtgaccccgggttgggagagtatgggagggctgcacccccttgctcactgctggcgctagaagcagagcctcttccacacaaaagccgcaagcggctgtcctgggctgggaggcgagggtgcagccaggccccagccccgtccccaccgcgggggccatagcggcccttgcgcacgcggggtgcccactcacctcggtcaccgtgtcctgcgggatggtggcgaagttgggggaggagaaggtgaagccgctgtccgtcccggcgtcgtaggggtacaggtccagcgccgcctgttcccgccaacggtccccgtcgcacaggtccaggctgtccacgcccacgaaccagtcggggctgggcacgatgcgcaccacaaacgagacctgcggcgacagcggctcagcgcgcctggccccggccccccggaccccgcccccggccggccccgcgctcaccagcgagtgcctgcgctgcacctccagctccgccgacgtctgcccggtgccgctggggacggcgggcgccgaaaacaccgcgtgcacgctctgcagcgcctcccccgccgcctcgatctccttcatcagcgcccaggcctcgccgcgctccgcaaagtcgcgcagcccgttactgacgtactggttcttcctccacatgctgtagtcggagctatgcgcggcccctgcaggaccacccggccgcgccgcggaccatggtcagacactgcggtcgggcttggattccagggggcgccccaggaaatccctccccgccgcccgcagggaaccatggcccccagtcacgtcggaccgtgacaccctgtggctgcccctgccgcgacccacctgcgccctccccgtgagcgccccctgcccccaccgcatccccggaaccgcacaccgcaggcgctcggcaaacattctggtgttagagtctcccgacgtcagcacgccccagactgggaagcgccgccgtgcagctgtgcggggggctccggcgccgcagccctcctggtggagcaggaggcgaggagggggctgtacttacccagcagcgaagaccactgcgcaggggggcggaacagggggtactgcttggggaaggccgtctggctccacttgcccgtgaaggtgatgctgtatttggccagggctctggcggaacagatggactctcccccaagaggctggccggcggcgccgagagtggccaggaggagagcgcagagggccttgcccagggcggcggccgggctggggttttccatcacctgggagcacagaggggagcagccgcgcgctggcaccgtcgtggcagcctcggggtggaaagccgagagggctgcggcactttgggctctgaggacggccccgagcacccgcgaccccctccctgctccgcaaagctctcctgcggtgcttccgagacccccatcagcggaatggacggcgcggggttagatcgcccgtgcgcctgcgagcgaccaggggtaacgggcaggttttcagtccgagtccctgcagcttgccgggccggtctgggtgcggcctccgggatgccttcgccgtcgcagggacccggggccttggccgactggctgcccccgggactagacccttaaagctcggtcgcagccagtcctgggggtccctctggaggtgccacaaggttctgggccgcggggaaagtgcaggaggcccgggccctctctgggtgtcccgggggcacgcagtactcacccggcaggagcagcgggagcgcggccggcagcggtcgggtcccagccagagcccggagctcctatttaagcccgaggccggcgccccgggccggccaatgaggctccagttcctcctgtcttcgatgctgcacggcctggcctccagcgagaggcagataggacgtgggagaaaggaggagaaggggctgcgggggcggcgggggctgccgctttcccaactcgccctgcccagcgaccttccccgggtcggatcaccctcttcccctggcagtgctgccgcacccctttctttgtctgtctgtcctatccctcccctcccctccctgtcccctcccttcccctcccctcccctcctcccctcccctcctcccctcccctcctcccctcccccctgtcctcctccctctccccgtttctctcccgttccaacaagcgccttcctggtgcctccctaggtgccactgaggggagttctttgccccaagcctttcgggaaagctcagggcgtgggggcagaggggctcttgttttcaccttctcgaaattagagccagcgtgctacaccttcttgcgcagggtgtgacctggagagccctgtgcgtggcctgacttcagtctacatgctggaagtggctggggaagctcctggctcccggcgcaggcatccctggcctttggggccctggctttaagtctctttcctggcatggcctaaagctgcacagaacagcctagcggtctgcactgtggccagagggcatttgcaagccatccctcctggagggaggtcagagtgggctgagggtctggggtggaacgcgcagggagtcaggaagagccacagaaagggggcccccctccccaggaccccgcacagggctggggctgcaggccggcggtgtgtgcggtgcagagccctcccaggggctctaggcttccctgcctttgggatgaagctaacagatgctgaagttgatcctgctccatgtcaggaaaatatttataggtccccagtcatgggatctggaaacagagcggaggaaggagctcgggaatggtcttgctcaatccttcccggcctctgctcatcggaatcacccagagggcttttaagcttagacaaaacactctgatgtttggaaccctgttaatgtttcacagattcaaaaagagagaaaaaataaatagaagcaactaggacagaatgcaaacagaaacaaatgatctaacctgtattttaagcgaaaaccacagatcagccactcaatgcagtatttagactccaggcccccaggccaaagacaaatttccacctccgtgcttctcaaatgtttttatctgaggactccttcatactcttaaaggtcactgagggccaggcgcagtggctcatgcctgtaatcccagcactttgggaggccgaggcgggaggatcacttgagcccagagtttgataccagccttggcaacacagggagacctcatctctacaaaacatacaaaaattagctgggtgtggtggagtgcgcctgtggtctcaactagtcaggagactgtgtctgtggtcccggctactcaggagactgaggtgggaggatcacctgagccaggggaggtcaagcctgcagtgaactgtgtgtgccactgccctccagcctgggcgacagagtgagactcatgcctgtaatcccagcactttgggaggccagggcgggcggatcacttgaggtcaggaactcgagaccagcctggccaacatggtgaagccccatctgtactaaaaatacaaaaactagctggatgtggtggtgcacgccagtaatcccagccactcagaaggctgaggcaggagaatttcttgaacccagggggcaggggttgtagtgagccaagatcgcgccactgcagtccagcctgggcaacagagcgagactccatctcaaaaaaaaaaaaaaaacaaaaaaacaaaaaacaaaaacaaaaaaaactaattgaggacactgaagaacttttttgtttgtatgggttatacctatggatacttatcattttctaaatcataacagaaatgttcagaatacttgccaattcacttaaaaataagaaaatattgctattacacattaacataaatagcataatgttttatgaaaagcaatcatacttttaaaaatgaaaaacccgcctgagaaaagtggcgtggttctacgttggtgcgaatctttgtattgtccggcttagtggaagctggattcccatatcggctccagcacttcatctgctgagatgtgctgttggttgaagtctatgaagaaaatccagccttggctgcgtatgttaccagccttgtcaggtgcctgctctggcctgcagccctcgaaagccgccgtgtgcccatcagagcatgggagcaaaaggtgccctcatgcaatgggcttcgatctcatcatctgcctggaaggatctcaggccctccacgagtccccagagcaggactggcagccgctgctcagaggctggactcgaatccacaggcctttttcccagagcggcatggggcggctgtactgcagctactctgcatccctggacaatcctcgctttctggacagcttcctcggctgaaaggagcacaggctccatggcaaagctactggctctgggtctgaggagaggaaggaggcgccgggtctggggcatgttcctgtgtaggaagccagggtgccgctccagagactcgctgaggcacagtccccatctcagtccagctctggccgtggcagcggcttccaggctcacccagtctcacaggaggccaaggaggctgcggaacagcccaggggcagcaggagctgttctcccagcccggccctcatgccgtctcagtgagctctgcgacctggggcccccacttggcggtgggcccaggctggggggtctccagctaggatgtagggcggtggtgggcccaggctggggggtctccagctaggatgtgggtggtggtgggcccaggctgtgtggggggagtctccagctaagatatagggtggtggtgggccctggcctgggtgggggttctccagctaggatgtgggtggtagtaggcccaggcctcgggggcttcagctaggatgtgggtggtggtaggcccaggcctggggatctccagctaggatgtagggtagtggtgggcccaggcctcgggggcttcagctaggatgtagggcagtggtgggcctaggcctgggggtctctagctaggatgtggggtggtggtagaccgaggccttggaggtgctccaggcagggccacagctgatttgtctgggaagggagggggcttgtttggagggctggagtagacagcagccaggaggaacttcctttggtagtgggaggcccctccaaaagcacgcctgcgaaggccctagggcaccaggggacatgggagcattctttgctgtgctcagagagggggacatgggagaactggggccaggtgggcttaattttctggatcctgtggccccttgggttggatcgggctggggtctcaggcagagctgtttctgcactgaggcagggactgcaggccagtgacggagtgatcttgtgtgactccatgctctcagagtcttgctggaaacccccctggctctcagaccctcttctgtgaaccagaagtctctatcctgccttctgctgagggtcacaggataagtatccataggtgtaactcacacaccagcactttgcaaggtgtccccccacccacacagaagagttcctctgtgcccgcaggcaggagcagccccccacatacacacacagtacattcattcattcactcacacagtactttcattcatccacccattcaaatagtacattcattcattcactcactcacacagtacattcattcatccattcacacagtacattcatgcaatcatccacacagtacattgattcacacagtacattcattcactaattcactcacacagtacattcattcaagcatccattcacacagtacattcaatcatccattcacacagtacattcatgcagtcatccacacagtacattcattcactaattcactcacacagtacattcattcaatcatccattcacacagtacattcatgcaatcatccacacagtacattgattcacacagtacattcatgcactaattcactcacacagtacattcattcaatcatccattcatacagtacattcatgcaatcatccacagttcattcattcattcacacagttcattcacacacttcattcattcattcacacacttcattcattcattcacaccattcattcattcattaaccacaaggtgagtattccttgcatctcagagatggggacaaaggagtgaccccactaggcccaaggttgcagggggctggggtggagtggatacattttgtagattggattctcttattcagtaaagtgtttagtgaattggttgacagcaatgccagggtcctctgaggacagggccttcctggaggtcacttgagccacttgccccaaggtggttttcaggagagtgtggctcaaggctgtggctggagccagtggctgctgcctgtctgcagctgggcagagcagcccctgtgtccacatccagctccacctggctgccctgccacggccccagcaggcacccccttgtctttgacacccccttagtgcctgctgtggttgggtaagtgtagaccacagtgtgagtaatcagcgcccacactcccagggtgttggcaatgtttaaaagttgtcttaaccaaaatgtgttgctaaggttggacttttggacaaccgcaggtgctgtgaagctcctttcccagtcaggcatcgggggtggagtctgtgctgcttaaattggatctgagcaggcgggtgtggggtttccatgggtttgtttgtgagccgcgtggagcagacggcatacaggaatgcctggcgagcctcccctaactgccaccctgctctgtttcgcctcaggctgtggccctgccccgggccccagaacccaagatcccttcagggggcaggggtcccagctgagaagggagaggccttctttacctttctgcatgggttctggcatgggggccctcagggtctggcatgtcaacggctctttcagggcttgcccacagcccctccctggggcgcggcacaggcacccaggcctggcccagcagcatggagctcctggccacatctgctgacaccacaccagctgactcagacgcggagtacccacccacgggagcggccgtctcctccagagcacccagactccaggatcagtttctggctcccccaagggaccctgctgcgcatttgaaaacccacctgaaaagtcctgtgtttgccagcccacccagacacatcacacttgcttgtccactcacggacatgtaccaagggcctcgctccggccaggcaccacgggctctgcacacactgagggcctccctccggccagacaccacgggctctgcacacaccgagggcctccctccggccagacaccacgggctctgcacacaccgagggcctccctccggccaggcaccacgggctctgcacacaccgagggcctccctccggccaggcaccacgggctctgcacacaccgagggcctccctccggccaggcaccatgggctctgcacacaccaagggctttgctccggccaggcaccatgggctctgcacatatctgctttctaaaggctactttagcccttgagacttcagactcgcagggatggggccacatggtccagtggttctcctggccccctccccctccctcatcttcagactcgaagggatggggccacatggtccagtggctcttcccgccccactctcctctgtccctcctcttcagcacccgctgacttcctccctggccaagacacccctggctgctcacacctcagggcctttgcacgtgcagctctccctacctaaaggattcttcctgtgctgccttcttcctgccatacaggcctcagggagaacagctgcaggccccaccccccacccccagaggagtgcctggtcatactctgtcatgccagggtttttttttcaatcagagctcctacagagaactaagcctaccataaccagtgtgagcagacagggatttactatgggggctaagtggcttatagaattgtgaggagggttgaagagagactgtggactgagtgtccaagggtgacctcccacactgcacagcaggacggggctgcggagtggcagctggtcccccctgtgcaggaacccgccaccccagcagcagatggccacgtgctcctgtgtccctcttgcccacatgcctccattctggattcaggtttctctgagcacttccgattgattggcagagcctgaatcaggtcagggaatccagagtcttggattcagctttgcagcctctgcagtccaggaggacacccagaaggaggatgtgaatcgtgccagtgagctgagctgcagcccacacagtgctcatccccctgctcttctctgacttatttagctgacgctgagtggggaccttgcccggctgcttcacctctggaagcacgactgcagccaccatgccaggctcacgggagggccagcaaacacagcactcactcttatcaggtttcacagtggctcttccagtcccaccttgcaaaggaggccaggtcactgctggcgagccacagatctgggaggagaatctgctgctactatctggttctaaatactgttttttctcctctgtgcaacagtccgcctccctcgaatatgagcctatccattttcagtgacacttgccatagtacctttttctatccacgttaagatgtcaagactgcagcaaaaagggcagcataaggacctctgagaattctcatcttcctccaagcagtgaggaaactggcaaaaaatgtcagaatacattttaagtactctggaaattaaccaaaggcgtgcagcaatctatgtagggttattttattttatcgataaaataggctgaatcttggtaagaacagcatgcattcccacccaccccctccagctctgtagtagccttaaaaattaacaacctacatttgtgataaaaactaacagcctgagctggagctctttcaaagcctcatttccagaaagtcattattatttgacctatctggtggttccctagaagacaccacttgcaaagctgtctgtttctgacttgattcagagcttacccagcatgaaaagacttctcctggggctattgttgaaaataataattataggcaattgatgaactttgcagttgcccaaggtggtggctaacagttgggcaagaaatagacaaactgaaaaaaaaaaggaaaatctgggaagtgagatgtcaatggggagctttgaaaaaatccaacctatttctgagaatctagaaggccacacatattcccaggtctgagctccagaaatacctcagaaggcactgagctcatacttctgactgaccttcaggctctatgcaagcaggaagtgagggctactgcagagttgttaactgcccgactgagtgttgaaagcattctctaatgcatagaacctcaaaacaaaaactgggagatgactggttctgggcctttaaggaaatctctgtctggccattaactgaccactaagctaactgaggagagacttagtggccacacatggtagataatacagattttgcataattaattcagaaaagttaataataaactacaacaaactctgggggaatggaggtgtatctggtttctggagttgccacattatactatttaaaatgttcatttttcaacaaaaaattgtgagatgtgagaaagcacaagaaagtatgacctacacatggggaagaaagcaatcgatagagactgtcattgaggaagacaagatgctggatgtaccagacaaatactttaaatttatggtcttaaatatcttccaagaacaaaggaaaacttttctaaataatttaaagtataagagtgatgttttaccacatagagaatatcagtaaaggacagaaattatagagaaccaagtagaaattctggagttgaaaagtacaataactgaatttaaactctcactagaggatttcaacagaagatttgagcaggtagtgtaaagtgtaagtaaaaaaggaaataggtaaattgaaagtatccagcttgaggaaaaaagaatgaagagaactgaccagtgactcagagacctgtgtgacatcatcaaacatacaaacaaatgcaaatgcataactgaagccccagaaagggaggagggagataaaggggcagaaaattatttgatgaaataatagctgacacttcccaaagataaagaaaaatgtttatctacacatccaataagctcaaccaattccaagtagggaacatgcaaagagatagccgcactgacacacatcattatcaaaccgtcaaagccaaggacaaagagagaatcttgaaggcatcaagagagaagcaactcatctcatacaggagatccttagttaggttaacacctgactttttaccagaaaacatggaggccagtaggcagttgggtgacatattaaacacattggaaaaaaaaatactatcaaccaagaagtttatatctgaaaaaataaaggtgaaattaagacattctcaggtaaatcaaaaccagagtctatcactaggaaatctgtcctacaagaaatactaatgagagtaccttagactgaaatgaaagaacacaagacagtaactcaaaaccacatgaagaaacaaagagcactggtaaaggcagtgacatggggacctagaaaagacattctaggaagattctgggaagatggtggagcaataagcaccagaaatatgtttccctacccagacaacaattgcactggcagaatctgtctgatgtaacagttttggagctctggagtctattggattgcagcttccaggagtaggtttggaggcaaaatgcagttaattttggcacaacagcagtcacccatcctccccaccagccccagcgcagacagttatgcacatgttcctgtagcagtttacagacagctttcaggagcgaggctggcaagaaaaaaggatgttgtccttcagatatttgggattggtgttctgattgctgattgctgttctgatcacaagagtgcaaagaagcaggtgcctattgtttcaccttcccccattgttgcaagctctcctgcactggatgaagtgacttcatttttctccttttccctttttggaagccagacattaaagactaggacattcaaaagcagctgcatgtatggagaaagttagaaagtgatatggcacatacaggctcagaaaagacctgagaagaccttatgtttgtacctaacgctgacccttggcacagagaaagcctacaacaacaacaaaatgtaacaaaaagcaacaaaccccagggaagggggaaacatgattttcaaaattgtgatattagattcaaatgtccgattttcaagaaaaagaatcacaaggcatacaaagaaacaggaaagtatggcccatttaaagaaaaaaagtcaatagaaactgttcctaaaaagacctgattgattatatatctactagacaaagactttaaaacaactgtcttaaagatgctcaaaggactaaaggaagtgtcaagaaagtcaacaaaaaaatgaatgaccaaaattgaaatattcataaaaagatataaaacctaaaaagaaaccaaaaagaaattctgaaggtgaaaagtataatcatggaaatgaaaattcactagagggattaaaaagcagatttgagcaggcagaagaaagaatcagagaacttgaagacaggacaatggaaattattgtctgaggaacacaaagaaaaaatattgaagaaaaatgaacaaagcctaagaaacctgtgggacaccataaaacagggcaacatatgcattgggggagaagagagactgaaagagtcaggagaacatttgaagaaataatagtttaaaattttccaaatctgatgaaagacatgtatataaacatctaagctcaacaaactccaggtaagatgaactcaaagaacccacaccaagatacatcaaacttttggaagacagataaaaagacaga

SEQ ID NO: 1185 - DNA, 27728 bp, Homo sapiens
gtcaaggctggggtcacagagctatgctgagggtgcagggccagagggtagtgcagggcttgggtccaggcctagggtgacagctgctactgtctcatctccaggcctgcacccccatgttccgggagtactccctgcaggttctgaagaatgctcgggccatggcagatgccctgctagagcgaggctactcactggtatcaggtaagccagcaggtgatgggtgagggcctctgtagcttcaggcagaggcccaggactcaccactccccatttcttacccaccttaggtggtactgacaaccacctggtgctggtggacctgcggcccaagggcctggatggagctcgggctgagcgggtgctagagcttgtatccatcactgccaacaagaacacctgtcctggagaccgaagtgccatcacaccgggcggcctgcggcttggtgagacctggggtttgaggagggaaggggctcccatgctggatgactgccaggtgaccttgggctatgctcatccctccccttgtgcctcgttccaggggccccagccttaacttctcgacagttccgtgaggatgacttccggagagttgtggactttatagatgaaggggtcaacattggcttagaggtgaagagcaagactggtgagtgagcaagaaggagccccgggccagccagttcccactcactgtctgctccctcccccagctgatctcactgccttccctagagctctgaccacttgtttcctcaccctctctctctagccaagctccaggatttcaaatccttcctgcttaaggactcagaaacaagtcagcgtctggccaacctcaggcaacgggtggagcagtttgccagggccttccccatgcctggttttgatgagcattgaaggcacctgggaaatgaggcccacagactcaaagttactctccttccccctacctgggccagtgaaatagaaagcctttctattttttggtgcgggagggaagacctctcacttagggcaagagccaggtatagtctcccttcccagaatttgtaactgagaagatcttttctttttcctttttttggtaacaagacttagaaggagggcccaggcactttctgtttgaacccctgtcatgatcacagtgtcagagacgcgtcctctttcttggggaagttgaggagtgcccttcagagccagtagcaggcaggggtgggtaggcaccctccttcctgtttttatctaataaaatgctaacctgccctgagtttccattactgtgggtggggttcccctgggccaaacagtgatttgtctccctcaatgtgtacaccgctccgctcccaccaccgctaccacaaggacccccggggctgcagcctcctctttctgtctctgatcagagccgacaccagacgtgattagcaggcgcagcaaattcaatttgttaaatgaaattgtattttgcccacggctgcttctgtttgatccctggggacagaggggagcaagggaggggagtggcagggggaggcccaggtgtggggctggagggggtactggcggcagcgggaggcagtaggcttgggcaggggaggagtgcgctgcgcctcaggaggcaaaggtgccccagcctgggcaggccctggaccagcccaagctgagcagcgccgcccctgggctggctctcagagcctgggctaacgtggagcccgccacgtcgcttggcactcagaggcccctgcttcttgttggctcacgtaggccacgctcaacacgtagcctgtgccacacccttcgaggcccgggtaggagggcagaggggctggtctgggctcttggtggacccctgctggtgctgcctgcctcctcctcccccacgtgggactcaagccaagggtcagaggcgcttccgctgctgggagcaagggaggagagtaggggtggagcagcctcccctctgcgtgggaacccggcctgtgtaagcagtagcgggacagggtggccggagtgatgccttggggcctgcggggaggagtggaagaagtggatgggctggctggctgtggcttgcatggcactggcagcccagcctggcttagaagtctggccggtccttcttcagcttcttatagtcagtggaaactgcaaggaactaagaggagagggaaagggggttgcgctgagtaccccaagcctccctttgcttctagtacgggagttgtgggtgccaggaccaggagataagaggatggggggcaaccctagagccatcgagaggtaccttgtattggtcattggggctcaggcggttccagggctccgggttgttctttctgtcccagctgtggagcaggaggggggagggttagggtctcctccctgggacccagaactctgtaacccaatttgacccccaagctccacccggaggctctggccccaccccagtacccctgcctcctgccctgggggtcccatttcccagatactgacaaaggaacggtcatattagcaggtgctgacaagtgagacaagaagcctgtcaccattgtcagcatggggctgcgtgacaaactgacaacggggcccagggactcccacttgctgcctgccaccctaggttaaccctaagagcagagtcgtgggaatcagacacagatcccaaggggctgggtttctggtgatgtgccgggaattataaagccatgggtgcgcctttcacttccggaccctctccgcggccgggtgtgaaatctccgccccacactggtccccaatgccacccccagcagctcacccggccacaaccccagtgctctggtgaggacttagaggtacccaaaagcccaagcccaccgctggctgagcggcgtcgtcatggcaacccggccgggagaggcgcgggttccgcatttcagggcgggccaagctgaggagtgagcggccaggtgggctggaggggatacgggggtctcccaggtcagcagtgggctccagccctgagatgccggtcggtacagtcgaaggtgcatgcagcagggcacgggatccccactagggccgcctatttccaccccatcttgcctcacccaggcccccgtgagcatcccaagccgtgcctttaccagacgtcggggctgcgaagggcgagtcgcagcaagtaaagcgcagcgctgcccatgcccaggcagattaagccgatcatcgggatgatctgcggggaagagggagagcacttttggggtcagccctctccccgcagttcccagtcaccctttacaagcttttctgcccaccccaaccccaccccgggtctggtgctccctccctggaatctcctacaaccatatttcctggcatggtctccctcaccctacagcgatcgtgtccaaggtagtagatttgtgggacacagggacgtttcggagagagactggggcaaccttaggggaagaataggagcgctgagggacctgggcacaaggcaaggcattgggggatttggagggtggggcagcaggagagttaggagttagaggttctgaggttctgaggactcacccccggatgtcttttgatctgccggtagaagcgggccccaagactggctcctgccatatcgttgttttcccagtctggtcctctgcagtggctctgtcctctccctcctcctggggtcccgcccctgagtggggagggatcagcccagcccagagcagcttagcttggcccagcccgtgcttctttggactcaccccaccccaacttagctcactttctcctcaattccaggcccaaagcctgtaggggaattgtctgggagccaagtggtttctgctctccgactctctcctccagatgtctgcacctggaccaagggacaccatcattcttggggcttctggcatctgagggaaggacctcagtggcataggaccccataagatgtgggaggaggcatggccatgggacaggcacttagcaaaatgcatgtgtggaatgttcacaggtgggaccaggaggggctaaggccagtgagggcatgtgcagcacttccctgacacccttagagctgtccaggagcgggtcctgagaaccctggttctgtcccctccacagtgtagtgggggaaggaggaagacaggcccacaccgtaaagctcccccagcccctcttgttctgagtggtttcttcaggttgtggttggactggaattgcggttggaggctggaagaaccaggtgtatgttaatcatggctcaggatagaatacgccagtttatttattctaccacagtcatggcagtgaggcttgagagacttgcttgctctgcctacctggggtagggtaaaggtggggccgcccaaggaggccatccacttcctctggctgtgggatggataggaagggaatggagtgggggaaacaggaaagatcggacagatgctgaaagagaacaagacacagacacagaaatgcaagcgattccctcctgtcctcaaccatctcaggtgtgtgctgtgctgctggggtggggaggctcacagcccccgtctctggggaatttgggtcttagggacgtaggaaccgagtcctaatatctctccccactcccacgataacctccaccaccccctccctcctcgcagccgatcctgcagagcacctccccctccagagcccgccctgtggagggcgcgggcgggagcgagctatgcacccgtctctgggatcgtcggggtacagggagggagagggcgctttctagggtccgcctccctttccttctcgctgatacttccgccgccccctactctgacaagcgcggctgtaattaggctgcggggtcccgggctctccgcctcactccggcggataatgagataaagtgtcagagacacggcgagaacaaagagacagagactcgctgcgatgtgtgtggggggggcgggggagcggggctgacgggctgttagagcctccagcagcccagccctcccgagagcccgcgcctccagggcccaggaagggagggcgtgtcctgtcacccgcgcaccccagccctccagtctctgggaccaaaaaacaatcccagagctcaaactcgagcggccgcacaactgggctgcacatctggttctctgtggcacagctggggagccaggacgccggaaggggcgcctggtccttgcgcctttgctcacaggccctcgcctgcttccttgtgccctttgttctgagttccggtgaccccggccaggtcccaaattctccgtcgcgctccttttccagagccgccgctgtccctccggccttgggcctccgccccgctcaccgagatgcaacgttacattattgcctccgctccgcctctccgccactctctgacccttctcctgcttctggtccctgtctctgtgaatttatttctaagcccccttccatctttggttcccgtctctggctcgtggcccatggggccgatctggaatacaggactccttgggttccggatcccatctctcctcgctccccacactttcccaccacgaggactcaggccacgctggcccagcggggtgagggaccgcaggagtcattagccgcagattaggcacggcccgggatcccgctgggactggactccaagcgctaacccgcaccaggatcccaatccgcgcgctggctgcacagagggtcaaaggcagcgggactcagcggatcgagcgtgttgcaggggccgtgggctcgggcgccccctggaggccgagcggcccccaagctcggggaagaggccttgggcaccccctgtcgggcagtgtcgaccctgcactcccggcgttcgggccgctaagttggtgcctggagtgtccgtccacgcccagcccgtcactccgccactcccgcctccaagacagtgggtcctgcagcctccactcttctggtgtgagatgggaccggagggcggagaggggacgcggaagctcctatctctccagccacaatcggcacccagggttcaggcgggttcctcttctggggttgggcatcctcagatgcctgggggccggggaggcgggggcttcatctctgcttctgggctgcagattcgagattgccctaagccctctgacccggcctgtcctagcctctggctgcccttctttctgcctcttgttctttctgccttctgtctgcttcctgtctctgggtatgtccatctctctcttccctattctggctgtgtctgtctgctctccctcttgctgccttccctacctggctttgtccctctgcatcggtttttctgtgtctctttgtgtctcgctccctccctccacatctctccatctcactgtgtctctctttactaatgcctctctttgtctctgtctttatctctgtctctccccaaccccactccccagctctattcctattctctgggttgctgcctctggggactgaagcagcccaacagggcagcccggagacgcctcggggcactgcccggggtcctcatcctggtcacctccacatgcccgtcaactccgcgcagcgttgatcttcccgctgcggctgtgggacgtggaggggcgcccggaaaggaagacacagggcccagcatctgctcgggagccccggggcccctgacccccctctgccattattaagggcgcctggtcccgaggcaccgagatgatcatgattgcatcagccagacagaagcggagccgggagctgcgcggtgagcgaacgagtgagacaaagccgcccgcgccatctgtttatgcaaagcgctctccgccggggaccccggcgtcccggctcctggccgggcttggggcaagggtcataagcccattcccacccggcgcccccaccgcgccttggcttcccctctcctcagcacccagagggccgctgggcgagcggaacggaaagggggcgggggtgttgatgtgattggagcggacgcggctgtttcttcaataatggatggagatgatgcggatggcgaagccgagctggccgggagaggagagaggaatagaaatggggaaaggaaggagtgggggcgggagactcaccccggcgcgcgcacacacacactcgcgcgcgcacgtgcgtcacactgtcattcggatacacgccgccgcgcggctcacacccaggcacacgcctacgcactgtcactgagacacacatacctgcaggcggagacgcgatggcaacacacactccccgctggctcttcctgattttcacacatacacagacctgcaggcggagacgcacggaaacgcccccacgcggaggcacacccgggcaaaatcacccagatgggagctggggacggggaagtggacaaacccgacagatatagacacactcaggggcacagacacacacccgggcacagagtcggacacacctggggctcaggtagacacacctcacatacccagggaacaaacggacacacactaaccacacgccggagatacagacgtccataattgccaggggcacggagagcccacccacacccactcagaggctagcacaccttagcatatgcaggagttgccatctgtgccctgcggggtggaatgtggcagggaggtcgtcagggtctccggagcaggccttgttagcctagcagtatgatgaggtcttggtgacaggaggcgcctggggctgtggactaggaggcccgtgcaccagggcttagctgtctgcaagcttccttgactggcccctagggcgggtagcgccgacgttgggctgcccctgagcagcagaccgggcggaccccactgacccaaatcgggcagtttcgtggagggagagcctaaagggaacactggagctgcaccgagagattctcaggatccccaacactgctgctggtggggtttatagaaagggtcactctgtactctgccttttccccccgtgctgcccagtcttccaacttcaaggggcacgtgtgtgtgtgtgtgcgcgcgcgcgcgcgctgagtagagtgggcagtggaggaggttggggtgccggttgtcttgtaccccagtaccggcccttcctcggatctgttttcaattcagtctgctccttggcccagacttatgacctttgcagcatgcggcagtatcatccatcacccaggcgccgtttagggggatggagggcgctgggagctcacatagggtcgctgtcacgcctgccgccctctctggggacctgctctccggcccgcgggccagggcttaagagtcttggtgagtaatgacgggagggtgtgaccgtggggctcgatcgggacactgggtcacatgtccccacccctggtaccctagcacccctccttctagttcagcacagcctgtttccccgcttttcccgccccccttctctcgggccctttgcttaatttcctattaactgctgataaatccaattaaaccgccgctctaattagggacagctgccggctcagtgaggctagggaggggggcgccccccgagtgttgggggagaacagccgctctccctgcttctcggcatccgcacaccagcattgccgcccaatgagccagtaaattggttttgccttagcattggcgggggtctctcgaggatctcggggggctctgattttgagtccctcagaccttgatgaatagagacgacccgagccctcgcggtccctcccctcatacattcctggtaggtggatttcaaggaaggataaggacagaatgcttgatttgcgtgtggttggtgtgtgtgtttgcctgtgatctgttcctattccagctcaatcgcgattaaaggggggggtcttctttaatgactccgcccccaccccctcaggcatccgggaccgtcaagggcaaagggaacagaaaactgaacccggttctgcagagtcttcttgtgtgcttccctacccccatcacacctcagccttctggaaggggggcgcgcccgtcccaggcctcctcttccccagcccagctgagcctctgccctccccccgccagcagcagatggtgcccgggctcccgctgccaaccttgctaggcggtgccaacctcggtcctggcagacaacgggcagacgagaagaggagctcctggctggccaagccgaccctcccccacccggcatcgagctcaagaccccccccacacacgcctgccccactccagcgaccaccccagcctgcctctcactgggtccgctctcaggtccccaaactcctcgtctccttctgctcccttccccacaccttcctgctcctcgccacctgccgccctgaccagggccggcgtatttgcatatttgcatatgcaaataataacatttgcatacggtgctccgcaggggtgtctccgcgagagccggttagctgtctgccctccgttctcactcggtacctgtcggaaagggttagggcaggggccgcgcgggtggggttaggcccccggcctagctagctcggttctcggaggacttgaggaagtgttgccatggagacggcacgcaccccaccccctcccaggcccagggtctcgggcttggtgtctctggttgtctccccttacccaccctccaccccctccccatccctcgctctccaaccgagatcttgcatcgccccctggcggcctagctcggcgccaagccagattccgaaatgcaaggggctgcctgcggctaaatcgccaagagcaaggggggacttaccctactacaagatcctgctcccaaccgctggggcgcgggggcggcgactccagccctgcgctcccctttctttactgactacagaggcctcacctggcgggcgcacttcccacctcccgccaacctcagcccagatgggtctcaggttacccgatggtaacgaggcgggacagctagggaggattctccacccctccgcaggccctctcctcaaccccagttaaataacaacttttctaagttttgtcaaaagtttaataaattcgcaacattcgacagttcgccctccctcgcccccgccccccgccccagtccctggctcctcctagtagatacgcgtttttttccagctcttgcaagcggggcctgaaaggtttcgggtccgggctgctctgggcagcaggtatccgaggccccaggctggggaagggggcgagaaccagtcccttcccggaagccccgtcgcgctcaggcgggccttcctacccctcctctcccagcagtcccgttgctttcgcccccctccccaaactccactgggcccgcccagaatggggtgtgggtgtctcccgcttgcaggcgcccgcacgcctaaatttcctctagaaagtcggtgggaaacagccccaccttgcggccggtgtagaccttgacgtagccgcccgcttcgtctcctttctgcaccacgatctagaagattaaaggatcagaagtaggagaggaatcaaaggaaaaggtaggagaggacagcaggggagccggggtttacaggggctcaccctagtcttattaatggttaagctctccaaggagtgtggtgggctagggagcattcaggcctgggattgggttggggcaacagcctacctggtccttcttgagagtgatctgccctatctcgcggttccccacgaaggatctcgtcacgcggtgcacacgttctccagcccggacccgaatgatgaagtttggagggaaaaatccgaccttctccccgattttcccctagggaagatagtagggagagtccatctctcaatgtcgggttctggactcaacccacactccaccctagccctagccatttctctcacccgccaccattcttcattggagtcatcaatgactgtgatcttctctcctggcctgggaggggaagggaggggcctcactcacatagcaggtcccctgctgtgccccgggtccagcatcaataggctccaagccctgagtccccccttttcctttcccttgggggaacccagctctttcctcttcactccgcagtaccagccccctgccccaaggcctctcacgggaaatccagatcgtccttctccagggctttgaaccgatagagagccacaaagtaatgagactgctggaagccaggctgcttgtgctgggggtgcaagggaatgatgagtcttagggctcctctaccccacactgaggggcaggattccaaggcagggacattcaccacacactctacactccaactctcttctaggtccctgaactgagagaagtgttttggtcgtgggtgggtgtgcaagttgatggagagtgtgggtcagaagtgatgggaagcctaggagttaaagagtgagcttctgccagggccatgagtagtggtgtcagagctgggttggggagagaactgggttccttgcagggaggaaggattcttaccttgtcatcaggtgtcttcttctcagccttcttatccccttcagggtttcctgggataggaaacaccaacaaattgtctgtctcctggagggcaattcttattctcttacccttttgtggaagggcctcgtctatccaaagctggcctgccctttgctcctccaccctctgttccacagctgagcctctgatcctactccatctctggatggaggtgggtaacactcaccatcctggggtttgccttcctctggtctggccgactctggctcctcctccatcatggctgctacaggctggagggggcaccagagttagggagacgctgtcttgggaacacatgccctggctgtctataatcaggtcagagaactatagaataatgggatctcagagatctcagagttggaagaggccttggaggaaatatctagttcagccatctgcctaatgcaggaactttttttttttttttgagacgggtctccctccgtcacccaggctggagtgcagtggcgcaatcttggctcagtgccagctccgcctccaggttcacgccattctcctgccacagcctcctgagtagctgggactacaggcgcctgccaccacgcccggctaattttttgtatttttagtagagacggggtttcaccgtgttagccaggatgatctcaatctcctgacctcgtgatccaccagcctcggcctcccaaagtgctgggattacaggcgtgacccactgtgcccggccatgcagggactttccctaaaacatcctatcaggtgggtcacccacattctgcttgaatgtagctaaataacagggaattcactaccagattccaggtccttgactatgctgtcagcctttaaaaatactccagtgtgtaagtaaaaagtgagcagcatggtcaggcgcggtggcttatgcttgtaatcccagcactttgggaggccgaggtgggcggatcacctgaggtcgggagttcgagaccagcctgaccaacatggagaaatctcctctctactaaaaatacaaaattagccaggcatggtggcacatgcctgtaatcccagctactcgggaggctgaggcaggataatcgcttggacccgggaggcagagtttgcggtgagccgagatcgtgccattgcactccagcctgggcaacaagagcgaaactctatctcaaaaaaaaaaaaaaaaaaaaaaagagcagcacaatttttataattcccttaaaagaatataacccaagagtatgttagcccttctggaagcagccatatcacattgctagtgccttacaagtcattaattcactccatagaaatcccttatctgtgtccaacctccatatcaacaagtttgaggccagatttctagttgttttttgcagttgatttttttgatcagatatgtacatttatcttttcttttcccttccttccttcctttccttccttccttccttttttttttttcttgacagggtctcactttctcccccaggctggagtgcagtggcttactgcaacctctgcctcccgggttcaagcgattctcctgcctcagcctcccaagtagctgggattacaagcgagcaccaccacacccggattttttatttttatttttgtatttttagtagagacagggtttcaccacgttggccaggcaggtttcgaactcctgacctcaggtaatctgcccacctcggcctcccaaagtgctgggattacaggcgtgagccaccatgcctggccgagttttgtgcaattttaggggaagacaatccattacttctgtcagctttccaaatgggaaaatgacctgctccatgggatctctgggagggacctcgtggggaggtacagtgctcacatttttcttatctgcctgtcccttcttccgttccttgtttgccatgatcaccccagtgcgcagggtttcaaacacaggatcattgcgattggcagcagctaatcgaatgggaggagaaagaagacattattgggaaggcagagaaaggcttggaggaaaggaagggagaggtgggattgagtagatggatacccatgtgtgtgttgggtggcggtgggggcgccgcggggaagattagggaagggtcagctaggcaatacccaggacaccaatctataaaggactttaaaaacatcactggtgatgtaaagtgagggaggaaagtatttattagaactccttccaggcagagcattatatgatgtttgaaacacaactttgcttgcttgggagctgagacatgcgcagaatcactattctccttctaaggagaatgggcccttaactgctggcttttgttctgctaaatggcatgtgtaagctgaggtgctgccaccaataggttcttctttttcacccatgctcttcacagagttcagcctctcctccaaataaatgttgagcaaatttgtcaatgaatatgtttttaagggttgccaaattattattattattattattattatttttttttttttttttttttttgagacggagtctcgctctgtcacccaggctggagtacagtggcacaatctcggctcactgcaagctccgcctcccgggttcatgccattctcctgcctcagcctctccgagtagctgggactacaggcgcctgccaccacgcccggctaatttttgtgtgtttttagtagagacggggtttcaccgtggtctcgatctcctgacctcgtgatccacccgcctcggcctcccaaagtgctgggattacaaacgtgagccaccgcgcccggcctgggttgccaaattatgaacctgcccagggtgcctgcagcctttgggtcttgccccgagtctgatatgactctgtagtaaggatgaggacaatctagaatccttgttcttgcttagaaatgattttgcacacaaagagcacagattctgaagctagcaactgaagattccagtcttggctctacctcttgctaactgtatgtagttgcaactaaatcgtatctccctctgctgtaaaatggggatattgcctctgcatccaaatggatataaaaatgtgaggttgagggagaattatgggaaacagaaagtttctgtttcagaatttggctcccaaagctagagatggcatgaaaccatctctaggcttgcccattccctcatgttccataaagggcacttacagagatctttgacacaagcgtactgctggttgctgtagagtggggaactataggcccgatggaaaccaggtggctgtaggatgggatgagaggaagcattagaggtagcaaagtaaggtccagaagcctatctctcccaggagtgctcaccctttctcagaaaaagagatgggctgagaaagaaaaagcagagaaatgaatgggatggaggagagaccagcaaggggtagctggctggtgacatgtcccctctttttttttttttttttttgagacggagtctcgctctgtcacccaggctggagtgcagtggcacaatctcggctcactgcaagctccgcctcccgagtttacgccattctcctgcctcagcctcctgagtagctgggactacaggcacctgtcaccacgcccggctaattttttgtatttagagacggggtttcactgtgttagccaggatggtctcgatctcctgacctcgtgatccgcccacctcagcctcccaaagtgctgggattacaggcgtgagccaccacgcgtggccatgtcccctccttgctctccacagcctactcacgatcttgccgaagcatctctgcatttccacataggactgacagtgttcatggatgttggttttgcagttcttacagcgaagcccaaacttgttgttgacttgggaaagggggagaaaattcagataaggttccagattgccctttccctttgtaccactgctgctactcttaggtttccttttctgtctgggaccctacttgctcaatctctaatagcattgccttacaccaactctagccacagcccatctgctacaaatactcctctcctatgccctctccccaaacctctgccttcaatatcatactctcttcacttcccttcatgactcacgaacaatcatccgggcacagacatcacagaactttggcttcttgaagaagtgatctttgaatttgtggggcttatcgttgaccagcttaggaggttctgggggtggctcctcctcctcctcttcttcctcttcctcttcctcatagatgtagtagatgggcccacccccagctcccactgcctccccattggcctggggctctgggggaagttccatctcctttgtccctgtagaacccttcctgagtaactgctttagccgctgtagctgagggagggagtgaagaaaacccaatgttaaaaggacttgtcaccctctctagagtaggggggcgctagagcaaactagacagttttctagtttcaggcaaggaatgtaccccaggattaggggggtattggtattggggactgcaggtgctggccagcaaaaaatgagtcacacacaaatgagatcaatttaagcactcttcttcagctgtaatggcttcccagccccccacacccagtggtcagaggcccagactcaccccactttgccgagtctctgctgggaaggagggcttaggggactccagcacctccttttctgtcatcctgcaagaggttggaccccactatgaaatctaatccctttcattcttctctccctttctgtcccttgcagtagggtggtcctcaaaggggaggctttcggagaaatgtgatgagagattttgctgttgttactgttgagatggggtctcactctgtcacccaggctggagtgcagtggcgtgatcatggctcactgcagcctcgacctcccagcctgaagcgatccccctacctcagcttcctgagtagctggaacacaaggtgcacactacctggctacttttttattttttgtagagacatggtcttgctttgttgcctaggctggtcccgaactagctcaagcaatcttcctgtttcaacctcccaaattgttgagacaggcgtgagccactgcactgggccaaatacagatcctttggcaggttttattaacagatttcatggaggtctagaaaaaagcttaacatggccgggtgtggtggtgcatgcctgtaatcccagcactttgggaggctgaggcaggcggatcactagagatcaggagttcaagactagcctggccaacatggtgaaaccccatctctactaaatatataaaaattagccgggtgtggtggcggacgcctgtaatcccatccactcaggaagctgaggaaggataatcgcttgaacccgggaggcggaggttgcagtgagccgggattgtgccactgccctccagcctgggtgacagagcaagacttcgtctcaaaaaaaaaaaaaaaaaaaaaaaaaaagcccaacagactaaagagcttcccaattagttcctcaaactgatactcatccttccatcctgaggggcgaccccatagtttacagcccttacacagtgttcaaagctgcgtggtttacgtcattttcctataggtactttgtttctcctggaaatctgtgggcaacagagatgtgatgcataccttcccagatctcctctcttcaagaggtttaatgtgtgtcctcgtgtgcacacaaggaaggatggactggagacatttgtcctcccctacttttttcttgagccctgggggccctgtgcctagttctgtcccagcctgcctcagggctcagctattttaagttttcagggtaatatgagcctttccttcccttactacttcattcccttcaccccacccccacccccaccccccgcttcaatccaaactcatcctagagtagaataataattttacgcctaaaacccaaaagactcacagacaaggagagaaatgaagaagctgagtagattatagatcagggcagctggggtgagcagtcgtggaaatcaagaggatgaagaggtaacttacgttcgggattccctaagtcagtccacaggctgtagagggagctgggagcctcgaggccttgatggtggtgctggggaaaaactggtcctcttccttgggggctaagcccccccagtaccccctgtgttcacaccagctacccagtcgctatttgtagacctcctagcctcctgccttggtgtcagggctgaaatgacagggctggaggaaagtggacagctgagaaacacagctgacacagagaaattggacactgagaggtctggggcagggccggaccctaactcctcccaaccccctagagctgctgttccttgattcttcatctaaggcgaacaggtgaataatggctgaattcaggaagggacagtttctgttcatgctcatttaacatttaaggggagtttatttttatttttcatttattttttgagacagggtaaaaaaagactaatttgaactcatagagctctcctatcagccatactagatggcttttttttttttttttttgagacagagtcttgctcttgttgcccaggctggagtgcaatgaagcgatccgggctcactgcaacctcccaggttcaagcgattctcctgcctcagcctcctaagtagctgggattacaggcgcccaccaccacgccaaggtaatttttgtatttttagtacagatggggtttcaccatgttggccaggctggtctcgaacccctgacctcaggtgatccgcctgccttggcctcccaaagtgctaggattacaggtgtgagccaccgtgcatggctagattgctttttatctgtaggtggttggaggagtactttgctatcctgtaagaaagtgaagaatatgtagtattgcttcattccctccagcagctcccagagacatctccccaccctccttcttgtaaaattttgtcctcagactgaagggaattaccagggctattaaaaagggccagttaacactggacagaagcatatagctgccacataaggaattttttaaatcatttctaagtaatgtccccttcctcatgagaactgcaaactcttaaaggtaggatggccaaccctcacacttcctaaacccttttgattccctgattccatctcccacctttgatgcctcagtatataactgatggatcaaagagacagatgccattctcatctcacaggggtgcacccttctactctttgggctgtgacatggatgaaagaggagatactcccatctcaggggagagcaatttagaggtggcaatgcagtgctgctctattccttgtatctgtaagaaataaaggactgtgttggagactgggtcaggcaagctcctgtaggatcgtcgttagggatacagctacttggacccaagagatttccagggcaacgtgctttgtcattctcacccactacttttttctatttaaggggggagtttgaaaagggggtgcaggatggttctgactctgcaggttctttaatggccctgctctgacaggctgcagaacaacagggcttgctttgagatgctctaaaggaaaagctccatcttgcaggcaagatgacttctgctcttcgtcttttttcagccacataggacagggactgctgagcatgtttggataatacagcatcttggcactgcgagttcagttgctgtagctttcattgtaataaaaatctgcttctgtccctgacaggtaaaacccaatcctccagctttaggattaaagaaaggcagccaggcacggtggctcacgcctgtaatcacagcactttggaaggccgaggcgggtggatcacaaggtcaggagttcgagaccagcctggccaacatggtgaaaccccatgtcaactaaaaatacaaaaattagctgggcacgatggggcacagctactcaggaggctgaggcaggagaactgcttgaactcgggaggtggaggttgcagtgagccgagatatcgcgccactgcactccagcctgggcaacagggcgagactccatctcaaaaaaaaaaaaaaaagaaaggcccaagttctccatccctaaagggttttcagaagacgagctgggctgggagtggtggctcatgcctgtaatcccagcactttaggaggccaaggcgggagatcacttgagcccaggagttcaagaccagcctgggcaacatggtaaaaccctgtctctgccaaaaatagcaaaaaaaaaaaaaaaaaagattagccaggcatgctagatcgcgcctgtaatcccagctactcgggagactgaggcacaagaatcgcttgaacacgggaggcggctgcagtcagctgagatctgccactgcactccagcctgggtgacagagcaagaccctatctcaaaactcaactacaagggccctaaatgagtacacagtaccacagaattaatagtctggaaggaaacctagaggtcacctactaagtccaagtctcttattttactgatctggacacagatccagagttgagaagtgatatgctcgatgaaccacagtggcagaaccgggagagcccaaagccatggtcccattagagatctagccatctatcagaaccgtgtacagggaagaggatgagacagagggaatggtgttaaaatagtgtgcgtatgctagagaaagccatcccaacccacgacaaacacctccaacagctgtagggctatacctacccagggcctccaaccctttacccataccagggcggcaacagagaaacagtgactgatgtccagtgacagatttttttttttatatttaaaaacaaaaccaacctccccccaaataacccccaaacaaacaaaaaaacagattaaataaaatttacagtgaatatacccagcaaacatctgtatgtgcaattaaatactgtgtctgttactgcggcacgaacctcaaacaaacaatatacaagtgttctgggggggccaggggaatcccaagttttaactctgtggggtctaggaagacaagatggggaagtgagagaatggggcaatcaattttgtttatcttaattctgtccatataaatatattcataaagaccaaaaaaggaaaggaagcttgggatgttaaggtaataggaggacagtgtgggactttcccaattctacctgaccaaaaaatgagaaattaattttatgataggagaagagatttaaaaaaatgatagaagaggatggaagccaggcacagtggctcacgcctgtaatcccagcactctggaaggccaaggcaggtggatcacctgaggtcaggagtttgaggccagcctggccaacatggtgaaactccgtctctactaaaaatacaaaaattagccgggcatggtggcgcgtgtctgtagtgccagctacttgggaggctgaggcaggagaatcacctgaacccaggagctggaggttgcagttagccaagatcgtgctactgcactccagctggggtgacaagagcgaaactccgtctcaaaaaaaaaaaaaaaaaaaaaaagaagaggatgggaagaagagtgatgcaaggggggtcaaccagggaaaaagagaggacccatggcaggggagcaagaaggagtccaatgccagtgtaggtatctgtgtttccatcttcatcactgtcttaggttccagtttaacatcagtttccttacttcctgcctctgtccatggtctgtcaggatccttcaaccccctccaccctgcccttgctccttctgtgacagtccctttcccctcctccatttattgggagctggctcgctccaggatcctcaggtcatagttctttttggccattcgaagtttgaagcgactcacggagttgttgagacgaagggaggcattttgggcagccagggggctggggaacacagccacaatggtgtacaaggcagcgaggtccgagtggcggccattctcagcagtcccactgttgtcccccccaccccctccaggcagcccctgagcatccttgagccactggatcttggcgccagacatggcgagctgcgtgaagagtttgtccgcctcagtacgggtgatgccctcagggagatctgtcacctccagcacccgccccaggactggaaggggaggagagaggacatggttgtgagaggaataggacaggaaggacttgacagcagcccagcagagaagtgtccagctgactaagtctgtatacaatgtcttcaaaagcctggcctttctctcttagccctttcttcccctccccaccatcccagctctgatcagggcaactaggagaaaaacaaatgaacctttctattctcctagcccagagatacaggaaagaagggacagggaatcagaatcctgggtttctgagctaagaacctatacctcagttctctcacaaggtgctactgctatgaagaaaatgtggcttttgctaatgttctttaacaataatgtatcaatctgaaatatgttccatagttcccttcccactcagaggctggctcaaatagattcttccttcttatcatctcaggaagtcaagtttcccttcctttccttgtttaggaaattgctccaaatcccaagacagatcttgttcacctagtgggaggcttgtaggacgagagtttctcccccatattctctaccaatcttctcctaaactgggtctaggactaccaaaggtagatgtcgtagattagggacaggacactaattagaaaactctttgttaataagaggcaactcccataattgtgttattcccactttttaccatgatcttcctcagaatctgagatggcttggtagggaggactgagatacttcacttctccagtttctgcttgcttttgagcacaaagggtcccacttccactccccatcctaagctggcttttcccacccatgctggactggtaattaagcgctggaagggtgggcaccttctcttggggattcagcatcccgtgactcaccaacatctgctgtccccaggtcagtggaggcagatttgagtgcttgtctcttgccccggtttccatgcttcagtccactctgtcccttcaacatttgaaagacgactctcatcccatgtaaacaacattgactgccttgcatcagaatgtctgcctgagagattgtggagtagcaccaacccagaggaccccaccccactaggcagtcaggttggccatggagcagcgactgagaaacaaagagcccctccctcttggcatgggggtcgggtgggagacatgagtataggaggtagggcaaggctcctgctttgttcattctgtgttatttcccttgtatacccagctggttgaagctcagacacaggcacccaaataagaagaggggtctgatggccctacagttgctggtggacacccttacctggtgcaccgtgtaagttgactggccatggagcaagggagggcagatggacagattgtactgtaatggctggcccaaaagggagtagcgcccatcacctagggagtaagagcaattggttttctgggagcttaagcttcatagtatgacttttataagacttcaaggggctttggagacagcaacaatgcatactattcctaattttctatgatggaaatgcccatgcgactggtataagagttgtttctcttcctaaatcctttggctctcaactgtgtctcacagataaatgggactactaggtcccatcatccttgaagaaaggctctatccactgtagacaacagtcctatgaaaatgaccagggaagaaacttacagacccttatgaatgtcttttatctctctttttttttttttttgagacagagtttcactcgccacccaggctggagtgcaatggcatgatctcggctcactgcaacctctgcctcctgggaagcgattctcctgcttcagcctcccgagtagctgggattacaagcatgtgccaccacgcctggctaatttttttttgtatttttagtagagatggggtttcaccacgttggccaggcagtcttgaactcctgacctcaggtgatccgcctgccccgggctcccaaagtgctgggattacaagcgttagccactgcgcccggctgtcttttatctcttatatagattctcccaacccctaaacccagggttcaagtttctgactcatgtgagaggcagtataagcacagtagacaagagcatagtcgtggagccagactgcctgggttaaaatagtggctctgttactggaaatatgatctaacgttgggtatttttttccctcattaatgttgctggaaaggttaaacaaatataagacatgtaaagcatttatagcaatgcctggtacatattaagtaccattaagtgttacctattattgataaatattacatttcagagcactttaaagtttttaaactacattctcatttttatactgcttgtgacagctaaggcagaaagcagataaaattcccatcttatgtgtgattaaccccattttacagactaggaagtgaggtctacttctgagtttaagtaacttgttgaacatcacaaagctagttagtggtgagactggaacttctgaaaccaaatctagtggttccttttctaagaccataccgtttcttacaaaatcccacattcccagccctcagacttggtactgatattaggttaaactctttggtcattagaaagttcagtgaacttattttctccagctctttttacctacttggttgtaagtactaagtatgtaaagaaggctaaagaaagttaagcatggacagcactagagaggggcaagtgtccaaggcctatacagggatgttaaaggaagagttaactcccagaattggatcatctacactggtcctctgcctgttgttactctttcaatctctgcaattgggaatgggatgtgaaaggtgaattccatagcagccagcactaatctaaccccctaccctgtgctggacccccaggccgggggaactgtgtgaggacaggcaggggactgagtcctgtgcagacactgctgaggctggtgacaggagagggtgctggagactgggtaggagatgtgacagggctgctgctcatttgtgtgttggcctgtggaaaagaggagcacacgtcacataaacatcaaacattaccctctggatattcctatggcttggcttaaaattcacctctctcaggaaataagtttctcttgctgaactctgccaaagtcagactcttccttcaaactgcaacctcagtccttaattcatttatgctattttatttatttatttatttatttatttatttatttatttatttattttgagatggagtcttgctctatcacccagacaggctggagtgcagtggtgcaatcttggctcactgcaacctacacctcctgggttcaagcaattctcctgcctcagccttctgagtagctgggattacaggtgcccaccatcacgcctggctaatttttttattttcagtagagacggggtatcaccacgttggtctcaaactcctgacctcaagtgatcctcccgccttgtcctcccaaagtgctgggattaccggtgtgcgccaccatgcctggcccatttatgttattttaatatccatttctggcatattgatttaagtattctctgagcattttcaagtgtgtatcccacctgccaccttatatattaggttccttaaaagaggatgctgtctacttcctgtgtttctccccagaaagtacccaggaaaagacatgtaaaagaggctgctcagtcaatagcaaacattgcgccccgggaagaatacggtcatctccttgccaagacaaggctgagtgctgcactcacctgggggctgctgtcaggactgtacaggtctccaggcttctgcccccgctggtccatgctgtagtatttacaatgactccactggaccatggatgggttctgagggggctggggtccattagggacattcagctgcatgaccactacacctggtccagaaggtgacactcctgaagggcaggaagaaagcagttggttacaaattccaactgtatttttgccttccaactagccctgagtgggaaagcagcaaataaatccacccattgcctcagggtcactcaagctacgtcttgccaggaacctgagatggctgctgatgtggcttctgactccatcttctcaaaccagtagaagtttgagtggaagggatatgagccccagatgccagtgctcccctggccttcacctggtgaggggtactttggtatgcttggcagaaaactactccattctgtcaacgctggctataaccaaatgcccaggtcagattgctcaaatgtctaggcatggtacgggtccaggtctgggccacaggccagggctgcagacacgtgcaggcttttctggtaatggctatagataaggcagtgacctctggttgttctggagaagataaatccacatagtttcactatgccagacccagaaagtacatcttggccaagaatggggtaagctgggaagcattttaagcatttaagcatggagatgtatgtcatattcaggaactgacaaatgattcaaggtgctaagacacaggggccatataggggaagcagtaggagatgagacacgtttatttaacaaactcttattgaacatttgctatgtgctagttcctatgttgggcactgagtgtacaaaaaacaaggctgtccctgccctgatagaatggacagtctattaaagagtcagacattaaacaaatagttggtgtcagagtttgaagcatattctggtaagatgtttggactttatcctgtaggtgttgggagacctatgctttggagagctaactcaaacggccaaatgtaggatagctagggagagagaccagcagcaagaaagaccagtcaggaagctactgaaggtcgggcacagtggctcatggctgtaatcccggcactttgggaagccgaggcaggtggactgattgagcccaggagttcaagagtagcctgggaaacatggtgaaaccccatctctacagaaaatacaaaaatgagctgggcatggtggcaagcacctgtagtctcagcagctcaggaggctgaggtgagaggatcacttgagcctgggaggtcgaggctgcagtgagccgtgattatgccattgcactccagactgggtgacagaatgagaccctgcctcaaaaaaaaaaaaaaaaaaaaaagcctgctgaaacagaatgaagagatttgaaattagggcaatgccagcaggaatggagtgaaagtcagaccctctgaaggttacactgacaggttcaggtgactgactgaatgcgactttgaggttttggcactggcaaccatggatagactcatcctcccacagggtgggagaagggaaagccttaataaggaggaacattaagacctaaatcttcatggtgaaaagcaaggtaaagagtcagggtcaagcagtttgatggacagtccctgctgggagggatgggctggagctctgcttccccgcaagggattgtctagagtgagggtttattcctgacctcccaggctatattcctgttgaggctgagttcacacgtgggtggtggtggagaaatgggaaatttggggttactagcttgaaaacctgctgcaatgctgctgttttcatggctcgatgctccagggctgccactgctgctgtcatcaaattgcttcctatgacgggaaatgttgcagcctctgccctgggcaccagtcatgctgggaagtgagcgtgattgtttttctcaggtagtatcagtcaaaagaaaggaaaagaaatggtgggaggtctaagagaagctcaggagacagcatctgtcatatcatattccccagaccatttgtacccctgaccctctagggttcatccagtcagagagcacaaatactcagtgcaacaggctcagatatccccatctcctgccaaggtggacagagtattcatgggcataggttgtagtagggccataggaaaactgcacagttgtggagtgtcatgcatttaacaactctccccttactgtagttttgctgggtattttatttccccatcctaagaatcgctcacctgcttcaaca

SEQ ID NO: 1186 - DNA, 224764 bp, Homo sapiens
tttaagttttaccttctaactatctcttgaatcttcccccttctttatgcccacttaatgcagatccttgtcatttctctcctgggttcaaaaaggtaattatttgagtgccccttaagtgtcaggccctgtgctagacactgaggatacagtggtaacagtatttgccttcagagagctcagtcttcacagtaaaggcagacactaaataagaagtcacagcagaacagaggttgctaaactgtggcctggagctaagaatgggttctgcatttttaaagggatataagaaaaaggagagtgatagcgtgtgacccacagagtgcagaatacttgctgtgtggcccttcaccgaaaaaatttgcctattcttgtgacagtgttatgaggaaaataacaaaatccattctctgttatacactcattctgcagaaacactcgatgtatgtgatcctatattttctggtcaccagcactcttcccagtccagtctcttaccattaccatttctcacgtccttgaacctcagccaccttgatctacttccagatctacagattcgtcactctttctcgcggccagggagtggcatgtgctgcagcctgaaaagccactatttcttcccttgctcccttgattcttcatctgactgcctcctgtgtatccttccttactcagctgggggaatcctttcttccagaaaacactccttccttcagtctgagtgaggcagccttctgcagcatcctgtcttccatttagcttagctcttacagccttgtatgaggaattggctttttatttgtctgtgtgctcctcgaggctaggatgggaccatatcttattcacttttgtgtccccattgcctggtacatacctccttcgtgaatgttgaatgaatgaatgaaatgccatatgtattcagaactggaagttcagaagagggacaaataacattttattgggtgtatgaaaatgtgggtccatggttttaagagtcagggaaaagttcatcactatttaaagtgttccttaagtgttacttttcaagggcagaaactgggcagaatgccagagagacacaactagaactttttgagccaacagagacctttgtgtaagttgttagttggatccatcagcctcgctatcctaagcattcttctcttattttactttctaagcacagctgtgttaggactaacccattcacagcctggtcaccaatgttctatcagcatcacagaatactgtctcatggtgtctagcttgatgaacttggttaggatactctctctgttactcagctttgtcatctgtaacatggggactaatacaaggactaaaaccttctattagccattatccttcttgccatctaccccatgttaaagccaggctgatttgttcttggatcttaagtgtgacaaagcctgcgggaaggaaccacattctgaaggtttgtgggctgtgtgagatccagagaacccaagggggtttttttgctcttgacaaacgaatgttaggtatgacctatgatgatacaacttctgcaaaattgaggaccagcctatttcttcattagaaatgcaggaaacctggccgggcgcaggggctgacgcctgtaatctcagcactttgggaggcagaggtgggcggatcacaaggtcaggagattgagaccatcctggctaactcggtgaaaccccgtctctactaaaaatacaaaaaattagctgggcgtggtggtgggcgcctgtagtcccagctactatggaggctgaggcaggagaatggcatgaacctgggaggcggagcttgcagtgagccgagattgcgccactgcactccagcctgggcaaaagagcaagactccttctcaaaaaaaaaaaaaaaaaaaaaaagaaatgcaggaaacctatttaaaagtaacagaaacagctgggtgcattggctcatgcttgtaatcccagcattttgggagaccgaagcgagtggattgcttgagcccaggagttcaagacaagcctgagcaacatagcaagaccccatctctacaaaaatgaaaaaattagccaggcctggtggcatgtgcctgttgtcctagctactcaggaaattgaggcaggaggattgcttgagcccaggagttttaggctgcggtgagctatgatcgtgccactgcacaaaaccaagaatttagaaaaaggaatccacataattggaaattgagtattaagtttttgcttcctaggaaggtagtctaaatccttatacaaaaacttagctatgcagtgccaaggttggattgcttgtgaatgggtttgcatgctctgtaacctatcagttattctgaatcaagacttgaatatttaaacatacttggaaaagaaaaagatcaaaaaacaaaataaacatatttggctatttagtaatataattaagaacatgagtaaaccatagtattcgaggtccaagtattagttgccagcctaaaaactaaatatggccaggcgcagtggctcatgcctgtaatcccagcactttgggaggccgaggcgggtggatcacctgaggtcaggagttccagaccagcctggccaacatggcaaaaccccgtctctactaaaaaagtacaaaaattagctgggcgtggtggcgggcacctgtaatcccagctactcgggaggctgaggcaggagaatgacttgaacccaggaggaggttgcagtgagctgagatcacgccactgcactccagcctgggcaacagaacaagactccatctccaaaaaaaaaaaaaacctctaaatatattgtgttaatttatagaaaaattgtaatttaaattacatattcatagtcttgcctacttgcatgagcatgtttttattgcttctaacctggattgaaatctatgactttttataacagtcattgagtctgtttcaaaggaatcttgtggtaagtatttttgcatgatgtactcaaggtatcaagtttaacaattgactttttttcattggaaagcatatgtgattaactagcatggattgcttcttgacctgcttgttttgtgtttgtctttttcttctaatataataaccagggattaatgaaaatcaagttccatcctcagacaagaggtaaagttcacacattcttcccatgtctgttcagaaaagaaacctattcagatataagttaagctaatttagtaatcctagaattgtcctctgagagatttagatggatgggccacttcacagtagcagccaactcacgggagcacctgggcaacgctagtggacttttttgtagtgagtgtgttgatcatagaaaatgtagatataaggaaataaactttgaggatagagaattaacattattttgagatattatatataggttgtgaagagtggtggttgtcacactttatggtctctggaccccttaatgtctgattcatgtagcagaagccagctagattttcatctgtctctattcattttgttgtgatgtcatggatcatgtggcctctggaaaactctactgtatactcgagaatgagaatataacaggcaaaataacattatcatgaaaatagttttgacctcatgaaccccatgaaaggttccccagaccaaaattttagaatcactggtatagggtaacactttattgtgtaaattcagttctctgtaccccacttaaatatgtattattatctcttgacattattttcccaaaaaatgctgtttgatttcttacttgttctgtactttgtttttcaggtaaagaaggaaaattcagccagttgattttgtttttagcttactgctgcctttgtccgaagaaactgttcctccattatttgaattactgaagacagcaagatatttgtaaattatcttaaaataaacaacttaaaataaaatcattgtttttcttatatataagaacaatagatatagtttttgaaatgagatgatactaaaacatttaaaaatattaatatgctactattaaaattttttagtagaagacaatttaagaggctcttttgatttggtagtgctccactgaccttaaaatgtctagcctctatggggacaacgtagagggaaagggctgcagccacagcctcagcccagttctgtgccttattacagccttaaagaacagtcaacaagaccaggcacggtggctcatgcctgcagtcctaacactttgggagactgagactcaaggtggatcactggaggtcaggaatttgagactagcctggccaacatggtgaaaccctgtttctactaaaaacaaaacaaaatacaaaaatggtgcacacttgtaatcccagctactcaggaggctgaggcaggagaatcggttaaacctgggaggcagaggttgcagtgagctgagatcgcgccactgtactccagcctgggcaacagagtaagactctgttccaaaaaaaaaaaaaaaatgccacaggaagcatttgcttggaattctggatacaaaattgcaagcatatacttactctaaattatttaaaacatcttttctaaacactgagaaaagtacgatactcacatttagatcacaattaagattagatgcctgcgttgactccacactctgagttggccatgccaaaatttcaggcttttccctatttgtttaaaattgataacttagttttttgggttttttttaattacaaaagtaatatataaattccaaaatacataaaattataaacaatataaaacccattcttaacaagctcctcttttaaaaacaaatgaatgcatgtatttagaatggattctttaaatatttacagctatattcgtggtaatgaataaaaaggttcagtgaactgaccagagcttcaaagtcattttctaactcccctcaaagttttcaggagccacttctgaaggggttggtggctgagactaggagaaagaaacagctcacaactgaggaatcagatggaggtgtagtgtgaaccagtacaagataccttttgggaatgttagcaacgaaccacgtgcctctggaggctgtgtgtatgtgtgtgtgtgtgtgtgcacgccactatacctggctaatttaaaaaaaaattttttttttagagatggggtcttgctattttgcccagtctggtcttgaactcctgggctcaagtgatcctccttagccctgcaaagtgctggaattacaggtgtgagccaccatgcccatcctgttttgtattttgcttctaagcttggcttgacccacctccagtttctaggagagcagaacacatttgtgagggtgatttgagtgtcctagacatcatggaaggaggaaaagcaggaatttgaaatcagtcaacataagtaagaataatctgtgtctgaactggaatactagctcagcccttaacagctgtgaccttgggcaagttacttaatctttcagttttatgatctataagatggagattaaaagattgttaggattaaatgagctaatattttaaaatatcgagaatctgacagggagtaagtgctatattcttggttaaatgtctgctctatgtaaaattaatcatcagctccctgtagcctttagtggtgctcttctgtgtactggcactctgactctctgaggatacaataacaaaacgcctccttgcaggagcttacagtctggagggaacacaagcaaatgacagaatgtggtaagttacaattggtgagccacaagagggacagtgactcaatttggggacagatgaaggggactgagaaggccgtccagcttggaggaagggaggtctaaacagtcctcaaggaccagtgaccaacagtagaaattaaactactagagctaactggtggggagggaaggcatttcaggccaaggaagcagaaaaagcaaagaccaaaatctgttcaaatgcacattctgaaaactgctaatacagagaacgagaaaggcaagataaatctggaaaggtgagtgtaccatgctgtgtggtttagacatgtaggaaggaatcaaagagtaagcttgaaattttcccccaacttctgtcctctccttttgctaagtggcataacacagtggaattacagtgataaatgaccactggtaaggtttattacataattcaaactgcttttttttttgagatgaggtctggctcttatcgcccaggctggagtgcagtggcaggatcttgacttactgcaaacttcacctcctgggctcaagccatcctcccacctcagcctcccaagtaactgggactacaccatgcctggctgatttttgtatttttagtagagacagggttttgccatgttgcccaggctggtctcgaactcctggcctcagtgatctgcctggctcggcctcctgaagtgctgggattacaggagtgagccactgctcctggctatcctattttctgcaaacacctacacagtacctaaagggctaggtctgttaattttaatattctaggattgagtttccatcattacaactgttgtctataatgtgccctttaggaaactgtttctctgtgtgctttaatatagaatagttgaagctttcagaaattttattatcattattcaaaactctctaaatgaagcttaagaactgtgcagtcactgagctcctggcaccaactgaagaaaaagtgctgccgttggctgaagttgggctcactggtcctcaactgtaaccctcgtcagcattgaccgctacgccccagtactcgcctttcccacattgctcttggttcttttccttgtccaccaagacagaatgataaggatcaggcctcttggatgagtctgagctctgatctcaggaagaaatttcgttctacagatctcatgccccgctaagctgtgtgcagtctcactgctaaagaagcagctgctctccatttctgccactcctgctcttgaacaggttcctgattcctggcctccactgttcacttctagttactctcttcaaagagtggcttcactgagacatcatccacatgccatgaaattcacccttctaaattctaccactcagtggtttttcatatattcagagttgtgctctaatccactctctatatcattgcaagatgaattgtgctaaaaggcattactgaaatatgactaactgctaggtactatttactagtgaatgagacgaacacagatcctgcctctacccccgcaaagtatacagcaaagaatggaatgattttagtttcggacatccctcaaacattaattacatttgagtgatatattggacatccaagcagacattagtcattagatgcagttagctacgctagtatagcactcaggaacaatccaagataaagtgttatattaaggagtcatctttacacagctaatgatgaaatcactgaggtgaatcctatgaaaagagaacactgtaaaagcagacaaaagctgccaggcgtagtggctcatgcctgtaatcccagcagtttgggaggccgaggtgggcaaattgcttgagcccagcggtttgagactagcctcggccacatagcaaaacccatctctacaaaaaagacaaaaatgagccaggcatggtgacatgtgcctgtggtcccagctactcaggagcctgaggtagaaagattgcttgaacctgggaggtcgaggctgcagtgagctgtgaccaggcatgatggtgcatgcctgtaatcccagctttttgggaggctgaggcaggagaatcacttgaacctgcgaggcagaggttgcagtgagctgagatcgtaccacttcactccagcttgggtgacagagcaagactctgtctcaacaaaacaagcaaacaaacaaaaaaagtaataaaaggcaaagacattgcaggataagtcaaatctttgatattgaagccaggtttctcactttgggagagacaggatatgcaaataggacatgggaggagaaaagggatatgtaattttagacttgaattagaggcatctgtgtgtactttgcacttcaaaagtacacatattgctgggtgcagtgggtcacgcctgtaatcccagcactttaggaggccgaggtgggcggatcacctgaggtcaggagttagagaccagcctggccaacatggtgaaaccccatctgtactaaaaatacaaaaaattagccgggcaaggtcgtgcacctgtaatcccagctactcgggagactgaggcaggagaatcgcttgaacacgggaggcagaggttgcggtgagccgagaccagccattgcactccagcctgggtgacagagcaagactccgtctcaaaaaaaaaaaagatacatattttttagttctttccactacaagggccctgaagcaatgatttccctgtagtaatgaaggtcagctagcacacgtctgggttctaaataatattcctttctaagaagaaccagggctcctcagagagatgtctacttccaagcttagagcaagagaagcacaaggtgagcctggaaaatctagtggcaccaaatagcaagtcctccatgaatgatggtgacacagtacaagaatacagtggccggctggaaagggctcccactggccaaatacgggacaatttaagcagcaagagaatcacgaaggtaatggatcatgacacaccagctaaagaaaagaatccgtgctgggtgcagtggctcatgccttgtaatcccaaaactttgagaggccaaggcaggtgggagttacagaccagcccggccaacatggtgaaaccccatctctactaaaaagacaaaaattagccaggtgtggtggtgcacgcctataatcccagctacttgggaggctgagacaggagaatcgcttgaacccgagaggcggaggttgcagtgagccaagatctcgccattgcactccagcctgggcaacaagagcaaaactccgtctcaaaaaataaataaataaataaataaaatgtaaagccataaaaggcatttggggacaatgggaaaatctgaacacgcactttattttgtgggatattattgtgtcaatcttagtttgctgagtgtgatcatggtattatggggaggtgggagctgtgatgcaccatccagatcccccttcagaaggaccttccactgggaatggtggaagcacacagcccccagctgccaaccctcgttggaattgcctcagctggagatcaccttgcccaaggtcatggccccctccggaagcacctacatccagtgtctgatcagtatgagagtataaagaccccctgcctggctcaggacactgcaaagggccattccagccttacagctctctgtgggcttgactgaggcctttgtgagctggagcccaatgtctccctatcccagtcctgctctctcccctttcccgtccccccctttcccatcccccttcctctcccttccacctttcctcctcaacctctccccatcccttcccctccccaagcccctcccttctcaacactgcccttccctagtcctgcttcctgcctgccctcctcttctctctgccaggcggtgaccccaagagccctcctctgaggttaatcttcatctcagagacagcctcctggggagtccagcttgggacatttggtgccggagaggtctgaaagagcagatgcaagatgggattttggagctggattcccccactggctggcggtgaggacttcagtatgggtggtggatggagcacagaggtgctacctgacacaaggcagcagttcctgaatatgcaagtcttaaaacttccaccaggggtgaacagggtagtaaaacagtggaagcaagctgggacaatgtatgaatgtaccagatatttgagaaatatggagctcatgggaccccaaaaatcatagaaaccaggtggcaatacttaactatttagcagtctgaagccaagtgaatgcagttatgcgtgagagcaatcagaggggtgtgggcttacctggtgagttacggggatggttcatagaataaggggtccctgggcgaaatggatggacgccaacacgtgggctactcaatctggtccatcaaaataattcaaggatgggtagtcgggggtgagggcagatactcccataaccagtcatgattccatgccccattcctggatccaagccagctttcagactgaaaccctattgactgaagaagaggctgagtcttcaggaagaagaatgctgcagcaccaaacggcgaaggtaatgatccccccactccttttgcaaaagaacctacgaccattactcaggtaacggtccactggggaaagggaaacccacacattttgaggaagctgagaatgaaaccaggagatgcggagtcatcacgagtcccttgtcagagtgggggcatctgaggccaagtggcacctggagtcttggcccaggctcagctcacacttagacctactcagtggccaattccctgattcctgaatgtgtcactggaacagacatactgggatgttggcacaacccctacgctggttctttggcccataggtaagaactttgggcatgggagggttgaggagatgactttgaaactgcccctgcagctggggcggggtgggcagaaatcatgacctaaaggatgctgaggctgtgggtcactatattttcatttcatctgacagtctggctcctgcaaatatgagatgcatcttgaagggtgagagtgaactgttgtaaacttagccaagtagtaaccctggttgcagttgctgtgccagatgtggtgtctttgctagaacagatagacattgtctcaagcatatggcatgcggtcattggctggtgaaagttgtcttttccatcccaaacagaaaggatcagaaatagtttctattcagttggaacaggcaacagtatacattttggtcttgtcctagagctatgttaattctctcaccctgtgtcatcatacacagacggtccccaacttaacgatggtttaatttatgattttcaactttgcgatggtacaaatggaatatgcattcagtagaaaccacactttgaattttgatcttttctcaggctagcaatatgtggtaccatgctctctcatgatgccggacacaggctgtgagccacaattcctagtcagccatgtgataacgagggtaaacattcattgtgataagaaatagatatatactctgggtatggatttgcctttcctgctcatcttgtttgagccactgggttcccatatcacgctatgtcagcctaaggggcccattttacaataaaggaaacgtgggagtgggcacaaggctatgaaacccacgggtcatatcatacaccacaccactcagaagctgtcagcctggcagagcaatggaatagacttttttaggcacaatgaaagcaccagcacacaggcaataccttctgaggatgggcctgatcccctaggctgctgtgcactctttaagccaacaaccttttttctttttgtagagacagggtctcactgttgcccaggctggagtgcagtgactcgatcatagctcgccgtagcctcaaactcctgggctcaagttatcttctggcctctgcctcctgagtagctggggctaatttctttatatatatatatatatatatatatatatatatatattttttttttttttttttttttttttttttgtagagatgggggtttcactatgctgctagggcttgtcttgaactcctggcctcaagccatctacctgccttggcctctcaaagtattgagattaaaggcatgagccactgtgccccaccaagtcaatgacttctgtgatgctgggttcccaataagtagatgacacagggtggagactggggtttctccacttacatcactcccagggacccacctgggaaattgttcttcctgtcctgccactctgggttctccaggtttacagatcccatttccaaaagggggaatgctttcaccagaggacctagcaggagtcccactgaaacattagctacagttgctgcctgggcacttccactgagactgcagctaagagaggagtcatctttaggagggggatgggctcctattacagagtgggaggcaaggtggagtgtttggtttccacatggtctgtttgggtgcctcttgcccaattttgggtattctcttccccagttctgatggtacaaggacgagttcagcagccacagtctgaaaagggcctggaaaccaggggctcagacctgcacatgagggtctgcatcatgccaccaaataagctactgagaccagaagtgagagaaatgtaggcctgaggaggagaatactgagtatcagctgaggcctggctgcagcagtcggggctctaatttgtctcctgaccttcctctttaatgttttccccagggaaagggccccctccagaatcctggaggagctgttcctcaaaccaagaagtgtctctgagggtaaaatagatgaactgtgatgaatgctctaatccactgctcagagccccctcaggactgaaggacttcagctgtccttggaattgaatggactcagctgcagtgttcctttgcctgagagcacacaccctttcccaggtagccctcatgcagtgacctgttcctatgggaatataaaggtccagtcttcttgtttggattcagggaagctctgaagggccactccagcttctgcacactatggcattggcttggctgaggctttcttgccaaggaattcactgcaccctggctttcactccttcccccaagtcccaggaggatccctcaatgaactttctgcaggctcatctctatttcagagttgacttcctggggaaccaagcctgtgacatatggtcttgtgtatagttatgtgggggaatgttcttgttttggggtgatacatgtcgaggtgtggtggggttaagtgtcatgaagtttgcagcttattttcaaactgctggaaaaaaaatacctgcgtgcatatataaatacaaaatatatagtaaattggcaaaatgttaacaattggtgaatctagttgaagtgtacacgtgagtctatgattttgtttcaacttttctgtaggtttgaaattttccgaaataaaatcccctcccctatacacagaaaggcaaatgaagaggaacaaacacccagggtggcggcggtagcgggacagatttgtgaaatccaaggcgcaagagagtttcaatgttacagaagcgttcaacattatcaaatagctacaaaataatcaagtacggctaggactgaaaaatgtctcatagatttagcaacacaatgttcctgataacttggggacagagtgtccagggagtaaatgcaggcaccttgccctttagtaccttgcttctctgcagatcgtcatttagctgaagaaccataatttcagttctattattgagtttcccagactttgaaaaatgtgaatatcatgttcaaagttctggaatagtccctgtcggaggaatatagagccactcataaactcgcaatttattggaggagcacataaactaaatacactgtgataagtacagaagggcatatttaagaaaccgcatagttcagccactacaatcgggcgacctgcaggctgaatctagactaaccgtgggatcagtttggcttttgagatgtgttcccaattctgtatttaaaaatcaagatatttatccctaaatccgatttctggcaatacttggatggagctgggagaaggctctggggtaggcaaccgttcccaggacactcggcctgcgacaccggtttaaggctcggtttggcctctgtaggcagccgaggtccccatcccccgataggtcacagccgcgatgctcaaatcgcacactatagcccacaggcagcttacctgttttttttaaaaaaaaaaaaaaaaaaaaagttttattggaaccagggctgggattagaatgacatgagtgagtcaggagtttatggcatggatttggatttttttaaaaaaactgttaaaatattatcgatcttgatgactgagttttttgaggcccccattaatttggcacagagtcctcctagttcctgccctattgcgaagggctttgaagggcatgcggaacagcttggactttatttaatctttgcagtggcaagcagctcaatacacagatttttagctgaggcaacaccagcgcaggtctgcgtttggcgagctccgtaagttcccacgccccaaacttctctctagcacataactctctaatatgactaacgttattagtgctaactctctaacctgtcaatgtcgtatcccagatccctcgtttgcctctaaaacactggcgttttcgtcaccgctgtcccccaggtgagcgccccagcacctgccgccctgggcgcctcctccacctgcgcgccccacgcccgcttccggccggcttccaggcctcagaggcgatcccgaggaatcgttccgctcccaaggggcggagctttctcatcgccgcgctcggcattcggcttatgctgcctcgccccggcggccgtccagcgggaggcggagcgagtccaaaatggcggctctcaggctggcgcgctccgtgctgctggggctttgaggtggtcgccgggggtccgggggaccctttccccgccgcggaagccctagaggatgaatcggggaccctgctaaggtctggcggcggggctggagagcagtggcagcaagggctgcggtggcgtccacgcagcgggatgtgcgagagttactccaggtcgttgttgagggtctcggtggcgcagatctgccaggcgctgggctgggactcggtgcagctcagcgcctgccacctcctcacggacgtgctgcagcgctatctgcagcagctgggccggggctgccatcggtactctgagctctgtgagtaccgggctgggtgcgggagggctgccccggcaagtcaagggtgacaccttcgctctccctgtccctccgcgtccccggggtgtgcatcccgcaccccgcctcgagatctgctgtttcctcggcctcccacgtccctgggcttccactgccgctccaaactctagtcatccttcgggtgcctcttccttatccgctaacttcccgccaccagcccgggagtcgggtcttcgctcccagctccacaccctcctaccgctcctccgctctgaattgtgtctggatctctctcattgtctcctgtttgctgcgggtagatccacccccagcgtgccctacaccctcttttacctcggtcctttttctcccttgcccgcaaactactacaactagttgtcacaggcgctccgtctaccggccgtttcttacaagactggccattcctgggctcctaactacatagactcgttgacagctctgctccgttagggacactgcctcgtctttctgtatctgttcgtttcgtgaacgacatctccatttactgtttttccaaggctgactttgtcagtttcgctgattagatgtactttcacttacgtctcggttaccagtgagatgtcagtggctatcgaagtaggatagagggaccgtgggcagttgacaagattctccaggtaatctgggctacagtacttatgagttttaaatgaatgtctggtaatatctatagctagtggtatttaataatttaatggaaggaatggaatattttaatagaagctccacattatcttgttgatgtgaagcattgtatgtgtgtttgttgaggagaggaaactaccactcattttagtttcaagtcatgatgtttaaggtggtgagctggagaactgaatgaagtgtttcataggatattttgttttgttaaagtggttcctatactggaaaattgagactcacagacacacgctgtatttcttaggccccaagtttcgttcccgcttccacagggctgccaaaataatctgtccatagcacagatctgatcctgtcattattcttaaaaacattttaactatacttcgttggttacaggctaaaaatcgaaactcttagcagtacacagttccctttgtgagctagcattttgcttaccttttgccagcctgccatgctaatctgcgaccacgctgagctacctgccttttccaaaatgttttaagctgtccattcctacatgcgtgctgtttcttacctagagtgtcctttgcccgtggcccaccaatagtattacttttattttcagatgcacttatcacttgctctagggaactcatgttatctgctttcataattctgtgcatatttcttttatattatttgtcatcttgttttgtaatcacctgtgtatgtctctttcccctctccaggagaaaaattgattatatttgtattctgtaacctgtagggccattatataataggcacctgagaaatatttgttgaataaatgaatgaactgataaaccactaccctaaaagccacttattgactttacatattgagttccaaaaatgtatatgttttgaatgcttgatttcactgatacttctattactcttcttcttttgagacagggtctcactctgtcgccgagcgtggagtgcagtggtgcgatcttagctctctatagcctcgaacttcagggctcaagtgatcctcccgcctcagccttccaagtagctgggactacagggatacgccaccatgcctggctaatctttttattttttgtagagatgtggtctggttatattgctcaggcttgtgtcaaactcctgggctcaagtgatcctcctgcctcagcatttcaaagtgctgggattacaggcatgagccaccatgcccagctcactgatacatctgaatgtggaaccacaaagtaatatgcgtgcatttttatcttgaaagtacatcaccagctgactactcttctggcttttgtttctttttcctctggcctccgctgcagtggtccttgagtataccgttagtgataggctaggctaggctaggctaggcatagtccagattatgtttgctaccatgtatctttagatattcaaaatgtctcctgaatacatagttacctttactgccatttatacaaaacagaagggagctgccactctatgtgactaggtattccaaagtcatccaggggtcactgcagctcttcagtgtaaaccttgttcctaattaccaagtttccgtagccagtttcttggtttcagtgagaatgagattgtcaggttcattattcccacgtaatttggtgacttttttttaatgctaattttggtatacttattagatatttttagattcttttttctataccagccttattctaaaatcaaattctgtagctccaggttaccactatggaatcttgtattccacccctttaaatcctttctgttgttttaacaaacacttactgagcatcacttacgaaccaacccctgtactaggcattggagacataaaattactaagatacaatccctgaccataaggtgtgttcaagagttccagaatgtcaggaaacaacaaactgatggtgtttgtttcttctaaaagaaatgttctcaagttaaagcaagtattagaagttaccattaattcaaataatgaacaaataatgaacttaagaattgccttagggtaacaatgtctccaagcattcaagggcagatgtctctgtcggtgtcacattatatgttaaatatgttggcatgtactgaaagcaggtgctaaatctttcagactgactcttcaacactagtactgtaatatttttttgcatggtacagggagtaaatgtaaaagggataagaggagagatggctgtaggctatagattctggggtaggattacttcacagaaaagataagatttgagttgagctgtgaagtatggttgtataaaggtatagagtattccagcttagagaatcacataaactaagctgtccaggtgagattaagcataataaaagtaccagtaaggtgttcagctccctatgcagctagttcattccaagggtgtctgagtaaaatgttcaacagagtgagatcaggttatggaaggacttgaaagctagacaaaagaattaaaacatgtagtagaaaacattgcatactcctaagtaggggaatagtatgattaaagtggtattttaagaaaattgtactgacagtgatgtgcataagagattgaagtgggcagaacttgagactatactgagatagtgacagtaagaatagagagaaaggaaaaaaatctgaaatcatggttaaaaaaaaaaaaaaaaggtggccgaaggggacggggacagggttagaaactaccaggttttggtttgaggctgcaaagcatatggaggaatttaagattattatattttttagactgagagagtaataatagctttaataggaatagaagagatgaaatgcctgtttacattcagtaagaagaagagtattcgttttatttattttctttttttaatgcatcacagaagtaacccatacttatagaaaaaaaaaatcaaagactgcagaagtatgtggagttagaagtcagtctcctgcttccaccacagccctcgcctctactgcagcttccacccctcgaactgttaaccattggctgaatatccttccagaggtttctgtatgcattactacacatgcgtccaattctagcaatatttggattctttttcattttacagtgtgatttaatttcagacatactgagtttgaagtgatcaaatttcaggatttcagttaaaaagtcaggatttcagttaaatcctttaggctattgaaaatcagaaaatggaattttcatagacatttttaaagatgtagagaccttaagctctgctaagaataggcataagaaaaacttgcttttgtaaagaaaaaaatctctatatctaactttttatctctgttttatgtggtgttttctaattacatttgaaaatttatagataaattatctttatggctaggcatgttggtggtgcactggtagtcccagctactcagaaggtgaaggtaggaggatggcttgagcctgggaaggtaaggttgcagtgagccatgattgcccttctgcactccagcctgggcagcagagtgagaccctgtctcaaaaaacgaacaaaaaccaaacttttatgatctaagccttctttgtaaatattcttagattttaaaaattgatttaatggtataattcattcaataggtatttattgagtgccagctatgtgccagccactgtttaagattctgcagatgcatcagggaacaacagaggaaatgtaaccaacattgactttgtcagcacagcacactacttatttgatgattaaaaaaaaaaaaaaggccaggcacattggctcatgcctgttatcccaccactttgggaggcagaggcaggaggattgattgaggccaggagttcaaaaccagcctgagcaacatagcaagaactcatctctacaaaattaaaaaaaaaaaaattacccaggcatggtggcatgtgcttatagtcccagctactcaggagactgagaggggaagatcgcttgagcctagaagtttgaggcagcaaggagctgtgatcataccactgcacttcagcctgggcaacaagcaagatgccatctcttttttttttttttttctgagatggagtcttgctctgttgcccaggctagagtgtagtggcacgatctcggctcactgcaacctccgcctcctgggtttgagcagttctcctgcctcagtcccctgagtagctgggattacaggcctgcgccaccacgcccggctaatttttgtatttttagtagagacggggtttcaccgtgttgaccaggttggtctcgaacccttgaccttgtgatccgcccacctcggcctctcagtgctgggattacaggcgtgagccatcgcgcccagctaagatgccatctcttaaaaaaaaaaaaaaagacaaaacactattttattattattatttttggggcattttctgtgtgtcaggtgctgttccagatgcttttgatcatctgtaaactactttgaaatttgttctataatagctaatcatgaatgtggtttttctgtggtgttctggctagttgtctgattatatttaaacttgactttaataatcagcttaaacatgattctgtgatactctttaaaatctattaaattctttccaataactaggttaaaatgtttgattctgagctgcatatttacttactactttttcttaatatttaaaaatatattcgtgggatttcttcaaataatttgatttgcttttcactttgtttcagatggccgaacagacccaattttggatgatgttggtgaagctttccagctgatgggggttagtctacatgaactagaagactatattcacaacattgagcctgtcaccttcccacaccaaattccgtcatttcctgttagcaagaacaatgtacttcagtttcctcaacctggaagtaaagatgcagaggaaagaaaagaatacattcctgattacctgccacccattgtgtcttctcaagaaggtttgtgagtgtttcttcttcatatgttagtgattattttaatggatttttaatcctcttagctttccatgctatgtcaactttataaattctggaaacacaatagaaacatttactgttacttacaaattattctaacccttaaaccaacaaacttgcaactgacattaccaagccgagtcacggtgtaatcaaggtcatgtctgaagcatttatctcctttgtaaagttcaagtagaggaaaacagtgaagccaaagagaagcctttcaacagccctattatatgagaatgggatattaggtaaattagaaaacatttgaaacaaaaagaaaaattggggtagctcttttcctcctcgcttattattcaggccatgagttgaatgccatggctttatactggaaacagtgagtgaatcgtgagtattcagtgacattgtgtagacttctgttttttatcatgaggagcaatgtttattgtttgatcatatagaacttttgattataaaatgatagctaatcaggtataatggtcagtccaattgcagagttcccttttttcctgcataattttagatgttgatcactaagttcactaagattctaaggagatatttaagtaatttctggtctctaacacaagtacacgatattttttcttataagagttggaaaagttgcaataagttctttcattttgtaaaaaattctaaaacctgtatacttcaggacaatgcaaatgatgccagcaattacttttacttatgattttctattgtaaaatatacataacataaatggaccattgtaaaggtgtgcagttctgtggcattaagtatacattgttattcagccatcatccccatccttctccagaacttttgttccctcccaaattgaaacactgttcccattaaacataactccccattctccaccacttccagcccctggcaaccaccattcctttttttgtctctctgaatttgtctattctaggtaccttttataaatggacttggacattatttgtctttttatgactggcttacttcacttagtatgatgtcttcagggttcattcatgttgtagcctgtgtcgggatttcgttgtgtgtttcgttgtgtgtttaaggcagaataatatatgtacattccacatttgtttatccattcactcactgatggacatttgggttgtttcaaccttttggctcttgtgattaatgccgctatgaacatcgatgtgcaaatctctgttcaaattcttgctttcaggtgtttttttttgggtctgtaccttgaagtagaattgctggatcatatagtaattgtctatttaatttttgaggaagcaccacactgttttccacagtggctgtaccatctaagcttcctatcagcagtgcccaagggttccaatttcttgcaattcatttcttagaatcggttctactttaatagcattttgaagtgttacctatttgtctcaggaagtatgtttaaatttggcataagttgttgtacagtctgtgtgtcagggttgcctcatctgaaaaactggacagctactggacctaagtggtagggatttgttgtgaattggtggctcatcatttaggtgctctggatcttagctgcagtgggttctactgaatgatactaacacaccgacagcccagaaccaaaactaggactttgatcataatctacacttaactatttggtccttcttgtcttatttttatagcatgcaaatattccataataaaattctcttaaagtgctatggttatcatatttaaatactagcaaggaaatgtaactaagataacaggtttagattaggtagtgaagaagtatgaaaaacaatttagtgttttttttgttttgttttgtgttgttttgatactgacttctggctgaaattactatattactatagatttttgggtttcttttctgggttatttgaagcaaaaaaagaaactcatttagttttatgcaaacaatataaattataaacattttaaaaggaaaataacaaatcttgagaacactacttttcactttttatctaacacatgtggattaagaaggaaaaatattgctgatttgtaatatatgcatatggtttataaggatgcagtaagtggtaggcagtacagtaagatgcttgtcaaaacgttctcctcttcataagaaaaggatataaaatgcaattctttggttaccatttaaaaatataaccatacaagaccatttcttgtcatttacaatctgaaatatttttttttcatgggtacagcatgttagaaagttcctggtattctgattagtggtgcaaagtgaggtacagaggtgaacccctttgataatgatgctgttcaccatgctctttattttccttttatttccttaagagccacagacaggccagactttggtcttaaaatattattagcaaggtccttccatggggttccctcttatcagccactcagcttggttcatgtcaaaaaagcctgtgaaagtctccctccacagcagctggagctggcgagtgtgcacacatagaaggcctgaaggggcagcaggctgtgagaggcacagcgtggacctcacggcatcactgagacatgactcagcgagtcactgagtttctggtcttcccaagtcactttacctttctgaactttatattcatctgtaaaataagtgtaataacacctaccacattggggaaatggagaatcaagtaatttttttttgttaacacatttatataaaattggacagtgtttaacatataaaatacataacagtgggccaggtgtgatggcttatgcactttgggaggctgaagcttgagcccaggagtttgataccagcctgggcaacgtcatgagacctcatctctactaaaaataaaaaacttggctgggcgcagtggctcacgcctgtaatcccagcactttgggaggcggagacgggcggatcacgaggtcaggagatcgagaccatcctggctaacacagtgaaaccccgtctctactaaagatacaaatattagctgggcgtggtggcgggtgcctgtagtcccagctactcgggaggctgaggcaggagaatggcgtgaacagaggaggtggagcttgcagtgagccgagattgtgccactgtactccagcctgggtgacggagcgagactctgtctcaaaaaaaaaaaaaaaaacaaaaacaaaaacttagctgggcatggtggtgcacgcttgtagtcccagctatcagagtctgtggtgggaggatcagttgagcccaggggtcaaggctgcagtgagctatgatcacaccacagcactccagcctgagtgacagcgagaccctgtctcaaaaaaaaataaaacacatgacagcgaatattagttctcgtcccctttttcttttcttgctcttaaataatttacttttgaattgaaatacaatatacattagtgaagtcacgctataaggggaatcggtgtcaagctgcattcagtggcacacccatagtcctagctacttggaaggccaaggcaggaagatcgcttgagcccaggagtttgaggctgtagtgcgcaatgattgagcctgtgaatgcccactgcacttcagcctgggcaacatagcaggaccctgtctctgaaaaaaagagacgaatcaatgtaaagtagtgttaccatcacgtgctgaggatctgagggaacagacttactagctgggctggataggtacttgactgaggagctgtgtgattatccgcagtgtgaagatgacagatgaggagatgatgtggaaggagttattgcctgctttatctgattatatgtttagaagtgagacctctttgaaaatattttatacatgcatatttttgcttggactgttacagttctgatggctggtacccagtgtgttttatccaagaacattctctccccagcttgccatacatattttcagattcacaccaataccatatttttttgcttcctattttattgtgctgaggaatgtctgaaaatagtacagcgtactatgccaaagtcattgttggttctcacagtgtggtctctagatcactggtcaatgggggtcttctgggggggtctgttgattggttcaaaatatttgcataagaaagaaatataggctgggcgcagtggctcacacctgtaatcccagcactttgggaggccgaggtgggcggatcacttgaggtcaggagttcaagacgagcctggccaacatggtgaaaccctgcctctactgaaaatacaaaaattagctgggtgtggtggtgcctgtagtcccagctactcgggaggctgagatgggagaatcacttgaatccgggaggcagaggttgcagtcagccgagatcgtgccactgcactccagcctgggtgacagagtgagactccgtctcaaaaaaaaaaaaaaaaaaaaaaaaaaaaggaatataaaccatgtaccctgacttattgcaggaaacttaccaagctcaacttaaacttggtaaagatactgtgaggttgccacttttagagtttctattttttaaaatttaaaatagactattttttagaacagttttgatttacagaaaaaattgagaagttagtttggagagttcactcacatctgaaccatttcttctgttattaaccttttacgtgactatggtacgtgtatcacaattaatgaacaatattgacatgttattattaagtgacgcccgcactgtattgacattccttagtttttactggatgtcctttttctgtttctggatcccatccaggatatcatattgtgtttggttgtcacgtctccttagacttttcttggctgtgacagtttttcagacttttcttgtttttgacgaccttgacagttttgaggattattggttaggtatattgtcggatgcccctctagtggaatttttctgatgttttcctcatgattagactggggttatgagatcttggggagaaagaccacagaggtcaagggccatttttatgacatcatatcaaaggtctatcctgtcatcataatttatcactgttgatattgatggtgatcacatggctggggtagtgtttatctggtttcttcacagtaaagtttctcttctatcccctcttcccctactgtgctctttggaaagaagtcactgtgcgtagcccgcccttaaggaatgggagttatgcgtcccgctttgaaggtggaatatctgcatatgttgttaggaactcttctgcatggggatttctctctttccccactaagatttctatttttattattaaaccctttaaaagtaaacatttacatgtttgaaaaaattaacaaaagtaatacaaacttgctgaaaaaatatattgccaagtgaattcgttatgaaatggaagtgtctcttcacttcccttcctcccccttcccaagaataacctagttggcagatggggctcctctgcatcttcccgtgtgaccttttgcactccttggactcaagaatctatgtccacttcagtacctgccatttctttctcaagctcctgccatccttttcttgaagcagttcttgctgtgaacaccaattactatctaaatggttgatctgaaggaaatttaaaccctttctcccagttcaagaaacagaactttaccagctatctcagaatagcttctatgtgcccaaccccaccccaccccttcctccctccctccaaaaataaccaaccactgtcctgactttgtaggaattactccttagctttatagttttatcagccaaatgcgtatccctagacacattaatttaatgttcttcacacatgcacacctttttcactttacatgtcttttttttttttttttttttttttttttgagaaggagtcttgctctgtcacccaggctggagtgcagtggcgcaatctcggctcactgcaaactccacctcctgggttcaagcgattctcctgcctcagcctcccgagtagctgcaattacaggtgcatgccactgtggctggctaatttttgtatttttagtagagacggggtttcaccatgttggccaggctggtctggaactcctgacctcaagtgatccgccagcctcggcctcccaaagtgctgggattccaggcgtgagccaccccgcccaaccatgtcatttaccttttagtttgtgactctccttccattcctttctttgtcttacagtttatttgttagaaatctgggttgtttgatctgcagagtgccccacagttggatgttgcgcattgtgcactcataatgcagctcaatgtgtttctcaaaattggcagcaagaatctgaggcttgaccagatttaggtttggcaagatatcagctgatgatgtccagttttcacttttgttggtgttagcagtgctgatgctcagtgcctagatccattaattcattaggggttacaaagtaatgataatactatcactttgtttttatttcattctttagttgaaataactttataagaaaatccttttcctcatccactatttagtaacttaatggcatagtttatatagggaaagcagggttaacgcttgatttttttcatatggtatattcccagttttcatgagaataaattggttccttgttatccttagcaggtgactagtttcatttaatactctatcattgtgaactcacagatttaaacatacttgacggatttcattcattactttttttttttgagatggagtctcactccatcgccgaggctggagtgcagtggctcaatcttggctcactgcaacctctgcctcccaggttcaagggattctcctgcctcagcctctccagtagctgggattacaggcatgtgccaccacgcccggctaatttttgtatttttagtagaggcgaggtttcaccatgttggccaggctggtcttgatctcctgatcttgtgatcctcctgcctcggcctcccaaagtgctgggattacaggagtgagctaccgtgcccggcctcattacagttttttacccatattgtagctttaattgttgcatctttggccagtggcagcttcttcactcttgcttctgagtccttttgacacatgacccgaattggctttggtgacgtcctcaccttctggtatatcaaaatgttctagactcagcatgtatagtcatgttctatgcttggtataaattatctgtccaggaaaccctggtttcttggaaagtagtatttcttttctttttttaattttaattttttttaattataaaatttcaggttacatttgtatatatctggggggtgcaaagcgatgttatgttttataaatacaatgtggaataattaagtcaagctagttaacatacctgtcacctcaaatgcctatcgttttttgtggagagaacatttaaaacttactctcttaatgattttcaaatgtgtaatacattattatttttctttttcaccatgctgtgcaatgtatcaaaaaaagtactcctcctgtcagattgaggctttgtaccctttgcctatcatctctgtatccccacatccccacatcccctgccccagcctctgtaaccactgttctactctctgcttcttggaatttggttcttttcgtccacatataagtgagaacatgtggtatgtctccttctgtgcctggcttacttcacttagcagaattgtttgaattccatctatgttgtcacaaatgacaaaatttccttctttttttaaaggctgaataataatactttttaatttttatgggtacacagtaagtataaatatttatggagtacataagaattttaataaaagcacaccacaatgtgtagtaattacatcagactaaattggatatttaccacctgaagcatttatcatttctttcttatttatttatttatttttgagacagtctcgcactgtcacccaggctggagtgcagtggtgtgatctcagctcactgcaagctccatctcctaggttcaagtttaagtgattcttgtgccccaccctccccagtagttgggattacaggtgcccaccaccacacccggctaatttttgtgtttttagtagagatgcgatttcaccatgttggccaggctggtctgaaacccctggcctcaagtgatctgcccacctcagcctcccaaagtgctgggattacaggcatgagccactgcacctggcccagcatttatcatttctttgtgctacagatattccagttatactcttttagttatttttaaatgtacagggtgcagtagctcacacttgtaatcttgtcactttgggagtctgaggcaggaggatgatttgaggccaggagttcgagataaaatgttcaataaattattgttgactttagtcaccctgtggtgctattaaaggctgaatagtattctgtggtgtatatatattacattttctttatccactcatctgttaatggacacttaggttatttctgtaacttggctattgggaacagtgctgcagtgaacttgggagagcagaatctcttccacataatcttttcaaatcttttgggtaaatactcaggagtggggttgctggattatatggtaattctattttgagtttttggaggaaactccacatagttttccatgactactaatctaaattcccaccaacagtgtacaaggattcccccttttctccacatccctgctaacacttgttacctttcatcttttttatagcagccattctaacaggtgtgaggtaatatctcactgtggttttatttctgtaatgattagtaatgttgaacattttttcatgtatttgttggcagtttgtatgtcttattttgaggaatgtctattcattttttattggattatttctttctgtagggttttcttttttccttttttggggacccagcaatactgctgatttattacaagtccccaagagggcttcagtttttcttttcaacatcctgttctgtagcttccatgtctctttttgtccatatgtggaggagccaggcattggcacgggccatgcagcaactagcaaaggctctgaaattcttctcctcagtggtgacttgagctttctccttctcatagacattctggatgggcatgactggtcctgtcagctgggtggccaattgcagttcttcagcagaactgtctcccttcctggggaccgagggcttcctggggaagaggatgagtttggagcggtaccccttcagccgctgcacagtgcgtgtggaagtggggcttcaagatcttgccattcccgctgggcaccatggctgcctgctgtcctccggcacaggacaacagccagactgttctttctatagagttgtttgggttccttatatattttgcctttttttttggtggtggttgtggctcttgttgttgttgagttgcttacatgttttgggcgtgagccccttgtcagatgtgtgggtgcacgtgttttcctcctcacccacaggttgtgccttcactctgctgtttcctttattgtgccaaagctttttattttgatggaatcccatttgttcagttttgcttttgtcaccctgcgcttttggggccaaatataaaaaataattgcccagaccagtgtcttacagtttttcccctatgttttcttttagcagttttgtagtttcaagtcttacatttaggtctttattccattttgagttgatttttctaagtggtatgagataaggatccaatttcattcttctgcatatggatatccagttgtctccacgctgggaaatagcatttcaagtacacagtctcggtgctaagggatacttattatatataactcggttgttcattgtttctaggcaataagtaaataaatatttatatacatgtagatgtgtgtgaatagatagataggtggatagggttcctcctgagttcatgcagattttccaattcatatttaggactacaaggtttttattttttatgttacatccataaatactgtcatccatactgagaattctggttctcaggaataaagaagatgataaaattagaatattccataattattcatttgctttatcccagattacacgtacaatattgcaactgatactatcattcatgattactgaaacaggtaaaaaaaattttttttgctcattctgtcctatgaaaccaattttctttcattttaccgtgtgtatcttgtcagatcatatagctactgtcttgagttctgctacctaatttctgagttttttctgattttgatttatatactttcatgtcttttagatcatttcaagatagaacattataggttcatcagttttttcgagtgtgtgtttctctcgtactttcattgtctggagggatgttttgctatttagtcttctcttctttatagaaactatatgtgagttagttttctgagcctttagaacacaggtgtccaatcttttggcttccctgggtcacactggaagaagaaggattgtctttggccacacataaaatacactaacaccatcgatagctgctgagctagaaaaaaaagtcacacacaaaaaagtcataatgttttaagaaagtttacaactttgtgttgggctgcattcaaagccgtcctgggccgcatatggcccatgggctgtgggttgacaagcttgctttagaaggagattcagggtagctcctctgactttgcagtgctccctcttctatcgtttttgcggaatgttccaaatatgggaacttgctcactgagattttttgtttgttttcctccaccacttttacctggatcttctcttcccttcatgtcagttttcctttttctggccagctgtgattccactgccagctgtgtcctctcagcgaggctctgtcctggcagagagcagccagggtcaagtctgagagctcctgggctcaacttctagccccattggatctcactcagccccttgtactccctgtactggaagtggtcccatccttcccagcctcagccgctcttctcgggttggcctgccgggctttccagcagaggcctggtggcccttttggggttttcctgtttcaggtcagtcttcccgttgcttctcactgtttcccttgcatagatgcctcatactcgggtctcatggcgcttggtggcatgttgtcacctgcatgtattttggcactgatgggtgtactctgtcacctggttatgttgggaagatgcacaaactaccttgccccagctaccactttcttcccaggattccccttattgaagctttttgctgctttcatcactgttgggcaattcctgaagctgcttttcttcagcgccatcatactcccttaactctccttatatgatgagctccatcttggggcctttcttgggcacgtcttccctggctctcctactgctaaaacattggtgcttctaaaattttatccttcacctactatgtttctcacgttacttagtttcagagttgactttcctactctcatagtttgaacccccatctgtatgctgatgcctccccaaactgtccctctacatccacctctcagaccctgcaaccagttgcagttggccatttccacgttttcttttttctttcttttttttttttttgagacggagtttcgctcttgttgcccaggctggagtacaatggcacaacctccggctccctggttcaagtgattctcctgtctcagcctcccgagtacctgggattagaggcatgagctaccaagcccagctaattttgtattttcagtagagacggggtttctccatgttggtcaaactggtcttgaactcccgaccttgggtgatctgcccaccttggcctcccaaagtgctgggattacaggcgtgagccactgcacccggcccatttccacattttcttaccacgaatacacctgtgttatccatctcagttggtggcaccatctctactcagtcacctaagctagaaacatgagaattagcattgacctcttctctcattctccttcattccctatctctaattctgctaattttctttcttaaaaaatttccaaaatattattgcatcacttcctttgtttaaacctttatctcttgtctgaactgtccttatcctctaaacgaaactattagacaaaaaattaacacatcccacattataaaacactttgttggctctccaactgcttacagttaccaaaaatacctatggagaggagttttcttttttgcatcaaaatgaaaagagctttggttgagtgtgatggctcatgcctataatcccagcacttgggaggccaaggcaggaggatcgtttgagcccaggaatttgagaccagcctggacaacatagtgagaccttgtttctataaaaaatttaaaaatctggccaggcgtggtggctcacacctgtgatcccagcactttgggaggccaaggtgggcaaattgcttgaagtcaggagttcaagaccagcctggccaacagggtgaaatcctgtctctactaaaaatacaaaatttagctggacatggtggcatgggcctgtagtcccagctactcgggaggctgaggcaggagaattgcttgaaccagggaggtggaggttgcagtgagccgagattgcaccactgtgctccagtctgggcaaaaaaaaaaaaaaaagtcagctgggtgtggtggctcatgcctgtaatttcagcactttgagaggttgaggcgggctgatcacttgaggccaggagttcaagaccagcttggccagcatggcgaaacctcgtctctactaaaaatacaaaaattagctgggcgtggtggtgcgtgcctgtaatctcatctactcgggtggctgaggcacaagatttgcttgaacctgggaggcagaggttgcagtgatctgagattgcaccagtgtactccagcctgggcaaaagagcaagactctgtctcagaaaaaataaaaaataaaacaattagccaagagtggtgatgtaagcctgagaggctgaggtggtgtaagtactcagaggctgaggtagggggatcacttgagtctgggaggttgaggctgaggctgcagtgagccactgcactccagcctgggtgacagagtgggaccctgtctcaaaaaaataaaaagggaatagctgtagttattcaagagaaaagatgtttattcttacaacgtagattacttactgatttaatagaggaatgttaatgaagatatttgcatggctttcagttgctaaaataatgtttgtgtatgtaaaagcagccatcaaataatttatccttgatatcacataatatattcataaacattatctcatttaatcttgaaacaggtcctaaaggcagatgctgctatcattcccatttatggaaggagaaatggaagtttaaaaatcataattgaattaacctgcctcgtgttgcattgggaattgggagcaaagctggattagggtttagttgactccgttcagtgctgtgtgtatgggtacctgccatgagtcggatcctacacaaggaactggtgttgaatatagagagatgagtgagatattcctctctccccattttggcctttctgctgttgtttggaagtccctgcttggccaggactgtcctaagcagaagagtacctttaccaagccagttttgtttttttttgttgttgttgtttgtttgtttgtttgtttttgagacagagtctcactctgttgcccaggccagagtgcagtggcctgatctcgactcactgcaacctctgcctcccgggtttgagcgattctcctgccttagccttccaagtagctgaaattacaggtgtgcaccaccacgcctggctaatttttgtaatttttgtagaggtgggatttcaccatgttggccaggctggtctcaaactcctgacctcaggtgatccacccacctaggcctctcaaagtgttgggattatgggcgtgagccactgtgcctggccaagctggttttcttaatgggcaggcaggcttcttgaataccttctggccccctaacatccgacgctataagcctcctccacacccagcctcctagttaaggatctggctgcctctctcttggccctctcagataccttcctgttcattaccttgttaggctggagttccagggtctggggaacgttccttctgtgtatctagggaagttgtctggaggcattgcttgtttttttttttttttggtttgtttgttttgttttgtttttaaatccagcagcatctgagccagataattgcagctgaaatcgtaccaagggctgatgttgggatatgcctgtggtgttcagtacacgtgtcttagcataaacctacagggccctgtgtgatcggactcctgcccacttgacatgttagttacttgcccctcgttgcttcgtgctttaccttccagaatcattaaactgctgatgtttcccaaaaataactatgtacctgggtcagctcatgctggcatggagttctcgtccatcaccatgcccaccctggcttctttgagcgcccgtataatatatatctctaccatcatacttcatatattttgttataattgctggttttatttgcctctgtaacttacccaggtcttgctttctctttaagtcctacactcattctccatttcaccatttttttggcagaaaacctatggtcctgctactctatgagagttgaattcaagacatggagaaacttactgactcctgttcttagggaaagtttttcagaataatggaggagcagtcgcaaaaattagcttgtccaaagtcacatggctgcgaagtgatagaggtgacagtgggatcccaggtttcatagtcttggccccatcttctgtgtatcattcatggccctggcattattctcaagggcacagatagaagaacaaaggcttgtattgtggctcttcgtttgtttcttttcctttcaaattggtttcttgagtacaattattttttttttaattgtgttttgttaacatcttattcttctattcaggttactttttctgcttattcttgttatcctcaggaatgattttttactgacagcataaagattgaagtagatcttttagaaatctctgtgtctcttgctttacattcaggccagcaagatttagcgcctcagcggaggtgtatacatgtcagcagtcagcatggagagtagaagtcccagcatacacagattgagagggactttacaaatttaaatggactttgccaaaattctctgcctttcaaaaaggtttttcctttaatttatctggatttataaaaacagaagcacatttccaatgctatagtaagagatttttggatgggggagtatttaagggattgaaaaattttttttttaagttttaatgtttctaaattaacaaagtaattctatgaagtatcttaggaaaatgagtgttttttttttttcgagacggagtctcacactgtcacccgggctggagtgcagtggcgccatctcggctcactgcaaactccacctcatgggttcacgccattctcctgcctcagcctcctgaatagctctgactacaggcgcccgccaccacgcctggctaattgtttgtatttttggtagagatggggtttcaccgtgttagccaggatggtctcgatctcctgaccttgtgatccgcccgcctcggcctcccaaagtgctgggattacaagcatgagccaccgcgcccggcctggaaaatgagtgttttgatatttactataaacaccaaatttgtctacttctctcttctaggcatccagaatgaaaaaaaaaaaaaagattggttttttttctaaatttagaatttgccagaaatttaacatttctttatctgtgcttacggtttttggaaattttcccacgtgtgtgaggggaagacgggaatatcaaggaggagcaggcaatacatgcttgtggctggctcagtgtaagaccccaaagttagtacttttgctgtaagttaggacttactttgtcttgctttcttgaatttgaatctgaaattgaacagtgtactcattgccttttatttagctaatgactgcttacagccacatagaactttgctatttcatgttttcttttctttctttcttttttttttttgagatggagttttgctcttgttgcccaggctggcgtgcaatggcgtgatctcggctcactgcaacctccacctcccaggttcaagctattctcctgcctcagcctcccaagtagctgggattacaggcacacgctgccacacctggctaatttttggtatttttagtagagagggggtttcaccatgttggccaggctggtctggaactcctgacctcaggtgatccgcccacctcggcctaccaaagtgctgggattacaggcgtgagctgccgcgcccggcctagagctttcctatttcagataaaataatagcaagttatttgcttcttttacggtggttatatactgatggtgtgccattggtgccaaaagtaaattcaaaataattgtttccttccttcattcgtcaaggagctgtggagagcctgctgtctgcaggctcactgcttatttctgaaaagagaggtaaagaaatagaggtccttccctgctttcctagagcttacagtctacttggggaaagaagggctggactcatgtttatatactatttaaaattataatttgggattcttaaaggaaaacagagtgctccagtactataaacatcagaggtctctaacctagtgtgcttacaggaataagggaatcaatggatattttttaagtagggggttaggatgatttcattataaattctgttggtactgagaaggatggactcaagaggagatgtcactggaagagtcttgataaagcttgtggtagtcacccaagggacatgataggaaggaccaaatttgggagatattggatggtcaggatttggagatagataaattgtagaggatgtgctacagagaggagcctaggtttcaagcttgggagattggctaggtaatcagatatctaaatatccagatcttaaacagactggccagatctggagtgagaatttagaatggaccttatagtctgcaggcaatcctctaacaaaactttttatttattttttttaaataatcaggtagagctcaggattgtaaaacatgacacgaacctcgtacccagggcagacttggttgcttatgttaagggcagcaggtacacttgctttaaatcaggtggatggtgggcttttaccaaatgactgcctatgttggccaggcaccacgcccgatgtgggaggcagaggccctcctatcgttcattgagttgcgtgagtaccctatttaattaaagatggccctgtttgtcattgtaggatattgaattaatattgttttttttttttgtttttttttttgtttttttttttttttgagacagagtcttcctctgtcacccaggctgaagtgctgtggcacgatcgtagttcactccaacctctgcctcccgggctcaagcagtcctaccaccagctgggatcacagacatgcaccaccacactcaactaattttttaattttttgtagagatgaggtttcagtatattgccctggctggtcttgaactgcaaggctcaaccagtcttccagcgttggcctcccaaagtgctgggattacaggtgtgtgccaccacacccagccttgaattaatattctttgagttcctagaacagaattgctgtaaaagaagaactaaaatcagttttgttctaaaagattaaacaataaccttaaattttttagatgcgggcttaaagctatatatatatatatttgtccgatgatacctaatggtcactattgtcatgtctaccaaaaatttaatagcttggtatgtcattgaagcgtgacagttcaaagccatgttttaactttctccccaataagatatatctgttatttcctcttccaagcccaaattccatcatttgtaaaatgggaatagtaacctccattggataattattataatcaaattagatataaatgtcgtatatttttacagatcttagatatgattttccaagggcaggcccacatttacagtctgttcctgaaaaatctcagcactgaatgtaatggttgtcatactttgttttctgaagaaacgcttacagtacagtaaatatatgcatttgcaataatatcctccggaattctttctaatctgggaattctgacatgctttgcacctgctagggcgtagtctgtgtctgtctggggcttttactgctttctggttaagtgaggctctcctctgcctttcccatggaactgcgcagaagctgcacaggccagaccttgtgaatatgttcttgagacagggtctttccctgtcacccaggctggggtgcatatagcttactgcagcctcaaattcccagactcaagcaatcctcccacctcagcctccttagtagctgggactaccagcttgcaccaccatgcccagctaacttttttttttttttgtagagatgggctcttgctgtgttgcctagactggtcttgaactcctgggctcaagcgatcctccccactcagcctcctaaagtggtggaataacaggcatgagccaccgttcccagcttacagtcatcttttaaatgtctgcatttgtcttccatcattttttgatctgcttttagttgtagtcatctacaggtttaagtaacttttaatcttttttgaacccttagtcatattgaagatgttttatttaaaatactacttaaatgtagttattcgtatctagttttaccacaggaaaaaagtataataatatttctctctccctgttgtgtgtctcccctatctctttctcactctttttttttttttgagcactgtgatcagtcgttggataattgtgttgcttaattattgatattttgtgcttatgtcacacatacaattaacatgcattaattgattatttctcccatgtaatcagacttggtttaaatttataattcattttcactacatattatgtagtgaaaatataatggttaaatacactcttgttagttaaattttatcatccattttactctttgtggacttcaaattttgcagtataaataagaaaacggactgttttatatggaagtgattacaattcagtaggtggcactctttcaatttctgttagtgttaatgaatatccaattaaatgtcaaagaatgttttaaaatcttgagaaaaagcatacaactttagtcattgatgccttgttttagaaaggatagtaacaatttgttcataatttagcgtctctggaactttgtgagaatagttacgtatgaatatacttaatatttatttgccttgaggaaacttacctaaaacagaatttcttttaataaaggctttgtgatatcctatctgaaactgtagattttctattcagaaatttaaattactgtccattattgtccattttccttccatgttttgatttttaaacattattactagagtcccagtacaacatgctttaaaaacattaacacagttctctcattctgacacagcagcttttcttcttcttcttgttctttttttttttttttttgagacggagtcttgctctgtcaccaggctggagtgcagtggcgcgatctcggctcactgcaacctccgcctcctgggttcaagcgattcccctgcctcagcctcctgagtagttgggattacaggtgtgtgccaccacacccagctaatttttttgtattttagtagagatggggtttcaccatgttggccaggatggtctccatctcctgaccttgtgatccgcctgcctcggccttccaaagtgctgggattacaggcatgaaccaccgtgcctggccagcttttcttctttttagtctatgcctgtctttttccattatgaacataatatttagctagctggatcagttaacacaacttagttttgctctttttattcagcattatttatgttctgcttttttttaacgtatcatttgttatgttttccttgttcctgtgtattttttgtatttcctatttttaaaagaatatgccattagttacttagccaatcgcttattgttgggcatttttaatattttaaaatattgcaatgttgcatcaaatatctttgcacatgtttttcttttatattatttccttatgataaattcccagggtagaagtttttaggtcaaaggtataaacacatttatggtttttgacacatattacccattgatttccaaaagagttgtatcagtttacagtgccgtaatgaatgtatgattacaccagtgtcccagcagtctccctggaatagcatttcaaagtgtattgtttttttactagcttagattaaacaatttgggaggtgtgtcattttgttttaaaatttttagttgaaatgtgggaactaccaaaaaaaaaaaatctcccactggaatataactgctgttatttttttgacgccgccctccaggtctttgtgtgtgtgcgtgtgtgtgtgcacacggttcctgctttagcatagcttaagtgtagtgttgaattttatgtcctccgtttttcgtttaattaagtcacttactatatgctagtcattaatttctatttgctgggcagtgctaggggtaggggtgaacccaaagtgcataaaatgcactgaaatgatttggtttgggtggttctgttagtcacgaaagggtatgtggaagcgagaatgtgtttgagataggtggtaatgtgaaaatatttatgtttgtgaaatatttttatcttaaatgcttgcttggtgaatatctgtgagtattatagcagtatctgatcagatttagagtgaaggtgagaggtctcatctgaaatgaagatgaagagccttactccgtgtggctgtataatctcagcatcattttcaattggccgtgtgagaggccattccttagtattgagcatcttagtcttttctgatttttaacttatgtgaatagcattgctttcttgacatttcagattttttgtttttaatttttatttctatttgtttcttttcaaatgcgttgaaggcaacagattatttcttatggttgaaaaagtttgatttctgagtttaaaaggatgaagtggtttgtgtgtttttgttttttttttttttttttgaggcaatgtctcgcctgtcacccaggctggagtgcagtggcgcaatctcggctcactgcaagctccgcctcctgggttcacgccagtctcctgcctcagcctcccaagtagctgggactacaggcgcccgccaccacgcctagctaattttttgtgttttggtagagatggggtttcaccgtgttagccaggacggtctcgatctcctgacctcgtgatctgcccgccttggcctcccgaagtgctggcattacaggcatgagccactgcgcccggccaaaaggatgaagtttttaaaaatagtttttgataaaatttcttcaaaaagtattgtattaatttacagtactactggtaatatagaatacccattatattctgtcctttcatttaaaataatgtttctaatttgatagttgctttatctgcatttgtgatttttagttcttctggtaccaacatttaacataatttgaggaaagtgttcttaacccttggtgtactgtttgggtccactggctccagtttagttttcaagttttgtttttgaacagttttaactattacagttttgagtggttttgactagttgaaaagattggcatttcatgatttttattctttcctagaggctaacaaaaaaggagaaaaatgatcatttaaaaaaactgaaaaaaattcattctcttttgctgtcaccaaatatccactggacctcctataaagctaagacatgatgagacttcagggatcatatttcctgcatcttgaaacattttactattttatcgttgtaggaattattatcattcatcattactcatcagttatttccaaatatgctaaaaaagactaaaataataagtggaagaatgatgaaatcacctaagtaataatgatacaatagtgaaatagattgtcatccttcattttcttactgtgtgagacccagaacattatatttcaagaatagattaaaaaggactggaaacaccttctttttagtctgcttatagctttcatttgaatacagttgaaatttagaatttttcattttcagcttaaaatggacaagaaaaaaattgacatgtttcacagttattaaacaaatcaaaataaatgcaaagagatagcatttctggctgatgaggattataatggaattggccatataagtgaaatttcagactctgggtcttcagattacaacatcctagaagaattataagaaaattcctctaggatgacatctgataatatttcatatttgtcaatatgaattgacatatgtctaagaacaaacaagaaatatggtctctcatctagtcattcaaaaggactttatcatgcaataatatttttgtgacaagaacctagaccatcctgttctgaaagaatatatgagagtttaaaaatattttatgctgttaagcaccaaaatttacctgacacaaaaggttacatgtgtttaaattcttttttttaagacagagtcttgccctgtcgtacaggctggagcgcagtggtgcagtcatagctccctgaagccctgacttcctgggctcaagggatcttccgcctcagccttctgggtagctggaactacaggcatgtgttaccacatccagctaatttttttttatttctgtagagacagagtcttgctgtgttgccctggttggtctcaaactcctgggttcaagtgatcctcccaccttggcttcccaaagtgctgggattacagatgtgagctaccatgcctggtatgtttagattcttgttaaaacttctttttttcttaattttgagacaagagtttcgctctgtcttccaggctggagtgcactggtgcaatctgggcccaccgcaacctccacctactgggttcaagtgattctcctgaggctgagcctcccgagtagctgagactacaggcacccatcaccacacccagctaatttttgtatttttagtagagacggggtttcaccatggtgtccaggctgatcgcaaactcctgacctcaggtgatccacccatcttggcttcccaaagtgctgggattacaggcatgagccactgtgcccagcctatatttctaataaaattgttttcactatctttttattcatagttctatgcattcttcattaaatggcttaacaatataaaggttccattggagccagatgttaactggtactagctattcttcctgatatactgagggttaaagtaaaaaatatttctcagatttaatggcattattacattttaacacttctctagtgtacagtcctaattatgtctgacatacacaattgggaatagttagaaggaaatcattctggaccaatcagtaatggaatgaaaaactcaggaagtcccaatgccatggtaaaggagaaaaactcctttttcatttcctttcatgtacagtgtgttcagattaactttaaaggagagtgagatgtaggtcttaagattttgtctgcaattgagtattacctgtatatggagcccatctcagcaggcacccagtcatcagccagcaaccccttccaggtccctcgacctggtccctcgacagctgctagatatcctgttgcaaattaaatatgaagcagggatggacttaattttgcatttaaaggatttcttaaagttcagcctcaaatgaagttgttagtgttttcatttttattgaagctggctttgttggaaaggaaggggcagctagaattgtcctcagtggtattaaagaaaaatgctctggaaaaaataaagtttatgcctaaagtttggcataaactttatgccaatatgcctttatatatctatatgccacatttcataactcttcttataaatactgcacagttgtcaggcctgccaaaatggtatgtagcctactgtgtcagtacagcctgttagtaaacatatgtttatagtttaactgtttcccagtagggtgtttttgagactttcctttttcagctttgtctttctgaatggtagtaacaaagggaaataaaacatggtgagtttatatcacactttgagggacaggaggctaaactctagaattaaacttatgaaccgcaacaacacttacatgtttccttaggtaccaagtgcttcacacacattaactcattgaatcctcataataatcctgtgaaggaagtactagtattatctttttttttcttatagatgagggaaataaagtgtagggataacttttaaggtatgttagaaactggtagatctaggatttgaattcagacagtctgactctaaagagcttttttaaaaaaattactgagctatttttgtctttagattatattactacaagtgatattcccgtttgtaagacatcatcctaaaggttcagtgatccataaggaatatttgggatatgttatgccactggtgtcatcctgtagatcttgcacttctgggacgatttagggttattgcatgggatgtgtgaatttatgtttcataagcattgtatgtaggctaaattttaaaaaattatgtaattgtgttttaaatgtgcataatagttgtggcttggaaaattaaacttcatttagtattgcttagttcatagctttctgttattatgtattgcccccaattatcatatattaaaattataacaactattgggggggttcatgcgaactttttttttttttcttttttgagacagtgtctctcactctgtcacccaggctggagtgcagtggcacgatcttggctcactgcaacccccgcctcccaggctcaagcgatcctcccacctcagcctcccaagtagctgggaccacaggcatgcaccaccatgtctgtctaatttgtgtattttttgtagataccaggttttcaccatgttgcccaggctggtcttgaaatcctgagctcgggcagtctactcaccttggcctcccaaggtactgggattacaggcgtgagccaccatgcctggcctcatgaaaacttttgatgttaaaaaatagggaatattatttgttaaaaattgttgggattcattgagtgagaagtttacaggctttgcttaaaatatagatcctcgtatttcctgataagtcctctctgtctgggccagggtaaattgcatagccaatagcaacaaaactcagtgttattttctattcttagtgatgtacctgtggattaaatctttactatgttttaataaagaagcaaactggacagttactactcttttcattgatttgctttcatgagtgagaaaatgctgcattcattttatactgcgacggataggacaattcatgatgtcagtttggagaagccatatgtcagaggcaaaagctatatcatacataaatttaaagttaaaaactaatactatttaaggctgggagcagtggctcatgcctttaatcctagcactttgggaggctgaggtggacagaccacttgaggtcagcagtttgagaccagcctggccaacatggtgaaaccctgtctttactaaaaatacaaaaattagccaggcatggtggcacatgcatgtaatcccagctgcttggaaggctgaggcatgagaattgcttgaacccaggaggcagaggttgcagtgagctgagatggtgccactgcactccagcctagcaagagagcaagactccatctcaaaaaaaaaaaaatatatatgtatatatatatacacacacatacatacatacactaatacgatttaaaatatcagcctcacaatacatattctaatatttaagagagaaaagtttagctttagggtttcaggtttattttccagttcgcccaaacatctaagttagctgtactgtcatctctgtgtttatggtgctttgtacatgtgtatgttatggtacttattattcattttattcagttctttcagcacatatttattgttctctgattgtgtgtgccagtcactatcatgaacacagaaaatatgtaagtgaacaaagcagataaacagtctctgcttttgtggagtttacacttccatggatggaacagaaaggaaataataaacataacaaataagtaaattctatagtatgtttggaagaggataagtactatgagaaaaacatagagcattttaaggagaaataaaaatgctagagtgtgggaaggaaagttgcaattaaaaatatgctagtcaggggaactagtgagaaagcaacattctagcaaagacttcaaagaggggagagggatagccaggcaggccatctggggagtgagcacttcaagcagagaggatctggtgtaaggctcacaaaagggcacatggctgcggtgtttgggcacagtgtggaggtcagtgtgactggaacagggggtggttggggcagagtgttaggagaggagggatcaagaggtagcaccagagatcatcatggcaggccttgtggcaggagtttgacttttactctcagtgagaggaattgaagcattttcatgttaaaacaacttttttttttatcataggaaattttcaagcatgtaaaagtaaacagactacaacaattaacttccgtcatcacccagcttcacccgtatctactcatggccagtcttattcatctgtgcccctttcccttctcccctttcatgttggcttgatgaaaagccctgatgaccttattttattttacccacaaatgttttaagcatataactctaaaagataactatttttggcatatctacggtagtattatcacacccttaaaattaataattattttttcttccttttgttttcaagacagggtctcactctggcactcaagctggagtgcagtggtacagtcctggcttgctgcagcctcaaactcccaggctttaagcaatcctcccacctcctgagtagctgagactacaggcgtgagccaccatgcctggctttttttttttcttaattttagtagagatgacgtcttgtcatgttgcccaggttggtcttgaactctcgggctcaaacgatccttccacctcagcatctcaaagcactgggattataagtctgagccaccatgccaagcctttcccccaccatctcccagagacggggtctcactttgttgcccaggctggagtgcagtggtgtgatcatagctcactgcagcctcgaattcctgggctcaagagatcctcttgcctcagcattcaaaagtgctgggattacagacgcctggcacctagctagccactaattcttgaatgtcatcaaataaccagtcttttcacattttaaattttctctcaaatgttataaacgtttgttggtttattatgtactgttttttgaattagggtccaaataacatccacacgttgtgactggttgatctctctccctctctcattctttctcattctctgtctctttcccttttacattttcatatttgttgcagaaactgcgttgtttgtcctgtagagttttttatagtctgaattttgcttatggcatcctaatggttttgtttcacgtggtcctctgtttatcccataaattggtatagtcggttctaagagcttgatgaaatgtcatgttcaattgttttggcaagactacttcatagctgggggtgtgtaactccgtcagagtacacataatatcaacataatatcatttgtgaatgtgtgggtgtgattttagcaaacattgaaccattaagtcaatagaagttgcaaattggtaacagtctaattctgttttcttcacaagctggagtgcttctataaagagaaacttcctatcatctactatttggtttcctggtggtagagtttgtatatgaaaagctggatgaatgcttgatcccttttcttcattcatcagttttcaaaataatgaatttgtttcctaccttcttccaatagtcaccaactagttgtgcatatgttttttgaaagtatcattatgatctcatggatttaaacagatttgatagatattagtccatttattatccattgatgttcaaattgtcccatctttggcatatgagaccagtggtgtgttggagctggctcatacccatttttgagagtgagttggcaaatgttgtttaatattcagtcagtttataggctggttgttaaacacagcctttatttaaaaaaatcatataaacttataattaaataaattatactagaagcaaaggtgctcaaactccatcactttctagttatcttatttttgaggttaagtttattgtagagttgggtgaaaatactatataactgtgcctctgaacacctcccaactccacatgtgggggcattacattggcggcttgaaattggccattgtaggagtgtttacatcacagcagtcagcaaatgctacagatcatggcatgatttattgtcttttttattgtctagacgtcaggaggtggtggtgaaaaatgtagattaaacttcaaaatgtatagtatctgtagctgttccattgtaagtagtaccaaaaatggtataaaaatgaggaaatattcttcaactgttatctgattcagcaaagaagttgctcacatcattgacacgtgaaattctcacataccccttccttgttttgctttagattaaactagaggtcagcaaactgcctggcctgcagcctgattctgtaaataaagttttattggaacacatctctttccatattatgggtgactgctttggcactacaatggcggagatgagatgtgacagagactgtatatcccaaaagcctaaaatagttaccatctggtcctttaagtgtgctcttctgtagtctaaaccaacattcatgccaaactgcattcatccatcagttgcaaccacaggttggccactgatagataagttttggaaatatcaataaaaacatctgtgagaatcaattggctgcatggaatttataataaagagtgttctttttatttgtaaattatgtgctgtgcctcctttatatcaacaaaacttagaagaaacacacacacaatcattcgccccactcagccagttgttaaacatttaccagcatatctctcaatacacttgcaatcggatccagtgaccgatgtcattactgaaatgattcaaccccttgaatgagatatttggaaattgaataagaagtaagaaccatcaggtttacagggataatatattcaaggctcatgagaatttagtactgcacaggaattctggtcagccaacacatatttgcaaacatgcatagagtttctattttaagttagttgttgacttctagcaatagcagcccccaaactgcctacgtaagataactggaaggaattatttgccccaaaacaatttctaggtccacactgttatgcgagccgcagcgagatacacacatggaagctctatgtgatttttggctcttaagaagttaacatgctaaagagacaaagctaacatatacaaagcactttcattactgcagtgagtataatatggattcagaatggggaaagacttctgtgaggtaaagcaactggaagaagcctggggaggaggtagatcttgacctgaacctggaccttgaaggataagatttaaatttcagtgaagagaactgaaaagagccctctaatgggggggcggggggaggggagcttcactaggaaatcaggaagctagggaagaaaatatgtgcatgtttctgtgtgtattcgaagggggcttcctggtttgtgaaggacagtaagtattcagatccatacgtagatcagtagtatgttacagtagcatggaagccatttggaacatttagattgtagtgtgaacttctgaaccactgagtgttgtggatgaacagaatgagacagcaaaagtggtatttgttaaacacttttgacttctggttgaagatggagaattaaatctatgtattcacctaagctcccttatgtcaccatgctaaaattacagtgaaggggttttaaggtgttgttgtagttgttaagtttgtaagtctaaaaaaatgaatagaatgggataaaaggcaagagtaacccattttttgaaactggaaagtcgagggtcaaatggtaaagaacttagcagacccagtacaactgaatcccaagccagcaatgcggaaacctaagacccatccagagccccaggctttgtggcttcaggtacttctggaagtgagggagagaaatggttgaaaatctgtttaagaagcaaatggatacatggatttcctccctggtttggtgcagctgagcagctgcctctacaaaagactgacttcaaagggccaaacaaagggaccgtgggttgaggcctgtgataacacaccagaccagaaggcagggatggcatcctgaaaacaagggggaattcatggaatgtgaatacaccggatgccgagatgtccagcctccttccatttgagatgctggcagccatttcttcatcctttggggaggagatttgagatttctctaggcattctgatcaaacctagataggatacccaaagatattgatggtaggcatttcccaaataaatagctcaatccgattcctctacagtggagtccccacttcccaagccctgagtcccactgacatactcaaagctcccagacagcttttttagttccattctaaaggcttaccagacaaaggaagaaaacatctgatatgaaagggagcaaaaccaactaaaaagcaacttagaggaaacagtcatgcaagaggaattaatttgaaatagttctttacactgggcgtggtggctcacacctgtaatcccagctctcagggaggtaagaggcgggaggatagcttgagcccaggagtttgagacctgcctggccaatatagcgagaccccattctccacaaaaaggaaaaaaaaaaagacaaaaaaaaaataagcgtaatagttctctactagtattctaagagaggacaagaaaagataaccaggaagcaagagcagggtgctattttaaaggaggaaatgggggaaaagaagaaggggaagccacagaagcagcattccaggccaaaagagctcttggaaatgggaaatcatggcagcagaaatttttttaaaatgcagtcgagaactagaaaataaaggtaaggaaatcctagaaaaagcagaatcagaaaagattttggctgggcgcagtggctcacgccagcactttgggaggccgaggcgggcggatcacttgaggtcaggagttcgagaccagcctggccagcatggtgaaaccccgtctctactaaaaatacaaaaattagccaggagtggtggtgcgtgtgtacctgtaatcccagctactcgggaggccgaggcaggagaatcgcttgaacccagtaggtggaggttgcagtgagccgagatcatgccactgcactccagcctgggcagatgacacaggacttcatctcaaaataaataaaaaaatagattttaaaagagaaaagattttttaaaaattatagaaccagtccaggaagcctaatatctgaacaacaaaagttcagagcagaagcctaggagcagtgaccatccgtgtgacactgaggaccaataaagccagattgttgccttgaatttatttccctctaaaaggaacaagggctccttcgaaaaatggctttttccaaatctagggcagaaaatctgcaaagtgacttggaacattttgttataccaagtagcaaggaagctaccaaagattagggttttatctaaaggactccgaagccaacttaaagacggtcccactcactggtgctctggtaaatgtttaacagctggttctcaaaaaaaaaaaaaaaaaaaaaagcagaaagaatgcttcacaagtttattttactaacataaaaatgtgtagtaaaacatttacaaatactaatgagataagcaatatccttgtagtaaattccatgtagccaactgattctcagagaatgcttttgttaattttcccaactttcatgtccgtaagcaaaccactgttacaactgacagatgaatatagttccaacgtgaatgttggttgatattttcctttatgttaatgaggaagacaaaagtgaaacaacacatacgaatgtcaaaacctccctccttgcttaatgatatgagtgacttttttgctgaattggatactagtttctgaatactggaagaatatttcctcagctgtttgtgttcttcacaatggaacagccacagctcacttataaatgtaatctacattttcaacatttctgaaactttgccttccctatcacaggtacatagttttatccgattagcaagttagagcagtttcttcccactgcccccttaaacagtctgtccgggagaaagttctctggagctggaggagaagttggcaggacgcctacagagtagccatgggtacccccagagaggaagggaattggtgccacacagtcttcggagtgtggaggtggacactgggtagtgtatcatttgtggatgtcacaagcctctactcagacttgttctaatgttttaaagggcattttgattttatgttgcttgcattcttcatcctgtttgtgagttatttcatgaaagggtaattgtattttgatttgagggaaataatgacttttttctttcacacgggtataaatatctaagaaaagctcttagctttctgtcagcttttttatgtgattatttacctcagtatcttaagtgatgtttttgttaagaaagaaaaaggcaggggaaaattagagaagttatgaaagtactattagctttctaaattcattgggaagaaactctcttgattttcagctatatcacaccccagggttcttttcaacatttctgattttttttttttttttctgctaaccttagggatttctcagaaactttgccagctgaattatctgggggaggtaggagtaggggagagtggaatttgaggatttatggagttgacagcttacaaagaggtttgaacggcctcagtagaatattaacatttgggctctgttttgttacaaatagggacatgaaatcatattgcttcctcttatatcccatagtaaaagaactatgggatgtagttcaaaatatataatcaaaataacgattggcctggctgttaagaatcactgtcttttcccagagaatttttgtgatagaatataagatcctcctctttattctaaagccactggtctgcaggtcatcaaagaagtgagtgatgttacaagcaattgccagtaatattgtatcatttggacttggattctggttctgttcctgaattgtatgtttagtttttcttcctggcgcttgatcctttagaacctcctggatgatacaatcgtttatgtcagctaggctacaattatgatcattagcaggggttgttcttgcatctatacttaactgttttttcactagttccggatcttactgattaggtactttctgaactgggaggcagaaaaatgtcattgattggcaagttcgtatctgtgtcatgttgaaaattgtcttagattattaactaagttcagtctttttgtgtgttctgcctgtcaatatatctactgttaatgagaacttattttaggattgcagtgagtttaatgtgtataacatgcttagaaccgtggccgggacatattcacatgcttagcacatgttagcagctatgaattattttaatgtcaacattatcatcatcagatttcactggtacattataggctctgtgtgtgtgtgtgtgtgtgtgcgcgcgcctgcatgtcactgaatgtacgtgtgagtgtgcgtgtgtgcatatgaacatgtgaatgtatcctcctccattactgctggcctcttcagcgtcttctgggctctattcatatgtcatcttgtcgaggcctttctagaacaccttattgaaaagtgtggtggctcacgcctgtaatcccagcactttgggaggctgaggcgggcagatcacgaggtcaggagatcgagaccatcctggctaacacggtgaaaccccgtctctactaaaaatacaaaaaattagctgggcgtgtggtgggcacctgtagtcccagttactcgggaggctgaggcaggagaatggcgtgaacccaggaggcggatcttgcagtgagctgagatcatgccattgcactccagcctgggcgacagagtgagactccatctcaataaataaataaataaataaataaataaataaataaataaataaataaataaataaaagagaagtgtgatgcctcttctacatatacacatcctgccttcagatcctgccatgtggattctgagtttcaggagggcagcggggatttctgaaatcatctgacatgggccttttcttcagtccattccagattgggggagaatagtagggacccatattccaacatcgccagttcctgaagtcaagtctgagatagggctgtccactgggcactggccgggtttcacctcctccattcctacctcatgtctttgctgttgataaagaaccttagacgccctccatttgccctccatttgagaatgaagtgagggaacaggatacggttcatctgcccattgtgttgtattccacttttccgccggggcattatggctgcactttattttactcatttagtttgttttcttcctctactagaatgtaatccatgagaagagatatttttgtcaattttattcactgtttcattcctagcacttataatggtgtacagtgcctagtaggcacttagtaaatgttggacaaatggccgtttcccagataacttattatttcataatgattattacgcatccttggttcatgcctctcaatccatctcatcctaaatatggctactaatggcagttacatatgttgaaattcaccttttgaaattctagtttggccaggagtggtggctcatgcctgtaatcccagcagtttgggaggccaaggtgggcagattgcttgagctcaggagttcaagaccagtgtgggcaacatggccaaaccctgtctctactaaaaaatacaaaaattagctgggtgtgatggtgcatgcctgtagtcccagctgcttgggaggctgaagtgggaggattgctgaagcctgggaggcagaggttgcagtgagccaagatcacaccactgcacttcagcctgggtaggtgacagagccagaccctgtctggaaaaaaaaaagaagaaaaaaaaaaagaaaaattcaagaaatgaattattaagcgtttgaaaattagtttttataaatggttggtatgataggagcatatgatctatgagagaataaagttgtacctttgccccatcccaatcacagcctcttctttcctccaaaagtaacccctacacttttagtgcacacattttatatgtattattttatgagtgtatttgtacattttatggaattatttcgagatacttcccctcatgtactacttggttgtccagaggtgtagttcatatagaaaaaaacaaaaaagataaatgcttgatttcttttatacattgttttcaacttaacagaatgactcattgtcacctacaaaaggtaccaattaaatttttatatcattctgaacttactgatttaaacatttttagtgggttttaatccatctcaattattgtccatattggagtccagttgcccagtctttagctaacaggagccttttctttctttctttctttctttctttttttttttttgaaatagagtctcgctctgtcacccaggctggaatgcagtggtgtgatctcgggtcgctgcaacctctgcctcctgggttcaagcaattctctgcttcagccttctgagtagctgggattacaggcacccaccaccatgcccagctaattttttttttttgtgagacggagtcttgctgtgtcgcctgggctggagtgcagtggcgccatctcggctcactgcaagctccgcctcatgggttcatgccattctcctgcctcagcctcccaagtagctgggactacaggcacctgccactatgcccggctaatttttttttgtatgtttagtagagattgggtttcactgtgttagccagggtggtctcgatctcctgacctcgtgatccgcccgtcttggcctctggagtgctgggattacaggcgtgagccaccgcatccggccctgcacggctaatttttgtatttttagtagagatggggtttcactatcttggccaggctggtcttgaactcctgaccttgtgatccacccaccttgtcctcccaaagtgctgggattacaagcatgagccaccgcacccagccaacaggagccttttcatctttgcatctattccttttgactagatcctagtgattgttgatataggttccttgttatctgatgggacaagtcaggttcatcttgtatatgtcatgactgagacgtgaaatcagccatttctcaaaaaagtccataaaaaatgattatataattctgtactgattttttttttcattttagcactttacagatatttttccaccatctcataacctccattgtttctgataagaagtcagacgtcatttgtcttactgttccatggatctcatgtgctgtttttctgttgctgctttcaggccttcctgtttatgtttggctttcaccaatttaactaggatgtgcctaggtgtggttttctttctttttttttctcaatgcttgggagttactgaacttctttaatgtgtatttatgtctttttccaaactggaaagtttttagctatttatttctttgaatattttttccctatcatctccttctgagacgccaattaaacttgtgttagaccttttgatattgttccatagagtcactgatgttctgctcatttttttcagtctttattctgtccgttcttccaatttgataatttatgttgatctattttcagggtcactgagctttctgctacacatgcagttaagtttgaatttcagatataatatttttcagttgtagagttaccatctggtttgtttttagagttccatttctctcctgagattgccagtgaatatattttcctttatgttcttgaacatagtaataatagcttcttgggctcctcttagtgatggtctcatttgattgcctttctcttcagtatggatcaaagttttctgttttttcacatgtctaataattttggattatgttcttgacattgtgagtgtagtttgtagagaaggtggattctgctgttttcctgatgtttgttttttgtttcagcaggaagttaccttagttcaactcaaactccaagctgtttttcctatgatgggcagcagcagaaatctctttaggttttgatttgtgtgtgtatatgtgtctgttttctggactattatctttatttttttctaccttaattgaggcataatttatgttcagtaaactgtacatgtttataacatttttaagttttgacatatgtatatacttgtgaaagcattgtcacagtcaaaattatgaagatatccatcaccctgaaaagttaccttaagccttttgcaatccatatctcctcttccctcctccccagggggatccccaggcaaccactgacctatttactgtcattgtagattattttgcatttttctagaattttatataagtgaaatcatggtatgtactgttttttggtctggccttttttcaccaatataattattttgagattcatccaaaattctggatattttgcaaatatccataagttactcctttttattgttgagtattgttccattacgtgtatatgccacaatttctttacccattcagctgttaattgacattgggattttttactgtcttggactatttcaaataacgttgatatgaacatttatgctttcatttatcttggataaatacccaggaatggaatggctgtgaacaataagctatgctttatctctgacctaggagtctgatgtcttctgtgaaaatccaggaaactgtggtggactaacttcttggaagtaggacagcatttcagaccctttatgattcttgacactgagttctttgcattttcatataaaatttcaaatcaatgtatcatctacaagaaagactgcagggttttgtactgggactgcatggaacccatagaccaatttggagagagttgagatcttcacaatattgaattttctgattaaagaatataaggctgggcatgacaggtcacacctgtaatcccagcactttgggaggttgaggcaggcaggtcacctgagttcaggagtttgagatcagcctggccaggatggtgaaaccccgtctctactgaaaatacaaaattagctgggtgtggtggtgcacacctgttatcccagctactcaggaggctaaggaaggagaatagcttgaacctcagaggcggaggttgcagcgagctgagatcgccccactgcactccagcctgatgaccagagcaaaactctgtctaaaaaaaaaaaaaaaaaaatatatatatatatatatatacacacacacatatatatatacacacatatatatatatacacacacatatatatatatacacatatatatatacacatatatatatacacatatatatatacacatatatatatacacacatggcacatgtctccattttttaaagatctttaatttttctcagtgatgttttatagttttcagtgcatctcttatacataatttataaactttatccgtaaatatttcatattttcaatgttttacatggcatacatagtttttttctttaacaatagacttaatatttttaagaacagttttagattcatagcaaaattgagcagaaagtacagagttcctaaattcatcctgctccttcatccccttatccttccccactgtcagtatcctaagccagtgtggtaggtacactgatgaacctgccttgacacattattattaccagagtctgtagttttccttaggttcactcttggtgttgtacattctctgtgttttgacaaatgtgtaatgacaaatacctgccattataacatcatacagagtagtttcactgccttagaatttttctgtgttctacctattcttccctcccttaccccaacctgtggcaactactgatcattttattgtctccatagttttacttttttcagaaattaattgacagatatcatcattatatgttattactgtgtacaacatggcattttgaagtatataggcactgtggaatggttaactctaacaaatgcattgtgtcacatagttaactctttgtggtaagggcacttaacatccactctctacattttaaaaaaatactacagtatattattcttaaccgtagtcacattgctatacaacagatctcttgaaatgtgttcctcctatctaagcgtaataatgtgtccttcatgtacaggtttctgtgtagactcgtgttttcatttttcttgggtaaatgtccaggagtagaatggtggggttatacggcttgtttgtctttttattattcagctgtgaaagttctttacctatcctggtcatcagttttttatcatctatttgttttccaaatatttcctctcagcctgtggtttgctttttcattttattaacattatctttcaagaagtaaatgtttcagttttaaggaaatatagtttatctttttttttttcctttttatgttttgtactctttgtgccctaagaaatctttgcctagcctaagatcacaaaggtttttgtcctgtgttatcttctagaagttttatagttttaggttttgggtggctggggtgggtggctgggagaatgaatgtcaaaggatccctgcaccatttgttgaattccattgctatgggagaagcttggtagaaatgccggtggatttgtggatagagtgatgggttgaggagggagtcctcaccagtggtgactcatgggaagcttcagagggaagtgagtggggcctgggggtcaggagcttcaggagtggagagggcagggaatagtggttcagaaagtaggggccgggcatggtggctcatgcctgtaatcccagcactctgggaggccgaggcgggcggatcatgaggtcaggagatcaagaccatcctggcttacacagtgaaaccctgtagagacagggtttctactaaaaaatacaaaaaattagccaggtatggtggcgggcgcctgtagtcccagctactcgggaggctgaggcaggagaatggtgtgaacccgggaggcggagcttgcagtgagccgagatcgcgcctctgcactccagcctgggggacagagtgagactccgtctcaaacaaacaaacaaacaaacaaacaaagaaacaaacagaaagtaggggagcaagctgcctagaaaccttggtgcgtgctgagctgtgtggggcctccctggaggtgggcgtagtaacaggcctgcgtgtcgctggctttagcagccccggcagggtggatgcagccacgtgcaaagtagcaactaggttcattcttagagttaggctttcacaggcaggggtgaaggaaaaatagaaagttgcttagtaaatgtgcttctcttgaatggacagtacttgagctgaggtcaaacctcgaacagcagcagaggatagacactgacaaggactctcccgtcacctcccctatccatttccttcctttctgctccttctagctgctccgttttatgtctcttgcatcttgtcagcgttgatttatgcagagaaaagcaactatgaccatacttcatcctccccatcgtgtgtaacagactggagcatgtggtgcaccatgttcggcaccttgactttcgttttacccaatagcatatcctgtagctctttcctgttggtgggaaagaatatttgagagtcatcttagtgatggataaaggaaacacttaatagcagttttttctggatcgtaaagtaatttctgaaactctcctgtgttttctaagttcctccagtatgcatatgttccttttatcattagcaaatggaatgaaattcccttctttcagcacatgtccactctgtgccgtcactcttccaggcacgggggatggagcagtcaataaataggcaggctctgcttccatggtgctcgcattctcatgtgggctaatcatccaaataagaagatgagagatgaggctgagtgcaatgcacaagagaatgaacgtaggggcctgtgatggtggctgaccacggaatttcagggcaggccttctctgagaagggagcacttaagctgatagctcagtgatgagagccagtcatcgtgaccagcaaagaagagtgtgctagacagagaagagtgagcgcaaaacctctgaagtgagagtcaacttgatgttttcaagaaacagcaataaggccaacatgcctagaatctactgagggagcgtggcgtaagatgaagcagaggtcagtgcttatctggtaatcagggagaagaatgaggattttgttttaactgcaatgggaaaccattgaagagttttaagttattagaaaggagagctatagaaaaagccaaagttgccaggtggaaaaagaccctagaaagcccaattagaggcgagtgttaggaaaaccctgcagtgttggacgcatcaggttaaataaagcttaggttgaaaacaaagagaagtggtttattaatttgtttttatggtgcgctctaaaaagtaatctccctgaaatgggaactccaaatttaaaagataaattttagatcaatgtgcaatttaaattccaaactgaggaaagcagtttttaaagatatgatttcggctgggcgtggtggctcacacctggaattctagcactttgggaggccgaggcaggcggatcacctgaggtcaggagtctgagacgagcctggtgaacatggcgaaaccccatctgcactaaaaatacaaaaattagccaggcatggtggcatgcccctgtcatcccagctactcaggaggctgaggcaggagaattgcttgaacccaggaggcagaagttgcagtgagccgagatcatgtcactgcactccagcctgggcaacagagtgagactgtcacacacacacacacacaaaaaacaaaaaacaaaaaccaccaaaaaaagatgtgatttttaagtatgcattttaaaattattttgtattttagaggaagaaattagtatttagtcatttgtttcttctagaattttaatgctgatgctgagattttaggaaacctagtgtttaaattacagctcgcaaatatttcctgattcatttaaaaattacaccctggctctgaaattagcccatttgtgtttgttttgcctttaggagatccacagtgtagttctggagggtgtgtagaatataaggaaggggcaccctcattctgtctgatgtctgaatatggaggagacaggtactcactcatcctgtatggtatttcaatattgtggagacaggatggctactggcagtttttgataaggaggatagtttgcgcagctttgaataggaagcaagattaatgtctttgttagccaaaatgaacagttagatttttattacaaagttgacccttgaacaatatgggagttgggggcacagacccctgtgcagaaattcatgtgtaacttttgactcccccaaaactttactaatagcttactgttgactgtaagccttaccaataatgtaaacggtcgattaacacgtatttcgtatattatatgtactatgtactgtattcttacaataaattaagttagagaaaagaaaatattattaagaaaatcataaggaagagaaaatgtatttcctggtcattgagtggaagtgggtcaccataaagttgttgatccttgtcatcttcatgttgagtaggctggttggggggttggtcttgctgtctcaggggtggcagaggtgggagaaaatccacatataagggggcatgtgtagttcaaagccatgttgttcaagggtcaactgtattgtttgacaagcgagatgttctgaaataagaataatagaaagtcatcatccaacaaaagtaatgacaagaagaagaacaagaacagcaagctctggtgaccattcaggagtggaggcagtgtgacatagtggtccagctctggtgattcaggagtggaggcagtgtgacatagtgtcaagctctagtaaccattcaggagtggaggtggtgtgacattagcggtcaagtctagtgaccatcaggagtggaggcagtgtgacatagcagccaagctctagtgaccatcaggagtggaggtggtgtgacatagcggccaagttctagtgaccatcaggagtggaggcagtgtgacatagtggctaatccatgtgccttgtaggcacacaatcttggattcacatcctggagcagcctgttagtagccatgttctattgggtgggttacttaaacattccaaatctcatttcctcttatggaaaatatagatcataaatagtacccacataacagggtagtagtgaagatgaagtgatcatctatataaagatcctagtgccatgtcttttggcacctagaaagtaccaagtaaacaagaacagtaatacatttaatataataattatgattttgttatctgttttacttataaggcaagtattcacatcaccatttttcagatgaaaaacatacttagagaactctaaatttcctaagatcacagagctaggaaatgcagtggcagggtttaaacttatgaaggtctgactccagaatttatgcttttaatcataactccatatttttttctagcaaggtccttccaagattggatcattggattcataattaattcagagtgtaaaacaatacatcgtagaacaattccctattttgcttgttaatctaaagatttcacattatattctacttattttaaaaataaaaaatattctagaagatagtaactttagaaaaattttaaaatgtagataaaaaatgtttacagataagataaaagaaagatgtcacatataatcccatgaagaataatccttcctgacttctaccgtgtgtgtgtgtgtctgtgtgtgtgtgtctgtgtgtgtgtggagtggaggcaggagtgtagagacgcacacacacatacacacacataaatacatacgtacatagatgttgatttctttttccaaaatgagatcacaccatatattctgtgctctgatttgggttttctccccagcttattttattgtgaaggtctttccatgtctgttaacttatcctcatgggagcatagtgttgcattacctgtgtgtgccatcatgaatttacatagttccctgttgtgacatttagattgtgtagaatttttcactattttaacagtgcttttattaacattcttaatcacacacatccatttgcgttttctcataatttccttaagagaaattcctggaagaactgctgtgttgattgtcacctttttaagcttttgatacatatttcagttgccctccagaaaggctgtcccagcatgcacccctgcagcagcacggactgcctccttccctgtgcctgcatctgcagtgcatattatcctttttgatctttggcagactggtgaaaaatagttctgtcttgcatgcctttgattaccaatgaatatatttatgtttataaactatttgtactttttccattataaattgctctttaaaaattctttgcctcttttatcacgcctgacccctgggttttggttggcccagagattactgaactactttcgaccccaagttttgcatatttaaatttatttttagggatttcaggtgagcatctttaaaaaaattagataattaggagaaatgaaaacggcttgtattagtatacaaatagtaatgtaggtattggcataaaacaaaacttgctttaaggactcgctctaaagacatgtctttcccattacattactgaatagaggtttaactttgaactcattcttatgagtagggaatcataaaactctgatcccaagtccatcattccttcttctttgagcatgaaattctcatcagtcattggttgtactttggaactactgtatattagaaaccaattctcacttttccgggagtatattgtttaaaaaacaaattcagatccatcaggatatgttctctccatttttacttatagttaattctctgctgctttcctaattacttttgtttcttttcttccagtggtcggttagaatataatttatttacgtgagtgttgcctgatggaagatactttctggtggttcattataaaatacattttttaatgtaaacttcatttttctattgatttccattgtacaattggaaactgtaactgttagtgaaaaatggcggtctgttgttgaagagttaggatggtaacttgttaaacttctacagactcctgacttgagtttttaggccttaacgagcggcagaactcgacacgcttctgagttcgccttccttcacttcttctctaagtcctttccttgagtgtcttaacactcatgcctgcccccacttaacatttttccctgacagtctcctgctggggccattttgttcttgatcccttcttctgccctgccacccccactccatatttaagatgctaaaagaatgtattctaagccttacctttcttgaagctcagagtttcttgtaatatgaaaaaaaattgtttcctataaagctattaagttcttatattgctttcagaagtataattttcatgacttagattgtatgtatctgtgatagaaattatttttgtataaggaaagacaacggaaaatttttagtctagacataacagtttatttttgctagaaattaaaaatagtaatacactgtagtcagtcgtttaatatacttgttcttaaactttattagttcacttaaaagtttcctatcatacaatataaaattcaaagattttaaaatacatgtagctggaagtcttgttatttcttgtaaatcagacttgcatatgtggtagaatttctacttcaaacaaaggaaatattagtaatgatggctatttcattattgagatctgtgtgctaagcatatattaattgttcctaaaaccagatattcttacagaaatatttattggattaaagaaatatttactggttaaaataaataaattgatagtaaattttctctgaatctaaattgatgacaaataactgctgctttttttttttttttttttttttttgagacggagttttgctcttgttgcccaggctagagtgcaatggtgtgatctctgctcattgcaatctccgcctcccaggttcaagtgattctgctgcctcagcctcacaagtagctgggattataggcatgtgccaccatgcctggctaatttttgtatttttagtagagacaggttttctccatattggtcaggctggtcttgaactcccaacctcaggtgatctgcccacctcagcctcccaaagtgctggaattacaggcgggagccaccgcgccaggccaacgattgctattttgacatgacattatatgcatgacagcctgagaagtaaaaattcatacatttaatgaattagattttaatttcttttactaaatatgtgaattttagattaagaaatattgattaactatccaaatatttctaatatttgttcatcacttaaaataaacatgatttgtcttttagccagatgatatatagtgggaaaccacgtttctgaaattcacagttatttcaaaactataaatttaatcgggacgcttttcacatgtcaagttaaatattgatttaggtttaaagtgacacaagttgaatttcattatttatattaaagaaagtcagcgaaatttccataattaaagtttgttcttcctggcattcttttctaatttttctttttttaacctgcaaagtttccagtttaccagtagagggcactgttgtaacatggtagaagtgttgggttgattttttttttttttttttttctttctttcccagtagctacccgctcctccgcctttgcagtttggaaagtgttttttaaaagcaatgttctctgtgtaattaaaatcagttccctgtataattagcaatggagccttattctttgtggcagagtttgtggatggcgttattatttaagtctgtgttcgtgtatagccaatgccagaactgttgcctattaaaatataggaagttatattgccgtttatcagcactaagcaatattgtagatggaaatatataaaattacagtatgtttcatttaggtgctctgagcaaattactcaatggggaacgtttaaaactcctggttctatcttgagaaatagcagagttaatgtgccatagttataatatcttgctttcaggtgccctgaataataatacaggacaactaattcttgcagggttttcaaaactatatctgcattagtgtactgcttaagaaagccactgatctacttagcaaattctttatataatttctttttcacgctgccttaaaatcatacaattttgatacagatatcaaactactaaaatagtattaaagcacaattaaagttatttctttctttcttaaaagacatatatgttatataaaataacattaaatgtgcattcattgcctggctgccttgggaaatatttgggggcagggagtttagagagaatccaagcctgaattttgagttgtcagaggtgtaattcatgaagttataatttatccataaatcccaaagtctctataagtagtttaaaaacaaacagaaatcttatttcaagactaaattatagattatttgctatacaattttttggaactgaaaaaattaaaagtaataatttaatatgtttataattaatttcattctgtgctttaatatttgtaaaatatttgagaatctggaatcttagggtttttaaatctttaatcgatagccatatcaaattagggaattagtattttcttcaagattttttttttctaactttatgaaatactctagctaaaaagttggctctgttgaaattgtgtttctctctaacagacctattttaaaaggtggaaaacggctttcattgacttactttgtatccacagacttaggaaagcaggtaatttaatgtttacttagtgatttactttgacaataaaaatgtagggtaaaatttgagagatgaacgagatggttgaggaacctgtcatgtaattttagaaaaacatttaggaatatcttttatgcattagtcactgcaggtgcaaatttagaatagtttagtagaactggaacaaaatgtcattttctaaatctaagtttctttggtgttatggatgtccccaagggaagacatccgagttctccccccccccccgtcaaaagggggtgtcgaatttgaggggagtcccccactcccttgtccttagggtacgtcataaagcagatgggaccaggtattttgaagaatcagccaaataacagaaggacatgacagaggctgtcctagttccttgattaaaatgtgtaaggttgattagagaaaagaacttaatgctgtttatagatagaaaactgttgctttctcatttcttattaccaaagtgagactgaaacaaatgttgattctgttggcacatttgtattgagcacttaggttccctgtatcatcttggtcatgattaccgctgtgtttcccctcgagaggccattgcaggttttagtctgggctatttgtattcagcaaggtcaagataagttttatcgttacagataagtcaagtgcattaggatcaataggtaatagtaagtgcattgaagatattattgccaagctcttaatgattttttaaagctgtgagcttgtcatataaaatatacctcttattgttttatctatctgaatggagctcaggagtccaattaattttgcggacatttcaagaaagagtaaagaaacttaagggcagattaaagcaatgtttttggaaatccttaattgctctgcatttaaacttgtactgatgaagttttagaggctaattatttttaaagaaatgcaaaaggacagctagtagacagcatttataaattacaaatattacttgagtttacttgttaagacaatcattttttgaagttatatatatcttacccctgggctttcctgcataaatcagatttctgcttcttcaggtggggaatagtgtggaaaaaaagaccttttatacttaccaagggatgatggtgagtatttcattattttagaatttctgttctggcctaaatatataaataagctctataagctctatatatttaaagccaaaaatatcctaaacattttcatgattttttttcttttttactgaaaggaatagtttttatggattatattaattaatatattaaaaatatggactctaacagatatgttttgtcttagttttttttttcagttaattttctgtggcccaaaacatgaccacaacattaggtgaaatgtagattgcatttcttttcttttctaggtgcagattacatggaaaacttttttcatcgatttcttagctgtatgtatcatgtaactgttcaaaacacataaactaaagaaattatgtattgagctcgggtttttttccttcttcagtacagccattttaaaaaatcctttctaaactttttagacttctagtttggaatgttgtggtgcctgcttgcatttgtgcttcttaatccttcaaaatgtgctgtttttcttttgatactcaattatagatagcagtttgtaggttttccttgttttaagtgaagctttcttatcttagctgataattgaaataaggagactgaaaccaatcttcatattgattttatgtattctttatcagtcactatttatatggtagtaaataatcaccattgctgtcataattgttcctcctcgatattttttttctgtctccatacattgtttatttatttaaccatttaagttgcaggtaatataagcatgtgacatcctttctggaaattgtaaactttttttttaaagtcctataaatgacgttctttgagcctttggcttattaatctttataatattggtctacatttccacctacttagccatttctctttctggctgaatagtgataatttttcctcaacattaggtcaatttattttattgctggattagattgattgtgttataagaaagagaaaaccaagaggtacagaaggatgtgtggaaacctccactgaaaacggatgctgtccttccagagccagcgggcacgaaggggttgttggcctccagttgaaaagtagcatgaaagagaagttgactgcctcttttcaaaagttatctttgtgtggtggtcctaatgcaatattaagaaaattagagctttaaaaaccagaacaatggtccttttaaaatatatctagtttagtgaatttaccccccaaagcctctggtgtctaattactcaaaaaggaaaagaaagaggagaaatctttactagcagaaaaataaattgcaaaaagtggcaagtttttacttttatggaaaacattttaattctgttttaatccagaaggcaataaaagcagcaaattttaagagtattcatttttttcttgtacgactaattttaccgacagaaaataattgaactccaaacaagtgatagtaatcttatattactattaaacttttattttatttatttttctctttaagtttttttatcatactattaaacttttaaatttatatttataaaaaggaagtttgttttcctcctttttacttataatttatcttgtctgtataataaagggagacgcttaatgaccaaaagaacaaatctgtacatagataaattaattttgtgcggtgttttatatttttcttttctttgttcccaaatagtgatgaaatcgactattttagtaagagaaagactggattattgtttagggttaattttctgaaatattgtgaagcagtttttaaatttaacaagattaattattacctgaaagcaatactttagcttcacatttagaggtcctcgtatttcagactgtgggcctggttttctctaaaattaattaggaacccttgtaaagaggtattttcaatgaaatgggccataagcaggtattttaaagtacatattgttttctaaaagttttcttgttggttttataagaatcgaatatgaaagaacaacttatttattgtagcaggagttcctgtaatgctgtttttggaaatgagtttattgtccacataggagaaagaggagagaggcagtcttacctattcctgtaggtgagcaccgtatacagaatcacgggggtcagtggttatgtgacagtttgtgtgtttactcagcttacttgaaaatacagctatattgtcctaaaagtcaggaaagttctttgacttaattatctttatctttggagcatagccaaagtcattatttccactgaagttgtcatctgtgctttacattttcttccatctattaaaactatttttcctcttcccccagcagattgttgaaactttgggaagtgcatgattcttcctccagactcttttcttgtactagaaataggacagtgccagacctatcacttgtactttgatttgctgcctttatctttagcaaatctaaataaaactgtcatcctgattttcagatctctctttgaacttcctttactcaaattgcccactttcctatctgctcactactttttttttttttcctaatggagattccacgtctgaggtttattttttacgctgttactgtcctttcttggatttttaaaatactttttactttataacttatctgttacttccttttggtaaacacaaatttaggtgataattacttagcttaagtgagaaaattgtcagtctccatgagtctttagaaataatttatactgatttcataatttctaaaaagctacctgactttgtgactttggggatcatcattaaggactgaggtggcaagaatggtggtatggaaatctgggaggtttttcttctttcatatttgagtgtatttcacataataatttctcaatattttacaaactgtgtaaaataagtagatacatttcttagcccagaatagcccacaaatatttaatgaaagttggaatttcttgttcagttctttaagacacatagaaaaaattgtcatagaaagcaccttgttatttaattcctaaatatttagaatatgaataagaatgtaatgagaatatggcatttattgttagaattttccaatattgctttgatataatgaataatataaatgctttccctttatcattatcttgtagtaagagaatttaagaattttagaggtaaagtgccctctgagattacaaccctactatttaaaaaataagacaactgagacccattgtgatgaagtgacttggccaagatcttaaaagctcattagtgacagacatatagagtgaggtttcttggttcttactccattttttttaaccacatgctcaattctgtgtccctctctctccttctagtaccgtttatacaccgtgtgtgttattttgagaagggactagttaatttctatactgtaacggcaattcagatctcaaatacattggagctaatgtttctgtcaccttacctgtcacagtgtcctttgagtagacgcgtactttgcaacttggcatttattcagtaaacattttttttaagtatgtaccatgtgcctctggcgtgcaaaataatagggaacgggtattatgcatctgaccttcctgtgttattaattctaaaacatgatttttaaaacaatacatttaatcatatagatgtacccaggagcagatcctgattttgtgaggcctaaagcttgtacaattttgggagcctttttaaagaaagtaatataaaatagcaaatgcaaaagcagattcaaaggcctgtcagtagtagactgggtaaatagattgtgaaatattatatagcaatgaataaaaggctctccaactgcacacagtgtgaaaaacatctctcctccattgaattgagtgaaagaatccaggccctcagagcacttctgctcttagaagactggctgtggttgccttggagtattgggcctgaggagggaggggtgacgggaggagtaagggtacaggtgatgttctctgtcttgatctgagtgtgttcagcttgtggaaagtcatcaggccacacacttagggtatattaactttgtatgtgtttattatactttaacaagggtatttaaatcagctatattggaagggagtcctgtaagtgagaaacccagaggccactagcttataggaaattccctctctagatgcactataattaattcaaccaatgtatgtatgtatgtatgtatgtatgtatgtatgtatgtatgtatgtatgtatatgagacagagtcttgctctgttgctcaggctggagtggagcggcatgattggggctcactgcaacctttgcctctggattcaagtgattatcctgtctcagcctcctaagtagctgggaccacaggcacacaccaccacacccagctaacttttgtatttttagtagagacagggtttccctatgttggccaggctggtccggaactcctgacctcaagcaatccgctcacctcagcttcccaaaatgctgggattacaggcataagtcaccgcgcctggcaaattcaaccaatttagtgttactacacatttaggctctttccaatacagatatctttttgaagctaagagtttaaaaatttataattttatgaaatgtttaatatggccatgtttagaggtttttttgaagtgttattttaaaatagtagattaataagacatttatatgttctatttgccctttttattttgagagattatacctttgtcataaaattactttcaccaattatagttaaactgtatggtagattattaattacaaacttacctatgaaagatttttggaactgtacactattaatgaaacgtaactatggtttcagttggtaacatactcatgcataattgattatatattttatctcataaggttttgagtcagaactatttttattatacatgaaatgaaataatgacacccaccctcatctttgtacaagattaaaaggaacaacagtgaactgtcttatttggaaaatgacatggcattattttagaaaacatttagaaatttattatactaataagccctaatatggactcctgaaatacaaagtgtaaacaccggctctttttgtaagacaattcagacagcatagaaatgacgggagatggtttttaggatatttagtatttcttctctacctattgggtaactcactttattcatctgatgggccatagttatttacctttctggatttatgggtggcttttaaaatattgttttgattttggccttgtttcttagtcttgtagacttgtatcattaaaaataatgatgcaattaaataaaatacatatttggatttttaacattcagtattcaaattccaagtatgtattttatttcctagtttgggagaaacaagacctagtaaatgaaataaaacctggctgggcacgatgggtcacaacagtaatcctggcaactctgggagtctgcagcaagaggagcacttgagcccagaagtttgagaccagcttgggcatatggcagaaccctgtctctacaaaaaatagaacaaattagctggccaccccaaaaatataacaaattagctggccttggtggcatgcacctgtaatctcagctactcaggaggctgaggtgggagaatcacctgagcccgggagttctaggctgcagtgagctatgatcactcactgctctccagcctgggtgacagagtgaaaccttgtctcggaaaaaataaaaaataaaactcaagtaacttactccttagactttttggggaaataactttgatttatcagagtgccttcatttgacagatttttgcacatctgaaaacaaaaactatttttgaattaatatgatcacttgttatgagatttaatatattaggtggtagtctggagggaattggtggatgtgagaaataagaaatatgcagctatcctgactagcaccctgagaaaacagtgtgccacagtattgaagagaagtgagccacagttaagtaacagaaacctgtattggaattttcttagactaccccactctctgcctgtatgatagacataatcctgctgacgttgtttcctttaagggccatttcttataaatgcatttatattcctagaataagctactctacacagtacatgttgtatctttccatgcctttaagtccctcatctaggtggatttttttttagtagtttctattctgaccaccaaggttatcagattcaactccttacctactcatcactaagccatttacattgtaatttggcaaagattagtcttgatgatgcgtgcaacagatgtatatttaaacgatatacctactaatattaccatatctaattttctgctaatccagcacatctgtgtttagaggaacaaacagaaataagagagaaatgattcacattacaaaaggattctcttagcccaagcatggtggctcatgcctgtaatcccagcactttgggaggctgaagctggaggctgatttgagctcaggaattggagaccagcctgggcaccatggggaagccccgtctctacaaaaaatacaaaaattagccaggtgtggtggtgcatatctgtagtcccagctacttgggaggctgaggcaggaggatcacttgagtccagcaggtcaagattgcagtgagccatgagtataactaacactgcactccagcctgggctacagaatgagaccctgtctcaaaaaaaaaaaacaaaaaaaaaacccacaagctcttttaatatactgttttcccaccatgtgtcgcaatactttactgtatcttgagaatcttcagttatatttcaatatcctaggttcctaaaccttaagatatgcctttaatgccgcctccaagtcagcagtatacgaaaacttcaaaattctctttaaaaggacaatagtttaatcaagtaaaagacatttgtctctcagacacacacatacacacaaacacacacacacacacacacacactagatagcaggtttagtataaaatttagcaatgaagctggaacgtaataagttttttatatcaaataggtatatgttttacaaataaaaagagcaagacaccttctatttctagggggccccttgaaatttgatagagtaacaatcatgcatttagatgtaatgaaaaaattgacctagaggaagcatgttagcattcagctggtagaagtgatgtgtagcagaaagagctgtgacagaagagctttccagcttgagttctccttccaactttcaatttcctttactgtgtaactttggaggagttgcttaccttctctgtgccctagttaacgcattaaaaagaaaaggataactgatttttgtgattcttgagcagagataatttcaccagagactttatatgttggtggacttccacactggctgttcttgtaaattcaccagcgtgtcctggaatcagtaatataaggaactagtaagtgcagttaaacaggtgtcgattgggcacctacagtgagttcaaaactgaactgagcagagttgatttgtctgtgagttttcatgaacacagctatttcctatactgatgcattataaattgtactgaattatgggaaaacaattataaatttcaagatgttttcttattcaaattttggaaggttttatctaatctgtggcttagtgcagagatcatcttattggagaccgtcaagcatcaatcttagcatgttagatttggaagttttggtcaatctaacgtgtattcctcatttacaacatgtttgtgcaagacatacatatacttcacagtccttgcctctgagaagtcagtctctcaataggatcttagaggtcatccagtccatctacctcattttataacagaggaaataattgttacagggatgagaaaaggaatcttcagaagtaagaaatgagagggagaagtttggtcgttaaaaaaaagaatgtgttacaattaaacctaggatgatggaaagcccttgaaaggttttagggaaataacattgtaaccacaggaaaagacacgtaggtttattggatgaaaattactcaggggtatacttggactcaacataaggaagaattctccaacagtcagtgtctaaaggtggagtgctcctatcagaaggcagtgagcagtaagatcactccctcaatgagcaagctttgcaaagtgatcacttgatgagggttttgtagaatgtagtacgtaaccactggggtaatacacctgggctttattttttcctttgtaataatttcagacttacagaaaagatacaagaatagcacaaagaattcctaagtattctttacgtagattccccaaatgctaacactttacatcgtttgctttttctgtgctgtttctatgtagatacatgttattttttgtttctgaactgtttgaaactaagttgcagacatcatgctcctttgtccttaaatatttcagtgggtactttctaaaagtgagtggcttctcatatgtaacagaacagttatcaaaataaggaaattaacattgatacaatactgtcatccaatccacaagctacactgagattacatcagttgtcccagtgataccctccgtagcaaaaggaaaggacagtttgtctggttgtgttcagttaggagtcccgtggtgcattcagtcagcctttctctttagttcttcaatctagaacagttcctcagcctgtctttgcctttcatgacctcaccactttggaagagaacaaactagttattttgttaaatgtctctccatttgggtttgtctgatattcctcatcaaattcagggtgattattttcatcagaaataccgtagacggtggtgtgttcttctaatgcctcatgtgatgagtcctgtgatactgatttgatggtaattttatttggctaaagtggtgacttccagatttctccattgtcaagttattactttctcctttgtcattgatagctatctggtggagagatactttgagactatgtaaatactctgtttctcatcaaacttttacctactagtttatcatccattggtgatctttactcatattaattattcctaatagttgctggatggtaaatttctaattccattcttccttctacatttatcagttggcattctactctatggaagattttcccctccttcccacttatttattcatgtattgatatccgcagacacttattttactcagtatattatactcttagtccattttctgttgcttagaatacctgggtaatttataaagaaaggaatttatctcttatggttatggcagttgggaagtacaaggtagaggggctacatctagtgagagccttcttgctggcggggagaggggactctcagagtcaccaggcaacgcagggcatcacatggcaaggggctgagcatgctaacatgcttgcccaggaccctcgtcttcttagaaagccaccagtcccactcccatgataacccatccatctgtgagtggattaacccagtgacaggagcagacccctcatgacccagtcacttgtcaactgccccgcctctcaatactgccacactggggactgggtttcgacatgagttttggaggaggcaaacattcaaaccgtagcatactcctttactgttattatttatttcactgcttcagctgtacccggtttggcccctgggagcccctcaagctccctcctatgtccttaggcatgttgtcattgttctttggacagtcccttactttctggcccaagaagatgatctaggctcttcttgtacttccagctttagccctggaagcagccgtttctccaaagagctctgcctcctttttttttttgagatggagttttgcttttgttgcccaggttggagtacagtggtgccatctcggctcactgcaacctctgcctcctgggttcaggcgattctcctgtctcagcctcccgagtagctaggattataggcgcccgccaccatgcctggctaatttttgtattttttagtagagatggggtttcatcgtgttggccgggctggtctcaaactcctgacctcaggtgatccacctgcctcggcctccaaaagtgctgggattacaggcgtgcgccgctgcgcctggcctgcctcctttttttgaagaatagagtctagaatccagggcactaggactggtcattgctattacaatgtcattgcttttagttcaccttagcagagctagggtgcatttatccatatccatacatacatctatgtctatttccataataatatttccatatgtattaaaagcatgatttcatattaataattccagttctgatttaatatcatacagctcactatctgtgtaattctagaatatacagaaaacagtttcagaattgctaacccataccaatatatctggagtttaatttttgttcagttttttttttttaatttgtagtttgaaagtatatagtcaaaactttgtgttcacaagatacttggaagggctgagggtggggaatggagtatggggagtaattgcttagtggctacagagtgtctgtttgggttgatgaaaagttctgaaaatagatagtggtgatggttgcatgacagtgtgaaaataatcaagccactgaattgcatacttaaaaatattttaaatagcaaattttatgttatataaattttgacacacacacacacacacacacacccccacacacacacaaagtgactaattccttcccctacccccagtgtagttagtgaggttatttatttgaaatatagttagattcgtttatttccatttatatttcttttttaggctttcctctcatgcttgagttttcttatgtaaaatattaatatggctccaaaaaagtcagaattatacaaaaaaggtatattcagagaagtgttgctcctgcattttgtctgccccatttccctcctcaccgaatcctttccacttggccccatccactgctgtaggcaaccagtctcattagtttctgctttatccttcctgtctctttcagatttattttctcctttgcatctatattcaattatccatgtttctaattcaaatgcttctttctgtgcctttttgttactttccacacagtcttcattatctcccaaataatcaacctttcttccttacagggataaacacacacatgttctctcctgtcagctaatgccttagtttcaccaccatcttttctctaaatggaggctccttgagctgacccatcactctttgtgggtgcttgccttcatgttattatttttgattacctgtttttagggttttaagtttggagaatcccatttgggccacatcttcctctgttgatacttttttttaattacgttttttgagacagtctcaatctgttccccaggctggtgtgtagtggcgcgacgatggctcactacagcctcaacctcctgggcccaagtgatcctcctgcgtcagcctcccaagtagctgggactacaggggtccaccaccatgtctggctaattgttttttgtagagatgtgggggggtctcactatgttgcctgggctggtctcaaactccttggttcaagtgatcctcctgctttggcctcccgaagtgctgggtttacaggtgtaagacaccacacctggccctgttgacactttgagatgagtcagccacattagacataaccagccgctccctaatgtttaccaagtgtttcattcccttctgaaggactggcatgacctggtccttctccaaacccccttctgcatgttcttcattttctttctttctctcacctctgtcctttattacaattcttccatatttgcctttattttttaatcatgaatatgtaactatttttttctttacacaaaatatataataaccaaagaaaagtttggtttttgcatttatagacctggcttaaaaattctagctttgccacgttgtggctatatgacattgtgaagacctgtgatctgaaatttctttatcagttagatgagggtaataatatctcatggggttagtgtaaaaactaagtgaaataacatatatacatcatagcacatagctgacatccagtaaatagtaagtcccttcccatttgcacaccttactcctaatacgcattttaacctcaacacttataacatgacctctgccttcaagagagatgcactttcgtatttctgtacttgtgtaagccttattcaggaagcaaaacttatgcttacaaaattaatagaaaaaatatagactaatcttgaattggaaaaattttaaataccatctctaagagtatctttaaattttatttgaaatgttatcttttatatttaagtgataagagctagttaagagggccaggcacggtggcttacacctgtaatcccagcactttgggaggctgaggcaggcggatcacgaggtcaggagcctgagaccatcctggctaacatggtgaaacctcgtctctactaaaaataaaaaaaattagccgggcgtggtggcaggcacctgtagtcccagctactcgggagacaggcagagaattgcttgaacccgggaggtggagcttgcagtgagccgagatcgcaccactgcactcctgcctgggtgacagagccagactctgtatttaaaaaaaaaaaaaaaagaaagaaagctggttaaggaaatgatgaggaaaactgaatctaaagcagtttatgaactgatgctgtagttgaaggggttgttgtgtacaatcgttgacctgtgaacccagcttgaaatgttgcttaggaaatttttgcaagtgtggaaagaactttttgtgattgcaaagagtcaagaaaggctttatccttaccatcgagagactccggatgtagctcttctctctttttctctgtttcttttctttttctttccccacttctgctgcttttagggaaaggaagccggagatgagagagcagagtagatgaaaatgcaacataagactttcctagtgataagtgtgaactgtttaggcaagatgaattgactgcctgggactaaaacagataagagccgctgggagtgttttgatgctgaatcatctgaagtctgagaacaaacctcaagaaaaggcttcaatccaagctaaaatcgggggggataaaggaaagttaaggatagagaagaagatccctggttataccttttggtttattaaaatcctttataattttaattggccacttaaaaaaaaaaacaccaaaacaaattatagaattggaaaagtgaagcattggaagcttttctgagctccaggccagggattccagctccaatccacagaccagcaatatcagaataagtcgaggaacttttttaatggaactttccaagcccttgaattcatatttaaagtgcccctgccaccaccgccattgtggtgaatgtcacccatctgtccagcttaggttcccttgctctgcagccagccgtcaactctcatccccagctctttctctccactggctcattcttgtcgcctgcaagcacactcagatctctcccatatgaaacgtttaaagtttttcctgaacgctgtcttcctctaggccaggatctacaccccttccttgttttacaaccaagcctcctaaaacactgtccaagcacatttttttgcttctttactccttaaccttcctaagctttcctcactctaaccttttcaacaatggtttccagagtgatgcacataatatgattcattgagacagtggagaaagtgtttaacttctatttatttttatctaaatttataaaaaaaaagtttcttgaatattttgatacattaattcatttacttttgatacatttaaacattgacaccccttaattagtaataggctcaggtcgtatcacaggcatgagatcttctaaagaagatgtggaggtctgcagtgtggagggttgacagggctcattcactcattggtttgctttcagtctacagtgatgtgtaacagtttatccatgcccagttaggtgcatttacaggttatgtaagtgccctcaccaaatggaaaagggtctttaaaagatgctagcctaaaagcttttggtcgaatatactatactaattataatgcaagacagttgaccaagaagacagtgacagagctttcgcatctgttcctggcccctgcttgtcattagccacgttgtgcttttaagatgactgtctcatctcacctaacaagaagttggcctgccagattcaaggctctaagtaaaactatttgaagtagagtttttcttctctactgttggtgtatgcacacttcctccggtgtatattgtgtcttgagagattagcccgtgattgcagcataggctataatttataaggatacatagacaggatggttgaggcactttttttttctacacgtgggatattggagctgctttttattaacatctccagttcccagttcgaatccacactttcagaactttatttacttcatatccttgtggacgtcgacattactgacttttcccttctctgaaactgcagacttgcttgccttccatgacagtactgttccttcttctgctccagcctttgcgttttcctcctcttaaatcttagtattgctagggttttgtctttgattctcttctcactctccacatttggggaatgatctcagctgtacagatatctttggttataacaaaagcaacaacaactaatattcagtaaaacatgctccatgccgggcactgttgtaaacacttcacatctactcatttaatcttcacaacaaccctgtaaggcaaatactattcacatctgtctgttacagatgaggaagcagaggcagaaagaaggtaaataattggcccttggtcacagaggtagtaaatggcagagactggattcacaaccactctgactccaggaaccttgattttaaccactcttgggcagggctaatgtatgcctcctgtcccttcctcaagccttgacctcttttgtgaggtccagactcatattcagtggcttactgggcaaattccacctcttagttattcttcccaagaaggaattaattatttcttccattggcctggtcctgtcctatatccctatcttgtgaaatagcctcgtcttgtgtcttgtttcttgtggtaaaagcctgggtggcctcttaattgtttctctttcacactcatctcatcagctgcctttaattcctgtcagttgtacctcctaaatattaaattcatattattttctaatgccacaggtcctgttctcatttggattttgaattttcagttacaccctcttccagtgtcgttttcctccctcctctagtttatcttccatcctgctgccagagcaacagttctgaaacagaaatctatttggttactgctgtatttataatttttccagttattttgacttccagataaaaatcaaacacttggccatggcaggtaagacctttcatgaaccggcttctgcccagtttcactctcagtcacttcgctgggacttttctctttttcaccagactgcagccagctgaaattcaccatggctctcacctgcctgcctttcttttctgtgcttggaaggaccatctcttcttatctgcctgctaaacttctgtatcccttttaagattcagttcatttcagattctccttagcctctcccaggtaccaagcctaattggatgctcttggtatagccctttatcatgctaaattgtcttgcccactgggtagtgagcagcttgtgtttgtagtctacgttccatcatagtagagtagaagcctcttatcctattagagttggttaatcgcagaaaagaagtttaagcatgcaattgtttaaagaagaaaagattcatattacgaaaactttatgcattttgttttaagatgtataaatatgtgcattcatctatcttttcagtacagtcaagactctttctgtgagtgttgattgtctgattagaatttaaccttgcttttcttgcataaaacacattctagcatatcatctatgatctccagtttcagtttcttttaagtgaaattagaactttaaaagcttacaaagcaatcagtgcagaattcttcaaattttaacttctaattcttttggtttatttttaagatacttcctcacacctacgtcatacatttttttcccaagtgattagtctatatcaactctttccaaagctttcgatttaggtttccttagaaataagtctctttttacattcatatttccttggttaatatttaattaagtaacacaattacagtaacaagtccagctgggaaaaactagtttgagaacagcgtaactgaattttgctaagcatgtagctgaacttgcggatgccagtacacatggaagcgttgaattggggccccgccctttgcatgtctgcagcaggcagtgagtgacagcagatgtgttttagagaaaaatggagaggacatttgttaatctagtaagtcaattgaacagaggctgcaggtttttgatataggttatctcccattggttgctggtataattattatttgttagctgattttacaatttacccattttgatataaaggagtaattttctgagtctgtttcagccttcatcttttattgatttatttgcttttaccttgaggtactttcaggaatgattaaggtgtacatagtaaaagacacagatacaagttaaattttgtgcatatagccactttttaaaaaaacctataaattatatcatttttaaaaaacttaatatgaaaaaggtagttatttttaaatgactatttgtgtgctaacttgcactatggtccaaactaagcaataaatgtattgaaaggcatggttaagtcctatggcataccacttacagcaaattttttgaaaacagttttttctgaagataccagtaaccttttaaaaaatgttttattttccctgttttctgtctttaccttcttatgtttttgttagaaacttttttcttaagatatttgattatggtataaggcagctaatttaagcatctgtttatcactgcctggctagactgaatgtaaaatttcaattgaattacctcccaggagagctttgagctcttagggtaaaacacatcattttctcttctctcctctgggattgtcagcagaaagaattcatctaaatagtttacatgcatcttgaaaatgttgtatctaccggacttagctttgttgtttgtggaacattgccaatataaatggagtatctactttgcttgttaactcaagtacaatagtgttatatagtattacaatatgtatataaattgtaacagtgaatgacttttgctgatagttaacttatgaccaattttcattaacagatagattttcttcttttaaaaatttaatttcaaaacccagatgtttaattattcatttattaaatatttattgagtaattagtgtatttacaactttatgcattacaaaattcagatgcatattatgaatgcttattttgctccttagcttctttctggaagagtttcaaattttctatgctcttttgtctatttcataaggacttggctaggaaatagattattgaactaactgaaaagatcaataagcagatttagcatgtgctgcctgttgggggctagaaagcatgctcagtgtgggtgagctgctgaggagctttcagcttcatggaatgtatgttcctttcttcaagtacagatttcataagaaagaaccataatgtacttttctttgttctacttgattacaaaattttgtaaacatagtcaaaaagcaattgaaaacttgctgggttgctctagtttttcttctgttacaataagatgtgatgattttttaaaaagcagcatatagcattttatatctttcaatatattaacatagtaaatcttaaactggtaaaatagaatatattgtcaaattataaaatgaaaatatttattatctctatcagttctgctgtaaagtttgggttggtttttgaaacacactgtttcttagaaaaattccaacagtatttttggttggtcagccagttagttggtcagttagtctatctatccatctttactttgaaatttccaagaatccgaaacagaactagtgattcattatttcaatatattttcttttctttttcttttttttttttttttgagacggagtttctctcttgtagcccaggctggagtgcaatggcgtgtgatcttggctcactgcaacctctgccttctgggttcaagtgattctcctgcctcagcctcctgagtagctgagattataggcatgcaccaccacaccccattaatttttgtatttttagtagagatggggtttctccatgttgatcaggctggtctccacctcctgacctccgttgatccaccccccttggcttcccaaagtgctgggattataggcgtgagccaccgtgcccagcttcaatatattttcttaaaatttattttataaaaagactttaacatacagtctttgagtatttgggatatatattgggaaaattgcagattacttctagaacttagtatcttttaaaagaatgatgtaaagccctagattcctgaaagaaagctttgttatttaataatcagttactaatgatgaattagtacaagcctaatagagaaacttttttttaaatctgtgcctttggatttggtaagtttatcacttaaaagatacgttgcttttaggatcagttaaacagagaagaagcagggaggagccatgcaatttgtaaatttctgcaagttctgtctacgtcgtgacccatcagaatcccttataagatttcctcttactgtaccaaacattcatatcctcaggtatttttctctctgtgctttgcctgtctgtggcttttgttgctgtagctagttgctccacctcatgttttgtcccatctttttcactcccgtagcgagatccgtccaagtgtcttctgccctgactcttgccagttccttcttatcatccctttgcttctagcgtaggcctggcctatctgtgtatgctcaccaaggttccctctttcccctgcccttccttcttcagcttttcacctctgttttgcccgtatcaatattttatcagctattttcttatctttattaggatccttcttacataaattgatcctcttaattaccacctcctttaatatttctatatacccatattcatttcatcatccttctcaaaagaccccttaagaaacacagaaagaggcagaaccagtctgtttctctcttctcccttctttaacttaatgttttcgccagcagagtaggtacaaaactcaagttactccagctgtagtcttctaccctgtatcatcaaaggaattgcacattttgttttattagtactaaaattatcctttttcttttcgccttttatattgtcttgcagtaagctctcagttgacagttagccattctaatggaagcaggggtttgtaatccaaagttagagtccctctctgtatttgacttaggaatgtggcacattttttccacttctcctacccctaagcaatacaaattctcccatgacggagttactgtcagcagggacagtcggccctcagggaacatagctggtcacagagcaaacgtgaaaaaaattaccacctaaggtagacaagtattatacagaacatcaaaatccatcaagtactcgttgcctgcattacgtctcagcgccatctggtttggagaagttaggtcactggtggagaggtggtatccatgtcttcatcctagcaagtgtagtgtgatgcgtcagtgacctgatcgattcctagatggtgactggacctaggtggttgaactgttaaaagtagaacaatgatttttaattggtcattgtttgaagttggaattcattttctgggaacctattttctgttcatttttttagccaattaatatttattgaacacttactataaatgccaaaatcatctatgaaaattttatatatgtttgttaaataaataaaatcaaatatttaacagaactaatggaactattttagtatgctttcccctgggctggagtgtaggctaagactttatttaaatacaggatggatggtgttttgactgaagatgcctccaacttttgctcttctgttttttatttgatgtgctcaagcttctaattcccttttttgttgttgttgttgtggatttttggtttttgagactctgccacccaggctggagtgcagtggcatggtcttggctcaccacaacctttgcctcctgggttcaaacaattcacctgcctcagcctcctcagaagctgggattacaagtgcccaccaccattcctggctaatttttgtatttttagtagagacagagtttcaccatgtttgccaggctcctgaccttgggtgatccgcctgcctcggcctcccaaagtgctgggattacagtctgcctctctttgaaaggtaaatcctaaatgaggggcaatttccttggtaacttgataacagctttagtgagtcctaaccccttgtttttattggcccattggacatctgcctagagcatgagtgccttctgtttcagtgatttcaacttttctggaaaatcctttgctgtatctgtacagcaatggcttcagtttcccattaaatttatattttgtgacaattatttctcttctgaagccagcagacagttcttatctcttccttagacatcccacggctctgtttttaagcattttgaagacagacaatgcttttcttgaaaccaatgcatcacactttcttactgacatcatggtcctggcacgaacaccttggcctgccacatctatgctgctgagttgtcagtaagacttttggtcataagtataagagtcttatttataatcacaaggaaatgggtaaaagcagagggctccaggttgagtcttgggaaattggggcatgattctaattgaaaagggcctgggctttggaatgagactttccattgcacacatttttttccactaattgtgtggcctctatctacagttatagaatttttgctttctcatctacaaaatgaggatgacagtatctgtttcttaggggtgaagtgaagataaagtgagaaaatgtgcgcagtttttctggcgttcagtaggcattcaccaatgtcagggctgctttctccccacccctgcgcctagttatcacgtgacaggaatcaagtgccttcagtgaacaccgaagctgaccatgcgggggtggaaattccaagttgggccagtgactgtaaatagtataaatagtaaaatatatatgagtagcaggagtgggaatggaataggagaattcagagaaggaaaaggagtgggttaccaatgatagttgaagtaactgcatcggttgctgctgataggtccctgggcctcagtttaccaagccctgaaatgaaatattggaaccttgttctattgtgtatgctagtaaggtaaaaacaactctgtttgaacctttcagttttctaataaaataataacccttctctatattctttttctcagatctttactcttgtgactccgtgaatggggggaaaacgtagaccaaaaccaattcttgccagaaccgttttcattctggggatggttgtaagttctaatgctgtcctgtgcaactactcccaggaacttggaggaggtcctacgacaagggagaaggacaggaggaggcttttcaactttgtctttgagaccaccacttgtcaccagccacttcctgccacccactcagccagctgggaatgtttgcttcatagatctctagttgccatagccccacacagcgtgcatgccacattctgtaacctctcattcgacagtcgcatttggggacagatttagctaagttgcagtaagtgggacagaggtctttcataaaatagatactttttccttcagtattgagcttttaggaaaagaggaacatatataatagcaaaatacttgattaataagtgtggtagttttctactaccacatgacaaattaccacaaatttagcagcttaacacaacactgagttattttcaacagtttctgtaggacagaaattcattgtggttcatctagattctctctttaaggtctaacaaggccaaagtcagatgtcagcccagtcgagcccagatgtcagcccagttggaaggcccttttccaaccttctttattggtagatttttgttccttgcatccgtaggactgaggtacctgttcctggctggccgtgagccagcagttgtgctcacctttcagaggctgccgacattcttgaccacatggtccctccatcctcaagccagcagtgacttgtcaaatcctcatgctttgaatccccaacttcttcttctgctaccagccagggaagactctgcacttaaaaggttcacgtgaagagatcaggcccgcttggcaagtctcgcttgtgcatcatcatcctgggagcaccaccttattgtctttgcagggtctacccacacccaaagaggacgggatcacacttaagccaggtcgccggggggtcacttttatcattctggctaccacagctcatttgactgaataaagaactttatgttgatatttactttccagtagaattttgagcaaattattccattatcttttagcattgagtagtatacttgagaaattctgatccgttctgaatcccaatcctatgtatactgtcagagttttctctctagcaaatttagattcttctctttatagccatgttttaaaatttcactgtgatttgccttcatgcgtgttttgtttttttcatggtaccgctaaggcaactgatgggctcttttaatctgataatccatacccttcggttcttagaagtttccctgttttattttcgcataacttcctttctcctagttcctattctctctctctctctctttctttctttctttcttttttttttttttgagactctcacccaggttgagtgcagtggtgcaaacacagctcactacagtctcaaactcctgggctcaagcgagcctcctgcctcagtttcccatgtagctgggaccataggcgtgtgccaccatgcccggctaactttttgatttatttgtagagacagggtctcactttggtgcccaggctggttttcaactgcagggccgagcgatcctcccatctccagcctcccaaagtgctgggattatgggcatgagccaccacacccggtccctattttctcttttggaattcttattggttggatgttgaatctcttgaacttttaatattcttatttttttctctttttattatgtctttgccttttattattcttttcaaaagcttttcttgattttatctatcaacccttctgtatcaactggtatgctttcaactccaagtaatagaatatggaagtacaaatggcttcaacagtaataattcattttttaaacgtaaataggactgaggaatttatgttcccaaaattgacacagggactcaacagtgtcatgaagaatctaactcttaggccgggtggggtggctcatgcttgtaatcccagcactttgggaggccaaggtgggtggatcacctgaggtcaggagttcgacaccagcctggccaacatggtgaaaccccgtctctacaaaaatacaaaaattagctgggcatgatggcgggtgcctgtaatcccagctacttgggaggctgaggcaggagaatcacttgaacccaggaggcagaggttgcagtgagcctagatcacgccactgcgctccagattgggcgacagaacaagactctgtctcaaaaaaaaaaaaaaaaaaaaaaaaatcgaactcttccatctttcttccttacttttcttggtgtgtgacagcctctctctccccctcagttgtaagatgtctgaagctcttcaagcactgggttcttataaaaccgctgtgcaaaagcagaaagaaagaggtagactctctttaagctcttcagacaattaatgttttttcctttcactctgagaatattgtgttgttttttgaaactgtcttattaaattgtctttgttttctttgagttttttttttctcttttggtggagatgatctcaaatgttgtggattgctgggtgtggtttcagacttgcgagtgaggcactcaaaaaccaagtgaaagtttcatgcgtactgtcagggatggcaagtggtgcgttgaacttcagggtgactgggaattggccttttctttaaaaaccattaatgtcagttcccataggttttttcttttattctaggtgagattcccccaatctacctggaagggagggattcttgtaaccggctgctagcatttttaagagagcatttaagagactggcattagaaggttgatatttttgttgatcagattgaagctttactcaatattgcgattttcgatcctgggcctcacctacatccttgcctgtgcgcagtctccctcgatctggagccgttctcattcggtccctccatccatctgttcctgcctccttcccttccccagatgtcttctgcccaagggaagaaggaatcgctgcctggctacttgaggttgtgatggtcatctgggtggctggcttccagcacacacattcagcaagtcccatgtccatcttcccagggacctggcgcctctgatccccagactcctccatgattctgtcctgaggagcagtttacttacacatttgcatttctctttgcagtgtttctttccctctacagttaaacccagccattcaccccttctccatcttctagaacattgctttctatttatattccatgtgcagctttgtgcttggtactggaaggttaagacagtctgtgctcaggaagcttccattcccgttgatactgaagaacacaaaggaagaaatcagaggaaaagcttagatgttcacagtaaacatattactaaataaaatgatttatgtatatgatagactattgagtgctcattaaataaatcatgtttttgaagatcacgttagggatgtgctctatagtatgttgtaaaaataaacaaaactgtttagtatgatttccattatgtagggaaatgaatatacacgtgcacagaaaaatactaagaaaatgtaaactgcaatattagtgacttttctagattatggggttatggtgatttttaaaggcaagtatcttttgaactacagtgaagattgcctttcccctcgttttcctcagtggacatgttaggcggcgtccactcatatccaactcccttcttatttgcctccccattacatgtctgttaaaatatattgaaaagatatccatcctgtgtaatggtgtaaagcttacaccgaatggtataaaatccactgactgctacaacttagaatagttataccagtacttttgccttttcctaaggctttgaacatcatagtttagccacttcctaccattttctctgttatttcttattgccaaaataagtcttctattctttaaaaaagtcaagaaatgaagaagaatacaaatagtgttttgtagcaattattgataaattatacttttaatggaggcatttgtttcaaaatcattcttataaggaaacatatgataatgtgttatttcttgggtttggaattgttttggtagcctgaaattggagataaaatgggtgacagctttgtacatgactgctactcctcggtggatggctggagagagctcagaggcccagctatccaaccactattgtgtggtcctgaaaggagccaagaaaacaagcacacaccaatgctggcatcattgaaaactcctgtgcccctataatgtggggcatgaaatcgaatctcaactaggaaaaggtagaaagttatgaaatgattcagattcttttaattactatagaaaaactatttttataaaaatttttatttctaaaacacatttaagtagcagtttccccagtttggggggaggttacataaggaaggtatagggtagggtagtgtttcactgttttactgaactttttgctctttaggcttcgtattaagaaggtaaagattttgattagaagcacatggattttctcctacattagcagatcataaaactttttaaaaatcataataaatttatcacaaaacaattcacgtttaggataccatattaatcttttaaattattttttaaatgggtgcttcttgaagtagcggtgtatgtagatatttataatttcttctggtgtgcttgtggtgatcatccaaaaattagttttctggttacacatttgaagctactaagatccactgcatttgattataatttatttttaaatgccctcatattataaacctgtatcttttatggggacttatctaggtgttggctgtcaatgattttattaaagctatttgtaattaagtttaactaacataaaactataatgcatatcctttggatgaagaaaatactttaaaaagaaaactttaaaatacataaatacattcttggaatgtttccaaacctctgcgtagtccatgccacagaagtaaagggtctttctcaaatgaagttaattacccacagggtgcatgttggtcactctttaaaattcttataaaaacaaagaaattaattatccagtatgaaaacaagttctactctttctggcaaacattcaattaactttttagtgcttgctatttaatgttgtttttgaccaaccaaccattgaaaactactttcctttgaaattgggcttgagtagaaaacagtattatgtgtggctgtttagatggccagttccatttggccatcagcttttttcccatgatctttgaattcaatggcttgttatattttagactcactgtgaggtgtgcattgagcacagttattttgtgtatttagtgttggaattaacatctaaaatgtgttgggaatacccagtaaacttcttaaattaatattttatattaagacgcttcagaaatacaatggtattaaaagcactttacagctgaatgactaaggctgtgacggtcacatttaaataactttgttttttcagaaaataggtattttcattgcctttctttctgatattttgtggatgtttccttcctatgttttggaaggtatattccaaatttgataatcttatcattttgccacattggctttcttccctttgaactgacagatttgtgtgtgcacgtggacgctcctccagactttatgttcggaaccactgagaatactggcagacactaactccgcaccccacgttcgtcagtgtgtgtgttttcttagaaccaggacatttcttctccataaccaccaattaacatatttagggactttaacattgatgtaacatcactgtccaatattcagtttggacatatccaatcccagcactttgggaggctgaggcaggcgaatcacttgaggtcgggagttcgagatcagcctgaccaacatggagaaaccctgtctctactaaaaatacaaaattagccaggcctggtggcacatgtctgtaatcccaactactcgggaggctgaggcaggagaatcacttgaacctgggaggtagaggtttctgtgagccgagattgcaccactgcactctagcctgggcaacaagagcgaaactctgtcttaaaaaaaaataataaaaaaagaatcttttcttaggagatgttattaagagtccgggccaatattgactgcgtgtggttgttttctcatgacgaaactcaggggaaaaacgtttctcagggttttcataggtgctgttgtttccttttcagtgtgttacatcaggaggcgtataatgtcaggctctctgggtgctgggggatgactgtgtagttcagatggtgtctatcggatgtttttcatgtaaaggtcactttctccctttataattaatgagtaataggctgagtgatactgtgagactttgcaaatgttctgatcctccgcgttcatttagcatttattgatgattcttgtcagttattatacttgtggctgtagaatgttgattttctatcacttctgtattgaaattcttccatttaagaaaaaaagaattgtctctcttccacttctgtacccttttttagtggttagaatagactcaggttttttttttatttaatgtttaaaaataataaagtcatgcttgtgctcacctatggtcccagctagttgggaagccgaggtaggaggattgcttgatcccaggagtttgaaaccagcctggacaacatagtaggaccccatctcttaaaagaaaagaaaaagttatcctggcatggtgacacacccgtgctcccagctacttaggagagtaaggtgggaggatcgcttgagcctagaaagtcgaggctgcagtgagtggtgattgtgccactgcactctcagcctgggcaacagagcaagactctatctcacaaaaatgtaataatccatttctgtcatcatgtatgctgctgctcaaattgtcccaaatttgacaaatgagaggcccctacaggtgacccctgtgtcctttgacaagtgtccatctcagcttttgaacattttcttactcttctggcacaagaagccccaggctcactgtgtacttcctttccttgtctcagccttggaagcaactctttctccaggaagctcacctccttttagtgaggaaatggtatttagcaaaatttaaaatttttaataaggacaacggtgtttaactgtattgtaagcctgtgatttaatatgtttttatcttaggaaataacttcttacctataaaacaaggaaatgttttgattagttcatctttggaattgcttagctgatgcagtttagcattgcaccatatatgaaaaattagaattatagaagcacgattttcaggagactacagttaaaggaaagatcaaagtgttggtcttctcctttgaatttaatcatcttttccaggcagacataaatatgttttatttagcccatgtttaagaaatatgtattattttgcttggaagttctgtggatattgaaatgactgggatatagatcctccccttcaggggcttacagtctctcgggggacataagggacataagacaagtattcagagatacataacgtgagataacctacagtaagtgtgagaatattttacggtattgtaggtatctggaaaacagagagcagatctgggtcagggtgtctgagaagtttcacggtgcgtctgagttggagcagagtccagtgtacttggaaacaagggccgcagagggaagcagcagtgctagaagtaagaagaagccagtttagagaggccgtgaacttcacactgaacttgttctgaattcagcggcagcgagagcctgttcagtctcgcatagtggggttgggacacgctcttccgaggcagtgggttatctcaaatagagactgtcttgggcagtatggtagtggcccacacagtagagttccagaggccctgaaatgttgcttctctgatgagccctccctaaccaagcaagactggttcctttctatttatgctttgtagccctaatacaactgaaatgaaatgatctttgatgtatttttttctttaaggcctgtcacccccattaactgttaatgccatgagaaagacgttgtctgtccagttcatcattgcatattctacacctagtagtctattagtgcctgatacacgcatttatctcatatttgttggataattaaatgactgagaaataataaatgagtgtgtaaattaatgagtgaaataacaaaggaaggaataaataaaggaagggaaagatttgctgatacgtagatagtagtgaaggggaaagttagaataaacaggagagaagggccccagcacacattgcaactggcaggtgggtgggctggaactgtgtagtgtgcacagcgttggctttcatgatatttagtagaaatttggaatagttaccagcatttgaaacttggggttttttccagattctctggaaaaactggaagatctggtgacacggggccgaccgtaactggctgagctcatggaagctggctgtgctccctttaggctgcacacatgaaccccaattccccgcacttcctccaccacccgctcctcctccacactgagctctccattgccctgcatcctttccctcacactgccctttttcttttgctagaggtgagaggaaaagtgaaacgtttcttgtatccgtgtctctttgagaagtggaaaaaccaaagatagactgaaaggctccaagtagtaggagggcattttctttgagaatgtgaagaatattcttagtctttaatatgcaaatagagtgtccctatggtaagaatacaactcaaggggggctatttatgaaatacaccctacgttagagtttgagaccccagaggtagaccgtacagaaaccgacaagtagagatgaagcggtaaacagaagagtgacacgcgctgccttgactataaatagcaaagtttagagaagcacctgtttcaggggaagccaatgattttgacattagagtttttcttaattttaattcaaataaattattaagtattttctctcttttagacaaaacctttgttttcatacacgatgaaaatgtaagtaattattgctattcaacttcattcacttttttagtttggataacgagttcagatggctggacatagctgtgttacagcccattttttgagtgtttttaatgaaatttgcaagtcatgggctaaaaacattgcaaagcaatatactcctttaaaaacttaagcagggccaggcgcggtggctcacacctgtaatcccagcactgtggaaagctgaggcgggcagattacgaggtcaggagttcgagaccagcctggccaacatagtgaaaccccgtctctactaaaaatacaaaaaaaattagtcgggcgtggtggcaggcacctgtaatcccagctactcgggagactgaggcaggagaattgcttgaacccgggaggtggaggttgcagtgagctgagattatgccactgcactccagcctgggtgatagtgcaagaatctgtctaaaaaaaaaaaaatttagcaaagattctgctttatgtatttgtactttatcaaatatatggtaaatgcaccaattttggtagaaagttatattcaaaagtttgttggcaactgctgatcaggcaaaaggaaatgtaatagaatgtgctttagtgtattgtgtcaggataattaaaagtgctcgtggataacacttgatgctatgaaaggagttttcttttattacttgagtattttagaatatatatgtgatatttcatctcttgtccaattcctctttctcctccaactcaactttcctttatttttcctactgaagttatagtttcagtgtcttatctttaatttcagtattggatggtaacatttctctcaagttattggcacctcttcctaaccaaagggtaaaacaaacaagatatctgataacgcccacatttaaatagagcaggactggattattcaatatccattgcttagtgacaaagctatcagaaacaggtggtaactacagctacatgattcttattcaaaggaaaaacctgctgctgcattggggaggggaacaatttgctgattaagattactattctaaacctctcttctttcggaggagaaaagccagaaaaatacaaaaagatttagggtggctgttttatgaaaccttagaggtttctgctaagacacaattaatttgctttatggacctgaacaaatgtgacactgacaaaggctccttatactttttttttctttccccaaacaggaaaatattgaaatttattcctacaaaagtaatgaaggaaccaaacgaattaaatagagcgcaagcagcatgtaagatttagttttgaaattctaccaataggcaccttatgcctttattttgtaaaggaggatcagttgagcccaggctggtctcaaactccagggctcaactgatcctcctgccttggcctcccgagaagctgggactgcaggcgtgcaccaccatgcccagcgtacaccttattcttctgttggtctctttttgcctcttgacattcctaacctaacagcgtgattcttatctaagactttgcatgtgaagtgtagcctttccctaaccccttactttctcccattcattttgggctgaaatttaggtgactgtcattgggtggacagtgttcgtagggccacctggcttagctttctgtaggattgaataacttacagcaatttttgtaaaatgtcaaagccaggtctggcacatatggagtagcagcagcacacgctggatctcctggagttgaaagtaggggcacagtcacacctgtgttggggtgcagttgcatcagagcttcgcaacaccctcggaatcacagcccttctgcagggctgtcattggtgcgacttagatcacagattgtgatgccagatgaggtctttgaaatccagcattgcccaaagtgtgctgttcctatccttgctggcagatgagataattttagataaaaaacaaatgggcatttagatttatttttttgtatttaatttatattagaaaaatacaattagcccaaggatccagtgagttcatggctattactgcttaggacaagggtaaagtgagtgttaaaaataagccaatttaagagaaataaagggataacaaagaattcagatgtcatgctgacattgcaaagaaattatgagggtaatacaatagccagaagtttgggcaatactgacttggtatgaaatggcttagatgggtgattcgtagcagagcctttaatgcctcatccattgccctgcccattttaatacatgcatctcccaggtaagctctttcttccaagggaggattctgtgtcttgaagtatgaaagctgctattataataatgtggagccatgaaaggtgtttggtgagtgggccaatgattagatctgtgttttagaaagactcctcttgaggcagcacagagggtgggttgaagctggaaaagccaagagggcaggagctagtgaagtgggctctgtgacaaccagcaggagtcgatggggactgaatctggagcggcagcagcaggaatagaaagaagaggctcagttcaggagatacgtagaagaagttggcagtggtgcagatttgctcagcagcgtatggaattcgccctgtgcccacagctctgggtcatctcccatcaagtcctttattccacatttccaacctgctttcattccactgctccctgccttctccattgccatttcctcttgtgtgtacatagacatgtacgtttgttccaaaacgagtcacaaactcagatgccttccagaaccaagcattcaggcattgattcagagggcctagtggtggggatctttgaactggagggggctttttctgcctgaaggccatggctactgcttagctcaggtgactcttcccatgcaggaatgcaagccctatgttgccaggtttttccattttaacattaaaaattggaaagtcatataattaatcaaaatctcctcaactttaagcattggcaactttaaattctaacaattgctatttcatgtgagcggctgtgaagattaaatgggttaataaatgaaaggccatagacctaacaccttataaatgtcatctggcattacccaacaccatcatggtcaccgtccccaccctcatacccacctcctcttctaaatctgggttaccgagcgcttctgaaggaaagtagcacagagctttatctgtataaagcatccagctaaccctatgccaccagagccacaaagcacataatgaggcagaagctgatctcaaacatttttcaagccacaaaaccctttcttcaacaaacgtttacagggaaacctgatatgtaagacagattagtttggatcttctgtgtttgaagtggttatgaagagctgcctgtctcccagagcagtgcttctcactgcatcagaagcctttagaggccttgtccaagcacaggtgcctgggcccagccccagaggttctgagtcagtggccctgggatggagcccagaacttgcatttctagcaagttcccaggtgatgctgctatgctgctaagggctgggagtccacagtgaagaatgttgtgctggtggcttagcaggtacaaaggtcaggagggagacatgtcccttaccagccgtcgctgggcctgtcacctctcccgtggaggcctgccaggggccattgctggaatgtgtttggtcgtctagaccaagtgtgggcctctgacctgcagtatcagcctcaactggagcttgtcataaatgcaggttcataacccattctaggcttactggatcagagcctctggggcccaggctctgggtttctgagagggctctagttgattcttgtacatgctgaagtttgagaactgttggtgtacatgcaccctagtcaggaggtggaggccagcttaagaaaccacctatggatagaaccatattcactacctcagcacttggcctccaccaccatctgcccctcagaacagcacttctgccaaattaaagacttgattctaccagaagcttccttggacttcactgtgccattggataaactagtgtcattggataaagtgctgcatctgttaacaacttaatttcaaaaagtgagtcaaagcaaagaaggccagaagatggaaggaagagccaaatatttagaaagggtgatgaattaaagtttagaaatattatttatgcttgatagcaatgaatccagggcaaaaggaaactatagtgcttaacagtctaatgtatggcagatactttcttaggcccatttgattctcatagcaaagtggagatttaccactttatatctttataaaggtatctttatttgcagaataggaatcaacagagccaggagttgagcctataacattgaaacctttattcttcctactcgctggtagtgatggttacagaagtcccttagtatctgtggagtactgattccaggacccctgcagatacccagctccacgactgctcaggtccctgatatggcatagtgattgcatataacctatgcatatcctcctgtatacttgaaatcgtctccaggttacttataattaatataacataaatgctatgtaaatagttgttatactgtatttttataggttttcattgttgtattgttacttttattggttttttcccctcaaatattttgtatttgcagttggttgagtccaaggatgcacagcctgtaggtagggtacagaggccagttgtttccctgaactcttagagttcctcagtccctccttatactgagcacttagtatttgtaaacactgacattttcctacttttatttaagtatgaagtgtctaataaagatgtatagtgtgacgtactgcaaatagaaaatactgctacaacatacaaacatctaaatatcaggacttttgaaattatttctactttataaattttattttattttatttattatttttgagacagaatcttgctccattgcctaggctggagtgcagtggtgcaatctcagctcactgcaacctccacctcccagattcaagtgattctcctgcttcagcctcccgagtagctgggactacaggtgcccgccatcacgcctggctaatatttgtatttttagtagaggcagggtttcaccatgttggccaggctggtctccaactcctgacctcaaatgatccacccacctcggcctcccaaagtgctgggattacaggtgtgagccaccgcacccagcctgctttataaattttaaacatgttgaattctgggtataaagctaaaattattttttcaaggatgttaacctggctactaactaaaagacaggaataattcggtgagctctaaactgaatttatttattgtatactgaatcacaaaccagactagattttttaaaaaatagatcaataagttcaagccagaaataatacatgctttcttaagttgtgaaataagaacaaaatgcaaacaaatagtatctgactgagagtgatatttcacctgtgatgtagagctctggacccgcttaaccttagcttctaagtgtctttgatattttatttgccacattcttagcactaaatgaaatgtatgtgttggggtgcagatggtattttgactttaattatatgatttttgagggagaagactcacacctgaaagtgtagtcttgctatctagatcttttaaagaaggtgctttaagaaaaaagtggtgttaattattgatatgatcaaaactcacttctttagaaaatagaaatggcaacaagcaaacatgaggaagggactgagtattcaaacccatgaggcattgtgattatatttagtcagtcagtgaaatctggcctaatctgggacagtaattattatcatttaagaaaacatatttagagttttaagagaaaatacttaagttactgaaattatttgcatagaaaagtgaacacttgcttctgagtttcatggaagattgcaagtcctctgccacatggcagagaagcagacccaaaggaaataaagtaatgcattttaagaaatggctggtgtacttggtatgatagtacatacctcgtgtcgtattattctgcaaaaatacttagggaatatcctcagctttgtttgatagatttcagtggctggcagcagcaggacgtttaccagaggttgcaaaggaggtgggttgtgggacacagttttcattcatcctgaacgtacgcttagtttgtctcatgttgtgtattttaaaattctgattttgttgccaacatttttaaatcagaaaaattttacgtaacaaataagcagtgtttacatctttctttagaaatttgaagatttgggaacattgagcttccattttggtcgacagccacagtgacctggggccaaaacttttttttctcttttcctttttcaggactcctttctgtaatgggcctagcttgctttactcgttcgcttcatttttctggttcctaaaggcacttaagtttaaagcccttactttaaatcatgcccaggctaccacaacgagtcatatgcactttcggatcatccagaattctgaaatcataatgattattcatgatttacttattgcttttatgtcattgtagtttgggagatattttttatgtagaataggaaacatattatcctcattatttcatcatccaggaaagatgtctttgaatagttgaaatgggaaaataaaagagccaacagttacaataaaatatgaagttgaagccgtctgtgttaactaaaccaaatacaagtaggagaaaaaaattgtaaaatgatggtttagtttttttattaaaaaaaagaaatggagacagggtcccacgatgttgcccaagctggtctcaaaatcctgggctcaagcgatcattctgcgttggccccgcaaagcgctggaattgcaagcatgagccactgagcctggccaaaaatgatagtttttatgggtaagaaacaacatggaatagtggaaaagataataatttaggatacttttttttttctgggaacagtcatgagactaactagttttacatttcagtaaccagtagatattggttttatctgtaaaagtaagactgaaaagcaagacctaacccttctggttataaaaaactatgattttcttaatttctgaaatacatggtaattctgaaggtagagacctttagaaatctttgggaatttgtaggtttactatttagagacttttgcagatatcagagttagtacaacaaatcatttaatatttccctacaaatccagatccagttcaatggttcattgccagtggcttaatccgtcagtccaggacctctgtggctgtagaaacgctgtttggcgaggcactggtgctttttttcctttctgaatcggaccccggaatcccttatgctggttaccttcacctgttaggttttttgtcggtgtctgctcgggctgccatcacaaaatgccacagactgggtggcttaagcaacagcagttgatttctcctagttctggagaatgggagtctaggaccgaggggtcagcaggtttggtttcccctgagacctctttcctcggcttgcaggtgggcgcctcacgcaagggtctttgtgggccctttcctctccgcacacacgcccgtgatgtctctcttcctcttcctctatggacaccagtgctgtcagatcagggccccactattctgacctcatgtaaccctgatgagctctttaaaggccctgtgtctacatacaggcacacagggggctagggattcaaggtatgaagtgttgggaggacatgggaggacatgattgagttcatagcagatggcagtgaaaaggaaaccagggtttctttgaaatgcaggatgtgcctgggaagcagcccaagtcacacagcagccactccagctctcattcgcccaggcttgatccaggcaatactttgcagcctttttctatgcccttttctcataagtaatagaaatagagaagtcagaagcttgatcctgcttttagaagattgccaacccatttattatgccacagtattttaagattaatttttaaaatccttttggatggggaactcaccacccaatctggcaaacctatctgtataaacttgtgttctccagcttgttggcatcctttgttccccagtagtccttgtctaagtcatgcaatgtggtcgctgtgccagggacactcttctgtcctctgcttacatcaacccattgatgaatcttgacatcactgaaagtgagacagcagatacttgtgcctctttagggatacagtaagaggtatactgcgtcacctataaactgttcttgccaaatacattgaacctgaagtgcagtcaagacttcagatctagctacatgcttataggaaacacagcagatagagattaagtgatacaggaggagggaaacaacttgatccagaatgtgatattctgccaaagcaatgacctggtttcttcaacaaatcagtggcatgaaaaaaagagagcaggggggaaccatgattgttcaaaaatgacttatgtgacatcaaccaattgcaatgtggtcctcttttagataccgattcaaagaaactgactttaaaaatgtcgggagtttttttttgcaattttttgaggaaatttgtatatagactgggtactaagattgtcattaatttgctaggtgtgatgatggcgatgtggttatacatattcttaaaataccttttctattagaaatacgtatggaattacttactggtgaaataatctgatgtccgagatttgtgttaaacgatgtcggggtaagaggaaaatggttggtttctcatccttcaagtattggcttatgttaaccccttgggggagatatttgaagcaggtgttttccccctcctatttcaatcatttcactctgttggtttgtttcacagcacttataatctgtcggtaagagtattttgtttatttattgtctttcttacctcagtctataaactccagaaggacaggagccatccctagttgcccactttgtactccgagcctggtatactgctgacctgtggcaggttctcagtaaatgcatctcaaaagagtgtatgagaagaaattttatttcatatgatgtttgcattttgatgtttctgtatttggacttttactgtaaattgttaataaaatctattataaatgtctagtttcttcgtatacctttttctgagggatggggtagtaagtgcttcctaagcttttattcttgagaactcaaatatgacccattttaaatagtagtttctttagtggttggcacttgtcattagtcttgcaggtagagtgaaaggtgtattgttaaatcactgacccattagccttttccttgtatatgataaacacatctgaccacatgtgcctgccacacctcatgcccctgaaagcctcggtgctcccagccttttttttttttttttttttttttttgagacagagtcttgctctgtcgcccaggctggagtgcagtggcgcaatcttggcttactgcaagctccgcctcctgggttcacgccattcttctgcctcagcctcctgagtagctgggactacaggtgcctgccaccacgcccagctacttttttgtatttttagtagagacggggtttcaccatgttagccaggatggtctcgatctcctgagcttgtgatctgcctgcctcggcctccccaagtgctgggattacgggcagggcatgagccactgcgcctggccgctccccagccttttatgaagaacctgcgctcttccctttgctcttcctgtgctgccggaggggcgaagtctcacttacagtataggtgagggctttttaggctcctaaagaatcatgggccgggcgcagtggctcacgcctgtaatcccagcactttgggaggccgagacgggtggatcacgaggtcaggagatcgagaccatcctggctaacacggtgaaaccccgtctctactaaaaatacaaaaattagccgggcatggtggtgcgcgcccgtagtcccagctacttgggaggctgaggcaggagaatggtgtgaacccgggaggcggatcttgcagtgagttgagatcgcgccactgcactccagcctgggcgacagagcgaaactccgtctcaaaaaaaaaaaaaaaaaaagaatcatggcaccctaggtttataataccatgtaggctgggcgcagtggctcacgcttgtaatcccggcacctttgggaggttgaggtgggcggatcacttgaggtcaggagtttgtgaccagcctcgccaacatggtgaaatctcgtctctactaaaaatacaaaaattagctggatttggtggtgggcacctgtaatccagctacttgggaggctgaggcaggataattgcttgaatctgggaggcagagagtgcagtgagctgaggttgcaccactgccctccagcctgggtgacagagtaagactgtctaaaaaaaaagaaaaaaaaaaaaccatgtagtttttaaagccccagtcttgttaggagtctaaacagtctgttgtatttattgtgtcagaggagtgaatggattgtaaatgttttagtgtagctccacctcttaacccaaagtgtttggtttggatgctacccaggagtgacttgttcaggttctttagaagatagaaaccttgctttcagtgagctagacagtttcctttgttaatggattattacattatgtctttgtctgaatctccttcaggtaattaatgtatgtatttctatttttgaccatgttttaagttgcatacatgcataaagctgtcttatacaaaagtagaatgaatcatgtaattagccttatgcaccatcaccctgctgtaactcatcagcgtcacatgtagattttagttagctatgaagttggataaatatgtctgttaattttaagaatgcaagaactgaattcattctaaaaatatgtcagtgtatctgctaatatacctatatgtctcccaattttattacactttgtttataataactaacatcatgtttaacacataattttctttttaatggaaatttcaaggcagttaaacttgcaaaagacatgtttttaataataggtgagcttttaaaaataaagtgtatatatatatatttaattttgtagatcaaatcccggcttaactgctttagcacaacttgatatttaagggaatctttttaaaaatcctttttatttttatgtataaatgtggatggttatatatcttgttgccttaactcaacccaggagtgtaagtaggtttcttctttcaacaatggtgcttttcaatttacttactatctgagccatattgtttatcttaatacataataattttgaagtaagttaattgacaaaaagaaatgtaattgggttcgtactcaattattttcttcagaaatatagactgtctgttgtgtgctcgaaagaacataggctttggattcatagggatctgggttcagagcctcaccactacttactaagtttattcattcagcgaatattcattgagaacatctctgtgctcaataagtcccagtaagtcctttgacatggcagatattccagtggatgaaacgaggttgcttatgtagtgccacccacattttagctggggagacagacaatataaaagtaaacatttgataaaatttcaggcggtaataagtgctgtgagaagaagcaaggagggaaaagagagcgaggatggagtgtcagagaggagttgcagttggtggagccatcaggatggcattgaagcaaatcgaagggaagaagtccacatggatagctcaggtgaaaacatttcaggcacgaggaacagcaagtatagatgctgtcacacagaaaccagctgtgcatgagagggagtgagctttgtggcaggactgaatctagagagaatggtgggaggtaactgtggaacggccgatggatttgagagggaggcaggggccagttcctatggggccttataggccatgatatggaatggacttgggatttttttctaatctaaaaggagttttggtcaaggatgcagcatggtctaatttctcttttaacaagtgcgcttggcctgctctctggagaataggtcgggttctgaggccgtcaccggttgggggaatgggggtttgccccaccaaggtggccgtgaaagcctaacaagcagttgtgctactggactagatacggggtgcgaggagaagagaggaaatgaggaaagatgggaatgaagaaggaaatacttttgaagttatataagatgaaaactgaaaatggaccattggatttggcaagagagaggccactgtggaccttgacaagagcaatttgagtgtatggttggggcaaaagtctgactggagaagaccgaggagaggagtggaaggtaggaaggagcaacaggtacaggcactttcagtgtttagacatgacaaagagcaaacacaggaaggtagctgggccggggcatttgttagttctgttttgtttttaggattcggatattatggcatatttgtatgctcatggatggttagtgtggggataagtggaagaacagaggccttgagtacattggctgacttgggaagaggtagttctggttgtttttactaatgaaatgcgtaaaacaagaaacagttaaggactgggagtggggaaaggagaaggggcgtgatgaaggtttgaagagagacgagaatgtatgaaatggtcttcatgaagagtgggagagagaatgatccagggaagaggtgggattgccaggcagtgctgtgggcccatttggaatgtatgtttctgtgtttaaagagggtccaatgcagtgccacatgtagacttagagtaagggaagagtgggatttgaccaggattgggactgggccaggtgactgtgatgttgaggaagaggcacatgggagggagagactgtgagctagttcaagttcagtctgtggcacagctaggaacaagagctgggagcatgacgggaatgtgggtcctggggtggagttgggcctgattctgtgcttgtcctcctattgctgatatagaagcggatgcaccagggggcaggcctccagacatcagtcaggaaggggcaagctgggacctccgacccaggcactcagcctgaagcttagctaggttttggatgtattatattccgtagaccgtatctctgccatatttctatctgttacctgggaacatttgggtagaagtggagagaacagtaaaccaggtactaaagtcttcaaaaaaggaagaggcataaccctttcattccaagatgtttactgcaaggagggatagcaggtggaaggaaggagggaaaatagtctagaagcaaaatgaagagcaaggaggcactcacctcacctccggacagcttgctgcgtggtatacagaagaagaaattgctaccagttgagggggctgtgatggaggtagactcctcagaggtttaacaggaaggtgaagggaacagttagaaaagcccctggacatagaggagattttgctaatgacagattgtgcatttcagagggtacagaatctgaaaaaaaatgggagattgagtgcgactaggggccagaaaaccgtgtaggaattagaatccagttggatgtcctaggaggcctagcttctggctaaggtaatgggggatgtaaaatgtgattatcggtcttgattatctcctaggggaaagtgatactcagttttctgcaggccccatctggggcttggtctcttaagcagtttgtgatggtgaagtggacagtattgagcccggggagggatggtcctaccaagtccttgctgaaatcttgcagggtgtactgtcctggtgttacttagggtcattgtacacgtgagcaaggtctgtggtcctcccaagcttgatgttttcacctgtagaattagaatgaatactagccttgcaggtatttaaatgataatatgcatacagagcaccagtgggaacggggttatagtacggtggtccctcataaccatggagcattggttccaggaccccccatagagaatcctcaaatgctcaagtcccttatgtaaaatggtatagtattttcatataacctacatataacctcccatatactttaaatcatctctagattatttataacagctaatacagtataaatgctgtagtctttatactgtttttattgctattattttttatttttttcaaatatttttgatccacggtaggttgaatccacagatgtggaacccacacatacggagggctgactgtgtatgcttaatgacattttttcccttgtatgtacatagaaaaatattgtatacattgttagtccccctcatattctgtaatgagtttttcatttgttgatgttagtgtcaaataatttaaaatttaggctgggtgtggtggctcatgctggtaatcccagtgttttaggagggtgaggcaggagaatcacttgagcgcaggagttcaagaccagcctgggcaacgtagggagacccattctacagaaaataaaaataaaataaaaattagccgggcatgttggcatgtggctgtattcccagctacttgggaggctgaaatgggaggatctcttgagtgcaggtgatcgaggctgcaagtgagatgtgatcacaccactgcactccggcctgcgcgacaaaatttatttcttgagtaaataaataattttttaattttaaaaattaaaaaatttaaacatacgtgtgtgtgtgtgtgtgtgtgtgtgtgtgtgtatgtgtgtgtgtgtgtgtaaatgcttggttcatttgttgagttttttcccctactagatgaatgctatgggtgcgttgtgtgatttcaatctcgttcctgaagttgagctttttatgctttgcattttgttctgcaatttaaatgataaaaacatttctggccatcttattccaaataaagtcatgttgatttttgtgtagcctataatgaaatagaaaataatcttctggtatctattctgtattattcacagaaacagtttctaaagaacaaatctgaatttgtacgatataaatcccttatctttacttgatataaactgccattttaaaagtcagaattgagatgaaaatcacagttaattgttgtcattctttaaaataatatggttaaatctgaaaagctttttgaattgtgggcaaaacattcttgaaataaagcttatcttaccaaatatttgaaggaaatttggtagcattgaaatagaatttttgtcaatttagaaagttaataatttttttaacagtgatttatactgtagctaaaaagctgttgctggtttcccaaatcttaaagctaactgaccttccatttgaacctagctttaatgtaaacattttcttgaggtggttaggggttgggccagccaatctggaggatattagtggcgttctgtttgagggaagttggaatccctagataattctcaggagctcttttctaggccagaagctgtctcagacattatatatttattttttaaggttttttttttactctttctttactgcaatgccatattatatatttcttaattcttccttggctttgttaataatgtctactatctgaaatctaattaataaaatacataattagctttactttgaagtagaaggaaagagcagttttatttggtagtttttctatcctttccactttagttgctgagaaatataatgtagtatgtaggctactgagagtgaggttattaccctactgcctttaaaaattctcactttttagtcatctattacttagccaaaatattgttgttcaaagctaaattaagtactttatcaactttctttgatacctcccctcccccgtttaaactttctgagcggtgtttttcaaacttcaggtcatgacccattaatggttgttaaatcagtttagtgagttgaaactagcattttaaaaaattaaataatacatagctcctagtaagacaaggtattatttcaacttttgttgcacttacacagatatatttgtgtgaatctatattgaaaaatgtaaaataccttttactgtgggtcaccaccaaagtttgaaaatgattactacagagaatatttcaggtaaggttgtatagtcttttttgcaagcatttgcatttttaaatcttgagatttcagccaaatggctgatattattgttagttgaatattgtagaagaaaatttggaagactgaatttttaagaaactacttattttaaaatgatttttcttttctaattctgacattgtcatatgatcaaaagcttaaatgccagagctaaggataaatcatatttctcttatttcagggaacatttattaagaatatgctagttaatagatatattgaaatataaatgtataattttccatctccaagaatcacaaatttttgttagacttgaattggaatagattatgttcgtatttgttttatgttacttccttaacagtgatggcctgtttacttaataaattcaactctcagtattcaaactcgaaggaatttttaaaagaaatatttgcctcttgaatcttgtcagatttctcaagccttattataatcgagtacttctgtctacttgaatttgtttttgctcattgaataagcaaactatcactgcactaatgttaattgtgaaaaggttttagactaggttttatttgggtcctaatgtggtagatttctttattgctgtttcatagaatcagaggaccagtttatgagttagaaacttgtgggacttttccattgtgaatgttgtactgtcttaatctcattcctcaatttctccaagcctctcttttctgtaaaacatagatgattatcaagtgatattccaaatagcaaacagatacctcaatatctttttaaatcccaagacattgcaaattacaacgtgctgattaataaagtaagttgttcttatgttaagtaacactatttgaataaaagcatgacatgttgagatgactgcctggtgactgagacttgattgttgactctgttgtaccctgtcctcatttaaataataggtttgtaaacagatggctggcaatcccttgatcatagtttattactaagttattggtgtttcataactaactgccagttttacatactggaacgtataaaaggtattctgttttcaagcgatgttagaatacaatgctacttcttgaaatatttagaaatcacttggagttcattttatctcagccttatcactttagagataacaaaagcagttaaaatgcataattggagcagtgtcttgatctgtcacaaataataggcttattagaaaacttgtatcttccagattctacacttaaaccgcttaataacattagtttctcttaatgtattataaatcatctatataggacttctggtctgcctaccaaacagttaattatctcatgctatcattattaaaagttttttctttctatatgaataaacaaaagtcattaaatataagcaactgtatttacattctactatgagtatgacagaactctccaatagcaaaaccatgcatgttggaggctaacattctatatcctcgattcctggtatgtgaacagaaatagagcggtgtctcattcaacttagtgtttaaaaaaatattttttaaaaaatagagtagtggtaagaacagggtgtcagatgtaatttaaaattgctttgtttcacatctgaaataatataaatgtgttttatatgtctgtttattaccttttgttataggttttgtgtgtgttatgaaaatggactcgtgtcctttggggtggggtggaactttaatatctgtattctgtaatattacatgaaaactaatgctaacttttattcttccagtatgtgccatatctttatgtttaaaatatctcagaaagagcttaatcacttttttctggctttattttagttttgaagtattgctgtatttgctgtatagcaaaaaaacaaaacaaaacaaaacaaaaaaacccctcccccaacagttgctttggttttcatcctgtattcaatagagtagcggatacctgatggcaaaacttttttgaaaagagtacctccctgcttttaaacacaaaaaaaaaggactcccccaattttttggataactatacaaatattgctatagttgatcatccattgtattagaataaatggggaaaaattgaatttttgcacataattgactttttaatacagaaagcaaggcaagatatcttaagaaatttgtataaagctaacatttgatatgaagttataatggaactgttgaatttcgatttggaaataaaggagtattccaaggtataaaggataatttgtacttgaatttttaaaaatttgatagaaacaaaatttcagacagttgaagtctgtagttgacagtatttaggccatcctttcattaagataaaattctctttgcgcacaccaatgccattcaaaagaatgcttccgaggtcttgactgttgacacgattacgtttgaatacatcattcttagacagtgtttgtgactgactattctaaatgtggtgccagggtatttgagaaagtgtgagggagaaatggaaagccaaaacttcttttttggtagagtacaccgagtttgttttattttgtgctaacccaatgagaaagcatattggtacaaaaccatgaaagaaagcggtggttctctgctagcatgttttgattttagaaggtcgtctgagtagtatgggctttttgttctgtaatgtagctgttttgacttagtaagtgtctatgcttgccttttcatttgggagtttgaaattccctgtgagctttgcttgttaagtccggggatctgcctatcaaataataacaaacatcaaagtcaagtgtgtaggtcatttgcacatctttatgtgggcatgtctcccattttctctttaacctttcctaacacggaacttatttcttttggtagaacttaagaatgcgctatcttggtagtgatcctgtgagtgaacaaatatcctttaaaaatctattcttttttatttttaaatatgtgtagcattacagaaaaattgaaaaagaaaaacgctcataatctcaccaccccaacagaacactatctgtgtttttttttttcttgtggtgagagagggacatgaattttaaacttaaagaaaaacccctagttctctggttgtcacatttgtttcactttatcatatcacacaaacatgttcatatctcacttaaaacgtaagttgtttagaaagtatagatggctaagggttctacttttggggtaattatgtcagtttagtttcctgataccttatcttactactgtttcatgctgttaaaagtgagaaatactctagatttgtaaggttcaaactatataaataattttttaattcactttttcaaatgtgtagggtaccaaatttcaacccttaggagaccacagaggtattaactaatactggcaacttaacgagttttctgtgaaccttgggataaaagtctatttttaaacttcaaaaatgtgtacttgactagaattgtagttctttgctgatcttttaaataactatgttcattacacatttactcatcaaatggaaccagaaagcttacattggtgtggacatgtgtgtggaccctctggcaggtcaggcgaggctctgccataatggctcagccttgacttaccaccttggctttgcactcaccttggcttagttgtaggcaacaagtaaatgcatgtgaatatgtttcgtcctgatgacaatggtaatatggaggtgttaacctcttttataaacatggagtgcttcttgtctgactttgattatttataacaaacttacatggtggtctttgaaaactaaaatttctggccaagcacagtggctcatgcctgtaatcccagcacttcgggaggccagggcaggtggatcacttgaggtcaggagctcgagaccagcctggccaacatggtgaaaccccgttgctactaaaaatacaaaaaattaggcatgatggtgtgcctgtattcccagctacttggtagactgaggcaggagaatcatttgaacctgggaggcagaggttgcagtgagccgagattgtgccactgcactccagcctgggcaacaaaaggaaactccatctcaaaaaaaaaaaaaagaaaagaaaagaaaagaaaaaggaaggaaggaaaagtaagatttttttacaatttcaataccttgattaatttaattgaagaatatgctgggattgtaataatctcttaagactggtaaggccaggtgcagtggctcatgcctgtaatcctagcactttaggaggccaaggccaaggtgggaggattgcttgagcccaggagttcaagagcagcttgggcaactgccttttataattatgtacaaagttttgcttttagaaaggattttgttgtttataaatattgaagatctctgatctttaaaaaaattaacttttgatgttactggtctgactgagaaagggtaaattaatttgtaggtgttttttgaatgacctaaataatcgtatgatattttcctcttttactttctccctcagtgggttattggttcatattttaatatatcaaactttttttttattacgccaaggaagaggtggattggccactacgatgttgtacattttgtgaatgttcagtaattcctgccatacttgattgagtaaaagttaaacttcattaattcataattttgatgattcatttgggctaaaaatcccttttcaagtatctgattaggaaaaagtattaccaggtccatatagtataaacagaattgcaaagtgcttgtattttacagtttaaaagaacaaaatgttcttataagactttatgagattagctttttatatgtgaacaattgttgctgcttcttccatgagttattgtctgttatggaggttcagcattacatctataataagttcttttaaaatctgtataattactctggtcaattgaaaattaaaacaaaatttgtctttaaaatttatccactaatatggttacttcagtaattctttttttcttcctttttagaatctgaatttgagcccattatatctaaaatgaaattttcagttctctttcaagtttaagattagtaagcaatagtttttaaactttgctgctatttaatcatgggtaaatttactttatcgtaacaactttttgtagcattttagtattaacaatgtcagagagaagagtattttactgtttggttcaacgtgtgtatatatattatcactagtggtattctaggggttgagaatccaaagatgaaagtggcctaccatggaaaatactacacatggggtgggggatgaacacagaaaacgataagatcatgacagtgggataactaggtgacttatcaaatgataaagaaacaagcactggtcatgcccaagtattgttggagggtcctcattcagagaacactttctgagttaatgttatatactcatctttcatgtccatgagtttaaaattaatttcaaatggttttgagtcattaaatttgcaaaggggaggataatgagcacaaattattttgtccatggtggccatgtaattgccattctcattcttctctccattctccactcacattgacctttttctacgtgtttttctgaacatcttccaacatgttggtggttggaagtcactcaagtagtcctttgctagttgtttaaatgtttaagaattgtcacctctaaagcctaggcttgaaaatgtggaagagaatttcccagctctgcctctcttttgttccctccactgtcttccccaaatgtcctttcttccctcctccaccagtatctcagtttctccatacttggttgtagataacgtggaatcagaatattttatgagttgcctaacaactaatctacaaaaatgattgctctatattttaacgtcagataatgcccagaatcttttcagaccctacttcataaaaatcacttataaccccttcctccttaaattgtgatgtttaattgtgatgaaataaatatgataatatatgtagttgataatacaataggtaccacccgaccagatttataaaagaaagtataaaaattatgttaataaaataagagttataatcatgttttgcttatgaagaggcactgtttccttttcttctcagcaacaaggaagttgcagaaataacgggctatgtttaaaagtgtcatcacccttggaattacagggtcaagattttcttctcaaaatctggacattgtttttttgctcccccacttttttttttggagttctggatgtttgatgaagaattatttgttttacggcctctaacattttattttgaaagggactagtctttaaaacttggctgtaaaacaaaggattaagagctcttccatttgtgcctattttagatctataaggtgggagtaacaacactgatttagagacctttgaccttccgcaatgaaaggacaaggaagtaaatactactcttactgttttgtatattccactaaaatataagtttcggtggtcaggcatttttgcctgtttaactcactgccgtgtcccagtacctgatacctagtgccacataggaagtacttaagtattttttgagtgagctaattgatattgttacactatagcggaattaccttaatcctgcacctttaggtaactgagtgggccacataaatgtgtttttcatgtagttttaccttttgtgtcaaaaaatgccattttaatgcatttatggaaatcttcaaattgtgtcatagtttttatgaatttcctaactagagtatttcaaacatattttgcctgttgactcaagggtgtcattatcaataataattactgtaattcctaggtgggccagtgaagcttgtaggattgcccttgtgttaataaccatgaactgttgtgttggcgatttagaacagataaggatgaatgttgtaatggtttttctattccttctggggttgtctgtcattctactcacgatgatctaggtaatggcctaagactggggccctttctcttatcaagtaatgcagtggacttgtagctgtcatttagcagcttttgttttcaggttcagagagctatattctgaaataccgagacttcttgaagactgacctctggagaagtaggcatattataaagtaggttacactgtgtagttgaaagcattgtgcttatgtcaaaattttcatctccacagaagaattttttttaagtgttctgcatttgcccctactgttagaactggagtcttgaagagaatatttattcttttgttgcaaagcaaaattagcagaaacttgaatttaatgtaataacagtattttaggtttggtttttaagggaggtttttgccttccagactgttctctatccacttagaaggatttaatttctaaatattagaaaatgttttatacaaagacaggtcttcaactatactgtactatagttatactataactagaattatgaaaatctcttcatttgtgttaattgagagaagtagtttattttttttgttgttttttttttggtaatagtcttctaaaatctattaatagactaccattatcaattcagttctttacagttaaggaatgattgtgtgaagtaagatacatacaaggaagtagtacctctggatggtaggattatggatgtttttgtttttgtttgttttttgagatagggtctggctttgtcaactaggctggagtgctcctgatcttggctcactgcagcctccatctcctggcttcaagtgatcttcctgtctcagcctccaggttagctgagactacaggcgtgtgccaccacacccggctaatttttgtgattttatagacaaactcctggactcaagtgacctactcacctcaacatcccaaagtgctgggattgcacgtgtgagccaccgtgcctggccctatatattttttaatgttcacattgcttatctgtataaaatataataaggttacattatttaatcaacattaccaataaataagaatatggagtactctttctgctcattttagatctaggctttaattttacagtggttctaaagtggtaagatggaaaaaaaaaatgtccaggcatgacaagaaaagagaacagtaagagtaggtccaagtaagaaattacatgtctgtataagtattcaagatacaggctagggccaggcgtggtggctcacacctataattccagcactttgggaggccaaggtggaaggattgtttgagcccaggacttcaagaccagcctgggcacgatagggaggccctgaccctaccaaaaacaaaatagcaaagtggggtggcacacacctgtggtctcagctacttaggagcctgaggcgggaggatcacttgagcccagggaagtcaagactgcagtgaaccgtgattgtggtactgcgctccaacctggcaacagagtagcaccctctcaaaacaaacaaacaaaaagatacagcctaagagaaatcctaaaaggccagcagttacataagcaagatacatatgtaggtaagaggtgggtgggtagaaagggaggaaaaagagaaatacttacttgaattatatataacaaattcttaatcatccatgaataggttattagtgagtaatgctaaatgtcagaccatttagtatatagactcgtacagccctatttctagagtagggagtacaaattgatttttctgctcctctaacacaatcttctggaacaaaaggtaaatgtatatgttcagtgcctttctaaagctataaggagtgcattaaactacagtacaattgcttctttttgtttagttaatgggaacttaattctatatagtagctggcagtcaaatttattttatgttggacactaagggaaaagtacctgagtacagtcatcaatatttttaagcgccatttgatcagagtaggtcatgtattccctaagaaatagaatccaggtgagaaaataattttgattaatttatagtcagcagttctatagatatactcgatactggtatccatttttttttctgttatcactacaaaagtagcagaggatattgctatctataatatatattttttatacttttgtatataaaaatataagggcttatatttttgtagcacctataagatgttactatctctagaaggaaaaggatctttataagtcccacaagtttgtctttccagaattgtttctaccaaatctgtgctgcacactataaatagaacaagaagaacttaatttgactctacagtaccagtgaagtctgttgccatctgatgccagtaaaagcatctaatactataataatagtaacattgcctggtgtttttaatttttgctttatttagatattatacttgattaatccacctgcatggtagtcaaaatgcatcgagtgtttaatatgtatcacattatctcatttaattcacccctcataataactcagagtcagttttgttattatcttcattttactgatgatgaatgaagtcaccgtgaagtcaggtaacttctgtgtgtgctactgctgatcaatggcaaacttggtccttgaaccccaagaaactctgttcctaaccactatgccatatttattttcctgctgaccctgaaattcattatgacagagtccccttactattttcccctgcgatagattttccatggatacttgaaattcttgttaattgtgacattgcatctcggggaatttcagcccatcatttaagtctggtagaccacagggacagattctcaatattctacacttctgacataatgaaactgtaaaataaacagaccacagattttcatgaaggttctaaaagcaagaaaatggtaattataccttgaagagtcttaaatggatttcttagataaaaagcccatgttatgttttcaaatctcattgtatgttctgcaattttattacgtaaattagttctgggtagtcaatcaggcaacaagtattaatactgagtgcttatttcatttaatccacaaacatttctgggcagttaactatatgtaaaggactagatatacaaatgactgacagttcctacctgctcaaagtattgttttgttgtctttggcctcatggataagacaaaaacagaaatgaattcattacaatgtaatgtggcagatgaaataatagaaatgtactgggtcttgaggagtacaaagtgctagagatacgcaaccagaatatattttcctataattacttttattcaagcaaattattataccaccctatatagagatacagaaatgcagagatcccctatggatttatgttttagttacttcttggaaaaactgagtcttagaaatttaactcggagcatattcaatactgggagtatagtcactgttttaaaaagtaaaaggaggtgaacatgctacctctatcagtcagtgtgacaattgatcctatttaaaatattataaggaatgacctgtgcactaaagggtagtgtcagttttcacctgggcagataattctcttttccccgcttcttggaaaacacaaaaatctcatggaatactgtgtgtacagtccaccacagagagggaatggcatctcaactagctagtgttccagcagatagcacacatgccggaagtactgattcagtgttttttacagcaaatatccaaaggtcaagagacagactgagagaaagagaagcagggtgtgagagagggaggagagagattgattatgagtctggggtcatgttttaaatgagtaaccagaatcaccagtcaaaacaaagcattcctgtattctctaacttgaagtactcccaatgtaaagatcagttgtgttaaccccattcttagtccaaaatacaagtgtgtagctgacgttgatttatgttccacttaatttttttttttttttttttttttttggagagagggtcttgctctgtcatccaggctagagtgcagtggcacagtcgtggctgactacagcctcgacctctcaggctgaagcagtcctcccacctcagcccctagagtagctggtaatacagatatgcactaccacaccgagctaattcttaaatttttttgtgtggacggggatctcaatatattgcccagcctggtcttgaactcctgggctcgagtgatcctcccgccttggcctcccaaagtgctagggttacaggcgtgaacctctgtgcccagcctgtgttccacttaatattaaatgagcaagactagaaggaaacccaattctgcctaaatccttatagttggatataatagcctactgccttaaaagaaggggggataagataaagcaaacaaaaaaaaaaatacctggctactttgaaataagtaggtattatattctcttcaagattacctttatatttcatgttattgaaacagttaacatgtacatagaaattcactgtaggaatgcaaacgctatggcattttgctttttaaaatgtcagctcactgaacatacaagtgtttacatgaattaaattccagatcagaggcacatagtggaaagagttagatcacatcttgctcactctgcatctccccagagcagtagcttcatgcatggcacccacctgaggaagggaaatatccagtgtggagccaaaggctgcacgacgagctctgatgcaaccattggtgacacttcacttgggctattggacagcagatgtgtgactgaaggtgactgtttcagttgtgataacatcttcaagggagtttctgtgctgggtttcctgtctctccttctcatcctgtctttccctcctccccaaatccaagtagaaagaaaagtaggacagtattcacagtggtgaagtgatagtgaaaatgtcctcaacgtttgcacatgcacatatacacatcagtgctgtctttcataggtctctagtgatgattctttctgctgtaatcctcaattctcaaaggggcagggaacaaaagaaaaaagcccatacagaaaaagaatgtacaatatatagactatgaaattatggaaatcatcttaagcctgttctttggctattataatattggagaagaaaacatgttttatggattcaaagatgcacgttttccccccgattttagcatttctgaaatccagatgcatctcacagtcactgcctggcagctgtcatgacatggtcgtcaccgcctgcacacatgcaccgaaacctgcagaatgagtgtcaatggcttgtaggaaaatcccagagatgctcattgagcacaaaatgccacctttctaacactctcgatagcgtagagattgatactgtgaggcaaggcatgaattctgacaactcaaggttgaaaaatcattcggaagaattagaaactgaaaggaaagaacttttaggactaccttaaccaacttacttcacttttttttaaatgtatggatgagcgatctattaagaaaatctaagtaagtgttcagttagtctaaaataaaatccctaagtgataaaaatgcattgtcagaatttaattggcaggagttttttcgttaatggcacgtaaaataagtgtgtcttataattgatgacatcttagattcaatgaaatgtggtaggcattccgtccttatataaaaatcttaatgtccttccattcttttatcttactgttatttatttatttatttatttatttgagacagagtcttgttctgtcacccaggctggagtgcagtggcacgatctcagctcattgcaacctttgctttccaagttcaagcgattctcctgcctcagcctcccaagtagctgggattacaagcacccgccaccacgcctggctaatttttgtatttttagtagggacggagtttcaccgtgttggccagactggtcttgaactcctgacctcaagtgatccacctgtcttggcctcccaaagtgctgggattacaggtgtgagccactgcaccccacctcccttcctttaatatttaaaagtactatgatatagagcagtaataattgcagttgtaaacatcaaatgcgatcagtttactaactaatctattcatttcaaaaatattcattgagcccctcccatgcggcaggcatgttctaggtgctgaaaatacatcagtgaataaaaccaaagtctgtaccgtcatgaagctttgtctgggggaaaaaacacataaaacaataaatattaataaatactaagaagaggctgggcacagtggctcatgcctgtaatgccagcacttctggaggccaaggacggtggatcacttgaggtcaggagttcaagaccagcctggccaacatggtgaaaccgcatttctattaaaaatacaaaaatcagctgtgcgtgctggtgcgcgcctgtaatcccagctactcaggagggtgagacatgagaatcgcttgaacctgggaggcagaggttgcagtgagccaagatcgtgccactgcactccagcctgggcaacagcaaaactctgtttctaaataaataaataaataaataaatagaagaaaaataaagcggccaggcgcggtggcttatgcctgtaatctcagcactttgggaggccgaggcgggcagatcacgaggtcaggagatcgagaccatggtgaaaccccgtcttgactaaaaatacaaaaaatagcctggcgtggtggcgggcgcctgtagtcccagctactcaggaggctgaggcaggagaatggcgtgaacccgggaggcggagcttgcagtgagccgagatcgcgccactgcactccagcctgagtgacagagagagacaacgtctcaaataaataaataaataaagcaagcaagctaaagctaagtagagggccagagaatactggggggttcatattttagatattcagggaagggggctctgataagtgagaattaaatagggacttacgggaatcagggagaggccctacaggtccactggggaagcacattccaaagagaggaagcgcagattccaggccttgaggctgaagacttctcattgattcaggagaaaagtgcaactggacctgaacgagggagagggagataaaaatggcctagtacagagggtgtttatagaccatgacgagggcttcaggtaggattgggagatgggaagctcggggaagccctgcgtggaggagtagagcactctcgagtctcatttgggctgccgattgtaggggctcacggagggaagcagcaagtcctgatggaggctgtggggataatctaagagacacggcggtgtcctggactagtgtgattgtatcgtaaaacagagagaagacgtgactctaaccacagtattcaaataacacgtgaacccaggggacaacaaggaagacgggccctgaagacagagcattagctgtgtgcgcgttgctttcaagactctgggaatgaaacaagcacagtaacaatattttcctgaagtaaaacaatccttgcttaattgaaatttttcatttctctttttcttttttgtaatttactaggcattgtggggtctgtcaaaagctataaaatgtcatccctgggagcttctagttggggagataagacggggatttctcttacagtttaaagcattatacgattaaggatcaaatgtcagcaaattcttttagagttaagaaaaagcagagatttctatggattggcatatcagaagagggtaggacctgagctgcatctttttttttttttcttaatagactttattatttagagcagttttgagttcccagtaaaattgaacagaaagtactgagggttcccattcacccactgcctgctccctccacagcctcccccactatcaacatcccccaccagagtggcacatttattataactgatgaaactacactggcacatcatagtcagcagagaccacagtttacattaggggttgctcttggtgttgtacattccatgggtttggacaaacgtataaagacatgtatctaccattgcagtatcatacagactagttgtactgctatcaacatcctctttgctgcttctcttcatccctccctccctgtacccgctggcatccattgatttttttttttggaaactgtattcataattttacctttcccagaatgccataattggaatcacacagtatgtggccttctcagtttgacttctttcacttaccaatatgcatttcagattcctctgtatctttttatggctttatacttcatttctttttagtgctgaataatattccgttgtctgaatgtagcacagtttattcattcaccaaatgagcgacctcttcattgtttccaagttttggcagttgaataaagctgctttaaatatctgtttgcaggtttttgtggggacataagttttcagttcatttgggtaaatgccagggagtgtgattgctggatcctatggtaagagtatgtttagttttgtaagaaactgccaaactgtcttcctaattggctgtatcattttgcatttccactggcaatgaatgagagttcctgtcactctgcattctttccaggatttggtgttggcagtgtttcggcttttggtcattctaataggtgtgtagtgggatattgttgttttaatttccattctcctaataacatataatgtggaacatcttttcatcttttcctgtgcctatttgccatctgtatatgtctttggtaaagtgtctgttcaggtcttttgcccatttttaaattgaatggttcatttttttgttgttgagttttaaaatttgtttgtatatttaggtgacagtcctttatcagatacgccttgtaaatatatttttctcatagtctgtggcttgtcttttcctcacagttgtgctccatcctgaaggatgagtaacaggtgagagggaatcacacacacaggtcacagggaatagtaatagtcacagcacctaacatttcaagagcacttactatgagtcaggccctgtgctcagcactcttacatgctttaacttgtttattcttagctagaaaaggggtactttttttatgctcttttgtagaagtgtcggcaaaggaacagtgaggttaaataaggtacgcaaggttgcataatttggaaggaacagaacccgcttttaagaccagtcagtggaacatcctgcttggaaatggggtttatattgagggccgcttagaggggattttgcaatagatggtggccagcttgtttagtgctttaaatcccagaataagatacctgtatttagatgtgaagtatgaatgtctttattaataaaacattttttcaacaaaataaaacttagagtcctatgatttaaaacaataaacatatatttttagataggttaaatcatctgtggcatccctgcctaaagattcatggagtttaaaaatccctaacttgaagcagtggagagccttgggagtttggtgtggctagggatggggaggtgtgtggggataagaagacagcattggcaggacatgggccccactgcgcaggaggacagggtggaggtggactcttgatggttatcaggctgttatattttagttcaggggcaatgtgatgggcgggcctcgcctaaggtagccaatgggaataataaagaaaatggtgattacaggagattttttgaagggaaatgaataatacttgtttagtgactagatatggatggtgagtgggaaggcttgaaaactcatgtctctagttgactgagagaatttgaacggccagtcagacaaaaaaaagaaaacgtgagcctcctttaacagagaaataatgaggccaatttatgacctgttgaatttgaaatgatagtgaaatagtcaagccaagatgcctagtaggaaatgaaagcaaatgaaactgagataagagaggaggaatcttgaagataaagatttaggagtcagcaacattaaagtgacagctaagctcatgagaagagatgaaactgccgaatgttaagtgttgaaagagactgcaagttgatcaataactgaacctcaggaacagtggagttaaatcctgagggagcggagatttctgtttgtcattgtggattgacccatgagttcatttgtgcttcttcctaaaccccactacaatgataggaagatactaaaaaatgtataaagccgtaaggataatagagcaagggaagagatggaaagtgggaactgacttagcagagtagaggaagctaaaacataccagcctgcagagaagattatgggaaacaagatgattgctctccaagagttcagaaacaggggtcatcaggaactccagaaggcagggatgtaaaagatataaaagtctgtttgtgcatgtttgtttattagcaaaaacatttgaatttttagtaaactcaacattttagtttattggctaaacattgagtgccaagtattgagttgggctcagtactgaaatgcagtctaggtgtcagtctccacactgaacaggtgagactttcctcccttttctccatcagactcctactgtgtaggaaattggaggattctctgaaaaaactgagctttcccagggaaaatacatactgacaataacattttagagctagattatcttacaatgtagcccgccagttagcaaagtcccaaacattttacatgtagagtgtccagcgactcacgcttaaacacccagtaactaccagaaatgaaaggtatcccacatgaaaagcagaagctgaaacctcagaaatagagacaatgtaggaaatagaagaaaactacacacacacacacacacacacacacacacacacacacacacacctctacctacaccccttccaagagacaagagcagaaaatgtcagaggaaccagctgtcaaagagccagagcaagttagaaattaaaaatataataaccaaaagaaaatgttctatagaggggtttttaagataaagtcaaggaaacctgaacagttagataaagagaggaacgataggagagaaaaaagtgtgagaaaactacagagttaattcatgaggtcctatagccaactaaaaggagtcctaagaagagagaacaatgaaactaaaggaaatgaaattatcaaagaaataacacaagaaaatttttcagaagaaaaacgtataaatctatattacaagagtctaaaaggtacccataacaatgactgaataaaaatgcataccaaggcacattattgcgaattagaggaaaccagagattaggaggaaattatatgtgcttgccagtcacatacaaaggactgcaattcataatggagtcagaatgaaggagcagtggtgtgaaggttagaagatggtagtacataccatcagaattttgagtgaaataatttcaaccttaaattctattttcaaccacgctgttaggtcagagggtagaatagggacattttagacatgtggagtctgaaaacatttacttcccatacatctcttatcaggaaactaccagatgattcagtctcaatttaattaaatctaatagatatttaagcacccagtatatttttagcatgatgccatgcatataataactatctgatgaatatttatagatttagattaaaaggttcagaagacaaaaatgatttaagacacagtccatgcctttgataagcttatagtttcctaatcctggataactccgataaacaactgtataaaaaacagtgtgcagttctcataaagttagaaacagccgtggagatttgaggaatggatagtgcaaatcagattgggagcagttttatgaagggaattattatttgagacagttcttgtaaagtagataagaaaaaaagcattccagttaagaaataacatagtggccaggcatggtggcttatgccagtaatcctagcactttgggaggctgagatgggaggatcatttgagcccaggagtttgagaccagcctgagcaacagagcaagaccctgtctctgcaaaaaattaaaaacagaaaaattagctgggtatgatggtgcatggctgttccagctacttgggagactgaggtaagaggatcacttggacccaggagtttgaggctgcagtgagctatgatcacaccactgcactccagcctggaagacagagcaagaccctgtctcaaaaaagaaaaaaaaaaagaagaaaagaaaaagaaaacaatataaaatacagaagtggaaagctcatgacctgttgaagtggtgcagtgctgctggaaggaagaaaagtcaaggaagataagagtaaaagttaggttggaaacatagagagccacaaatatgaagctgaaggtaaggcatgggaatcattgagagatttccactgggagagctgtctttcaggaggattaatccagcaagctgagtgaccacgtttagcctgctagatcaaatttgctgacaggtagaatgtctttcctctctagtatttctttactgtttggcatcgaataggcatacagtaaatatttgttgaattaaacttcaaatgaataacaaaataaaatttcaagaaagaggaaaagtgatcagcagttgttgctagatacaggtcagcagggtggggattatttgtaactgcacatgaggatgctacaggggaccatggggaaagtgtttccagtgaatggctggggcaggtcagagagtgaagagtttcagagttgagtgggccgtgtagtaatcaaggtaaatgtgctctttggcacaatctgacaaaggaggaagagccactgccctctgcttcgccactgcctcactgtatcctcatcatcctggacatccttgctgcgccgatgccttcgaggctgtgaaatcctttccttctgactgtgtctgttaggtcgggaaaatagtaagttctcatggggtcagtaaatacaagaacttatttacttgaactgggtggcagtgttgaggaaaagggcagggttgtggtagctgggtttttacactcgtgggtgcttggtcttagagagcctggagcatgtgtgtcagcaacagaggggagagacatccttgtgttggatctggctctggggtcctagtttcttaaagttagtaaaattttactttggaactctttttgtttttaataattatatattcaattacttctcatcattttctcccaaagtgtcaaatttactacagcttcaaggagtcaggaatatttgttttgaggtcagtttttttgcttcacaagtggggttgtatcatgtgcctccacttcagttatatctcaagaggtgacaagttgacatttttattaagttctgtaatgttctattagttatgttcttataattctgatttggaagacatccctctgtgagagccagggaaaaggagagtcagtctagcaatcacccgtgacgatgcataaattgcgttttgtcgatttcagtcgagcttcccatatagaatgagtatataaatattacttatctgaaaagatacttagggtaaatattttatcaaacatattttaagccatctgctttaattaaatttcattggcttatttatagaacttatctctggtagttcaggtttttttcagctgaaaattataatacatttttttcagccagaacatttcaaaatgtacttgtatgtttatatgacgttgctttatgtgagtaacagcagtgtaacacagtcttgctgatttacccataaaattataagctttgctttctgaaacaaaatccgctgggttttcctggagaaaacttgagggaatccaagcgagtcctaggacattgctgactgagaaaatcctgggctaggtccatctccagctctcttgttaggggttgcaaacacagatcccaagaagcgctggggaatgtggtgacagtgaaatccaggggccccatcccaagtgggcagccgaggcgtgtgggcacggagttctagatcttgtgatgttttagtaaaggcaggaaatttagttaaaaaaatttttttttgtcgtttttgggctcttaactcttagaagtgaatttaaaatgtttagaacattgtgcagcccacatacacaaaaatcacatttgcaggttggatttcagctgtaggctgtctgtgcaggtcttctgctcttaacaggaatttgaccttcgtcacagccctgactgtcccattcaaccacagtcatctctcctgagttgctacagttgccgtccagtccagtttctttctgtgtctgtgtttgtttactcccgaaagtctgtccttacttagcagcggttgtgatcctgctcagatcaaaggagtccaatcctgtggttccggttccctgtagctccgtgagactctgagaactccactcggcctccagcgctgcctttgccgttgccttgaatgaaacaggcgctcgatgttggcctcaccttgcttggtttcttggcttctgtcttctgattctggctcctacgcatcacgttctgcttgctccttagcattgcaaactctgacattttagatgatacgtttgtttcctagttcgtaagtttttcctgggtaaacatttggagggtgttttttgtatttgccttcttagcacccttgatacaccttgatagtaggtgtacaagatacacttgctgagtgggagcccctcttttgccagccttaaaaccatggcttccaaacctcacaccatgcttcattgtccttgccagttctgttctagctgccaggagtgcctgagagccaccaaacttgcacactgctagacacaaattaagatgggcttgaagaataaatacttgtcatttcctctgagctcaaggcatacagatggtaggtgctcagtacacattaaatgcatcatttgtgcctcttggctttttcacttctgtaccaaccaaatataattctacaaggagagaaaggtaagcaaaaattagttgtgtgtgttttcagctttttattaggatgtattccaaagcaaaatactaatgaatttggaattactgtcactatcatttccatctattaccacagatagtcaggaactgatataactgatttgctttatttggaggatgagcaatttctaaaaaatcattacccctagtaaaccaagatgagtcagctcattataatagggttctttatactttgaaaagggggtgggttttcttgttctttctgcaattgatatgcgtaagaggaagaatgcaaaaccatgaatccattcatgaaatgtacttttgaaattattcactgattttttaaaatgttcatgcttgtgtgtgtgtgtgtgtgtgtgtgtgtgtgtgtgtgtgtgtgttgtgggggggagggaaaaggtagatgaaaaactaccttgtttaggcatgattgtcaattttattttctgtctacttactgcgttggataaacatactggaatactgccaaaaattcaggtggctgaatgctaattttgctgaaattagatggaacagccatcccctgccaattttctgtctaaattatgcagaaatttgactcttgtaagacataaatctggtcaaaaatagagtcctaattttctagttagtcagtaagaccatcaacagactaattattcttgttttatcttttactttttattaagagaaagaaataaaaaatgaaacgcagtaaaagttactacgcatttttttcatgtaacccaaatgtagatttgcaacgttaaaggacatagcaggtctaactttgtctgagatagagcaggagtgagcctcagaaaacaattagtgcatctttcaaatgtaccatagttattgaataattactcaaataatggtcagtaatggaatacaaagggttatctcttagctaatcctcaagtaatggaattggtatatctgtgatttttctcttagccttccagggtatagaagaattagacaaaagtgattatgggaactagagggagccactggaggccacaaggaaagggagaccttatcttaagcaattaatcaagaaactcatattttgggacaattattcagagttaattctaaaatagctttagagccccaggtcttgagatatttttttccagaattttgtcaaggtcatttagagcactaggataatcttacattagaataaagatttggttaaaggtatatatattagtctctacctagaaatatgggcagcatgaaaacatagcatcggactacataactgtagttgtaattttttactctattttcattttttttggtagtaaactgcacaaaataggataaggctttgtcccagagatgggcagcctttcccgatgcacagtctgaagtgcactggcctctggcacccgtggcattagaggactggattgcagtttttggagttaggtcagtttgtctcaccttatgaaatgtgaacagagggatgctaatcctgtttgcctagtgagtttttgtttgtgtgccatttcacagaataactgatttcctattgggtgtggttgttttaaatctgaccagtcatcttatttacttattactgtggcattttttcccattagtggattaaaaaaactgttattttccaggtcttttgtttgtttgacttacctaatttatcttgtttacctgcatagtgagcattttaagacctttcctcagctttctctacctgccttccttggtatcttcccttcttctagttaagtggattccctttggccgcagacactctctagatgccgcagggaggccaggcctgccctcgcactgcagccccctacctcctcccacccctacagtaactacccacccggctacatcctgagaaggctgtcccagcagcaagggtgtgcccttgctcctctgcccctgaaatgcttgttcatgacatcatcacacagctggtcttcctcctgaatcagctctcagctgaaacatctcttctccatctttagacagtgactgtcctgtctaaagtcgccctttttctctccacacacattatcccattttactgtctccctagcacttactgtgaattttccttttgtatttgttgttgcctatctgccctgctagtaaaatctatgaatagagaaaccttgtcttttgtttgttaacctccgcattgccaggcggacacagatcttaacaaatatttgttgaatgaatggatggatgagattgccttgaccttgttatgcacacctgaccctgactgtcctcctgccttggcctcctctgtggggctgaagccaccctctcgggtcatccataacgtcactgcatcctctacacagctgctagagtcatctttctcgaaactagatcaaactattttaaaactaccggtgacttcctatacccttcaaataaaattcacactctttcccatgatccatgaagctctcttgacctacccaacccacctcctttcctcttgccttcacctgctccttcccatgcctcagacacaaaactcgttacgcagtatggctgtccacatgctgtccctgcacctggagtactttccctggcttgtctctgactggctgttttggttattcccatctcagtttcattaatcagtattcacatagttgcttcattctatttaagaaggtggtgggccaggcaccatggctcatgcctgtaatcccagcacattgggaggccgaggcaggcagattatttgagctcagaagtttgagaccagcctgggcgacgtggccaaacctcgtctgtatgaaaatacaaaaattatccaggcgtagtagcacatgtccttggtcccagctacttggaatgctgaggtgggaggatcacttggacccaggaggtggaggctgcagtgagccatgattgtgccactgcactccatcctgggtgacagagtaagaccctggtctcaaacgaaaaaaaaagaaggaaagtggcactctacatcactaccaccttcccagttgttattttccattcctttatcctgtttatttcaaagcatgtatcacaatgattataacaactttttttgtatatttgatgcttttctaatattggacacaatggaatacttaccctactcgttaaaacttttctttttttaaaaaaataattatttgtttgtttttggaggcggattctcgctacactgcccaggctggtctggaactcctggccttaagagatcctctcacctcagcctcccaaagtgctggcattacaggcatgagccacctcgcctggccacaacttttctttcttatacttgcttatactttctcttcattgttgttgttttaatcttttctgattttcctccaactcattggctgtcccatctccttctccggcccctcttctgctgttattgaaatgtcggcagccctagaatcctgcccttggttctctgctctgctgtgcaatctgcaggtcacctttcctgcatgcacggcccctccagcccccaccgcaggccggatagtgcggttaagagctttccatcagcagctgtgagggccttctctgggttaggcgctgtttagactctgggaatagtctaaaaggtgtagttccttccagcatgaagcttattgcattttggtgagggagacaaaaaatagctaagcaaacattctgtggtgttaggtaagggagtgcagtggcaatgaggccaggtaagaaagctactgggaggcgagttgattgcaatgtgcagtgatcagagacggcttcactgaggggtgacattagagagccaaataatacgagagaagcagccgtgagccgacctggaggaacagcactggggctgctgcgagagcgttggggagaagcttggtgagtttgagaagcatcgaagatgccagcatggcttgatgaaggcagctaagaaggaggatggggccagaccttccaagacctcagaggccatggcaaggagctggggctttattccagtggtgacaggaagcactggaggcttttgagcagggaaatgatctgatttgggattcggagttggagagtcaattccagcctcatccatcacatggctttatgtgaagaagcagcggtcatatttagcattttcttagccaacagtctaactgaaatcacccatgtacagacaggaaatgacgttcacaattctatgttgacgcactataacttcctgacataccttttattaaagaaagtttaaattgtctcaagtggttttattgttaaatatagtactttatgactctgattttttttttttttggagacagggtctcactctgttgccccggctggaacgcagtggtacgaacatagttcactgcgacctcgaactcttaggttcaagcaatcctctggccccagcctcccgagtagctgggtccacaggtgggcaccactgggccctactaattttttttttcttttcttttctttctttcttttttttttttttagagacaagatctttcttgttgcccaggctggtcttgaactcccagcttcaagcagtcctcctgcctcagcctcttaaagtgttgggattacaggcatgaaccagtgcgcccagccttcgtctgattttaagaatgtttattctgtatatgatggatgtgataactttctattattactcatagatggatgaactgttctgctgctctccctggttcctcatccaggccaggaaagagttgattgtaatttcatagcatttttctcataataatctttaaatcctgaattgcttgttttgtggcttttgcatatggatggtctcctagtgtgttgggtgttttgactcaccaaattttgagagactagcagcagattttacaggctgcctcctaaataggaagatgtttggagttgttggaatgagacagggatagatacataacaaccaaaagcttaaatactgatctttttccctatcaaatttatcactgggtactgaactaatgtttatcttaccagttcaaacttgagtcaccctaaatttgtttttctttcgaatcttgcttcctaacagtcattgtgtcattatactgagctttctttattaaatggttttgttaaaatctccaggattatacatgcatagttggggaaaagagggaaaaaagcaagtgtaggaacagcttcctcagagggactgacgcgcagaggtgctgggcgggtggggagcaagagctgtgcccggctgctgccgccgctgctgacagccgctctcgggtcaacagtgtcaggatgatttcccattacttttttatcgactgctcttgatgatcctgtgaagtaagtgggctcagcattattgtgtgagtgtctgtgcgtgcacagatgaagaaccttgtgctcaccatcacagagaaagaggaaggggctggttctgtaaatcagagtccacttgccctttgctgtttccactgtaacgaaatgctgccttaataataaagcacagccggaaataaagagtgggctgcttagcactgtccccaggacagaggccatgtggcaggcaagtcagcctcttcgacaggattgtgtaccaggcctactcatggatgcctgggtgtcttatatataagtggacacaagaagggagagaatggagcacttagggcaacagccaagcaggcccccacctgtcctagcctttccctttgcatcgcattatgtaagtcctcccttctttgacacttggattttagaatgtccactttcatgttgctttaataactagaacaatgtcttcattttacatagaaggaacacagtaagaatttaatagtaacttgaaacaactgtaaaattccgttgatcctgagatatcagttgtaagacacaccattcatttatgtaccactaaggtaaaaacaaacaaacaaaaccaaaacattgccaattagactgtgaagcaattctttcttctataaaacatttttttaactgcatagaccaaatacttcaaatttcttaaatggtttgttgactgaaacatagaagggttgcagtggccagtcattctaccaggagtaacagtcaagttcacccatcggcaggcagtgactgcgcatcaccactgcctgtccaataaagataggaagatactactggttagaaaagatggcccaatttcagagatgcacatttttgttttcacattttaataaattagagtcaatgatacatggtgaaatcgtttctctcatttttctaataatagcactgctggagaaagtacttattattagcctgtaatggtggtttagcagcagaaggcagatgtggttcccgtatcagtgaagctttgttggggaaacagacaagaaatgcatgaacagtcaaacagttataaattgcgactccttattttggggatgtagaatgaccagagaatatgtctttgaaaagacagtattactcttgagacttaaagggagagagatagagaaatatagaacgacccagggaagagtgttcccatgggaggggagcagaatatgtgggcatgaagaccctgtggagggaaagaccttggcaccttccagaagttcggagaataattgtgtgtctcgagcagaaagttcctcacgtggctagttctttgaattaaactcaaacatgtcctaatttggatttagagaaacgtcttaccagatacagtcatagtgttttagttcatgaagcatatttattcttttcatgaaatgcttctgaggatggaatcactttcaagcaaaatcttttcttttaagtcagtagtccgtaaaagtactggatgttgatgagtgtatatccatgtagttatatacagttatcctcattatgcacagattctgtttctcacaatcatttgaagacatgcagagcagcaaaaattcagtcgcatgcgttgcctgttcccagctgaggtcgagcaaggcagcactctgcctttggtgtcagctctcgcactataaggaagtgtggttttcaccatctcagtagtgccatgtttttctcattctgtgcttttgttggtgattttgtgtttaaaatggccccaaagcatagtgctgaagtcctgtctagtggtcccagtgccagaggctgtgatgtgcctcatagagaaaatgcatgtgttacataagcctcttctaggcatgagttacagtgctgtgcactgggagttcaatgttaatgcatcattaatatcttagataaggtgtctttaagcagaagcacatgtaaaacaagggtatgcatcgattagctgatgaaaatgttgtgaccagagacttataggaacctaaccgtgtatttctcttaagagcagtggttcagtatttgttagttcagtgttaccataactactgcaaataacaagtgacagtatgtgtacatatgaatacatagctaacatgctgttgtgtaacaagccacccccaaactttagcagcttaaaacagcaaccgtttactagcttacaattccatgagtttgcattttgggttggctcagccatgcggctcttctgctggacgaggctgggatcacccatacatttactgttggctggtggtcagtggctttgctcctatgcctggtgctttggctggggctctgggccacacacttcatcaccccgcaggctaacctgggctcattcctgtggcagtggttgcaggtttcccaagagcagcaggaaggcaagtccttagtgtgcagccgctttccatgcctctgcttctgtcacatttgcccattggccaaagcaagtcacacagccacccaaaatcatgtccacctcttgatgagaacagctgtagaagcccagtggaagggcatagatgcagggaggggaagaatgtctgttcatttttacagtctgactcgtacttctcatactaagtcgtttatatacaaactcattttttacatactttgtcttactgttactcaaaagccaaagaggtagtactttctgttaacccaaactggcattaagaggaaactgaagttcagaaggatgaaggaaccacatagcccaataattggcagaggcacatcatacatgtctctatgattgtagggtttttattctgtttctattgtttcactttctgatagataaatggctaatttgcctaatttgtcttattcctggggtggggaaaggaattgcaatgagattagtttcatccctacagaacaatactattgtctgtaaaataaactgtatcctatgcatagtcttactattttaagtctaggaaaatcatgatgatagtgatttgtgaatgtgtggtgtttgattataaatttgatttgcacaaagggcctacatcctggatatggaatcttagttgtaacagaatttatcctgaaagacttaaaggaagatgattaaaatattagagatattgacattgtctgaagagatctacttgtatttatttcttgcaaaaaaaaaatccaccatattaccatagccaggccctattatgctattgtaatcatagttgaaccaagaagagtgattaacgatagcaatttattgtatctgaggaggagagaaaataggagatgttgtcgttatcataaatcatatcataaataaccaaaaagaagcactcagaatgcttgtgtggtgtcagcagccagccctttcagacacgttagcccaggatgtagccatagaaaccccaaagtcatattgttatcttagtcttgctgcagttatgtgatacaacagtattaacatatagattaggccatttataatactaggtgtcatttcaggttggcttgcttatatagcattttagttttttattgtgcagaatgttagtgaaatagtacttttttacaggtcactgtgtatctaggaatttataatgcatcatattcactctactattaatttcttgtgttattgattggttgtaatgtatgaattgtcattgcctaattgtcttgtctttgctagtaatttcattttttaagtaaacaggtttattttaaaaatacatacccacttacacatgttgagttgtgttttaagggtctaatttctgttacattatagacaggacaattttaaaatattttataaggagatgtcaatggaattattttttagcctcatttagtactagaagatataatgatgaagtggattatgattgtttttgacgccatgcccttcttttccttcccagcatcgagtgcctgttttcctattatttcctgactgccccagcctcttctcctcagagtagcttcccagctgggcctgaccctgaccttcctggtagtaataccccgtgttctacactcacctaatcctcaacattccatcacgttgtttcacttcggttccattttcccagtcttctcacttcaaaaagtagggtagagttgttcatttgttagtttcatggtcttaaaaatattttcacagcaacattttaaagatactgcctttacccaaacacataaatcaagtggtagagtttcaggaactgttgcttgttggtcagtgagatatttaggggcaggagtagctctgtcctgccctttagatcatcccacacatggccaactacatgtagagatggccctaataataaagatcttcatctcttggaggaggtcagatgtcagtattcacactttacagatgagaaaacttaggtcttgggaggtgaaatgggctgtgctgggttgaacttggctctgtgaaccgatcccaggtgtcatttcagttaggttccctgcccagccaacatttccattcctgccttcatatcccttgatgtggctccgtgtgtaccttgtgcagattcctgcctaccgtgtgaactgatggccataaaatgtgtttgattaaggacagccaatcatgtcttatttgtctttgtagtcctagttaacacagaactttccatagtgagattcagagtgcacatcataggcaaatgaatgaattagtcctagttaacacagagctctccatagtgagactcaagagtgcacgccataggcaaatgagtggattagtcctagttaacacagagctctccatagtgagattcagagtgcactccataggtgaatgagcggattagtcctagttaacacagagctctccctagtgagattcagagtgcactccacaggtgaatgagtggattagtcctagttaacacagagctctccatagtgagattcagagtgcactccataggcgaatgagtgaattagttctagttaacatgagctctccatagtgagatttagagtgcactccataggtgaatgaatgaattagtcccagttaacacagagctctccatagtgagattcagagtgcactccatatatgaatgagtggattagtcctagttaacacagagctcttcctagtgagattcagagtgcactccataggtgaatgagtggattagtcctagttaacacagagctctccctagtgagattcagagtgcactccataggcgaatgagtgaattagttctagttaacacagagctctccatagtgagattcagagtgcactccataggcaaatgagtgaattagttctagttaacacgagctctccatagtgagatttagagtgcactccataggtgaatgaatgaattagtcccagttaacacagagctctccatagtgagattcagagtgcactccataggcgaatgagtgaattagttctagttaacacagagctctccatagtgagatttagagtgcactccataggtgaatgaatgaattagtcccagttaacacagagctctccatagtgagattcagagtgcactccatatgtgaatgagtggattagtcctagttaacacagagctctccctagtgagattcagagtgcactccataggtgaatgagtggattagtcctagttaacacagagctctccctagtgagattcagagtgccctccataggcgaatgagtgaattagttctagttaacacagagctctccatagtgagattcagagtgcactccataggtgaatgagtgaattagttctagttaacacagagctctccatagtgagattcagagtgcactccataggcgaatgagtgaattagttctagttaacacgagctctccatagtgagatttagagtgcactccataggtgaatgaatgaattagtcccagttaacacagagctctccatagtgagattcagagtgcactccatatgtgaatgaatgaattttagtggcattgagtcacttcaaggaactggttacaataaatatacctaaattcagacgaatagaaaggtattttttgaaaaaagtatgcttttttgtttttcaacctctctgccccacctctcccgtgctgtctaagcattcatttaaatgatcctttcatttgctagtaaaagaggaatctattataaaaacagtgacatgtatggactaataggaaagtttgtgcatcattgtagaaattaatttctacatctgcatacatttttcatttacagattctgacacaagattgtgtgtacacttttaaccaatcataagaagtctagctttaaatacgtttaatttttgatgaaatatatgcagatagcattttgttgttcctttgcttaaagtttaagaatacaagcatattttctgcttagttggagaacatgccactgaattttaaagttgcatgcgtctgtgtagttagtcagataaaaagcttctatgccatgtgcaaacaatttccctttatttcctaatgtctatgaactttttagattatagtgtttctttaaaggcatttactattctagttaaaaagatattttgttctaagtcaatatttatagtagcttagaattaacctcccaaaaatccttttggtgtgtcagaccttattgccttgttctgtttttgtctgagaagtttagaaaagaagcatgtttttctcattattcctcaggagaatgtagggagtgtggattatttgtttgtgttattaatgaaggaaaattgaaatggagtttgtggtgtcctgctcccatcaacatttgtaaagcttttgaaagatagggattaatatggatacattttgttgcttttatgtgattaaaaggaatttgacaattgttctgcagtcacactctgatgcttttagggtaaaggatcgtgatgtctacaacttattctcaaagtttcccaaaattatactataattaggtaattatattaatagatgtagttatataatacatatgttaattagtgcatcgggttatagggtattcatgaattctttgtagtattcttacaacttttctacgtttgaaattatttcaaatttaaaaattaaaaaataggccgggcgcggtgtctcacgcctgtaatcccagcactttgaggggccgaggtgggcagatcacgaggtcaggagtttgagaccagcctgccagcatagtgaaatctcatctctactaaaaacaaaaaagttagccagacatagtggcacgtgcctataatcccagctactcgggaggctgaggcaggagaatcgcttgaccccgggaggtggaggttgcagtgaaccggaatcatgccactgcactccagcctgggcaacagagtgagactccatctcaaaaaataataataattttaaaataattttacagtcaaatgttgacctggaaccattgattgtttaaacaagaagatatcttagaaagcatctctgtctccctatttttgtatacattatgatcagatacccagctaccaattaaatatctgtctaaaagtgaatctctagctgtggtgatgaatttgtgctgagtcattcatgatttcacatcatttccctttttggactggtgaaaaaagcataccagacatgcaaaacatttggcagaatgaggagttccttcttactgtggccatttcttatttgaagtatagcattcacattttagtgactgtgtgaaaaacatgaaaaaatagggttgttaagaggggacatgaattttagttaagatttttttgaaaataggtattaccacactgttttaggtgtgattcttcatgtctttaatttttttttgttgttagtgtcttttttctactagaactataggggttatataataatttatgggattctttgatgaatgagagtttaatcaattataacacataattttcaatacattctcacacgtgggaaaagcaaatcaaaagtcatatcactatcaactttaaccaaactttagcacaagcggaaaaggtgacatcacttttgggaataatccttactatgcctttagggacatgagcattaatacctatccagaactacctttccttagttaaatacccactgtccttcaaagcttccccaacagccctcaattgctttcatggagcgatggggagattagggcagacgatggggagattagggcagacggctgaggtgaattcacatcacccacagatactaactctggatgtgtgctgctattggttttacagagatcacggggaggagaattgttttttgtttttttaatcttctcaaaagggttacaaggttaactttccaaggcatatctctattattgatgggtattattatttagcagtttgaatacttacctttagtaattaattttcagaatactctcaagataaatggtgttaaagaactggtcttattgatcaaggaactaatgcgccaagaagatgaacttgtgtgaaaacttacaactaacaatcaattttttaaatttttttttcaatatttgtttctcacatatgtacagaagagtccttttctcccgtttcagaacactaaaataacagaaaatgagttcttagttctttggaaataaaaatctttgaaatatttcatatatacacatgctgtctgtctcacgctctctctagcgcgctctctctctctctctctctctctctctctctcgatgttggaacacagctattattattattatgtctatatttgtgttaaagtagaaagggcctgtgacccaaatttttttttattatttttgcaataacatatcaagattagatatcttgtaatattaagcttatgctgaccaaattttgcagttttataatacacaggcttccacagattagtgtaggaaaatatttttaagacatttgtaggatattttacagattattagtaaatgatgatcattatacacatgcatgcaaagaatactttgttgccattcaattattatgaaactgaaattcacctttaccagtggtagaggctaaacagttcaatagccattacacatgtatcttattccaaacacttaaaacatagaattaaaattattcatgtagtaaaaagccagatactcattatgtgtaaccatcaaccaagtctgcatttgagcaggcagaagctagatcaactgtatttatttgttttaattttaaaaattctaatatttttaaaataaaatatattcactcaagtcgaaaacttttttaccaggagaatggattagctaccattggacatttctgcagcagtgaaaataagtgaactacagctgcctgcatcaatctgggtgaatctcagaaacataatgttgggtaaaaattaaaaaaaaaaattatagtatcatactatttatgtaaagttcaaaaacaagcaaactacctacaaatatggtaaaactacaaaggaaacagattgaagatcaagatagtagttccctgggggctggggtaggagtggagaaagcaggggtggatgggaaaggagccacaggattgggagggccctgctcatgctcttctgaagcaggcgatggcctcgcaggtgttcactgattattatgcttcataacttccacgcgcgttacttattcctgctggtaggtatcagatcatttctaattttaaaaattgtttaagtatcttcacactttttccttttcttattaaaagttttaggcttttggccgggcacggtggctcacgcctgtaatcccagcactttgggaggctgaggtgggcggatcacaaggtcaggacatcgagaccatcctggctaacatggtaaaaccccgtctctactaaaaatacacacacacaaaattagccgggcgtggtgacgggcgcctgtagtctcagctacttgggaggctgaggcaggagaatgccgtgaacccaggaggcggagcttgcagtgagctgagaccgtgccattgcaccctagcctgggtgacagaacgagattctgtctcacacacacacacacacacacacacaaaaaaagtttcaggcttttttttctgacgaagtcctttgttcattttaattgattttgatgctgcaattgaagctttcttataaaatcttaagtaaataagaaagtgtaaattaaacaaataaaaataagaaacctttgtttgttctaaaaaaaatctattttaaaacgtttgtatttttaagtattcctaaaaccaacacttgaagtgatttagttttataattcatttctattcctttaaataacataaaggaatgaatacaagtttttgcagtattaagtaacataaaggaatgaatataaatttttgcagtaggaacttgaaaaacaaaagtgaaaataaacaataaaaacaaaataacaaaaacagaataaacctagcttgtggagtcttactttaaatcaagcttaatgttaagttttttttactgaaacacaaacaaccatcattaatttttgataccgttatgagttatttgagctctaaattcaaagtaaaccaatatattttctaaagtagttgtatgaaaccatcccagttttcctagccaagcctcacattcttccttcattcaaaggcctatcttgtagccattttgccagttctaatctgatagaattgcacattagtaaaataatatatcttactatacagaaaaatccaaattttcaagttattgtaactataaagcagaccttacatccataagacttgaaactgtcttactagtagtcctgggtatcccctgtagtccctttctagggaatgcttggagtagagcagtttccctctggtctcccagtatccataaggccttccctggagaacacacactgttagagctgagctatatccagattagtccccagagttagaagagcaggatgcaccataacatactctaaagacccgttatcctgcctaagccaaacctttatcattctgttttggcatcattgggatttatgaacctctgtggagtaggaggaggttctttgaaatttagaaatgtaatattaataagtgaatgttcattcactttcagaataccctaaagctgtcttctttctgattttctcatgtttatctgttggcagttgagcagatctgaagtccgccttgtcattctgatagcaaaagcgagggagggagggaaaagtttagatgagctgaatgtggtaggtctaggacaggggtcagcaaacgtttttttgtaaagagctggatagtaaatattctaggctttctttgttgcatgtataactggaacacagtagaccccaaagggagtacgtggttatttctagttgctaagagaaggcattacagaataggtaatacttgagagccttagaagtcgccaacatgttaggaaggaaaagacatttcaggcacggggaatcgcatgtgcagaggtacaggagtgtgaccacatatttggggattgcagataagttagcatggctggaatgggtagagcacgcaggggctcactgtgaatgatgaggttacttccctagcttagagggagcaccttgtcagtcatactggagaaattggatttttatattttattttttcctccaatttcccagatggagaggatttttgtattttagaatagtgattttcaaacatgttttagcctcacaacaaaagcttttgtggaagctctgcatgtaaaatagataaccccaggcataactcttccgtgtaataaagaacagccgtttctactgtgcagtagcctcagaaggggttctacaaaccctcaatttccaagggatgccttttacaaactgcttctgaaggaagcaatgaaaggtttttaagatgaggaaccacaagctcagatttgcgtgttcggaagatcaccgtaagacgacgtgagagatggttctgagaaagctgcactggaggccgagactaggtagaaggtccttgcagccatacagagaagaggtgctgaatattgatattaacaagacagaagcagggggaaagcacatgaaagcaaacagagttgaaaacttgtgctgtcaattcagatctggcggagaagatgggagagaatctagaatgaccccaggttcctgacttgggacctggtgggtgatgccatcattatcgcgaatcggtagcataattgatgaggttgtgatgttctttatgatttactaagtacttccccatgcatcatctcacgcgttctccatctgtgcatccttcatgcttttgcagcatggcttctgctgttggcctcatcctcgttgacctcttaagcatttggctttgttcacctgccttctgcataaaactcttgctcccttgatctctttgacatctgaccctccatgtatttctttagttcttcttccttttctttttatatataggtattcctcaaaatacctgaacctgtttcctcttgtttcttccttgttcatatcatccatcatggtgactttagttatctcaacaacactctttctctcatgcactctgtcctgttttctgatcatctgtattatatttcagctgccgagtaggcattgcagactaaatgttcatcaaactctgtgtctagggattgagctaataatcattgtccttttctatttccttatttcctgtttctgttcatcactacatttatcactcaccaaggctcaaagctttctttcccttttttttttctttaaaaatagggtctcgctctgtcgcccaggctggagtgcagtggcgcaatcatggctcattgcagcctcaaccttctgggctcaggtgacccttgcacctcagtctcccaggtagctgggactacaggcacgcaccacaacacccagctaatttttgtattttttagtaaagatggggtctcactatgttgcccaggctggtttcaaactcctgggctcaggtaatcctactccctcggcctcccaagatgttggcattacaggcatgagccaccatgcctgaccaggctcaaagctttgaaattgtgtttgagtccttgctcaagtcttataccctaatcatttatcagattctatccattctatcctcagaatatccttcacctctgctgcttcctgatcatttccactgttctagctctgacccttactgcctctcacatcacttcagtaatccatgttattgctctccttcagtacccatcacctcccaccctcatccatcctgcgtgttcctgccagtgtgacttttcccaacacataccccacacgtttttctctgttgtctaaaatccttctaggtccaaactaccagtagaataaagattatgtttctttttctggaattcaaaagtcctaggatctggatgcaattttactaaacctgcttcctactgctccccaccttgcactctactttccagacaaataattttctgtttctcttacactccccgtgtttcaccttcatctatttgtcatctgaccctttgtcctggacttcaccacttccagtctccaactatcccaaacgctgcataattaatcaagcctcctccgcatgattgacctcgctgagatctgtctctcctttgacctgctgtagcactttatctgtctgtggcactgatcactttctgtgggctagacatatctgttattgctgcactaaactgtgagctcttttagttgtgatttatttctgatttatttcagtggctcttttagactttatcattgtacattatatgcttagttaaaatgtgttgggagaaataatctgatcttagaaaaactcagccaagtaggcagggcaagtaacatcggctcctttttgaaagattaggaaacaggctcagagaggttgagagagtccctaaggctggttgctctctagtgccgtaactctagccgaaaaaccatttgtcaagtgcctaaaccaagtgtatttcattgcaccatactccctctccaagtggctcacatcaagcaagcaaaatagaagacataagtagtatatgaatttgtcataaaagtcctaaaaatacctgtcattcctgataataataataatccatactaagtcctataataatccatctcttgattttttagagggtgtgtgggtgcgcacgtgtgcttctatgtgcatgagagagagatagagaaagatggcatttactggttaggaaaataattaattcaggaaacaacagaaggccaactggaaataccgagcaatttccagatcctgaggttagggccagaccatgtgaaaggacaatgatcaatttgtacatctgctgttactgactgccactcttttaagaatgatggcacacatgtttggaagatccttgaaaactaacttactttttaaacactgtcaataatttccttttttttttagaaatcatgtttgaacgccgcatgttctcactcataagtgggagttgaacagtgagaacacatggacacagagggaggggaacatcacacatcggcacctgttgggaggtcgggggctgggggagggatagcgttaggagaaatacctaatgtaaatgatgagttgatgggtgcagcaaattaacagggcacatgtatacctgtgtaacaaacctgcatgttgtgcccatgtaccctagaacttaaagtataataataaaaaagaaagaaaaaagaaatcatatttgaagcattgtttttatttcttaggttttgttacattccaataatatttatttttttcttcctttttcttcctttaccagaagaagaagaagagcaggtgcccactgatggaggcacatcagcagaagccatgcaggttcccttggaagaagatgatgaattggaggaggaagaaattattaatgatgagaatttcctgggcaagagaccactggatagtcctgaagctgaagaactgccagccatgaagcggcctcggctattaagcactaaaggggacacgctagatgttgtgttattggaagctcgagagccactcagctcaataaatactcaaaagatcccaccaatgctttctccagtccatgtacaggacagtacagacttggcacctccctcacccgagccgccaatgttggctccagttgcaaaatcacaaatgccaactgcaaaaccattagaaacaaagtcatttacacctaaaacaaagactaaaactagctctccaggacagaagactaaatcacctaaaaccgcccagtcaccagcaatggtcggaagtcctattcgatcaccaaaaactgtatccaaagaaaagaaatcacctggacgttccaagagccccaagagtcccaagagccccaaggtcacgactcacattccccaaacacctgtgagacctgaaacgcccaacaggactccttcagctacactcagtgaaaaaatcagtaaagagactatccaggtaaaacaaatacagacaccccctgatgctgggaaactgaacagtgagaatcagccgaaaaaggctgtggtagcagataaaacgattgaggcctctatcgatgctgtgattgcacgagcctgtgctgagcgagagccagatcctttcgaattttcttctggatcggaatctgaaggagacatttttactagccctaagagaatttcaggcccggagtgtactactcccaaagcttccacttccgcgaacaatttcacaaagtcaggatccactcctctgcctctttccggtggaacctcaagttccgataactcatggacaatggatgcctccattgatgaggttgtacgtaaagcaaaactgggaacaccttcaaatatgccccccaactttccttatatctcttctccgtcagtgtctcctcccactcccgaacctctccacaaggtgtatgaggagaaaaccaagctgccttcctccgtggaggtaaagaagaagttgaaaaaggaactaaagactaaaatgaaaaagaaagaaaagcagagagatagggagagggaaaaagacaagaacaaggacaaaagtaaggagaaggataaagtgaaagagaaagagaaagacaaggaaactggcagggaaacaaagtatccctggaaggaatttcttaaagaggaagaggcagatccctacaagtttaaaatcaaagaatttgaagatgttgatcccaaagtgaaattgaaagatggacttgtgaggaaggagaaagagaagcataaagataagaagaaagatagagagaaaggcaagaaagataaagataagagagagaaagaaaaagtgaaagataaaggcagagaagataagatgaaagccccagcacccccactggtgttgcccccaaaagagttggccctgcccttgttcagccctgccacagcctccagggtcccagccatgctgccatctttgttgccagtgcttccggaaaaactgtttgaggagaaagagaaggtgaaggagaaagaaaagaaaaaggacaaaaaggagaagaagaaaaagaaggaaaaagagaaggagaagaaggagaaggaaagagagaaagagaagagagagcgagagaagagagaaaaagagaaggagaaacacaagcatgaaaaagtaagcagtttctcatttttggccctatctgaacagagtcctagtgagaaacacaggtaaacaaagcccacaattatatctgtattctgggtgtaaatcacccatcacttaagtggaaatatgtttataatgaggttacaaaatttgattttaattctaaaacccataaacctgtaatcaagccctcaacacactagcagatgttaaaaattcatagcctaagaggcatctaatcacagactataaactctctattagctatagtgatctctggcagcttaaaaaaaacaaatctgggttcttaaattgtgaataatatttatgtgaattatcaagtgtactgcattatattttgcacccatatattgagaaaggcagcatccatgtttctaaaagcatgcaaaaccacggcactattttaagaggacagcaaggcccgtggaaggaccactgccttggttttctttttggtgcgccattttggcatgtgtttaggattatgcctgtctacagaactttccgtagcatcttttattccttccgttttctgctttaataagataagggcacatttctgagtatctaggctgatctggcagcctggtgagtgggcagaaagtaatcccacatggcagaaatgtttgaccatctcagtaagtcagacttcatttcatagcatacagcccgacaaactgatagaaaccccgcagttttgtaggcattggggcctcagtcctcaggctgtgacctctgcttacccagctttgcttttcagtctgtggtttcttggattacagcagccggctgggttatttgaaaatttctcataaactttccgaaaaagtatctcttcatagtgccaccccagagctcctgatgatcctttccctgccctctaaaagttatcttctttgagcttggccacaaaataatacccagtagttttgttcatatgataaaatttgatgtatttgacctgcagcagatatattaccaataaattcggagtatttttaacttcaaacttacctagaaaactgagtgtatttgacagcagtaatggcaactcccatttttcgcctaccttgatttgttctttgttctctttggctatcctaaaatataaaaaagtgaaatgggaattctgatatcaataactgaacattgacaagttaacaagacacagaaatccaactcttatttccatttaaaaaatcattttatttattattatgcaatttctatatagtagttgtcaggttttaaagcagatccatacaccttgttttctcctcctaacacacctgtgacataggtccagcaggtattatcatcgatatttatggaagagaaactgagcctgagagagtgacttgtccaagatcaggatgacacagctagcaagagccaggtcagttacactgcagagagacttcacgtggtgaggggtttgttgttagagatactgcctgacagcagttagtcatttatcccttgtgtacctagtaagttggcagctgagccctcagtaaatcaaacaggggactgttcctgtcaccaccatcttcactttggaaagtcagtggagttgtttcaacagccattatgaatttgagtgaagccatcagattaggtttgtaacagcagtcccatgcctttctacagcatctacctgactttagggaagaaaagtcccccagaccaccttggtggaaggcaaaggctcagtccctcgaagcacagagtccacctgagagaaagatacatgttcttggatcagttttgctgggctatggagcaggtacatggcaaaagataaaaatgtagaaaattcagctatcttataagacctttataaataataaatagtaatgtctatagaattagacctgagttcagatcctgacttttgtaaaatgggtaagtcatttatataaggattaaatgagaacatacaaggtgtgcttagtaccgtatctgacgcataaatgtcagtagatggagagagtgttccattctgaatcaaactataaaatgtaggaacctggagattgctgctccattggaccatatcagctagcctgtgttaatatgggcaggtcagctattaataggttttaaaaattattctacttccttggcattctttggaatattagcccttgatacaaataggaaaggataaaggttaggacaacccagggaaatgccattgataaggagtagaaattgggatagtaacataaatgttaagacttccctttcttcaaccccgtttaaatcccccaagcaccacagcatatgagtaaacaaaaatacacctgaaatgcggttccatatggtccgagaattttcctacaaatctacagaagtaaggcaccaaaggttaaactaaagtgagacatatctgctcactttatgtgagcagctttatgtaaggcaccaaaggttaaactaaagtgagacaagctgccccaagaaaatgttttcagccaaaagaatgaaggccacaatctcattttcccttctcatcatcctgaccaagagcaactctcccagacactgacccagatcggcaagcaagagcatttgtttaaatttttcaatctccacatttattttacctgcttataaagctgataccaagaaccaataaagatgtgattaattaaaacggaatttgcatggtaggtagaaggagctttgggctttggaatccagcagacctggaataagatccaggacaagttttttagcttctttaatccttaagtatttcatctttagaaataatgataagaacactaaaaacagcaaaacagtcatagttaacagtgagtaattactatgtgccaaacaccatgctaagcactttaattccttaccacaaccctctaagatagatgctgtaattattatcactttaagatgagaaactaaggcttagagagattagtagacttgcccaagatcacacatctagtaagtgattgaacaggagccaaaatttcaatccaggctgtcagatgctataatttatggtcctcactaccacacttttctatattatgttaaaatgggataagtgaaatcacttggttggtaactcaccataagaagttcaaattgtttttctattagtgatgataaatccagagagtggtgagttgtgcaagcttttagttccccttcgtgggcagtcagacacctagtcagggttgggactctagactgtcacttatttaaaatagaaccacattaactttttataaaacacatgttaatggccaggtgcagtggctcatgctcccaatagtttaggaggccaaggcaggaggattacttgaggccaggaatttgagaccagcccaggcaacatagtgagactgtctctccaaaacaaacaaacaaacaaacaaacaaacaaaaacctattttttaaattaactaggcatggtgttgcacatctggagtctcagctgcttgggaggctaaggcgggaggatagcaccactgcacttcagcttgggcaacagagtgagaccctgtcttaaaaaaaaaagacatgttaagagcacttatattatccaattgcagtcacagccataatagttgtagcagtgataaatctaacattacatttcagaacagtttaaaattgctattaatactgtcacatttgggattaagtacaatttttaaaaatgttttattaaaattttggtttctgtgtgggttggtgtatatattgcatggatctttggggtttagatgagtatacaggattactttaattacaattccctcttgttcttttaagtgatttttggagggaggatcattttgaaaaaataaatgcatttttaaatttatgttagtggaactggatggttatacctatattcttaaatagaaagtaagccaaaatccatctgtcaaagtgggggatctgtttttacattcgaatatgatctggaaaggcacagtagagtttcaccccaaaaatgctgacatcacccaccatctgtagataagtaagtccagtgctggctgagggagcatggctttggcagccacactgaccggggtggaaattccagctctgccacttactcgttattcaccaacctcccatcctcgcagaccctctgcttccttcctccgtctccttcctcccattcaaaactaggaagagacagcagcattctaaagtttaacttatctctgcttaaaaacagtagtttcataccttctcgaagaatattctggcttcagaggctttctcttctgccttctcttagaaaacaataaatgaagagcagtttgtgtcatttaattaagataagtagaggactacaacagttcctgaattttcatacacatatccaatagtgttgatgatcaacccctgcataattgggagttgtcgacaatggaaagcccataaattctagaaaggattctcaacattttttatcctgttgattgaggaattgttttatttgaactttggctactgaataaactaactcgatagtcaacagtgttagcatctaccacctcttgagtgcctacaggttccaggccttgccagaattcaatgatttaattctcccaacagctctgagggtttggtatagtggttcctgttttacagttgagaaaactgcacagaaaggtcgagtaccttgctgtagccagtgaggggagggggcccaggcctgtctgcccgaggcctgtgttgtttactgcccagaatggccttctcagccacttacctcagtctgctttggtgacctaagtgacaaatgcaaatgagggggataggaatggtttgatgcttgatggcaagggcacatcatgattttataaaatgttagttcctggagataccttagagagcacctgtttaaccgccatattttaaagagcaggaaagggatatcctttacactttgatgactttagcaatcagaacaattaaaaattttaatgtttctttatccccaagtcctgtaggatttgcccccaaataatcttttattaaatttaaacggtttgttctttagagaatgataaatcatctaattggtttgtacctttaaggaagggttttcatccttttcctcttttgtttaaagtaatgtagtctcattccaagtcttttctcatcagctattgtaattaattcgtgaaatgaagggttttttttgtaaataaacccaataaaggggagggaaatgtttccttcctgtttctcataactgtatgttccaagagaaaacaagaaacttaatgtttaaatgagtatatttaaatttgtagttcacccaaggccagctcccagcctttctgactctacactctgagcacggacgggaaagctcatattctgtctcagctgtctacatggggtggcacttgttatacttaaccacaactgcacatcttctgactctctgtttaatattttaaatagttatcagagtttacttagactgtgtttctaaatggaaataatgtaaagaccttaattgctgagaaatacaagatggttacagccatagttcagcatccaaatgttaggttattctgttgagctttcatcagtactatttgtgagtttttttctaacataccggcatagatgggaatctgaactagcgcttgctaaatttgctgctaccctagctagtatacatatatggtgtttttttttttttttaatgaaaggagtttaacattaaaagaataaaaaaataaaaaaccttggacagattatattgacaaagctgcccattacctttgcagaaagtccctgtcaaaagataaactttaaagctggaatgcatgaaagagttccaagatagaatttaaatttgaactgattctttatagataagctttttaaaaatccacctctttgcttcaagtcaggattttaaaaataaatttcccctttaaatctcttgagcgattttcattttttgcaaggccgcactgctggtgtcctggaaaaatggagagttagagctttatcagttggtgccctgaggtgtgtggcgaagaagctaaatccttgaagattaacaaaaaaaatgcagcacatggcaataaggggcttatatgactactagtattagttcaggtgaaagaagtattgcttctacataaaactggacaaatccactgacaatgtatttttagttacctacaaaggagtcttatattgctggactttacctctttggtgaattgggaagcttagtaatccactgtaaatgctcttctgtgtgccccaattctcagcattactccaaagtgctgttcttttattttaacccttaaaagctcatcgtggccccagattttggcttgatgccattaaaagatggcattagtcatgttgtctaagtgattgaagtcatccttttgtttgttgtttttggtaagtgcatgtgagaaattattttatgattgtaggaaatgcctctgtttttattttggtgagcacacagataaagttaatggaaacaaaaatccgggaagaaattttaatttcgaaattgtactttctgtatgtatattattagcatcctcattaatctttttctacaatcccttgaattttctcaagttaaatctaatttaacttgtttttaggaatgaaataaaagtatttaagtagtttttagatatatcctggtttgcctgggacaatcccagttatgtggtataattaatagctccctcttttcctgtcagaggcatctgtgtttagatgatacaaacactgtaattacagatgaaactttgagccgagatagcaggttgtgaatcattcattaattcaaccagttgactgaatacctgttgccttccgggcacatttataccattttaaatctcacttatgtgtttccacttttgtttacttaatttttacatattgtattatttagggtttttttatagtagataataaacagaccatttcttgattcctttgtcctgccaagccatttaagacagcgttgaaaacccagctagtttggttgagtgaaggtggggccaaggttaatgtcagtttccatataaactagttagcctcccatggagaacaaaatttacaactaaccccagccatctcacaaatatttatcataagagatattgacaaataaagtgaatagctccatgtaagccatcaatattaccagaaaaaggactcacaatgtgcgtcagagagttaaggagcagtagggtgaacaggggatgaatttggtgtcaggagacctggatttaggccatttacttactaactttgtaactctaggtaaagcacttactccttctgagctcttacatgggaataacaccatccacacctaccctatagagttgtgaagatagagttgaataatgtaaataggacacagttcaccaagtgctatacaagtgtaagttatcattattgggtgttatggtaataaaaatgggccaaacacacaactcaataatagtagagcagaatttttttaaaggtaggtcaaacagctttattttaaaatcgagcttaagaaaaggttattggaatgcgtacatgctagtgttgtcagttgaagaaataagaaatatcacttctaatacctcatcactgatgactgtgtaaccctaaaattgttagagttgaagaatataagaacttcatataatttttcattctctgaatcaaaaagactgcattccgtctcagttttgctatttgtgtgacctcagaagagaaaaggaaaacaaaatggaaaagaaaggaaaaatggtttctccatatatgatcagtttacctgtaaaatgaaacccacattatctaccctacatgtttgttttttaaaaaccttaatgagcacattgggaatataaccaagcacaatgcctggcaaattataggtagcttgtaaatgtttgtttatttttgttatatttgtttattcttccacagataacacagaaagatgaggaagtcttaaatagttcataagactggaccatttgttttcagatttgtttagatataaaactcttcatttaaaaaatatattggagacagccaggcacggtggctcacgcctgttatcccagcactttgggaggctgaggcaggcagatcacgagatcaggagtttgagaccaccctagccagcatggtgaaaccctgtctctaatacaaatacaaaaagtagccgggcatggtggcatgcacctgtaatcccagctactcgggaggctgaggcaggagaatcacttaaacccaggaggtgtaggttgtggtgagccaagaacgtgccactgatctccagcctgggcgacagagtgagattccttctgaaacatacacacacacacacacacacacacacacacacacacacaaacacacacacgagacttgaatgctaactagttatgcaagggtcttgctccacccgccacccatccccctcatgacccttgaccctggaccatactgtctgcaggaccaggtaaatgaaggagacatcagccaagagtgatgttggctagggggaaggggcggtttgtgggcaagttgatacgttaagatttcagtgtgatgagatgaaatacttataggttatttagttgaaaatgttgaataggcatcttcatattttggccttagtgtcaatcagtgctaatccagaccaaaattttgaagacgtattttaaacttactttcgaaactgtgggcagggatgagatcactaaagaaactgtagcatgacaagaggagagggccaagtaaggttgggtgaaagaagaggagtttgtaaaggagaaggaaggagcatgagaagacctataatgggaaaactgggacatgaggacattggcaagggttgaggaatgaagaagaagtgagaaaacagacaatgaagtgaagattgaaatgtgtgagaaattgttagctagaggttgaagagaagttaagaaaatgtttaagatggagtggagcacatttaaaagtgagatgaaggccgggcacagtggctcacacccgtaatcccagcactttgggaggtcgaggcgggcggatcacgaggtcaggagatcgagaccaccctggccaacacggtgaaaccccgtctctactaaaaatacaaaaattagccaggcatggtggcagctgcctgtaatcccagctactctggaggctgaggcaggagaatctcttgaacctgggagttggaggttgcagtgagccaagattgccactgcactccagcctggcaacagaacaagactctgtctcaaaaaaaaaaaaaaaaaaaaaagagtgagatgaaaataattcgtggaacagaaagactgaagatactgtaaataagcagatgatagagaaagcttctttagaagacagcaggagacagatgctagtgtaattgtgggcacagagaagtttgtagggaattgacagagctctccttcaatactggtggcctcaccggtatttcctgtggagttagatgtgtagaaggggaaagaaggtcatgggaagagtcttgaaagtgctaaagattgaaatcattgcttcatattcatgctttacacttatcttaagacttactagggtcagatcctgaaacaggcactagaaaatagcagtaagcaaaacgcgcatggtccctgcccttagctgggttagctggtaaacagctagtattggaggcatacatgaagctggaattaaaaatgttctttggcatcactcggtgctctaggggatggttttaggttggtcctggatgtatggtggaataactaagaggtaaaagggttggggcaagataagttgataattcaacaaatgtctgccgagcatctcctgcatgcaggcatcatgcaagggagctgtcgaagcagtagatcttgatgggctgagggatttgaaaaacaactctaggaagagacagataaatacatgagagaaaataatagatttgatctacatgtactatattaactttatgatatgttgatcattattttatgtgttcccctttagaaccactatactgttcaattatgatgtaattcatgagcttgaaatacataaattaatgttgcagctagtcagtgactaacagtaaaccagtgacattaaacatctggcagtgcttgggacagtgccttacaacaaagaaccatcccaccaaaaataccaatcctacagccccaccgaaagacttggagatagacagtaatttggaaatgcagagcttttgtttagcttgttaattcaaaatgttgattatatgatctgcaaaccaacaattgtgaagagaccctttaacatcagacttagtttctgtgttctcttctgacgaacaggtcagatctttctgaggtctttatcttatttggcagccattgccttcaccacaaatccattccaaaagagaatatctgttttcgttttctttcttttttctttttttttttttttaagatggagtcttgctctgtcacccagggtggagtgcagtggcacaatctcagctcactgcaacctccacctcctgagttcaagcgattctcctgcctcagcctcttgagtagatgggactacaggcacccgccaccatgactggctaatttttttttttttttttttgagacggagtctcgctgtgttgcccaggctggagtgcactggcatgatctcggctcactgtaagctccgcctcccgggttcacaccattttcctgcctcagcctcctgagtagctgggactacaggcgcccgccaccacgcccagctaattttttgtatttttagtttcaccatgttggccaaactgatctcgaattcctgacctcatgacgcctgcctcaggcctcccaaggtgctgagattacagacatgagccaccacaccctgcttgtttttgttttcttttacagcatttcagattgttttacccctagccaaaaattgaacagttgaatggtacaattacacttagtatttcaactttctcatttgataacgcaaacttaagatgagtttaatgtttgtcaagttccataaacagatgcttttatcttatagggaagacatcatcgcagttttttctatttatattaagtctggtaattatttaaatgctccaccagaaatgatctaggtaacaatttttgtttaaaaattttaacaatataattaagtccaaaagttaacccaaacaaatagaaataactaccatatttatatagcatgattaaagtttgcagaatttctcatgatgccaggtagccttcagttgtacagaatggcccagattgtctttctgtctaaattttagccatatttaaggcttcaactttttaactcagtttgtgagagtgggagagtaggagaagtggtaggaggtacttttgttgaaaaaccatattgaactttaatgtgctaacttccacagataaaagtggaaccagtcgctctggccccgagtccagttatccccagattaactctccgagtcggtgctggccaagacaagatgtaagtataaacgttttgaatcagggtgaaacaaatgaaatttaaccttctctactctttcctaagggacttagaattccacaagcttctcccaggtatgaacctgtagggtcaagctttatttttagaactcttcgttttcaagtttttattggtttctttcacagagtaaatgctttttgctttatttgacgtaaaggattttttttttcttgttctttttctcttttttaaagactagcacctgacattatttctgcatagtctttaaggtcccacttatctgaaaaataagaaactctgtactgaatggacttactgccacattacacccaggtggatgcaatgttacactttcccaagtacatagtatctgtcaccatgacaaagaacaaagattctctttttgctcagatggcacatggttttattctgtacctgtaaaacaaagaaatgccaaaggcttggagagacagtatgtaatagtcacaactgatgacttagtccacttttttttaaggaagccctagaaatgcaaaccccacgtttgctgtttatttgtcttaattttcatggaatcatcatatcaacccactcgtctttacagttaatctgttggatatttttcttttattcattttttggggaagcattaaggcctacagtactcttacctgatcctaataagataatgaaacattgatttttttttttggaactcatgttgaaaatcattccccttgttctaaaagcatattatgcatcatttaaataaaatacacaagataaaaattctacaaccttacttttcccattaagcctgaaaatgcagtttacattgcaatcaaatattgtgttgaaaataggcttacaaggcattccatttacattcaatttttagccataaaagtgagagtaggagccatgaatttatttagtagagaggacagaaaatttgctttgtattctcagtggttcatttcatcttaaaagttacatgtattgatactgttgcttctgtcagttccacgtgtagtgcaaagaaaaagtccagcatgattctgatgaatgtgagcagagaggcaacttggttttccaggggagtgtatacccctctgaagatttaaaggagaaaatctgatggcttctgtttttctcacctaaattctctggataatttccacattactcttttcggttgtgccagtagagacctaggaaatgcagcaaaaatcctgtggattcagtgcttttgaaaccagctatctggtatacctaatgcccctatcttacctacagaagcatgaagaatgtcctcatcccttaaccagtagagcttagagaagacccaaccaaagtaaatcttccatctccatgcaaattctgcatatgggctcatttctctaagaggaagatgttgttatccatcattcaacaagtacttttctcctgcagtttatatttattcccatgtctcagtaactcaccattacttaatcttgactcccacacagaagtttggcttgctcataccctttagaggaataagatttgttaaaaggcattgaaaagccaggtatggtaggccatgcctgtagtcccagttacttgggaggctgaggcaggaagatcacttgaggccaggagttcaaggctgcagtgagctatgatcgtgcccactgcactccagcctgggcaacagagccagatcctgtctctaaaaataaaaaataaaaggcagccagatgcggtggctcacgcctgtaatcccagcactttgggaggccgaggcaggtggatcacaaggtcaggagatcgagaccatcctgtctaacacggtgaaaccccttctctactaaaaatacaaaaaattagccaggtgtggtggcaggtgcctgtagtcccagctacttgggaggctgaggcaggagaatggcatgaacctgggaggcggagctttctgtgagctgagatcgcgccactgaactccagcctgggcaacagaacaagtctctgtctcaaaaaatgaaaaaaaaatgaaaaaaaaaaaaaaggcattgatagttatattcaactcacctgcctttaagcatctttcagtcattctgttgattatttattctgttttccccctcaataaatcactcatacacctgagatattgaaagatatgagaaatcctatttggaacagaatgtctagtatcacggaaattataacacccaggtattctagacaaattgcccttgaaagcatattatatatcatgtaaactttcagatatgtaggtaatgactgccatgttatatgaaggattaatcatttgaccaaaggcagatgcaagaaaatccttataatgaacaaagagataaatgaagtgaaatagattacattttaaattaaaatagagcgagaaagaaagaggactaaatctaatagtaatagaattttatgtaaaataaaacttattcagtaaagtgctttttgtggggtggggtggtggggtggggggtggttctaaatcaggggtcagcaaattatgggccaaatccaggccactgcctgttttctgtgacctgaaagttaagaatgtgttttatatttcttagtggctggaaaaaaattaaaagaagaatgtattatgacacatgaaaatatgtaacattcaaatttcagtgatcctccgtggttgtagcatgatacatggcttagtccatggtgataatggggagggaggtgacagattcctgtcactgtgcctgtggttacccagtttgcacacaccttgggggggaataatactcttttgaagtgaaattaatgagcagactgggattcaaaagggggagtttgaatagtccaggggggtatttattgctgaagaacaggcagaatcatcttttgaaattaggaaaaacgaaaaagctttacagggttcaaattataccttctagttggaagatctttaagacagtatttactttctgagtcttaaataaagcagttatgtcttctgcccttgatccagaaaagtactttgagcttggattgtttcctgtgttccctattattgttccttgaagcaagacaggaataacttgtttttcccttgatttaacattcctggaaactgtattctaaaggagtcaatggtgagtccaggacctcctcctgatagtgttaaaattcaagatgactttccaaggacctcagattcctttaacagatcttccagtaatgggtgtccagagttccctgtagtctatattgaagataaaaccaaaacctaaccctgaaattacagtctcaacacctagagacaacatatccaagtgaattgctgaaatatctggtccagcctagcagaagccttgccttgatgctgggatagcaagtaagtttcagcttgcctcagagccactgcctgcaactctgttgatgggatcctgaggtcccacttggacttggggctgggagcagggtgagtgtgacagccaccatggaggccagggcaggtggcaaagcaggcaccaggttatttgtcctccccatcttactgtgtattgagtttggtcattttgagcaaatgtaggtagaattggctaacttacagtgttcatccttttcctcatttctgtcaagaaaataggagcaaggtaatgtgatggattttagggacaggggctgtttggatggaactgtcaagaaagacttggcagaatagggcctgcaactcttctataaagctcaaattcaggtaaaggagctttgtgagaaaaaggtgaaacactggtaaagtattaacaaaaaatacaaatttgcataaagatttggggctgaatatagggtagaggaataagcattcttcccctcagatttctcaaacgtctcttttgctgctgtcttctcccaaggactgaagaggaagcctcctccctcttccatctattcacccacccttgccctcgggcagtgggtcccccatgcccaggtccatggtgagcagctcctcctcctcctgctttcagagcactcctgcctttatcagcaagcaccagagaaggggtgactggttgggcccctctagacatcccatcatgcatggtcatgttttctctaataaatatctcataatatattggatcaggtgatattggaaccatttgagatgcctttcagagaacaatattattatcaatggtaattctaaattccctttgagagttcacagtaggtattctgtttaacaaatataactcctttttcaaaatatacaaattatgtcaagatatttttcagaaaccactttacctctggcattagttttctttctgctgacattttgatttctggtggcaagtggattgatttcttacaattcagtaacttcatcatcagccctcgtcctaacaaaggtgctgagaatgtgatgctttcctttacatgtcatttacttttttttgttgcatttcacagagtttaacttaagccttgtgggggctttttaatacttgtaatgtctaaattttttctatatataatgaaaatgagagctaaagctttgcttgttaatctttaaaatcaatatgtatagacacttgtctttgagtgatctaaacttttccagttaatgctttttgacaatagtagtgaagaataatcatgggcagttacaaaaataatcatttaaaatatttttaaggaaaataagcattttatattttaaaatatagccagatttagccaaatgacattcaacagagtgaagcttgcagtggtattttagtgaaacattctttagagaaataatagtaaatgttttttatctcactttctgaattttcctttctatacttgaagtgctttttattcatatataacttttttcctagtctaaacaaatttaggggaaagtaaagagagtatatatagtacagtcggaaatagaaatagatcttcttccctaagatcaagggaagaaaaaagaagcaaatgattgtaggtcaaatatgatcataccttcctagcagtaagggcaaaaaaatacatttttaaaattaatttgtttttatttatttatcttttttttgagacagagcctccctcactctgttgcccaggccggagtgcagtggtgtgatctcagctcactgcaacctccacctcccgggttcaagtgattctccggcctaagcctcccaggtagctaggatttcaggcatgtgccaccatgcccggctaattttttgtagttttagtagagatggggtttcaccatgttgcccagactggtctcaaactcctaacctccggtgatccacctgccttggcttcccaaagtgctgggattacaggtgtgagcaatcttgcttgactgaaatacatttttttttaaaggaaggtgtttcactttctcaggagagagtttttcaaggcagtaaatttaaaaattaacttctatgtgggagcagatgacaaagatggtgtcctccacagcggtttttataggtgacccaaaggcattttttgttgacttttgcacactttccaagaggaaagcatgaaagaacagctcagtgctgacagctcttaagcacctcttcatctctagtggaaacactcctatttccttttctgaactgtgttaatcaagactcttggtggcaagtaacagaaatccaaatcaaaccgtcttagaggggaaaacagcaggggtggatgtgacttcggcggggccacctgcaggcttgccaagtatcctagggctctgcccaccctcctcttctcatctggcctctgcggtggcagaggtggtcctggccactcaggctgttgtgattcttggtgctcacagtccctggcgaagccccgcttcccgggcctccgttatcagcccccgtgaaggacttcgcttcagcagcccctgtggtagggaggctgccctgtcagaaggggaagtggtaggttccagaaggaaaggagggctcacaccagaataaggggcaagaggcaggcaaaggcgatttatatgttttattgtagttaggaaaaggctgtcagttttgcatttttataaaagtgtcctggggaggcagggcaaagaacctggttggtgtacaaaaggatactttagatgtaacgtttgggaacatttcagaacgtcatcctgtcagacttggaaggccttttgcttttctgtttttaatattttcttcctaacaaaactgtctgcttttgatttaaaaacaacaacaacaacacaaaaaaagattaaagaatgttggagttttatttttccctgattaacttgctacagaaactgaaacatttcataggtattttgcctacgttaaaagctaaacatcatgagctggacgtagtggcgtgcacctatactcccagctacttgggaggctgaggcaagaggattgattgagcctgggaactcaaggctacagtgagctgtcattgcactgctgcactccagcctgggggacagagtgagaccctgtctctaaaacaataaataaataaataaataaataaatttttaaaaagcaaaataacaacaatgacaaaaagaattttaagaatgactggtgaagttcacaagtgacatttaacatttttaaatgactgtatttaaaattttcaaatgacctatttttaatgctagggaaagatgctaacattaccagtgaaattcctaggctctgaacaactgcaacaaaggttgtgagtttgatacgtcattcttgctaccttcctgtacttacaaattcagcagtcccaaacccatagatcttcatcccttttctgatttttccagaaaaggagtttttgacttccttatattactgtcttatttttaccacctagaacaatgatatagtctctaaatttagtttttaccccggcacaatactgtttattcattaacaccaaagatgcaatatgtttactagaaaaaaatagtaaactgtcagaaaaactggctttaggttttcagaaatacttttactgcacagtaaaacaagtggagagattataatcaaagcatttccatcttacttgtaaacaattacagcagttcttacatagatgccgcattagaagactcaggaaaatttactggattccattctaatgcaattagagctaattttgttctttaaatgaataaaaggtcagctagtaaatctagcttatcttgagtccagacttcaataaattgttttatttaatttgttgtaaaagatcttatccttaatgggtccaggtcttattagttcccttaggttttaaaatatttatgaccacctctttagatatgatttgaatgatagttggaaactttctctccgcagtgttatcaaggtccacgatcactaattgagtgaatataggaaagtacttaagattcattatctagaaaaagctgatgtggacttccagaatttaaatgttccttaacctgtgacaggcagagataatttagctgtatcatggaaaccttttggatgctatctgattataatttctcctaaagatcaaactactcacacttctggcatttaaaaaaagaatatgtttcctacagatgaaaacacttaggcactctttattaccaagaacatggaacgtttcaatcctttgcattctgttatttcctgttatgttatgggcctatactgtgttcagatacttacataaagattgcagctgcatggtgcaacatctcttcgcttttcccacgcctgcctgcatagcttctagagtgaatatccacgtcactgcaggactgctgtcatttagaatatgcacagtcttttttaatgtggtagccacaagtctcagcatgtggaactgcctcgccatgttaccccagctgattagacttgccttttgggttccaaaccttcttacatcccccacggcttgtcgtccaggctctaggaaagagtatgtgtctatggtcagccctcctcagctgctggcctccattcctaccttgcctgccccggctggaacttcgttccctctcttagctcctctcctctgtgtcttcctcttcttttttctcatttttgtccagcctttcattctcccatgctaaccctcctcaccttcatcaagccttccctctgtatgagaaaaaggctatgtaacatctgcttttcatgctgcttctcaaaacttattctttagttttactttcttctaattgttcactcctaaaccttctgtattctggtttctgccctagaaacttttctacagcttcttgttaagaccattagatgcttcccaattcccagttccagagaacatgcagcagctcttattgtacaaacccggtctgccgtttggacactgtcccctaagccctttcagaaacttcctgttcctttgatttttgtggtactacgctagactcagtctctcattctctctctctttttttttttttttttttttgagacggaatctcactctgtggcccaggctgaagtgcagtggtgtgatcttggctcactgcagcctccgcctcctgggttcaagtgattctcctgccttggcctcccgagtagctgggactatgggcacccgcccccacacccagctaatttttgtatttttagtagagacagggtttcgccttgttggccaggctggcctcaaactcctgacctcatgtgatccacccacctcggcctcccagagtgctgggattacaggcatgagcccccatgcccagcctttcattctctcttaccatggattccttttgtttttcttttatggacttattttttttcccccttcttttctttttgcccttggtacagtaactctgtttcttcttcgtaaatgttctcattttctctttaggtttgttatgcaatgatgattcccatttctttattactagctcatatttctccttcaagagtcagactaatctgccaagttactggaaagttctgcctgggtgaaccagcagcacctcaaaaatagcatttccaaaactgaacccagcattatttccgccagtgtggttcttcttctttttcgtatatgttggtgatgagaccagtgcctccattttcaagccattttgggcattagggtaacttgaatggaggcaaaaactatctaatagaattgggagattttctttatgtcataatgtcagactgggtgtcctgaaaacaaagataaatgtcttcttagctccaaaagtttcccaagctgaacaaaaccaaggaaaggccttgtcctagaagtctcctttgatattcacttggactctcagcatcttgtaacttccgctcagcatcttcaagcttggctgtctcctccttgtctagacacaaatggtcaggtcagtagcagccaatgagagaaagaagtccatatccttattcacagggatccataactcaccccaagcaaagataccttcagctaagaaacaggggaaaaaaggatatgtagctaggattttaataaatgaagattacataagaagatctgagaagcaaaacacttaaaagtctgatcaggacataataggctttcaaagaacagattaactgcttcaaaatatgtaacctagaaagcagaagtttcccccacatctcacccttcccccaggttaatcactgctgactgtgccgtgtgtatttcagcaatttttataaaaacaaattaggggctggacatgatgactcacacctataatcctagcactttgggaggccaaggcaggcagatcacttgagcccaggagttcaagaccagcctgggcaacgtgacaagatcctgtctctacaaaaaatagaaaaattagccaggtatggtggcatgtgcctttagtcccacgtactcaggaggctgaggcttcacttgagcctgggaaatcgaggctacagtgagtcgtgatcatgccactgcacaccagcttgggcaataggagtgagaacctgtctcaaaaaaaaataaaaaaagaacttagaattatcttacacatactgttcagcagcttatcccctcccctctaacagatcatgaacatttttccatgtctgtatgacatggtatttcattttactgttgtatcatcatttatcttgccagtcaccagttttcaaacatttaagttgtcaaaggttttgctataacaaataaagaaacaacatcctcatatatagatttttgtttattcagtgttactaggtcaaagaatgtaaacatttaaaatgtttaagagattattatgccaaattatcttctaaaaggctataccaattaaaattctcaccagccgtacatgaggatgaaatgaccctatatttaagaagaattagtgaaatcctattgttctaaaattgagcaagactctgggcaactagtagtgaatttatatgaaaagctagatccattcttctccctcgtgggcctgtgagttcatttcatagaaatcctttcttctttgggggaagctattggttgaagaatagttaacatctttattcaggctattcccagatctcttctgaaatctgtaggtccttggtgctggctccgtctcaggtgagtttttcttcattaagtgcactactcatgtgaacataatactacagagaattgccttctctgtgatagtgtttgtgctttggagtacatgtatcaaattcatctgtgaaggaacctgggaaatattatgaatttagtcataatatttataagtaacttatgtttgtaagtaatgtttataagtaaccaatttttaaaaacagtttttaaggccaatatatttgatgttgttactgctattaaatcaaggttatcagggctgggtagggtagctcatgcctataatcccagcactgcgggaggatcgcttgaggctgggagtttgagaatagtctggacaacatagcaagatcgtgtctctacaaaatattaaaaagatatccggggctgggcacagtggctcacgcttataatcctaacactttgggaggccaaggcaaacagatgagttgaaatcaggagttcgagaccagcctggccaacatggtgaaaccctgtttctactaaaaatacagaaattacacctgttatcccagctactcaggaggttgaggcaggagaatcacttgaacccaggaggtagaggttgcagtgagccaagattgtgccactacatttcagacctgggcaacagagtgagaccctgtctcaaaaaaaaaaaaaaaaaaaaaaaaaaaaagaagccagatataatggtgtgcacctgtagtcccagccatttggaaagctaaggcaggaggaccacttgagcccaggagtttgaggctacagtgagctgtgatcaccactgcactccagcctggacaatagagtgagattctgtctctcagaaaaaaaaaaaaaaaaaaatcaagattatcaagtaggcattttctttgttttttattttatttatttatttttttatagtacccctctgttttggaaataagtatctattataaatccctgtgtaaaatggtacattgtttgtactttgcacttaaaagtttatttttatataaatatcacagtaaaaattttttctgtaaaaaaaatgtgtgtcctatttgttgcctgttttttagtcattttatagattctttcctggtgttttataaaatatgttttatcagacttagctttgccccaagtggtggcagggctggtctattgtgaattcaaagcatgtgatctaccaagatttcaacccagaggaaatgggcctggaagtcccagagcaagctctcagtgggccagctgagatcacgtgaccagcctgaaccaatcactgtgcctgtggagacacggtggctctgattggcctggcttatatgtgttgcttggatctagaggtaggataaagcccactcaggccacatggacagaaagaaggaagagagagagggctgaaggcaggggcaaggcaaatgggtgctgtgtagagacaggcaaacccagcagatgccctgagcctagacctctggtatgctgaatgctggaagccattgggtttacttatatatatttcacggtgctgagaaacatctgtttgcattatttatttgtgaatcattcctaatataaattgtgttgctgttttaaatttcctatgaaatacgtttttaagtatcacgatattgcgtagtcaaatgtaatattgtttttgcacatggttctgtatacatcatagattctaaattaaaacttttgatagaaattacaaaatttgtgttaccttactgtatgggcatatttaaaagctaacatcctagtttctggagattctgatctaccaatatttcccatgctgaatcataagcttcagcatttctttaacaatatctcggcgtttggtataaaaccctttgaccccagatgcagagaatgattgttagttaggtaaaaatgagatggtgactggtactggtccattggccaaagtttggagcataatgttcctggtatatgtatgtcaactctggctgtgatatcatatacttacctggttttatttttataactttgtacatgcatcttgaatataatatttttctaaagtttattataattagaagatctttaaaattccctttaaaattatattttttctaagagacccagttaaaattaactgtatctatttttaagagattgttttagtttctagtttagattaactagtagagcacttctggctaatgtttgatattagcctggttttgaatatatctctaatgtgtgttataacccaactgagaaatgctgcttgatctgtatatgaatacgtgagttctgctaaaacactgaggaaccttgagagtcgctaatgccattagggttatttgttctgaacggaatgaacagaatgagtaaatcacaattgtgagtggtaaatggccatgttctagttttttttctcatcaaaccatttaaagccaagtgagcaaggcagaatggctggctacctttttattgtttttgtcattttgtttatttagcttataatttaatacaaggaaatttgtatctgctttatatggaggctgccttcaaagtacgtggtcagggtaaattttgaatgaccgctacatcttttttctcgccttgctagcatgaactgtttttctgtatgcatgcatacatctgtaaatcagtacatgtgctctactgttattatatagttttaaagaaaatacattaaaagaagaaaaatggctcttaaataagaaatgcattttagattgtctggcatttggctgttctgcttatttgtgctccctttacatctaaattaaaacaattcagagattccccatcagttcaaaggtctctgtagggcctgtattgttgacatgggtgggagtggagtgaagaggaagaggagcacaggaggtgcgttagagagtcctgctctgagcccttatcccatagacctcctcacagaagacaccaggctgactcactgtcctgcctgcttgtcatgtccctgcagctgaggctggaaacttctcgagcccctctccgtagtcctagatgttaggggcagaacctggaggagacagagggctgggacccaaagcagctctcagatgccttcaacccttttaagaccttcaaggttaggagctgcagtgaccttctcttttcttttttttctcttttgtaatgatctttcatgtgaatctgaagtcagtgtaataatttcagtcgtctcgtcttgcctcagagaaaattttggaaactttcttatgtacatagatacatacatatatatgtatagatacacacacacacatatacatacatacacatccgtatgcatgtatatataataagtgtgtatgtgtgtgtgtggttttgcttcaaactcccttggacacctttttttaaaattaatcttcataaaaattatttaaattctaaagcaactcaaatgattattcattaaataatttattaatgtttttgtaactaatttatttctttgcagtatggaaaaacacattattttatttcatcttatattttacagttactattgcaccattgttttttttcccaaacaaattgttaaaatcctcttcattctcattttggaagatcatttgtttattaacagagatataatattaaacaggcaatctcagagcagaatgacagcacaaaggtcaggagtgtgatatagatttatacacatacacacatgcatacataaacatatatagtcacttcttagcccacacagatgaatatatgtatatgtatgtgtgtgtctatatcacatgctctaaataagtatatatacactatattttttccatcctatttacaaagtacaataagaattcatataaagcatggtgattttggtgaagacctagcagcttttttgaattttaatatattttgaagtggtaatgttggattttccaagcatgacttcagtaataactgaattttataactctccagtgagatacaaatcttaatcacaatcttgttcatttttcaagttcactgcatatcatcttattacctttaatgttttcaaataacttgggatgtcatttgatcctaaaaataaaaagtaaaggtgtatcttttatggctaacttacaaattcattttcatgtgaaagcatcttttactaaataattacccatcctcctctatagactgtaggctcagggactacagaaagtaaagtttcatccatgttgaatgttcaatttcatttggctttgctttttcatagtaaaagcaccctcttgtttgctgcagagcagcaaaagcctttctgaaatcacaaaatcttttagaagttctgactccagagaatttggttttgaaaggaaccctcaaagtaccccagacaacactctctgggtttacattttgaaaagttgatctgcatttaacacatactgattttgattacatacataatgtaaccatgtcaaaggtagtagacttgaaaatagtgaatttggatcagatgttaattctctcaggagcataagtaaatatcacagtagacggtaggaagtgttaaaggctggaagagatacatctaaaattataaagaagttcaaggtgattactcccaactaggaagggctaaagaggtttggggaaagtagaatttgagtagagccctttagagtgagtaaaatttagaaatggagaaatgtgaagaaaaaaataaaagcaaagatgtatggagtgaaataatgaatgcacattttcccctaagaaatttccgtagtattctgttgacctagtagttcatatgtgccctagttttatgattaatgatctgaaatcattctggattgaacgcatattaccaacttctaaaaaagtttttattaatattttcaaacataaaagagtaaaatgatacactttcatctgctggcaacttggatagatttaacagttatcaaaatgttgccatacttgattctttttgtctttttattcccaacgcatttccaaacaaattcaaaacttaatatcatttcacctctatattcttcagtatgcaactctaaaaatatggttattttctcatataatcacaacgttattatcatacataaaatatacagacattttccttgttaccatctaatacctggtccatattcagatatctttatttgtctcaaaaatatcttcaacagtttaaccaggatccaaaccagacttatatctcataaggacttgtaatctagacctgttatttttaatccacactcctacgctcctcctccttttttgcaggggaaggggatgagttcttactctgtcgcccaggctggaatgcagtggtacgatcataactcactgcagccttgaacttctgagctcaagccatcctcccacctcagcctcccaagtagctgcaactacaggcacatgccactacacccagctaatttttttattttttgtagagatggggtcttgctgtgttgcccaggatggtctcaaactcctgggctcaagcaatccttctgcctcagcctcccgaattgctgagattataggcgtgagccaccatgcccagccgcttcctttttgccatgcaattgatttgtttaagaaaccagatcttttgttcagcagaatatctcactttctggatttgtctgtttacttcttcgtagtgtcatttaaattattgttctatccctgtaactggcatttagtcctaagtgcttgattagatttaagttcattctttttttcttaaagggtattttgctgctatatacttcttattacttcagatcagtaggcatggaatgtctgattgtcacattcttagtgatactgaatgatttcattgggaaattattttttaatctagtcattcctttcacatgtattagctgaaattcatccctaaaggtgaacctcagcgaccctgaaatacacctcatacaggagaggcaggataaatatacaatcttttttttttttttttttttttttacttgccagtcttcagtgaaaagagttgatggagttgatatagttatctccagtgatgagcatagggttttggaaaggggaagggttctgtctctctctgtctctttttctcccccatccctccccctctctctttctctgctccccctaccccttcttctctctcccacttcccctcttcctttgtcccccttcttctttctctttctcttttgttttcatgttcatattgtaccatcttgaccaacgtgaattccttcatgttgcctactgggtttcgacacaacctcatttgtgttggatagctttcttactttctggtaaaaaaaaattccaggtttatcttgcatatttcctgtatattcttgtgtatttccacagatctggaattagcaatttctccaaggaacattggttccttctgatgatgaatggtgtttaggaatcataatctgtcactagagatgcccattgctactgggatgtcattattctaggcctttacaagggacagaaataggaaatagatgggtttgaaaagaaaagaaaaaaaactatgagtttatactgtttccagttcagatttaatattactgttacgtatttatttattgttatttaaaaaatagagatgaggtctcactgtgttgcccaggctggtctcaaactcctgggctcaagcgattctcccacctcagcctcccaaagtgctgggattacagactgaaccactgcgcccagccacatattttctttcacattagaaatcctgagtcttggccaggcacagtggcccacgcctgtgatcccagcactttgggaggctgaggcaggcagatcacaaggtcaggagatcgagaccatcctggccaacatggtgaaaccctgtctctactaaaaataccaaaaaaaaaaaaaaaaatagctgggtgtggtggcgcatgcctgtaatcccagctactcgggaggctgaggcatgagaatcacttgaacccaggaggtggaggttgcagtgagccgagatcacaccactgcactccaggcgacagagcaagactccgtctcaaaaaaagaaaaaaaaaaaaaaaaaagaaaaaagaaatcctgagtcttaagagcattattataattatttgagttattcaacaagaattatataaaatagcctaaaagtaatagtaccactatcactactaccaccaagattattaaatgaagttaaagactaaggtttttttcagcatttgctcttaaaatacatttcactatggatatgcttacaaaatgctgtcctagagtcacttgtaattatttttgtttctacatggttatgtcatcagcttgatatacattgaggttcattcatttcatctagttttgattcataaggaatttttctaaaacttaactttctgaatatgtggaccatttacctaactccaaagtggaagctgtataacaaaatacattcagagaagtcttgctttcatgcctttttccctatgacctttatactccttattctataggttgccattttggtttcctttttattattatctttctagtgtatctcattgcaaatatgaggaaatgtggattatatatttcttacctgaatattaatgcccttttagagattttatgattcggaacatttgacaatagaagtgtaatcatttaagcatctcccttggaaatggagattctataatggctatattttcccctaattacttcatgcaatttgtttcatttttcaaataggtcatgcctgcattaaaagataaaatgtttgctacttgatatgtacttgagttatgacaagataaaataaccattttatgagatgatgtaaatattaaagaggcaggccacgagcttcaggaattaaatccatttatagttgtgttataattatatgaatgttaaaatttgagctgtgaggatcaagaagaataaggaataacgattgacttgaagaatcaacataaaaccgattctcataattgtctttgggtatttggtgttttttgatccaatctgaaatatggaaatgactgtgttacagtttggcgtcttaaggactggtactctaaatataatttcttccaacttctgaatatttatttacatacctaagttagaaaaatcgaacacctggtgtgttagttttctatttccacataataattgaccctgaaacttagtgatttgaagcaataaacatcagttgcttcctagtttcttgtggttggggatttgggtggttctggctcaggtctgtctgcaagctggtgactgggaccataggcatccagaggcttctgtgagggtagagaagccgcttcaagctcacgcacagctgtcggcaggaggctccggggacctcttcataaggcagcttcagcatcctccccacagtgtagctggctgtccccatagaagccacagcctgttttatgacctatccttggaggtgacgtggttattttcaccatgtgctgccagccatccagctcagcctgtccagtccgtgagggaactgtgccagtgtgtgaatgccaggaggccaaccaccacacttgggcttagtatttctggggcttttcataaaaatcagaaagcaaaaatatggagattatgtgtatgtgtgtatcactgatccagatatgaggttttatagtaatatgattgtgacatttcaatgtcttttttttttgtatttgttgtgaggggggttttttttgtgttatctgtattcttacgttgaggcagggtctcactctgggattttttttgagacagggtctcagccagactggagtacaatagtgcagtctcagctcactgcaacctccacctcctgggctcaagctatcctcccttctcagtctcctaagtagctgggactacaggcacgcaccaccacactctattttttttttttttttgtatttttgtatttttgtagagacgaggtttccctatgttgcccaggctggtgtcaaactcctgagctcacacagtctgcctgcctcagcctcccaaagtgctgggattataagcatgagccactgggcccagccgaggagagggttagtttaaaatacaacatgggaatctgtttctcaaggtggttggtatttctgagattgatcaaaaactgaaatctgaagaagaaaagtaagttttggtgtaaacaatatgttttttcatcgacctgattttcctcccaaatgttgaacttcctgttcaaaagtttctataaaattcatggaagtggttgcgatagtttttacctgtggcatcattttgttaccatttaataatggccgttcacttttagaagtaaataagtaagccattgtaagggaacttaggaactttgtgtgcagtttagtagccagctattcagactttgataatttggattactggtttcatcgtgtttgcacacaatagctgaataatgaggatcattaaacttcttgtgcagacatatccaacttgtgtttgctgctaaccctggaggctctgtgcagctggggaggtgaggacgggctctttattgacttgacaagctgtgagtttgcattacaggccaagcagctcatgacccattctatttatgtcactggtttgtggtggggaaacaggtaaagaaatcctgctgaaaatccctccttctgcacgtttttatgaataacgccagtgtttatagcagtgagggcactgtgatcaaatcctccaaaagctgtaatgctggcagcatggagccattgtgggaccagctgtgggcggtattggtttctctgtgagacattgcttattcaacagaaagctctggacgagaacttactatgcaattaaacaggagagaaaaagggatacttcagagagaaaaatatagagaagcaaagcaccgtctagaagtatgaaacaaataatggttggcaataaaggccagcaggaattcaaaattatttttacaacgatcaatttagattaagtgatgatagtttatctcacaagtgatgaaaaattatatcatgttatactgttaaatgtttttctgttttgtttaaaattaaaaggattgtttttaaaactgttttcggtcatcacaaaaataaccttagcttaagtcaaactttcaaactccagtgaattttctcttgaatttcaaaagagttgggaaaaatgggttactttagtgcctctacaccagtctaaccccttgaaaacaaaaagttaggataaaagtttgtcttgtcaacactgagtagccactttaatgttttttcttttactactcagaaaatctgagtgagaactatatatatatatatatatatatgtatatatatatatatatataaatttaaaaggggtaatgtaattgaactgggaatgttaggcatttttgaaggattatcttattattacaaagttatttttagcaaaatgtcatttctctaaattgaaaaaaatgagaacatatgcacaagcagacatttctgagattttaactattaacccataaaattggtcaacaatctgtttctatctgttggccacactgctaattttaagccattctaatgggcgccattatcaggccttataggtaagggagaaatgtaggaaacatagggagaggtggggcatggtggttcacacctgtaatcccagcactttgggaggccaaatcacctgaagtcaggagttcgagaccagcctggccaacatggtgaaaccccgtctctactaaaaatacagaaatcagccgggtgtggtgatgcatgccctcaatcccagctactcaggaggctgaggcaggagaattgcttgaacccaggaggtggaggttgcagtgagccgggatcgcgccactgcactccagcctgggcaacagagtgagactccatctcaaaaaaaaaaagaaaaaaaaagaaagaaatgtagggagaaaattaaagggcactggaaaagagtcaggtaaggcaaataatattcattatgtgtttggtatagctgaaaacaatgtaaaaccatttccggaaaacagaacaaagccttcaggatctgattgtacctggtgttgggaatgactaggtggctgaggaagtggaatctgtgttggcaaacagaaatctcagtggtcctgtgactcattaagcagatggaaggaaggtaggcagggaggaaagaacagaggaaatggtcttgtattttaaaatattttaaacaggcaaaaataattcttttacagaagtgttctcactgcagtagtaggtattctatttaaagctgattaatatttcttgagctgctgtgtttaatactgcaagtaatccaaagacaagatacaaatcttactcttaggaaattgactgtctaatgtggatgagagagacagatctgcacacaactgggacacaaagcaactatgggcaatgtatttctttgaaaaggcaagacccaaaactacgtaccaaccttaatgtctaaaggctgttaaaaaaaaaaaagaaagaaagaaagaaagaagttttttttttttttttgagatggagtctcgctttgtttcccaggctggagtgcaaaggtgtgatcttggctcactgcaacctccgcctcccaggttcaagcagttctcccgccccagcatctcaagtagctgggattataagtggataccaccatgcccggctaatttttgtatttttaggagaactggggtttcaccatgttggccaggctggtctcaaactcctgacctcaggcagtcctcctgccttggcctgccaaagtgctgggattacaggcgtgagccaccgtgcccagcccaaatgtattactttatgtacgaaaataccatcattgtaggaggttttctcttccccctcctttgaccctgtccttgttggtctgctatggatgatgcactcaacttagacgcactcgattgtgcagctccttgatctcactcagagctttgaatttcacaaaatcatagtaggactagactatggtcaacatttgcctggaaggctttttaaccaagctatcattttttccccagtaaattaataaagtgtaacatacacacagaaaagtgaattaattttaagtgtataactcaagccatccttaaaaattcctagcaacagtttagacgtatacattgtaacaggcattttcatctttttcgttgttttgctttgttttttgttttttgagacggggtctcactttgttgcccaggctagagtgcagtggcactatctcagctcactcctgggttcaagcgattctctagcctcagcctcctgagtagctaggattacaggcatgcaccaccacgcccagctaatttttgtatttttagtagagacagggtttcactatgttggccaggctggtctcgaactcccaacctcaggtgatccgcctgtgttggcctcccaaagtgctgggattacaagtgtgagccactgcacccggcctttttcttttttttatgcaagttatgtttgttaattatggataaatcaaaaggagaaaaaaggcatccacccagcacagtggcttaatgcctgcaatctcagcactttgggaggccgagatgggaggatcacttgagtccaggagttccagaccagcctgggcaacatagcaaaaccccgtctctacacacaaaaaaatacgtatacaaaaaattagccaggcatggtggcacgcacctgtagtcccagctactctggaggctgaggtgggaggatcaaataagcctgggaggcagaggttgcagtgagccaagattgcaccagcacactttagcctgggcagcagagtgagaccctgcctcaaataataaataaatagataaaacatctataattttcatgtaaaggcaattgctggacattttagtatatattctttcaaacttttttctaagtatacactcataccttcttgtttgctttttttattttcttagaaaaattccatcttacacctccctttttcttggatagacatatcatttgtgtgtgtgcacacatgtgtatcaccacttcagataacaacatggtgtttgttcatcatctatgtaaccgatctcctattctagggtattttaaattgcagttattctagtttttatttttttattttattttttgcagccatagacagtgctacaaatcatattctttaccccagacctttacacagctgtctaatgttgcctcaggatacatttctagaagtggaattgctggtaaagagcttgcacgtttttaagttttccataatcattccaaatactggaccaaccatctctccctttcccctagcctgacagtaccaggtgttgtcaatctttttcatctttaccaaagaagccttagattgtcatgtttatatctttgattactatgaaaatggaacatttttttcttgtctagtggctggttttggtttttttattctattttctacttgctgtttcctttgctcatgtttgaataagaacattaattcttttttattcacaacagctgtttatataagaaggcgtaatgctttattgttgcaagtagtttgcttcactttgtcttttgccttttaactttgctgaggttattttatgccatataaaattgtcgtgcagtcaaatcagcatttccctttatggtttcagcttttggtgagatactagaaattgtgtcctaccccaagactaaaaacatctatatttacttacttttctgggaatttttatggttttgttttcttttacctaatttttaagacgtttagaatttatggtttgtgatacagctccaattttgagggatttttttaattaactataccatccaacaagtcataattgagctaattctcaattgcacatgcgtaattattgcatagtaaagcacatgaacatctgaaaattattgtagacaatagcttcagtctctacctccaacaaacattttccactataacagccggcaaacagtaaagttaaaacgaagtgacaaccaaattctttgcaagcagttttctaaggccccatccgtcgatcctgtgaatggctattgtaagatagaagatgtttcccttgaataacctcctcttgttgataacttacattttcaggcttatttttgcctgcagtcatatttattgatcacaactctcttcttcctatcatcctctgttctctctctttcctgcccctgaaattaactccattaaccaacaactgaaaacgcctgggttgtcctcacacttcctgacctaaaattgtaattctttcacttgctctgtttcttctcttttctttttttctgttttcattgatatcccgtatttctctcacctgtgctttatcccgtcgcacatcgtaaagcatattattatgctttttggcgggagctataattttgaatggatagaaaaatacactaaaagtatcatgtcatctggaaaattactactttctggatcagcttttgtttcttagtttgaattctaacacattttattttaataaccatcatgttaaaagctgaggacatagaaattagaaaggctttttgttcctttgaggaactactgatagagcaggggtaacaaatctgtgtacaaactattcaaattgttttttagccttaagaaattgggtcagtttctttcattgttcagtatattttagaaaagaatgaatattccgcactgattgaagacagattttttttaaatgtccatagagtcaatttcattattcttattcaaacctatatctttgctggttttttgactgcttattctgtcagttatgcagggagataaatatgcttacatctgtggctatgattgcagattcatctgtttcttactgttctgtcagtttttgctttatatgttttgcagatgttattaggtacatacaaattttaaactgttatagcttcctggcaaattggaaccttttatcatcaggaagtagcctttattatcactgatggttcttgccttaaagtcttttttgtgtggtattacttttctttgtatttgtatacatctttttatagcctctcactttcagcccttctattgctagatgttcctctgggcattagaatatattgggtttcactgtttatacagcctgacaactgaatcacttagaccttttatgtgatataatcattgatattttgagtttgaaatctaccttattattttgtgctacttctttagtgttcagtggttttttttctctctctctcttttcttttatcagaccaaggttttttttttatcgttccttttttcctcatattatacgttgtttgtaatttttgtgtggttaccctagaaattaccatactttattcactacctttacactacagtttatataatagagggacattaaaatactttagctctgtttacccattactggcttacatatcattatgttgtgtaatgaattatgtaaacacttggaagatctttataagtcagtgaaccagtattttccaaatgaccaatgtatgacattataaaattatgcatgggtaaattttgtgttcatagtgctaaacagagcaataaattttaatgtaacagaatatgaatgtctgttgatatgatttcagattacacattgcaaccaacttataagaaactatcatttgttgcatttaatgcagcattaaagaagaacttacaccattatccaaaaaatcttttaaaatactcctcccttctctagttacatatgcctacattaaagagatttgcaaaaatttaaaacattgccagtcttggccaggcacagtggcatgcgcctgtaatcccagctattaggtaggctgaggcaggaggattgcttgagcccaggagttcaagaccaccctgggcaacagagcaagacgccattatcaaagaaaaaacaaccaaaacattgccagtcattaccaagttttttgtcttggaaaatatagttattttcataaaaaaaaatgttatctgttaacatataatgggttcattgtcgttacttttaaatgaattactaaatatttttaaacttttcagttttatttttattttattttatttattttttttgagaccgattcttgctctgtcacccaggctggagtgcagtggcatgatcacggcccactgcaacctctgcctcccaggtttgagtgattctcctgcctcctcctctggagtagctgggattacaggtctgcgccatcacacccagctaatttttgtatttttaatagaaatggggtttcaccatgttggccatggtgaatcactcctggcctcaagcgatccacccacctcggcctcccaaagtgctgggattacgggcatgagccaatgtgcctggtccagttttatttttaatatggtaaatattgacagatatagtgcacattttttaagttcttaataatttttaggaatttaaaggggccctaggacgaaaaatttgagaattgttgctttagaatttttttttttaaatgtgctggtggcaaattcttagcttttgcctgcctgtaaatgtttttgtttcatctttattccttaaagatgttttcaaagacataatttatttttctttagcacattgaagatgttattccactatcttctagatttcatcattgctaattaagaagtcagctgtcacctgtttcttctttgagaggaattgttcttttttccctctagctgcctttcagatttttcctctctatctatgatattttatagcttcactttgatgtgcctagatatagatttatttttatttatcttgcctagggtgtgttgggcttcataaatctgtggattggtatctttcgtcagttctgtaaaagtctcaggtactctttgttaacattcgtctctgccccatttttcttctagaattatgatcaaacatgcactaattagaccttttattgtattctctttgcttcttaggctatgctctgaaaatttattttgtcctaatactcagtttatagttctgtcttgtttccaatctgttgttaaatccctcctttcaattttaaatctcagttactgtattttttaatttctagaaggtctgtttggttcttttcaaatccactagatcaagtcactctctgtgacttcctacgacctatatttctagcctttgccttttattatttttttaacattgtaagcaaagttgttttatagttgataattcttgtatctgtggtctttgtctcttcatactagctgttatttcttaacagttttccctgatcccaccttacttcctcatagatttgattatctttgattatgtgctgcttattttttttaaagataattatctgtattaatatgagacctagattttaagatacttcccctcaggattgtgctgtgtgcctgggcacattgcaagtccaaattactttaaagtatcctagaacaccagaggtgaaaattcatgccattctcgtgcatctttaccttatgggtatagcccattgggaatccttagtgtcgggagggagttctattacaccttccacttcgggcagatcctgggctttgacattcgtcctcttcatcataaccaaatatcagacttgcctaatgcgtaaatgcccttggggtaaagcatctgtgttctgcttacctctcagggttcctgcttttccctttagctttggttccatcacttgtgtgttcaaccagtatgggaaactgcctctagaagcagtgttttaaaattttagtctaaccataaaaatagagaatgcttaccctctggatataaatgccatagcgataactttgaactcctacattacatgccttttatgtaaggcaaacctcagtacacattgagagacagtgtcatatacttattaagatcacaggctctaaaatcagactgccttgtttaaatcctggccctgccatgtagtagtaacctgtgttaatttatgcaagatacgtaatctctctgtgccttggtttcttcgtttaaaaagcagaataatagcttgcctcatgtggtcattatgaaaaacaaacaaggccgggcaccgtggcttacgcctgtaatctcagcactttgggaggctgaggtgggcagatgacctgaagtcgggagtttgagaccagcctgcccaacatggagaaaccccgtctctactgaaaaaaaaaatacacacacacacacacacacacacacacacacacacacacacacaaattagctgggcgtggtggtgcatgcctgtaatcccagctacttgggaggctaaggcgggagaatcacttgaacccaggaggcggaggttgcagtgagtcaagactgcgccattacactccagcctaggcaacaagagtgaaactccatctcaaaaaaaaaaaacctagataaggcaaggcaagtaaatatttaacacagtggtgcctggcccacaattggctttcaagtgcttaggacagtcagacatatagaaagtgctcaataaatattcatcggttatgatgttaagcatttatgaagtgtctgctgcaccaacaagcctgtgctaaagtctcttgatctttggctgtatccaagttaggaagatgatcacccttgcaggaaacaaatagagaacaattcgacagcagtaatgaagttacttgctgaaataatggtgaagtttttgaagtaacttaatgttttatgaatttatgatcagaatagcaaagagtcagtgccttttggtgaaagtggtttctaaactaggactatgaggaagtggaaccgtgaaggctggcagcaatgaggccagaggctgtcgtgagcaacagccgtgaacatggcacggggccggcagttcccatctggatgcagtttttgaagtgtttctccacattgaggttctcactacaaccctctgaggccactgcatttcttttcactttgttgctgagaaaaacaaggcctaaagaattgtgtggaatagtagaaagagacaagctgggacagtccacaggctggcaattcctggtgaggtgaggatggccatattccatggcccagaaacttcatttctagggatggggcttggagaagtccttgaacagttctatttatgagtcagtgtgtaagtttacaagtgaatgtctcctactttcagtaggatgatggacaaaaacctttggcttactaataccatggaatacaatatagtaattagaataaataatatagatctctatgtgtcagcatggataaatcaggagacataaaactaagtgggaaaagctagttgcagaggacaactggagtgtgacattgtgtgtataaaagttaaaagacagcaaacagtaatgcagtatgtattgtttatggacacctacaaaggcaggaaaggtacagagaaaaaaacaaagtaccaagaacaataaacaaaaacatacctgtcttagggcagtggttgctctggggcagggaaggaagttcatctgaaacaaatatggcaaaggctaacatattttatctctgattattacctaactgtctgttatattgttttctctgtgtgtgaaattatatatatatatatatatatatatatatatatatatatatatatataccttttttttttaataaagaagcttaaaaacaagctttggaatcaagtagactttggttcaaaagctgccacccgtttactcaaattcctttctcttgctgatcttcagtttcctcatctacaaaatggggtaatcattacttctttgatgttctcataaggactggatgagatgatgtttgtaaagtgcctagtataacctctaacttcttataggtcctcaataaatagtgctttttataataaattgagtaatccaaggccacaggtctagtctctggcggctgtagaatttgaactcagatgtcctggccccaagtccagagctgcttccactggcgagagttgtgtgaagaggatgctgttagtggaggagcagggtcacagtaccacagctctagcgacctgcggcagcatcaccaggacagaagctgccgctgcattacctcctccttacctctgcagcccgtctgggaacaatcttttttttttttttttttttttgagacgaagtctcactctgtagcccaagctagagtgcagtggcgagatctcggctcactgtaacctctgcctcctgggttcaagcgattctcctgcctcagcctcctgagtagctggaattacaggtgcacgccactgcacccggctaattttttgtattttttagtagagacggtgtttcaccatgttggccaggctggtcttgaactctcgacctcaggtaatccacccacctcggcctcccagagtgctaggattacaggggtgagccaccttgcccagcctgaacggtcaatctttaaaacctggcaatcaaagccaaacccagaagtgagaaagtcttcacagttttattgacaatggcattgagagtattaagaagaaacattggaattaagaagagagaaatagaaactttttctttttaagctgctctgtccagcagcttaggccaggttaggtttatggtaattaacaacccaaaaatctcaagggcttccaacagcaaatgtgtctttcttgcccatctccagtgtggagcacaggctgctccaggtcctctccagctggagccacagtggaaggagcagcccctgtcaggcccccccgaggactcagcagaggtgggggtggggagcgccacctctgaagccgtcagagcttctgccccagcacaggaacaggcaattgaagtcatatttctgtgaacaatgcatgtgtattggttgctagaaatttctaactgtctggccattgaggggaagtttggaaaatgaaaaattcgtctgagtaagtggagaggccacttcatgcagggcctggaactcagttcttgagctgcctctagacgttgaagtatttcgctactggaagaaaagctattttacgatcatgtttttaagcacgggtttggttcgatgatgatcctgttttgacttttaccttctcttcttttgttgacagtgtcatcagcaaggtggtccctgcccccgaggccaagccggcgccctcgcagaacaggccgaagaccccaccgccggcccccgcgcccgcccccggccccatgctcgtcagccctgcgcccgtgccgctgccgctgctcgcccaggccgccgcgggccctgccctgctgccctccccgggtcccgccgcctccggggccagtgccaaagcccccgtgcgcagcgtggtgactgagacggtcagcacctacgtggtgcgtacctgccgcccgcgcggttagcatggagacgttttcagatcgagacaagtgtgtgctctgaatcactatcgaatttcagacgcatttctcttcaaaattttattatttacttaattatttttgagacagggtctccctgtgtggctcaggctggagtacagtggcccaatcatagctcactgcaacctcaaactcctgggcccaagcgatcctcctgcattagcttctcaaagtggtggggttacaggcctgagccactgcccctggccagacacgtttctttttttttcttttttttttttgagacagagtttcgctcttattgcccaacctggaatgcggtggtgagatctcagctcactgcaacctccacctcccaggttcaagcgattctcctgcctcagcctcctgagtagctgggattacaggcacgtgccaccacacctggccaattttttgtatttttagtagaaacggtttcaccgtgttagccaggctggtctcaaactcctgacctaaggtgatccacccgcctcggcctcccaaagtgtgggattacaggcatgagccaccgtgcccggctttttttttttgaaaggggatttcactctgtcaccgaggctggagtgcagtggtacgatctcggctcactgcagcccctgcctcccaggctcaagcgatcctcccacctcttgagtagctgggatcacaggcagtcaccaccactctcgattagttttttgtatttttggtggagacagggtttcactatgttgcccaggctggtcttgagctcctgagctccagcaatccacccatttctgcctcccaacgtgctgagatgacaggcatgaacaaccatgcccagccaagatgcatttcttcattgcagtttttcactgcattttcaagcttttggctgaaaagttacatcacaatgttcacatagtcagcctccataaatcatatcaaagcttgtttttatattgttttgggatatgactatatgcatatatacagtaatatcaatctgtaaatgtagagacgcatggtggtactgaaatctcacattgaatttcttgatcaagcaattcagttattcacttaagagtataatttatagaatgtacactgatattatgagccaggtagtgtttctgaataatagcactaattatattttattggctatgatccagaatatgccagggcttgcatattaaatggaaatgaactttgagaccacagaactcctgagtatccaagcatgatttcaaattgtaaaaccagctggacgcagtggcttacgcctgtaatcccagcactttgggaggctgaggcagatggatcacttgaggtcaggagttcgagaccagcctggccaacatggtgaaaccccatctctactaaaaatacaaacaaaattagctgggcatggtggcacgtgcctgtaatcccagctactcgggaggctcaggcacaagaattgcttgaacgggaggcagagcttgcagtgagccaagatcgtaccactgctctctagcctgagggacaagagcgaaactccatctcaagaaaaaaaaaaattgtaaatcccaccatgtccactgagtccacattgttctgggactgttttttagtttcttactccctgaatacactctggcagtaaagtgtttatacagattacgttctttggatactatagaattaaacacacaaacacacaacgaaatatttaaggtgtgtggagccattgccattgctgtgactaccaactctgcagactgtgatgtgttagcctactggtggccctgaccttgtaactagctaggtactaatatgattggaaagtggctgggtaggactcatggtatttgttgttataaactgtacaatattacatttcttttttttatgttttctttttttcttttgaggtagtctcactcttcttgtccatactggaatgcagtggcacaataccactcactgcagcctcgacctcctgggccccagtgatcccctcacctcagcctcccgagtagctgggaccacaggcgtctgccaccacaactggctgtttcttggctgtttttgtttgtttgtttttggtttttgtggagatgatgtctctctgtgttgcccaggctggtctcaaactcctgggctcaagcagtccttccaccttggcctcccaaagtgctgggattacaggcatgagcaaccacgcctggcctattattaaatttccttaaaggagttttggaaggaacttctaaaagtgtgatcatcaaattggtccattcggggaccaatcattgtaggtgtttaattagaggcaacatcacccccaaatgggttgatcaggaaagattttgtacttaacctccttgaccttcgtgtcttcatctgtaattaaggagtttgtgttaaacttggtaatctctgtggcatgttctagctctaaaagttctggttttccagtagatctttgagctaactcacttcctggagatgagtccaactggaatagacaatgtagatggaaagcttactggctgtgcatggtgtctcacgcctataatcccagcactttgggaggccaaggcagctgtatcacatgagcccaggagttgagactagtctgggcaacatagtgagaccccatctctgcagaaaatacaaaaattggctgggcagggtgacatgtgcctgtagtctcaactactcaggaggctgagctgggaagatcacctgagcctaccgaggtcaaggctacagtgagccatgatcacaccactgcactccagcctgggtgacagagtgaaaccctgtctttaaaataaaaatgaaaatttaaaaaaagctttctacctcatgaagagagacgctttgtggttagaggacaaaatttatgatttagatgacatacaaaggctagagagcaaaaaggcaaattttgtcactgcctaatggtgtgatgttggaaatgccacttaaattcccttagctccggtttccccattcataagctacccagaggttgttttacagggattaaatgaaatgagatgtttagaagaatttagtaagctatgaggtatttggtattagttgctgtggatgccgtggtgaagttcttgtgcggcacacagagtcacggccttctgacttcaagcaaggtcagccagcagcaggactggccacacgtgggagcttcagggcataggatgttccaccagccttggcctctagacagcaggtacgggtgactgctggttctcaccccttgttactttttctcctggaattacggagggtcagagatgtagttgcccacagatttctttaggaagttttcctgtcaatgtagtttgcctttgtagagttgccttaaaggaagcccatcactacagtgaaacatatatggacccccaatgcacctgtcacacacaaagaaagcctttctaaaagcatgtctagtcagtgtggtatttgaaagtctgggaagaactatcccttacaaaataaaccggatgcaataatgtgctctgttattgtaaacactttggaagttacctttttcttattgctggtgttgaatgcccatcagtgaattaattcttccaggttggctctgttcatgtgaagtttgaggaagtggtgaataggatgttccctctttagaactgctaagttaaataaagtcaactctagagtacacaatatttgtagcaaaataatgttgaaccttgtagctctgtggcctccctatccccttatttcatttgccctttagttgattgtactttactaaaaatgtcataaagggaatggaaagttacttagtaacaactcttttatatccttgatcttatcagctccttcaggagaagggcttggctaataagtaataaggtggtgcatgcacatttggctgtctatattaattccatgcctatgaatgcgattgagaaaaccacatataaagtggagctctataactttcaaaaaatcagttgttaccacccttataaagacccaaatcattaagaatttacatagttatagtttttttttttatgaaaggggttacaggtcatattgttcacagagatgattataaaatgctttttatgacttacaaaagaaagcttagaatattcgttagaaatgccttatcattgaacacttagcgtttttctgtttcttgattctaaaacagtgatgacgctgatcatggcattaatgaagtgctgatctactatattttttagtttaatatgcctgtttattcggttaacagtataaagtaatcattctgatctggcctctttttgttttttttcccattccctccatttttgccgcttccgctttgcaaacatcagatccgagatgagtggggcaatcagatctggatctgccctgggtgtaacaagcctgacgatgggagtcccatgattgggtgtgacgactgcgatgactggtaccactggtgagtgcccagggcgccctgccggccacactcattaggcagcatcagccgctcctgagatgaagcatccactgagtagattcctgcctttggactgacccagggctgtcctagggacagtacatggagtcaaatcactgagcctgtgaagtgcaattaactgcaaaacccaagagtgcttagactattgttattcaccctaaattctgaatattctgcttagcttatctatccttcttattaaaaataataatactaaaaggagatccaggggcttccctggccttcctttccagtaatgttctgtaggagctgtagcactggccaggaccacgaagaggcagcgcctttgtaaaggtggtacaaactgcaggactaaagactgcttatctgttttttagacctcttcagcggttcctaaaaactgaaaagctcaaccagaatttatgcagataatctcgtgttatctttaaaatgtcagatacaaaaaagatagcaacctgttcagttatgatagacgatatctgtgagataaagacaaagccgtggctcggaagacttctattcctggctgagaggatgaatgaacggatgagtctctgcagggggcctgtaaagggagcatctgtgatctcatagtccgcatgcccaacaatagtgctacacacaagttagtgctgcttgactttgatttcgggtaaacatgtcatagactctaaaaaattactttaaaacatggaagggagaagaatagatgtctgtataaaagttgcttatctgagcttgttttcacgtgcaggccctgtgttggaatcatgactgcacccccagaagagatgcagtggttctgccccaagtgtgcgaacaagaagaaggacaaaaagcacaagaagaggaagcatcgagcccactgacgactcccgaggggctggaccaagcggggtcagcccgggcttcttccctggcgcctctggaagggagctggtgcaagtctgccgtcacatccacccccagatgcctgtggataaagaacccaggaggactgaggctggaacacaccgcgcacctggattgttcactcccgagccgccttggcctgtggctccgtggcagtgcgacagaaggaaactcaagcagaggcgtggcctgggggctgcccctcctccacttctctaataccagtgacaagtattattaataaagagcgtacatcttcccttttgatttcctttattctctccagggccttttcattgaggtattagatgagaagataatgtacaaactgcctcaactgtaatttaaggatgatagagtctgtatacagttttcagcccctttccctctatagtaagataatcagaataacataaaagaaaactccagttggagtaccggtaaatatttttgtgataagaatatatgaagcttccctccttcccccgtttttagtactaacatgtaaaatgttcaggcttttgtgaaataccttatattttttaagaaaaaggtttctatcatgtcctgtttgcttttgtgcaaattatttttgtttaatgtattttatatcttcgttgcattctaattttgcccttctttaaactgctggagtctcttctcactgcttgtacatttcatcaacttgtataaaaactcttcagactaaaagattgcccctaatgtaaataataaatatttatgaagtagttattttttaaatttttatcgtgtttaattctggctttctctgaaatccactgtgatttcagccaggtctgtaatgacgctggacagaaacaaggctagagaaaaagccatcgttcaaagaaatttcccttgagctcagcctgcgcagtgcccggaaacatggtggggaaagggcccgagcagttggaaggaaaacaaggcaatttaaatttagagtttatgacttgaagttgttttgtttgttgtctattttgtttttgtaaatttctttgacagacttttactaaaaggacatgtagtttccatgaaagtaaaaaaaaaaaacaacaaaaaacccacatatactgtagcattttgtctttatattgttttatttctacaaatctgttcattaatattgtgctttaaggctgaaatgaagtatattatgaatttttttaagaaaactcatcaaatttcagggtatcacaaaactttattatattattatactgcccactatttattatatgttatagatgtctgagaggtaaaccaaatattttatttttaatgttaaaaaaacatcaaatttaactttattagcatattttagcaactttgggataaatacggacttttacttgattttgaaataatcccagtgtaggcccatgtgctggatctgttggatgctagaatatgggctttgaacctaatacaaatatattactagaaaatgtgatttttttaaatgccaagtaaattgatattagtgtatgaattagtcatattttaaaacattatgtggttagagaaatgcggttttctgccatgaatgttaagttgcaaatcagtggaaatggagtcgacctcttcggagcacagggtgtcattgccctcgttgttcaagaggccagaatttttctatccccgctaagaaacaaagcatctatgttgagatatgtgtttttttgtttgattaatttgagatcattctaaatactttatacaatattttcacatgcacaaaaatgcgcgttagtggtttttggagaggggtgaggggtgggggaagtgcaaaataaagattattggctatttcatagtttgcttttccattttctttatttaggatttagttccttgaggcgtggtccatgatctgaagttgccacgtttaagtgagcaggtcacgctactgaaatcagaatggaggtgcctatatataactttccccccaatcttactgtctgagagacttcagcccatgctacatttaaggaatttcaatcagtttgttgtcccttgctatttcatggttgctttcctaaatccagttcatgattttataaatggtctttgcaataataaaaccaaagaatcattttcagggggctggagagctcgagggattagtaatggaatacagagcctttcacctctaggtcagtgagtcggatccagtccaggtcactagagaccaaaagttgtcaccatcttatgactgttcagtggcctgtgtgaaatgaactggtggtctcagtctctactgggtggctggctgtgacaccaaccaaaggaagttcaagaaactgcaaagagaaatgtggattagaaaataaaacatccacattacaaagaaaaagttagaaagttgggcgtagtcattctccagaaagtaataccgaagaaaaaagagcaacttacaaataccacagacaaacagagattaatttactttccttaatgaagtcaagcaaaaccggaaaagaaaagcctatattgggtgagaggggagagggttaagtggggaggatgatttgatcagaagaaaaagttcagggacccaaacatcagggaaaaatgggttttgacttttgagggagaaggaaatcgcaacagcagcaatttgaggaactactgtagcagaattcgacacaaaggaatgagaagtatttccctttagagggcttgcagtgttccagttggaagcaaaaccctgaccggctttcatttagcccagcactgtcatttgaatagcatcaatactttattaagagaagtaatgcggggggggcggggattgtcctgactagtgattttattgagggagatggtatttgagaaacagaccctcacctcatgaaaccgagacgctcttctggtgtgatgatctgccgtcagagccagatggaactggcagagcttaatttctgtggctgacaaggtgtttctcttccaaaggtgtctacagtgaggcacagtgaggatctttatcccctgactgatttgtggttccaaatgtcctggagaaaaccagaggctatcagagtcttctgactttgtcgggcttttttcagagataaaatatagtgcattactctcctgtatcacctaaaccgcctttgttctcctttcaatgggatgattaaacaaagacctactaaccaaattaaagtataaaatgaacactgagatatggaaaccttgccactaagaatgctaatgaaaaaagttcactaaagccacgctggctatgttttcaatacaaatagttttatggccaatctctttagatcatagcagttttctttagaagtgtaagtctaaaagtagatgagttaccttgacggaagaatgaaacagataatgtcctgaataatgtctctttccacaatggtatcagtcattctgttaggaaactatttctttgagaatcttgcgttcgctgcagcctaaaaagtataaagtaactattaatccatgtgtgcaggcgagtagatgacatcgaaatgagatatttaggtggacagcttgttcatttaatctacatatgagttattaaaatggctagtggttatttttttcgttctgggcaactcagttttaaatttagtttgaagaacattgttacatggtttcattcatttcgtccacatttgctacgcacgttttttggaaatggcaatgatgtatcagaaccaagttcatttccagttgcctggtttctgagctgctctagcccttccgctggctccatgattttggaattgttcccaaagtatactatgtattaaagtgtattgcatgaaattctaagcgtattccatattactcttgtcccatttttccatacatcatctttctatccaccttagactgcaactattttttaatgttactagagcttcatgcttttaaattttacatgcataacaaaataagagcttaccaaatgtttgcattaactatcctaggaattagcagagtagacatgacgtgagaaaatatatgtagatagatacatgtaccacacagtttttgttgggctttcagaacagaagttcattttaggtacatagccctaagcaaccatttcctaccatatccttagaacctagtcagtattttcaccttttgaagtttcgtgggttttttttttttttttggggggggggggggtttggtcttgtttttgattaatgaaatgttcagaataggactatctttttttaaaaaaaaaaaaacacaaacctgaagaatgtcattgttattatccttaatgagttaactattgccaagttaaatggtttgaagaaaatgtttgttctcatctggttaactcatttagagcatcagaagtacttaccagaggaagttcaaatcatccaaaaacattatcaagttatattctgattatttcttattatactgtttgggatgtggattaaattttttctgctagcttttagaaagtgaatatttatttatttatttatttatgagacagggtcttactttgtcacccaggctggaatgcagtggtgtaatcacagtggcctcgacctcctgagcagctgggaccaaaggcatgtgccacatgtcttgctaattttttatttttttgtagagacaggattgcccagattcgtgttgaactcctaggctcaagtgatcctcctgcctccacccaaagtactgggattataggcacgagccactgcaccaggccaaaaagtgaattttcttttttctttggagacagggtctccctctgtcgcccaggctggatcgaagtcagtggcacgatctcggctaactgcaacctccgtcttctgggttcaagtgattctcctgcctcagcctccccagtagctgggactacaggcacctgccaccacacctggctaattttttgtgttttagtagagatgaggtttcaccatgttgtccagggtggtctcgaactcctgagctcaggcaatccgcccgcctcagcctcccaaagtgctgggattacagacgtgcaccactgcgcccagccaaaaagtgaattatttacagctgatttcttgatagccaattcctaattttccttcattttatttattttgacattgttatttacaacattcacaaaaacaaatattaggcccaggatgtcccacactcagccatattcatacatttcttttttttttttttttttttttaatttttcagacagagtctcattcttcacccaggctggagtgcagtggcacgatctcggctcactgcaagctccacctcccgggttcacgtcattctcctgcctcagcctcctgagtagctgggactacaggtgcccgccaccacgcccggctaattttttgtatttttaggagagacggggtttcaccgtgttagccaggatggtctcgatctcctgaccttgtgatccgcccgcctcggcctcccaaagtgggggattacaggcgtgagccaccgcgcctggcccacattcatacatttctctaaaaaatgttcatcagacattgctctgagcaagacacattgtgcactgtgggaatacagcggtggaggagacagcgtgccccagggctgcagagagccgtcacaggctacgtacccaaaggcaggacacacctcagaagtgggtgcaaaccagaagtgccattgaaaggtgattgtttctcccttcagtttgaccagtgttcagctgtaggtcaatgagactaaggagatagcacaaaatgtaaagcaacattaaacataaggatacataggattccggctgggcgcggtagctcacgcctgtaatcccagcactttgggaagctgaggcaggtggatcacctgaggtcaggagttcaagatcagcctgaccaacatggtgaaaccccatctctactaaaaatacaaaaattagccaggcatggtggcgggcgcctgtagtcccagctacttgggaggctgaggcaggagaatcccttgaacccaggaggtggaagttgcagtgagctgagattgtgccactgcactccagcctgggcaacaagagtgaaactccatctctagaataaaaagaatacctaggattccctgtatagaaagtttttaaagagactgaaccacactgtcttgtttagggatgcgtgcaaagatgggaaagcaagagttcctaataaaagtgagggtggcggctgcctctgggaagaaagggagttttgatggggaaggagtgagcaagctcagggcagcttcctggggacaaggaacatcttgccccttgacctgggcagtgttatacaggattctctttatatctgtttgctaaaattgtgtatatcagttttagccatttttctgcttgctgttttacaattaaaacaatctagccaggcgtggtggctcatgcctgtaatctcaacactttgggagttgggagggattacttgagctcaggagtttgagaccagcctgggcaacataacaagaccccatctctacaaaaaaattgtaaaactaaaaaccagctgggcaagatggcatgcgcctgtggtcccagctcatctggaggctgaggtgggaggatggcttgaacccagaaggttgaaggtacagtgagccatgatcatactactgcattccagcctgggtgacagggcgagaccctgtctctaaataaataaataaataaatatggccaggtgaggtggctcatgcctgtaatcccagcactttgggaggccaaggtgggtggatcatgaggtcaggagatcgagaccatcctggccaacatggtgaaaccccatctgcactaaaaatacaaaaaagccggacgtggtagcacacacctgtagtcccagcttgggaggctgaggcaggggaatcgcttgaatccaagaggcagagattgcagtaaaccaagatcatgccactgcactccagcctgagtgacagagtgagactccatctcagaaaaaaaaaaaaaaaaaaaaaaaaactttggtcatataaaacccccttttttttttgtagtagagatggggtttcgccatgttggccaggctggtctcgaactcctgacctcaagtgatcggcctgccttggcctcccaaagtgctgggattacaggcatgagcccccgtgcctggccatataaaaagcatttcacgtggtaaaagctcgataaatggtattaatagctatagtatctattgtggcttttttccccatgttttcatgaattctgggttttccatgagtctccaattctagatttcaacatttcatacaaataagtgatcttaatattacaatcaaggattgggaagctggacaagacattcattcactaggcagtttgtaagaacaaatgactgattcgatacaggagatggccagaagaaagaggctttctcccggtgcacttctgagtgggcaaccagttggatgtgacacatgtcagtgtggtaccgaggtgaagagcagagggatagacacgacacagccccactcctaggaaatgcagccaatagcaggactcacgaccagtgtgaacaggcagcaggttgatgtggaatggatttggctacggtgttttggaagcactgcactcaacaatctctgaggagtaaacggaataataaatcatggagaaaaggccaggggtaggcctcccctacattctgcacgtccatgcttgcatttccattctcaaaacaacccacacagtaaatgcatcagataaagtaagaacccaacttatgcttaaaatgaggagagattttcaaaacattctcgatgtaggccagttgtagggatgcattcacttatagagtagaggagatatcacggcactccttctccctgacagatatttagggatctgttcagcatacaaatgtttgtatacatatatatatatatatatttagatggagtctcactctgtcatcaggctagagtgcagtggcgtgatcttggctcactgcactctccacctcccgggttcaagcgattcccctgcctcagcctcccgagtagctgggactacaggcatgcaccaccatgcttgactaattttttgtattttagtagagacggggtttcaccttgttggccaggatggtcttgatcacctgacatcgtgatccacccccctcggcctcccaaagtgctgggattacagatgtgagccactgcgcctggcccaaatctttgtgtttgaatcattgtgctcaatgcaggggctcaggctggtcaacagagctttctgtgattatggaagtgctctacaatttctacactttcccatcagcagccactgctacaggtggtgatttgcgcctttgaaatgtggctagtgtactgccactgagagactgatttttaattttttaaattttaatttattatttatttatccttttttaaagaatttatcttgagacaaggtctcagcctgttgcccatgctggagtacagaggtgtgatcatggctcaccacaacctcaacctcctgggttcaagcaatcctcccccttcagcctcccgagtagctgagactacaggtgtgcatcaccaagcccagctgattttctttgtttgtttgtttgcagagtcaggatttctctatgttgcccagactgatctcaaactcctgagctcaagcaaaccacccaccgtagtctccaaaagtgctgggatgacagacatgagccaccgcacctggcctaactttaattttgacagccactggtggctaggagctaccatactgcacagtgcgctactagagcagccacaaaagtagatacaccttctccttcattgtcatcctcatctttcccatggccaggaaggaggctggtccaggaagcactcacagcatagccatacttcctcaccaactgcatggtggtttattgtcaataaaatgaaagaagggaaatggacagatagtgtgacattttcaacttactaacaacttttcattaagtgtgtattttatgtatccaggagcctgcacttatatacaaaatatcagttgtcagtggtttgtatccaatgttagtgaaaagtctctattttatgtatccaggagcctgcacttatatacaaaataccagttgtcagtgatttgtatccaatggtagtgaaaattctctattgccttgatttaaccatcactctcccaatggcctcagcacttacattctgaaaccaagaggtcacgtgacatctccatgctgttgtagctataacattctgtgtttgagatttgaaaacttataaataaatcagttctgtgtcagagcaagtgactccaatgcctgttacaactggaatcaagagatgaagggataagcgtgtggtgtgaatggaaccacagaattgactcacctgaagttttttaaatgtgaatttggttgaattaaagaataggcttaaagtcaaaaaagaaataaggggccggacacggtagctcatgcctataatcccctccccccagcactttgggaggccaaggcaggcagatcacaaggtcaggaaattgagaccttcctcactaacacagtgaaaccccgtctctactaaaaatacaaaaaaattagccgggcgaggtggcgggcgcctgtagtcccagctactcaggaggctgagacaggagaatggcatgaacccgcgaggcggagcttgcagtgagccgagattgcgccactgcactccagcctgggcgacagagtgagactccatctcaaaaaaaaaaaaaaaaaagaaagaaagaaagaaagaaagaaagaaagaaagaaagaaagaaaaagaaataagggtggggtgcggtggctcacacctataatcccaggacttggggaggccaagatgggaggatcacttgagcccaagagttcaagaccagcctgggcaacatggcaagaccctgtctctacaaaaaaacaaaaaattacccaacatggtggtgcacacctgtagtcccagctggagaggttgaggcaggaggcgcacttgtgcccaggagtttggggctgcagtgagctgtgatcataccactgcactctagcctggggccacagaacaagaccctgtctcaaaaaagaaagaaagagggggcaggtggggagagagagagagagaagaaaatgaggttccaaaaagggggcgcatacgccatccttcccaggttggttacctcttgcaagagcagaaggtaaaaacaggagcagaaggaaatgtctccagctgtagaaatggttgtcttgggggtggaagtggaatgaccgagagctgctgagggagtgagggcgtttaaaaaattcctgcaccccggcgtgtctctttaattacaaacggctgggcaaaacagggcagaggcatttctgttggtttattgtcaataaaatgaaagaagggaaatggacagatagtgtgacattttcaacttactaacaacttttcattaagtgtgtattttatgtatccaggagcctgcacttacatacaaagtatcagttgtcagtggtttgtatccaatggtagtgaaaattctctattgccttgatttaactattaatgtgaacatagattaacttgttcctatacgtacactgaagctacgggcatctcaactgcttccatgctgtttctagcatttaggaggtaatttagccctttttcaacatctactccatttcttgaatggctagttattttcccaaatgtttttatgtgcaaatcattgtcaataaactttgtttcaaatcactaaaagcaatagagaaggcttgcctttggattacaaaatagcgaaacctgcttgagagcttcaaattaccagactacccgaacaaagcgagccccgtgtttcagtgtatagtcacagacaatacagtaatttaatgcagtaggaattctggctgaattcagaagatggtatttatgccataaagggttattcaccccctttcccaagtaacagtgatgtctgacacctgcccactcggtcttgcagaagcacacctacgtttgtgtatatggattcatgtgaaggatgtttgtataaaaatgcagaatgtaatcactcaatatagctgacatcacttcatattctatacatttatgggaaaattttgcagttgtgtagtttccagatacagaagtcacacgacatggctatatatatatatatatatactttttttttttttttttttttgagacagagtctctggctttgttacccaggctggagtgcaatggcacgatctcagctcactacaatctccacctcccaggttcaagcgattctcctgcctcagcctcctgggtacctgggattataggtgcgtgccacaagtcctggctaatttttatatttttagtagagacgtgtttcaccatgttggccaggctggtctcaaactcctgacctcaggtgatctgcctacctcagcctcccaaagtgctgggattacaggtgtgagccaccatgcccggccgacatgtctaaatttacagtatgtgtaatgcactcagaaacaaggatgtggttgataagagtgtgctcataattttcattaagttcttcatcgtgtttcgttagtgctcaaacatcagaggaaaaattaaagttttggagcaaaactcaggaaagacccagatgagtccctcctctcttcccttcagtcactgctctggtgtggggacagcccacgtcactaaagcaaacacacctttacacagctgtctgcttgtcttcactggcattgtctgattttttttttttcacaagaaaagctgatctttcatattaagaggagtgatgtcaaaattaggcaaacggtgtgtgaaggcgagtggaaagagttttatgcaaagaaacagcacaaggtttcaaaaagcatgctagaatttcagcagtttttagactcaggctaggacgacagatctttgagccaaaaaaacaaaaccaaaaccaaaaatcaaacacccaaaataagccattaatcgtgttctacccgagccaacccacaaaccagggatagaaaacagagagtgctaagataggaaggcactatagaaataccgcccaatcctggccatgaaagtcaacattccaaattccccgactctctcacacctaatctgatggagccacccaacggctttacacaaggtaagtggagccggctcccctcggcagtctagcgcagccttttaaatggactgctattaaaaagccgagttgagttatctcttgggatcagtgtggcatttagttgctgcccggccccagtagttccagccacccctacagcaaactcccactgtgatgggaagctccacttggtcactaagggccgccctcctctctgttttcaaggtctttcctgaaagttggccacagagataacctggtttccatgctattattgcataggaagaaggaagggttgagcccagcccctttgggaggtgaacttgtggttccagggagtctaggaagtcaaacctgatgcttttagtattaagctgccccatagaatgactcaaattggagttttctctgagaaccaaaaagggagctgaattacaatagctctttcttatttgtgacacttttttttttttttttttttttttggagacggagtctcgctctgtcactcaggctagagtgcagtggtgcaatctcggctcactgcagcctccgcgtcccgggttcaagcaattctcctgcatcagcctcccaagtagctgagattacaggtgtgtgctaccacacccctctaatttgtgacacatttgaacacacacacacacatacacacacacccttttcctagtactttagaacatatttaacctgtggcttttgggaatagaaatttttcaacattaagaatgaatttggccggcctcggtggctcacgcctgtaatcccagcactttgggaggccgaggcgggcggatcacgaggtcaggagattgagaccatcctggctaacacggtgaaaacccgtctctactaaaaatacaaaaaaaaaaaaaaaaaaaaaaaaattagccaggtgtggtggcatgcacttgtagtcccagctactcgggagggtgaggcaggagaattgcttgaacctgggaggcggaggttgcagtgagctgagatcaggccactgcattccagcctgggcgacacagtgagattatgtctcaaagaagaaaaaaagaaaaaaaaaaaaggccggtcacagcggctcaggcctgtaatcccagcactttcggaggccgaggtgggcggatcacctcaggtcaggagtttgagaccagcctggccaacatggtgaaaacccatctctactaaaaatacaaaaattagctgggcgtggtggcaggcacctgtaatcccagctacttgggaggctgagacaggagaattgcttgaacctgggaggtggaggttgcagtgagccgagattgccccattgcactccggcctgggtaacaagagtgaaactccgtctcaaaaaaaaaaaaaaagaatgaatttattttaatattctttttattaactcaaacatcatttcacccaggacctccatttactggtggcaaatctggttaagttcggaggcccaatatcacttcttccatcaaaatggattagtctgcaggttcaggaggattataaggtcgggtcaaacccctccctcctcctgagtgttttagcaaagataaaattgaaatgatgttgttagtaaaaatgattgccttcttttaaaagatggcattaaagataa

SEQ ID NO: 1187 - DNA, 28763 bp, Homo sapiens
agagaaaggagggtgagtcgaggcgatatgctgagcatgaagccatacagccccaccactttcaccaggcttcgcaagagcacattggcatttaaaggaagccagttactcatcagggtggtatccgagctcagccgtgagttcagctcccctaagaaggacagagcaggtgaggaaaaaggaaaccatgtgtactgcagggcccccagaaactccctcctgaccgttccctctgacacagccccctcctctgaacatcctccttcacttgcagagggacagtggaggctgcttctccaccctgtcccaaacaagagaaaagcatccccaagtcctggcatacgggtgaaggcaggaggagaggctgtgggtggaaggtcactgaggggcaagggatgtccatgggaatctcagacctggactccaggccccacctgtcttagtctcctggaagaaaccgaggtcctggcgcagcagggaggagaaaagctgctcccggatccgcaagttgattcgagacatggtgtaggtgaagcagcctcctcggcagcctgcagacagtgagctgtggggtaggagaataagaggggagggagatgcagagaaggagcaagccagcgggtgaaacagaggagcaagccaggagtgcagagaagcgcaaagtcaggggaaagcatgccaggaggggcaaaagagaaagaaatgagagacagacacacagagagagaagaggtaaggaatacacagaggaagaagaaagaggagacatggtgagctagatgtgagaacaaaatcataacatgtacaaatttacaagtatttatggagtgcactctgtactagacacaatagaaaactacaatagaagggaaaagatattgtgaaaacaagtatcccagtgcttgcttctgtcccagcgtccctcaggcttgtccctctgtgcgtctcctccgccttggtctccttcctgccccatacccaaagcccttctctgtcatcatagatacttcatcatgggaactgcaataataaattccctgcccccacaattctctggagccccagagtcatgtgattcccatctttcatccttcgagttggaaaatccctcttagaccaactacatgctacagtaacacttagaggaaaaaatataaagcataaaagcatgtattttacaaaatatatgtttctaatacaaatttagttaccatattgaagaggcgtttgggagagtcagacatgatataatgagggtttgtactttaatgacagggatgtgttctgagaaatgtgtcgttagatggtttcatcgttgtatgaacatcatagagtgtacttacacaaacctagatgtcatagcctactgcacacctaggccatgtagtttagcctattgctcctaggctacaaatctgtacaacatataactgcacctaacactgtgggcgactgtaacacagaagtaagtatttgtgtatctaaacatagaaaaggtacagtaaaaatatggtattataatcttgtgggtccaccatcttatatgtggcccatcattgacctaaacttcgttatgcagtgcacgactgtagtttcagcagaaagcagccaggatggaatgaaggcacaatgaaatggttttcgagggtactctaaattaagtatgaccataaaaatagagacaatcaggccggctgggatttgggtaaggtgagtgcacacctccttaaactttgcaccccaggtgcctcgctcacctcatcccagtcccagccttatcaaacagtttgtttgtttgagtatgtctagaaagagaaaggaaagcaagtgaagggaaaagagtaatgattctggaaagaaaggtgataagcctcagagtaagatcttcagggactggcaagatgagctgggaaagaagagtgaaagggagaagcatacccatcctgagggagtgaccctggagagatactttggagacagacttaggggtaggaggtaggaggcagaaagaaatggaatttcatggacctaggaatgttgagagacaactgagagacattccatctgagacttaaattccttttgtactaccttcactcataacttgttcctataataagatcagataaactttgaagatattggatgaatatgaacgaaggaagaaatgaatggatagatgaaacagaatggtgactacattcaccatattttagtttaagtatttttgtgttttgcgcctgaaagggcctagaaatggagttagggaagtgaagacccctataaagatttggggctagcaaatggacccagctgcccaccacctacctgccaaaggagaagaggcacatgaagaagatggcactggcaaaggcatgggggtcaaaatcacctcccaggatgtcaatcacacgaccagaatagtgagggattaatgtctcacctgaaagaggcatgaaaaataacacaagaatgtgctggtgcccaggcccttttaccacctccaactcacaacgtcctctcctgactcacccaaaacagcaaggacaaggaagaagaaggcggcaacgaggagaggcaggtccggcctggagagcttcagcagcctccacatcaagactttgttgttcacctggtcctgctccttctcctgggctccaggagggctcagaacagcccacagtgaccagctgagccccgcagccccgtaccccaccagcagccagctccaaggggctgaagcgactctggctgggggagcacgtgaggcccccgcgaccagggctctcagggagacagtcaggggggtggccagacagagcgggagcagcagtgtccccacaaatcccagcagccctcttagctttagcagcccccacagccctcccagccgcagggtcccctccagccatagtcctggcagcccttgaggaagcaaagtccccagagggccctgaagcagccacagtaaagccgcgtccaccagcagcagggaggtccagggtctcaggtcagggagccgcatggctctgtcaacggatacgagatgagaaatcatgggggtggagtcccaatccttgtccctgccctcctacccgcccggctccgcctaacccgtccatcggcttctcattttatcctattcaaccctgagagctctcctgagtaaccggtgctcatccgtacacccctcctacgacagacagctttcggccttctggggagctggaagcatgaccatcaggagcctcgtgcttaaaaaaaaaaaaaaaaaatccccggacccccacccccacccccgcctgccgcggcgagctaagtggtccgggctccgctccctcctatcgccgggtgcagagggactgggaagcaggagcgtggagtgggtagtcacttgggctgcgtccctgttggcgctccaggttcccctccgcaccaactcaccagccgcggcggggagaccgcagctccggggacttctgcttcagcgctgaggtccgctccgtctctcccaacctcgctaccggctctggtccgccagctacgctcggccagggcgggcgtcagggctcgggcagctttcgctttcgcttccccagccaaggccttcattctgggctgggccgccgggagggggcgcgcgagacccgcagacagcggaactggagcccgaactctggttcgcactgtacaggcctgcaatgagtctcactcgcctttagtggcggttactctgggatataaaactgcaaaaatgtttctttatcattaagtaaaatacagttgtctcaagggcaactttatctgttgtccttgctttgtaattggagaatgctttgtaattggagaatcactgaattttctcaaagttactacttcaagctctgagcctactattaagaagtgccttctttctggtccggcgcggtggctcacgcctgtaatcacagcactttgggaggccgaggcgggcggatcgcctgaggtcaggggttcgagaccagcctggccaacatggtgaaaccctgtctctactaaaaatacaaaaattagccagggcgtggtggcggacgcctgtaatcccagctactcgggaggctgaggcaggggaatcgcttgaactcaggaggcagaggtttcagtgagccgagatcgggtcattgcactccagcctgggcgacaagagtgagacttcgtctaaaaaaaaaaaaagtgccctcttccatgcaagctccagttttaggcgagcgagccgggctctcctaaatagaaggttccaaccaatctcaccaggccaaaggggattttcacgtacagactttgaatttagtaggccctgagcgttcatcttcatccgtccttctcagccggagcaccttgagctggcgcgtgttcaggtgcctctgagtctgtactccaaattatgttgggcgcaccttcagcctatgagggaaatgccccgtactgagctttggttcttgttctattttaacactgtttagaacagtaattaggtttttaaatatccttcctgacccagagccttcctatgcaacagaaagattcgtttattccagaaaggactcttcagattgaaaccacctcccaaactaaaaacaaacaaacaaacaaattccccaaaggaagggtcgcttggattccagatcaccattttgaaatgttacctgtgtgactaccaaggagtcacttaaagtttaaaatagtggtggtggggaggagggattttaagtaggggctcgctaaagttttacaactctattcattctggcattttaagaatctctctctaatgaaaaaagctccatgctcaagctcatgctcctactttcaagcatttgtttcctttattttctggaaagtgacatggtccatagttccagcatgattccgaaaatctcatgatgtgtgtctctttcttctaacctggatcttttacattttccccacactcctcacttaggggagtcctcctgatctcttcttcctctaaaattatagtcctgccatcttgcaattcagcatgacacatcatgaaattagacccttaatgtctgtctttatattcaatatccaatatctccaaagtgttatttgggataaatggtatggtgtttatatgattaccatattaaagtgaagtggaagctttttcatcctactctataaagtcaaaaacagttatcctaggtgccctactccctgttcctcaaaccattaacaatggaacacacaggagtccccaggtgcctctctatggaaaggaccctaacctatgtgaaattgcaaacaagtgtccatggacagcaatgagcagccttcctgaggtcttggagagatgagtgtggaaggaaaccccaggaagaactatgtggtgaggccacatttcttagataggggtctgagccccttctccagaaaaagcgtctctttactttctgccccacccaacaaccacaggcccaaccccattcagccacaagacagaggtatttataaccgtttttctttattctacttagtggggcacccagaaacttccctgggggaaatgcttgttcaaatagagaacacgcagaagatgcacttcaccggcctcctctggctgctgagcccgtactctctctttggctcaggctaggcctcttcttctccttggacttaacgtggcttaggtccctgagtcggccaagacctcccagaggagacctgcccagctgccaccaccaccattattgattggcttcccggtactggtgcagcaggtcactgacatctgtactttctactttcacccaaccatcttccttcatgtggtacactgtggacaaatgagaaaagaacatggagtcacctttcacctcagcaagttcctgtcactgatgttatgttgaaggcagcaacaagacacatgcgcaagcttaaaaccatatgactgggcctttaatgcccttcttctgactctgaaaatttcctccctactactctccctcctttgagtctctcaatcattttcttttttttcttttgagaaggagtctcactctgtggcccagactggaatgcagtggcgccatcttggctcactgcaagctccacctcccaggttcaagtgattctcctgcctcagcctcccaagtagctgggactacaggcacccgtcaccacgtccggctaatttttgtagttttagtagagacggggtttcgccatgttggccaggctggtttctcaatcttaaatcaccccccccaccacccgccgactcctcccaggcatggtggtgggagcattggtctcttactattgacaacgcctccagaatagctgtctctgtgagtggcataagcaatagccctgcggccaaggtcataggcctcttcagggctaagattaggccgatagccactgtccatgaccccgtaggcataagtgttcccactacccgtggagaacatatttcctgagagccgagtcccatgttcatccacgtagtagagtccaggaccctataagatgaaagatttcaggctgaaattggagaggaagatgttggtaacatgggggttcaaatatgagacataaaaagtgaacaaaagaattaatattaccacaagaacattggaattaggaaaccactttggtaaagtcatcgaactttagaaatgaaaaaggaaaaacaaacttgaaatcaactgtttaacaaaagggacaagcttacaaaacacatgcaatgattcatatctgggccaataaatagtccatggatatactgaaacagttctataaccaagcactctatatgccatgcatcttgtcagggagggagtaggagtatatgatgggaaacagatctgtcatccatagggaacatggtgggggaacatgaagaatggagagcacccaccttcttatcccagccacagatcatactgcccatagagaggcccatgccccggtactggcacatcatgttggacagcagcttggaggctgccgacactgaaatacgttctccatttcgcagatagtacagcctgggtgaggacaaggtggagtgaggaaagagaggttagctctttccaacttgatggggcaggaaatgattaaagagataagcattggaaaggaattattttgtaggatctaaagatcagagaaagatttggaatttaaagtatctgaaacatacaaaggcagcctagtaaatgatactgtcccgccagggtggatgtgtcagtgctaaatacctgacgtactatctggcttatgagtggagcacaggctgagatttgggagaagggtcttatcaccaaaaagctgttttgtgaaatatactattagcactaagatggaccacataggacaagagtaaggagcaatgatctgagagatccagggattaaccactaggctaagaaaggaagatgagaggcctcgcttacctgcattccttggccagcaggcgctcccagtactgacagtctgctgcacagccagacatggtgccaagcaggtaagggttaatctcaatcaccttgttcacccgtaaggcacctggaagaagatggagctttgggagagaagggatgaccccatagatcccccagtgtgtcctaaatcaatatccacttccactttgttgcagagttggcctcctgtggaaaggagagcccagctccccagattctgcctgctggagcgtatacactcactaatgtaggacccagctgaggcccgagaatccactgctgcaatcactccatgctggaacttgaaggcgagcgtggtggtgccatgggccatctcaatctgaacgttcctttctccgtccccacccagggactggaagaattctgtgggctgataagagaaaagaggttgagaaaggcaatgaaaaattctgtagtaagaggctccaggaaaaggttttagggagtatgagggtgaggagatatgcagaaatgatctaaccatcaataaatgaaacagttaataaccaatctctagaaggaaatggcttgggagaaggaaaagaagaggcatgccagtatcaaccttttccattttccagcacaacagaaatgaaagcaagcacatgttaccattactaaaaaattttgagagtgacttaaagggtttcttccatgcataaagcattcaaccctcacaaaacacgtttagtaacagtatcctcactttacagaagaggggcttgggacctagactaagtgacttgttctaagtcgcgcaacagtgagttgctgagaggaggccagcaggcaaatttcataggtttcccaagacaccacacacctcctatatcatgtgataaccccatgaaaaaggctccaccatttgtgtgtggacaagggcaggaaagttctcttgtcttcctttgggagcccccacctcacctgtaactctttgtcctaacttgcacttcctcctctcaggccccatccccatgtggcctcttctttgggtctggcgctctccgggactgaaggctacccccgaccctgtaccccgcgctcccgctctcgcctcctcctctcaggcgaccctccactcctcagcgcccgcctccctgcatccctaggggcttccctactgccccgacctgcattccccggggtaaagcgagctctggagatcgcatagagaaactgtagtgtcctgggtccgagcgacgcccgcttcccgcaaccgggagagccgattccggccgctgccctcggggggctccgcatacatctagtagcgccatgaccgcccagcacccagagatctgtccgctctcggaggaggaagtgaaagcgaaagccacagatcgaaggggagggaacaagactcttttccacatccccctgccttttccgagaaaaggacagttagtgcctggaccaggaccatcacactggggaccggcttctctgctctcccgttatgggggtcgggggaatgatgggtcaagggtcttccgaagaaagcgagaaaggaacaggcgccttcaaaagcccacttggcgatgggttacagtaagaggtacctccaggcccgggcatccgctggaaacaggggtgggtagggtcgtgtcatctaaaggcgcagcttcaaccagaagactagaagtcagccaggagctgggagtagtgtcacgcggggtgggggttcctatgagcatcactttacaaaaccaggagggacggaagtgcgagggggcagagtcttggaaacaggtcctgggccaactgcaacagaatatacccgccgcgtgtaggggaaggcggcgccagggagagggcgcagtctctgaatctttccacggggtccatcctagggcccctccaggttcaacggtctcctaacctgtagtcacccacaagagcgtgccctttctgcccgcccttcctagcgttgctccctgcttggctgagcactgcggagtttcacgcctctaaaccccgcctcttcttgcaacctgtgttggcctcatctacccagcaactgtcgacgtcacacgacctgggcctccctgaatgggagatatttactaggcaatcccgcctactgttctgaggtttcccctccaggtgcagcttcagagccaggcgagccaggaaggaccagcgggcgaggtggtgagttgtgaggcgcgcccagtccctctgttcccgcctggcacttgctctggccgcgcccgccccatctgccacttcggagaggccacggctctgagctgcggccgctagtgccctgatgggccctgtggctggggtcttgcacattcttgggggtgggcctaaggggataggggaagtggaaggggcctcataggaattaaaaagcttaagggaaaaggtgatgcagttagggggtaaaacattgaggatgataaaagaggagacatccgcagctgaaaagtgcgctgcaaaaggcagtgggccgtttggtgtgccggaaacataagaaaccacagtacaaaacaccaattttattataaatatcaagaacctacagggtgtttatgggccagcatatgccttcagttatgttgaaaatagctgatcatctttccgtacattctgaacatttctcagtttcagagtgctggccacaccaaagcatcagccctggctctaaactccgttacagtaaggaattacaaatcctgtgtttgtactccaggaagtctgcattatcacgaggagcttggaaaggaggtaacacactcaaggcaaatttcaagtaactcatcctggaggcagctgcctactctgcagctgtggttctccaccacagagagaagaaaagggagggagatggagtgcgcaggtctgagaaggctttcattctggagcatctgcaggagcctgcaccatggcccagtagcacccctttttctccatgagctgctggtgggttcccccctcccggatagcgcctccttccagaaagaggatgtggtcagcctgctccaccaggctgaggtgctgggtgatgagaagcactgagcgggagtaccgctcagggctttcgtacaggagctgctccacctgaggaaagacatcggaccgtcagagccggggactaccctcagcccagggagacacctgtgtttccagggctgggactgacctcacaggatcactgctggctctgctaacaaccccaaggacaccaacgtttcccattctgagtacttctccgcaaaccctttgtttcattaaggactgttttacatgaagggtgcaaaagtaggataaaaatgagaaccctagggtgaaacacgtgacagaagaataaagactattgaatagtcctcttctctacccatggacttggcatttttatattcgattttaaggaaatataacttagtagtaaagagatgagcattcaagtcaggcagacctgaatttgggtcaaggctgcgccactcaaaagctatatgacctctatatgagcagcttattcaacctcttttaacctccattttgtcatctgtagaatgatgataaatgcctagctcagaaggattcctaatgaataaatgagtgacagtgcatgtaaacagactagcttaattaatattaatatgattaggatgggctgggcccggtggctcatgcctataatcctagcactttgggaggtcaaggagggaggatcacttgggcccaggagttcaaggccagcctgggcaacatagcgggacgctgtctgtacaaaaaataatttttttaaataaacgatattatgaggatggtcttttccttatgtttcgctttagaaattcagtctataggactgggcgcagtggctcacacctataaccccagccctttgggaggctgaggggggcagattacctgagctcaggaattcaaggccagcctgggcaacatggtgaaacccatctctactaaaaatataaaagtcaaccaggcatagtggtgtacacctgtagtcccagctactcgggaggctgaggggagaatcgcttgagcccagcaggttgaagctgcagtgagccaagattgtgccactgcgctccagcctgggcaactgagtgagacactgtcttaaaaaaaaaaaaggaaagaaagaaagaaattcagtctgtagtttgtagatagtctcttttaactgattctaggtgtctttgcctcgtcttctatctctactccttggggaggcatccaatggaactggatttgggaactgagaactgcaaggactggtttgtataattatgatgttagtaaaactaacagaagatgtataaaagaagcaagattgggtgggatatagccattaagaagatgactgcctcacctgtaactggctgtttgcatccagggcactggtggcatcatccaggataagtacacacggtttccggatcaatgctcgggccaacgccactgcctgtcgctgaccccctgacagctggctcccagcctcgtctacctctgcagagcaaagggccaagatgagaacggtatagccacatgtgtgcacgcatgtacatgcacacagacacactcatgcattcacgcactcacacacaccaagatctgacggttgtagctggataggggagattctgggaagatgaacagaatcctgaggatgtcaggatgaagaagccataggagcatgatcttacaacttcaaattgatgtccatgagtaaggaggaactgaaggataaaggcaagactactggggtttcagcaaaggtaaagatggctgggtggtgagatgagtggagagagtacctgtgtcatagccctgagggagtccagagatgaaactatgggccccagactttactgcagcagctgtgatttcctccatagttggcttctgggtcaggccataggcaatattttcttgaagacttcttccaaatacctgtggctcttgtcccactgcagccacctgagatgaaatatgatgaagagtcatagaacaaggcacatgggagtatggttatctagagatcgaagactcaaaatctttattgagaacatgtcacaaaatcatactacctccctcctgactacaccaccatctccacccaaggtctcttatcattccctaacccctctttcagagtgctcagtaagaatgctcttcgtatttgatgctccctgccctccttcaagccacctgcttccatacctgcctgtgcaggtagcggtgctcatattggggaaggggcttcccatccaacagcagctgtcccccggtgggctggtacagattctgcagcagggcagccactgtgctcttcccagacccattgggtcccaccagcgccgtcacctcgccagggcgtagggtgaatgtcagcccctagaggccagagaagcacacgataagaggctaccaaggcctctaaccttgagagtgtcattgccttgttacatagcatgatgtcttaccccagaagaaaaacagggaaatatagaaactcctaccctcccacatgcacagatttctgggtgatgcctccccaaggagtagagatagaagaagcggcaaagacaagggcagagacccagcaccactatgccacacacttgatgtcagataccaccaggaaagggaaaaatcacattccaaattacaaaggaaaaggaaagatggaagaccgaagacacagattttgctgcagcaattccttggaacgtgagagcactctcttcgaaacctcttctctcattctctttggaagcccaaactgggttcttgagtttggggaagatttatggaacagatgatgcctaccattgcctttaaagggttagggaggatatatgcttggcagtaagcaggctgaaggcaggaagaaaatttaggatggcagaattgcagttggggccagtggaatacagggagtggtaggttgtacctgtagcactaagacatctgggcggtttgggtaggcaaaggagacatcttggaactggacaaggccctccaagtgtaagggagtcaacagaccactgggtgggcagcgaggggtgcggtccaggtactcaaatattttctctgaggagcccacagccttctgtactctggggtagatggagagcagtacctagagggaggtaagaatagtgaaagtgaggtagtctgcttgccagcattatgtgaagcaagaagggtaaagaatggaaggacatcacacagatggtgctgggccagaggaaggaatcacactggggagtgaaggtggagggacctcacctccacagcctgggtgaactgcatctggtagagaacaaatgtgacaaggttcccactgcttacagccccactggtcaccagctgcccaccaatgtagaggattcccactttcagcagcatacctgaaatctataaagagaccacaaaaaaagggactgaggtagagaaatctggaggggacacaaagaaccgcagtcattaacctgaaggaaatatcaagtccctgtctcctaagtgacatcggcaggctcaataggcagacaggagaatgaaccagagaccccatggagtctgactcaatgcacatcatgcaagtcacagttatcttcaccaccatcaccactatcaccttgtctggggagcattttactcttcacaaaaggctttcattcatgtgatgtcagctaatacatgaagagccttataaagaaggttatatcactccatttttgaaaaatgaggaaacaaccagtcgggcgcagtggctcatgcctgcaattccagcactttgggaggccgaagtgggcggatcacaaggtcaggagattgagaccatcctggctaacacggagaaacctcgtctctactaaaaatacaaaaaaaaaaaaaaaattagccgggcgtggtggcgggtgcctgtagtcccagctactcaggaggctgaggcgggagaacggcgtgaacccgggaggcggagcttgcagtgagcccagatcgcgccactgcactccagcctgggcgacaaagcgagactccagctcaaaaataataataataagtaaaaataaacaaacaaacaaacaaataaataaataaagaggaaacagtctcagagaaggtaaatttgttgtcatgatcacaagacaagtaaattgcatcatcaagccaggatcttcggatcactggcgtagctctctttccagtgcatcacagatgtccctcatccctggcttccactattcccatcactctcactaacaaatctacaaggtaccagcatgaagcagtcccaggtgcaagaatttatggcgccctgcacttcccctgagaggcaaaggaaggccctaggactggaagacacgcatctctccaatccacatggttgggtggattttatgtaccatactgaaaggaagccacctagcatctttaaagagagggagggggctagggacactgagtagagtcattgagcctcaggttgctaggacgaaaatactgaaccaaccatttcccagtaaaggaggagtgggagcagggtcataggaatgggaatggagtcacggcatcttaaggacaagggaatgggtattcatcttcaggtgctcacactagtggtccaggagttgactgcataggccacagcctccttctggttgagtgtctttatttcttgcagcttttccctaaacttctgggcttcgccctcctcgttggcaaagcttcgaactgtaggcatggccgacagagcctcaatggccacctggctggactttgccagagattcccgcacctgcacttccagcaactgtggatacatggacaagagatgtcacacgggttggcaaaccatcagggacactaatacctgagttacctatttggaaattaaaggtgagaagagacagaggaaaaggagaaaagagaaagagacacagctatgccccttggatgctaaagaaatacgaggaagaggaaaatgactcagaacgggttggggatcaaattcttaaagacagattgtggggagaagctagaaaagaagacccagagagtatggaggttaatgttgagcaacctgggaacatggaccacagggacagggtgttccatgaagatggagaatcagtaagggtgccaggaaagctggactgaaagcaatgtgagaggaactgagtctgccaagtctgggagatgagggtctgtgtagagcgggccaactccatgaacatacctggtaccattttcccaccttcttgggcagaaggaaaagcagaggcagggtgatcagggtgaccatggtgagggacactgatccccagagcatgatccccaagagacataggcctcgcaccaggtaccacagaaataagctcagattctcactcagagaatcactcagggtggacgtgtcctctgttacccgagacatgatgttacctgcagggttggggagaagagagtgaggtgaatcagacaggttccaagtgatgagacgaactaacaatgagccaggatgccagggtcaggggtgtcaacatggggttctaaggaggctgcaggaaacaaggttagggttctccagaggtctgcaaatctcagtgcagggaagatgagtgttaaagaggaaaggcctgaccttcattttaattataaagtcattaatgcacatgtgaatttccattttcctgaaagctttctgttccctagagaacctgtatgtcccatgctatacacacaggcaggaagagcttaaactggtcacataacagagatggaggaggagggtgctgctaggaagcatgccaaagtctgtggagcactcactgggactagggttctaaccccaggtctatctctagccatatgtaactgtacagcttctagtgctgctagaaagcatgccgaagtctgtggagcactcaagagaccagggttctaaccccaagtgtgtctctagccatatgtaactgtgcagtttcagcatttagggtcttggcctcagtttccttctctgtcagatgaggcagttggtctctatgagctcaaaatttccaggtttgaaattctatggtttctatctaaggatacataggaatagatttataagaaaatgctagatgaaaactctaggtttttcttaaggtaaggaggacaatattttgctcctgaggtatatcaagaatgagaaaaacaattgtgtgtgtgtgtgtgtgagagagagagagagagagacagagacagagagagagagacagggagagggtatatcaagaatgagaaggaacaatgtgtgtatgtgtgtgtgagagagagagagcggggaggggggagatcaaagcagatgtatgaggatatgaacagtacatggcgtataatgaaagagtttcaggagaaacctgtctggttctgttggaaaaactccgtctcctggcgcaggacagccccaaacacctctccctgcaagtggctgtgcacgtggcccatggtgttgttatagatcccgtcacccacgaactccagcactgcactataaagaacccggaaaaaaaggggatcagggtgtgttcagggaacagactgaaggtcccaggtatccccatataagtgcatttcggacagcagccccaacttccaactccctcatttgcagggtgccccattttcagcccccagacctggctatggtgagaatggacatgagagttaagtttcgagtgaaggtatcggctgagccatcttgtagaatccagtcagtgaggcggcccgtaaagaatggaatggccatctcccctggagaaagagaagagaggtcacgcacaaatattaagtctaagtaggtcagttccagtcagactggccccaccacgcctcctccccctcaccattatcctggagggcatcagcagaaaggaaacactgacgtctcaatcccgaacctaaataggctgccctggaactcactaccctgtggttgctctaccagaactttcaggattttattaggaaggctggagatcatgaagtagaaaagcctcctgttagagatgaggatgccccgcccttcggccccagagcaaaggatttccccgcttccggcgtggcccaaagaatcaagacccggtcagcaatggagcccagaacctctggcccccgccagtccagtgccgtttcttctacaccgaagtggtgttccaagacccacgctaggagtccttctcctgctccacatttcccagaacccacgctactctaccttactgacaattacctttgattcctgtcccagtccccttgtgtcctcccctcttgccctgcgttccccttaccaagagaggagaggaccaccaggaccaggaacagcgagaggcggcgcgtctccgagcccaggcagcctagaagccgacgcacagggtttccagagccgccctgaccgccgggcacccagaggctcccgagtttgtgccacagggctgctgcgggcagtgccgctgcataactgacaacgaaggcggtagggtgacttccccagtgcagtagcctggtgctatccgcggacccgggggctccccatgagatcagctctcggaacaaggcaagtcccggcagggccaagcccagtgccgcagctaatggcttcaaagcagccagccagccctgggcacctgcgttttcgctcttggagccaaccgttgccctgaggaccccgcaggcccccagccagagcacggcccagcggctcaggcccaccgcccagacccggagcagtggcagcgcggtgggcaccagcagggagaatatgcggggcagcgcggtccggagcagcacccagtcggcgagaagtagcagtactgtccccagccatgcgagagaagctccggggaggcagcggcacccgcggggagcgggacacctagagctagccattggcactcggacgccgtcccggtcccggccgggcctgggactctccgcgccccggtggggcctgaagctccgggtaccgccgagtcctcccctactggcggctgggggagggaacgagggcggggctctcggaaagtcccaggaacaggctgatcctgcgctggcgagaagctcagccatttaggggaaagcgaaatcgaaagcggccgcctgctcactagataacgcctacttccaaaagtggcctgcccagactattttggtagcaagcgtggaaatcagatctgagaatctcgggagcagccctggtgcccaattttctccatcacgcacacccttctcgcctctccctgcctcctgcctttccacttgcaccagttttcccaccccagcctcagggcggggctgcctcgtcacttgtctcggggcagatctgccctacacacgttagcgccgcgcgcaaagcagccccgcagcacccaggcgcctcctggcggcgccgcgaaggggcggggctgtcggctgcgcgttgtgcgctgtcccaggttggaaaccagtgccccaggcggcgaggagagcggtgccttgcagggatgctgcgggcgggagcaccaaccggggacttaccccgggcgggagaagtccacaccggggtaatgggtctgggcttgagggttggcagaggggtggaggagatgcagcggccaggggaccctggaagcgcgcgcggagaagtgaatgcagagaccaacgggagcgcagggaggtcgcctgtagcagccagcgcttgcaacccgcaatgagcatagagtatttcttttctgaggggggtcgtctagagtgtccgtgaagggaacaggcacgcgaggctggtggaaaaagcgggtgctttgactcttagctggaagcgtcaacgggaagctactctaaagcgctttcgctttcactctggtcccggacagtgggggctggttaaatcaagaaagggggttggggatggtgcaaagagatgaggaaatggtgccctgggtgaagtagaacagcacttgggagaaggaaatataggcacttattgagaaggaccaactcatcacacagacttttgataaacttgccactgggcaactcttagcccaagcactgataatgggcgttctgtgttaactagtgatgcccttccctagcttgacccaggaaggcctctccttggcccagatgctgccttactcccttccctgtgtcttccctgcccactcccatgtgcccactggggggactttgcttaggatgggcgcctggggcagatggcagccccaagactggctggctggcttctgctctggactactgccaccactcgtggcttgggggcggctttgttagagaggaatagcctctaacttgaagttaaccctgttctttgaccctctattcatgataagtcggtccgtcggaaagcatactcagaggagcgtcctttggggccagagtaacttacggcctggtaagaaagacacagtgaaaccacttataatttgggaaatctcccctcactgccaaatgagcagtggcaagtaggaagtagaagtggaaacaagggataagagttagacctgaattttagtcccaggtctactattaactctgtgtgactttgcataagtcgtttgcattttctgtgacttggtttcctcatttgaaccgaggatctttaaggctccttccaactcaatagtagaataaatgtagctttatcttccctcacttcttcttgattcttttcttgacctggaaaagtcagcttaaacttctcagtcaaattatctcttggtacaaatttacctccctggctgctgagatatgtatttacctcttgatcggaaattccataactgaaacttttattttcaaccatctgtatgtgttccttgctgcttctctcctgccttgcccctggccatgctaaccactgccctcctcgattttttccaatgttcagtaaattggaagagctcacttctgatgaaatggggggtgagagtggaggattgtggaccaaaaaaaaaaaaatagactgaccttgtttcccaagatcatagtcaattactctgtgttgggtctacaccacatctgcacatactatgagcccttccgttggagataattttcacttgcggagctgcttcacttctacctgtaggagcctcatctccacctctctacagtggagaggattccactaggcaagttggaacttagggacacagttctttctgtgttgtatcacagctgggctgtggcattcccctgcagccggatgaagcaatagagaaagtggaaagatgaagggaaaaaaagcctgtactgacagtcagctctggcctgttactgtgtaatctttgagccagtcacttcgcctctctgggaatgtttcttcttctctaacatgagggcatcaaggctgttcttgccctgacattccatattctgtgtctctgcagaccaccatcatggcagtggagtttgacgggggcgttgtgatgggttctgattcccgagtgtctgcagggtgagtaaaagtgaagatgtatgcatttggaaagaagctaatggcctcaaatacacactttccttacccattcatgaaaagactggcaaactggagccttggaggaatggagttgaccttccccaaaagccactatgataagctatttggtgggtgcttgggtctctgaatttgtggaggaggatctggggtctgaatgtgtatgtgacctgtcccagtagtgtacagggatgagtaaaggaatagggtctgagagggggacaggagatagatttttgagggtcttctttccatctgtgcttagggatcaaaaagatgattctgtcaagcagatacctggtttctcatttaccatatattgaactattttgtctcttctcccactcctaaccaatttcctcacatgcaaaatgagtatatggggttaggtcaatattactgacattatgttccatagaacataactctctcaagattgttaatagcaaagaaaattgatgaggcatatttttcttaccttagcattttttgctttgttataaaatctaagcctgaaaaataagcctaattttgattaacatctgcagtgattaataatatctgagatgattatttgcctcctgctttaatccaagcattaaacttcatgctattctcttgtcaaagaaatttgagagacattgaatgatcaccctcaaaaattcctgagttctggttgggtgcagtggctcacatctataatctcagcactttgggatgccgaggtgggcagatatttgaggtcaggagtttgagaccagcctggccaacatgttgggaccttgtctctactgaaaatacaaacattagctgggcttggtggtgggtgcctgtaatcccagctattcgggaggctgaggcaggagaatcacttgaaccagggaggcgaagtttgcagtgagcccaagattgatccactgcactccagcctgggtgacagagtgagactgtctcaaaaaaaaaaaaaaaaaaaaaaacctgagttttaacttggtgactgttgactccctcctgacagcgaggcggtggtgaaccgagtgtttgacaagctgtccccgctgcacgagcgcatctactgtgcactctctggttcagctgctgatgcccaagccgtggccgacatggccgcctaccagctggagctccatgggtatgaagctctggagttctgactccccacccactagagctcccccaacctgcatgaatccctgtacagtgtgctgttccaggagctggacactgggaaatggaaaagtcttgtttcggctcttgctggcacttgaatctgtcagtttctgcatctgtaaagtggagataatatagtacctcatgagacggttattttgagaaccacattctatatgtgaacacagtttaaaagctgtaaatcactatcctgatataaataatcaggaagaaggtgatattgtgacccaccataatatcaggcagttaccatacgagaaatcaaggtcgttgggacggaagtaaccttatctgcttttccccataagagcagggtccttgcagccaaaagaaagttatgtgggtggggctgagcaaaagagtgagcaattgaaagcttcttaccagttggtggtgtgggactctggttcccctgtacatgtgggagggaggctgcagtttgagctattgcagttacagttttcaggggtcgtttagcagggatgatggtaacagtataggagaatgagacttaaaattctatcaacctttattcctaatatttccctcaggatagaactggaggaacctccacttgttttggctgctgcaaatgtggtgagaaatatcagctataaatatcgagaggacttgtctgcacatctcatggtagctggctgggaccaacgtgaaggaggtcaggtgagtttctcccaaagcactctctcctctgggcttccccactctcctgcagaggaagatggaagtcctatgtcattctagcaatgagttccaaggacactacctctgaaagcatagtactttggggatatgagataccagggcttcattgcagggtgcagagaccacttaatgtctcagtgggaaggaagggcttgatgattctttaacctgaggatccctttcccaggtatatggaaccctgggaggaatgctgactcgacagccttttgccattggtggctccggcagcacctttatctatggttatgtggatgcagcatataagccaggcatgtctcccgaggagtgcaggcgcttcaccacagacggtaaccagccaagtggaagggtacctggggagggctttgaaacatgggaaggaagtagattatgaggaacaggaagagaaatacaggggtggccatttaagttaatgccgggcctggtacacttttaagagtgaaaaggggcaggacaaatgcaaagctcaatggggttcttgggcaatacggataaaccagggctgttctgagtaaatcaaatgaggatacacagtcactgtgagaaccagtggtgtgctaagcacagtggctcacacctgtaatgccaacaatttgggaggctgaggcaggaggattacttgagcccaggagtttgaggccagcctaggcaagatggtgaaaccctgtctccacaaaaaacaataaaaaaaagtaaaaaaaaaaatgaactgggcatagtggtgcacacctgtagtcccagctactcaggaggctgaggtggaaagatcatctgagccggggagatcaaggctgtagtgagcggtgattgcaccactgcgctgcagcctaggtgacagagagagaccctgtctggagaaaaaaaaaaaaaaaaagaaccagtggtgtgctgaggtgtgctgaggctggcttgggaccactcatgagagcggactgttaaatagtcaaggatttgtgaactgcttagctatttgtaacttgcaattcatcatagcgggagcatttacaccacggacatcagcagatgccacatatggaagcctttttgtaaaaaaactgatttaccagcacaccactaaatatgccttcctggaagatgagttttgaggtgaaagtggtagtaggcatatggatggagggggagtaaaaagatttttgaagctaagccatcctctctctccctctctccaacttgaaaccctctgcagctattgctctggccatgagccgggatggctcaagcgggggtgtcatctacctggtcactattacagctgccggtgtggaccatcgagtcatcttgggcaatgaactgccaaaattctatgatgagtgaaccttccccagacttctctttcttattttgtaataaactctctagggccaaaacctggtatggtcattgggaaatgagtgctcagggagatggagcttaggggaggtgggtgcttccctcctagatgtcagcatacactctttcttcttttgtcccaggtctaaaacatctttcctagagaaaacaaaagggactaaactagaaatataaagagccctatacatgacaggtgatcacgtactgaatgattttgaagtagtacaaacaataaaaattctcattccgcatcatcatgcggtccatgatgatgaggccgcaagtgaggtgatgggactctttcctttaaggctaagactgacagataggcaagacacctacacacatgagaattagctaagactatcagcaaactcgcatgtaaaagaattcctttcataatgcattcattcatattaaagggcaatacatgaaaaatgcttaaatattttggggcacttgtgaatttcaaagaataatgacaataaccaaaagaagctacatttgtggcattggctaaatgttttataaattttatctcttaaaattcaaaccaaaaaaccccctgtattcacacctgtaatcccagcactttgggaggtcaaggcgggaggattgcttgagcccaggagttagtgaccagcctgggcaacatagtgagaaccccatctctacaaaaaaatttaaaaattagtcgggtgcggtggtgcatgcctgtagtcccagctgcctgggaggctgagtgggaggatcgcttaggcctgggagtttgaggctacagtgagctgtgattgcgccactgcactctagcgtgggtgacagagaaagaccctatcttaagaaaaaaaaaagaaaagaaaaagaaaaaacaaacaaaaaaaacacccaaccctatataggtattattattacttctataggacacatagaggtttggaaagattaaatcacttgaccaaggtcacaaaataagttctgaggctgggatctgggattcagtcttattatatgcccttcctctaccactccctaaaacttctcattccctcaatccccatatatcatcttaaaatctgcaataaatagccccatacattcgttggcacttaggaaactgttaccagatggctgagtaactgtattaaaacaaatttaattctgcttctatctttgccttgcacttcctgagtgacaggagtgaactctcatatccttttctgtcaaaagatggtgctgaatgatttctaaggtagtttacagttccaacattcaatgccattttgctaacaagtgggcagtcaacaggcatattcaacagaaatactagtaggatctcaggctaaacatacgaattcaaaactctaaaacaatcacatccccctggagtgtaaagaaaaaaatctaaaattacaaatgcctggagttgtttctagccatgatatttaacttatttgagattttaaatagcccatttttcccactgatcacaagtagaaattctgggcagtatacaaaaagcaagtactcaaggactccaaaaagtaaacaaaagcaggtggattgtgaagagggtcaaaactgggagaggggcccctcctggggagtgggttttcaatgttttccccttttttcctcccagctctgccctgacgtcaggcctcaggtgcagagctgcactgcgtggtagcacaagccctgagttaacaagagaaataccggctttctggccagaggaatgaagaaaaagggcccctgcgggcaggaatgtgtaggggaatctccaaactgagagtacaggcggaaattccctaattctgagtctgaaccctcaggagtaccaggttacccctgagctgcacatgcgtgtgacatgccttaagggcacagcaaagactttgagaactgaatgaagattagatcttttaaaattggaagacttcggccaggcgcggtggctcgtgcctgtaattccagaactttgggaggccaaggcgggtggttcacctgaggtcaggagttcgtgaccagtctggccaacatggtgaaacctcatctctacttaaaatacaaaaattagctgggcatggtgcctgtaatcccagctactcgggaggctgaggcagggagaatcgcttgaacccgggaggcaaaggtggcagtgagccaagattgcgccattgcactccacctggacgacaagagagaaattccatctcaaaaaaaaaaaaaaaaaaaaaaattagaagacttcatttttctgtattggccaaataactgttctaatgcccttcattccaataaaaggtttgtagcagcttacagagataatttaaaacaatttttaaaagaagaaaacaacactgggtcagagagaaaatatggttaagaaaagtaagtgaagccaaggagtgaaactaatggaaactaatggacaacgtgaatatcttaaaaaaaaaaaaaagtggtgcgctgtcttatactggctagcaagagcagattgcaaagtattcaggatttttgaagacagttgttaactattggtaacttgatattgaccactatggaagtatttatactatagaaatcagcaatgctacaagtcagaagcattgtttttcttcagagagccggtttaacaggacacatatttatcagccaactataaatggataaaaaataattggctccaggccataggatagtgaaagcaaagaaggaaataaaatgaggtacaagattcataaaattcattttttaaaagttgccagaaaaccaaaaattatatataatagttcaagccacacagaacatttactcaaataggacatgcatcattccataaaggtaacgccaataaattccagagtatcggtatcttagaaactatctatattctaggccaggagcagtggctcatgcctgtaatcccaacattttgggaggtcaaggtgggcagatccctagagcccaggagtttgagaccagcctgggcaacatggcaaaaccccgtctctacaaaaaatttagctggatggggtgcacctgtaatcccaactagtcagaaggctagacgggaggatcgcttgaacccaggaggcagaggttgcagtgagctgagattgtgccactgccctccagcctgggcaacagagtaagacactgtcttaaaaaaaaaaaaaaaaaaaaagaaaaagaaagaaagaaactatattctgcaaccatactgtaataaaattagaacttgataactaaaatatacttaaaattgtaagtgaacaaatatatttatcagtaacatggatttaaaaggcagtcgtggatgggagcatcgctggagtccagaagatggaggctgcagtgaggcatgattgcgtcactgcactccagcctcagcaatagagtgggaccctgtgtcaaataaataaacagcagttataaagaaaattaactcttttagaaccaggtgttaaaaatgttacacataaaatatacatataaaataatattataatttcaaatacatttattagaacaagaaaagttaaaataaaggacctagaaattctactcaaaaatttggaaaaagagaagttgagcaaacctaaagaaatacgaagaaaaggagttataaagataagaatagaaagcaatgaaacagaaatagagaacaaaaaactaggtagtgaaaattaacatacttttgattccaaaagctgcttacttaaaaatatttgtaagatattcagagttacaacaaggccgattatggataaagggagaaaaaatgaataaacaaatacataatgaaaaagggggaacagctacagatatgacacagatataaagcatagagtgttatgaacaagtatatgctaataaatttgaaaacctaggtgagataagcaaattcctagaaacatttaatctatcaaaattagcacaaaaagaaatacaaaacttgactataccaatgagtattaaagcaatttttaaagttatcaatggcatctaataaaaaaatatatttttgaaaatgcccagatggtttcacagatgagttctatcaaacattcaaggaacatgaaacttctatattatatactttttccagaaaacagaaaaaaactaaacctgattagctaattttatcagccgagtgtaatcttgactccaaattgagttgtggaaaactcaaggaaaaaaaaataatagacccatttcaccttgaacacagatgggagaaaaaaataattatttatgaaccgaattcaacaatattacaaataataatactgggaggccgaggtgggaggatcgcctgaggccaggagttcaagaccagcattgtcaacatactgagatcctgtgagatcctgtctctacaaaaaattaaaaaattagcc

SEQ ID NO: 1188 - DNA, 20900 bp, Homo sapiens
acaacactagtgggagaattcaacaccccacagacagcattagacagatgatcaagacagaaaactgacaaaggtactcagaatctgaactaaacacttgaccaaacgaacctaatagaccaccacagaacagttcaccccaaaagaacagaacacacattcttctcatctgtacatggcatgtaatctaaaatgaaccacacaatctaacataaaacaattcctagcaaatacaaaacaacaaaaaatataccagtcacgttcttggaccacagccctataaaaatgtaagtaaatactaagacaatagcttaaaaccatataattacatggaaattaaacaaccctctcctgaatgaattttgggtacatatgaaattaaggcagaaaccaagaaattctttgaaactaatgagaaaaaagatacaacataccagaatttctgggatatagctaaggcagtgttaagaggaaagtttgtagcactaaatgcccacattgaaaagttagaaagatctcaaattaacaacctaacatcccaacaaaaagacctagacaaccatgagcaaaccaatgccaaagctaacagaagacaaggaataaccaacatcagagctgaagtgaaggaaattgcaatgcataaaatcatacaaaagatcagtgggctgaggagttttttttttttaaattaagatagatagaacactagccacaatgataaagaaaaaagagagaatatacaaatgaacactttcagaaatgacaaaggggacattaccactgaccccactgaaatgcaaacaaccttcacaaactactatcaacacctctatgcatacaagctagaaaacctagaagaaatgcataaattcccgggcatatacaacctccaagactgaactaagaagaaattgcatccctaaataaaccgatgatgagttccaaaattgaatcagtaataagaagcctgccaaccaaaaaaagcccaggaccagacagattcacagctgaattctatcaaatgtataacaaagcactggtatgatttatacagaacctattctaagaaactgaggaaaagggactcctccataactcattctataaagccagcagcaccctaatacctaaacttttcagagacacaacaaaaaatagaaaacttcagaccaatatccttaataaacacagatgaaaaagtactcaaaaaatactagcaaactgaatccagcagcacatcaaaaagctaatccaccataatcaagtaggctttatcactaacatacaaggttgtttcagcatatgcagatcaataagtgtgcttcatcacataagcagaactaattaacgaaaatcgcattatcatctcgatagatgcagaaaaggctttcaataaattcaacatctcttcatattaaaaactctcaacaaactaggaattgaaggtatatacttcacaataataagcaccacctatgacaaacaaagccacatcataccgaatgagcaaaactggaagtattcccctggaagataggaacaagacaaggatatcttccctcaccactcttaatcaattactggaagtcctggccaaagcaatcaggcaacagaaagaaataaaagtcatctaagtaggaagagaagaagtcaaactatccctgtttgcagacaatgtaatcctatacctagaaatcccaacagtatttgcccaaaatctccttgatcttacaaacaaactcagcaaattctcaggatacaaaaatcaatgtacaaaaattagtaacattcctatatatcaacaacatccaaacagagacaaataaagaaagcaatccctttcacaatagcagcaaaggaatacaacatatagaggaatacagctgaccagggaggtgaaatatcgctacaaagagtattacaaaacattgctcacagaaatcaaatatgacacagacaagtggaaaaagattccgagctcatggatagaaagaatcaatactgctaaaatgcccatgctgcctaaagcaatttacagattcagtgctatttctgacaaactaccagtgacattcttcaccaaagtagaaaaaaactattttaaagttcatatggaataaaaaaaaaaaaaagaaagagcccaaatagccatggcaatcccaaggaaaaagaacaagctggaggcacattacctaactttgaaccacactgcaaggcaacagtaaccaaagcagcatggcaatggtacaaaaacaggcacatagaccaaggaaatggaatagagagcccagaaataatgccacccacctacagccatctgatcttcaacaaagttaagaaaaacaagcaatggggacagaccccctattcaacaaataatgctgagataactggctagtcacatgcagaagattcaaactggatactttcctaatacatatacaaaaatcaaagcaagctggattaaatactaaaatgtaaaacctaaaactgtaaaaagaaaaataacacctgaaaaataacctaggaaatacctttctggacataggacctggcaaagagttcatgacaaagatgccaaaagcaattgcaacaaaaacagaaattgataaatgaaacttaattaaactaaagagtttctgcacaagaaaagaaattatcaacagagtaaacagacaacctgcagaatgggagaaaatattttgctaactatgcatctgacaaagtcctattcagaatctataaggaacttgattttgcgagcaaaaaacaaacacctccatttaaaaatgaataaaaggcatagacaattttcaagtgaagacatacacacagccaacaagcatatgaaaaaatgctcaatatgaatgaatcattaaagaaatgcaaatcaaaaccacaacgagataacctctcacacccctcagaatgcctattacaaaacaaacaaacaaacaaacaaacaaacaaaaacagactctgtcaaggttgtgatgaaagggaatgcttttatactgctggtgggaatgtaaaacagaaacagcaaagcaagtaccacatgttctcacttacaagtgggagctaaacattaaatacatatggacacaaagaagggagctacagacaccagggcccacttgaagacggagggcaggaggggggtgaggatcaaaaagttacctatcaggtactctgcttatcaccccagtgatgaaataatctatacagcaagttcccatgccatgcaatttacttatataacaaacctgcacatatacctctgaacctaaaataaaatctaaaaaaaatttaaaactgcagagagaagtgagatttctctttaaataaggcaggattgatttagtgatttagtgatatttgaggagtggtagtgtttagtgttgatatctgagaaagagcattccaagaagaaaggacacaagtatgaagtccctgaggcaatgcttggcatattcaagaagtgacacaaaggccaatgttgctagcatgggatgagccaggtgtgttttaggacagacaggcagacaaaaacagatcattcaaatgattataggacttcgtaaggattttggccttactctgaatgagttgagaagccactgaaaaatctggagcagaagaacagcatgatcaaatttgcacttttgcaggctctctctggctgctacattgagaatacatcaggggaatgtgcagaactagaaaaaattattaggagttgatagcaattatcttggcaagaaatgcagaaatttagatgagtatggcagaagtgacgacaagggattggattctgtatgtttttgaagacagagtctataaaatttgctgagatgagatgtgaaggagagaaaacgtggactctatgttttttgtctaaatatctgaaagtctgaagtcttcattaacaaaaggaaagactgtaggagaaacagatttggggatggaaggaaagatgagtaatttggtttagacaacttagttctaagttcttgtcagacatccaaatgaagatgtcaaatatgctattagagaaaggattctggagaccagggttgggttctgagctgaaggattaaatgttcacatcatcagcacacagaaagtaaggccatgaccagatgaacttacctaaaaagtaagagccaaaagagaaagaaaaaacataaatttagacccttattttataccacacacaaaaattaactcataattcattgatcatggagcaaaaacttaagaactatgattactgcgatactgagacactaactgtaccaaatgcaagaaataaaaaatgggttaatcaatcataattctatctatgtatttctttacttagatcattatgtccataatgattatcccctgcctatcaatctatcaatatttacattgctattttaaataaaactaaattagatactgagtcactatcactctgaataggcagaaactcaagtgaaaacattattgatcctcccacattctccctagatttttggtcatgttacttttaaatgtaactgacatttgaagaaaaaagctttatataatgagaaatatgtaaatagatgtacataaataaataatatatataaatacatatgaataatcagccttattcctctctattgaaccatttggctacattatcagtaaggagactccatgagatcaccaacaaaacaagcccgattgattaaaggttgaagaactgagaccttgggcagtgtgatattttcaatttagagacaagagagaactagcaaaggagactgagaagtggtgcccagtaaataaggaaaaaatcaggagagggcagcatcctggaatgcaaataaactatattcagtactgctcacagagcatgcaacatgaagaccgaccattggcaacacagactccctggtgatcttccaaatgtcagattcaatgaagtggtgacaacagccttattgaaatgggttgataggccaatagttgaagaggcttcatactttgctaaataattataaaccaagagggggaaagagttgaaaaagctgattcctgaggtcagcctttaacattgaaaatggaaaaccctcagccagttctcagggctgagccaattcagagaagcagaattcaatgattgaagggaatcttaagtcctcttgatgatggacattgaaaatgcactgcaagaacactcaggatgtatcatatgttgctttctcaaagacctgtagctattccccagaaaacagtcctcagagaacagaacacacgtccatattatctgagacttttaagtttggagcctgaactaacactaatatctgggtaccccaaaagacacagtggtccatgggatacggtggcaaatttttacttctggattttttttttttttttttttttttttgaggtggagactcgctctgtcgcccaggctggagttcagtggcatgatctcagctcactgcaacctctgcctcccgggttcaagtgattctcatgcctcagcctcccaagtggcttggattacaggtgcaacaccaccacacctggctaatttttgtatttttagtagaggtggggtttcaccatgttggccaggctgatctcgaactcctgacctcaagtgatccaaccactcagccacccaaagtgctgggattacaggcatgagccaccgcaccaggccctttttgggcttttgtttgttgtttttgtttgtttctttttagagacaagatcttgcttgattgcccaggctggagtgcaatgacaccatcatagctcactgcaaactcgaattcctgggctaaagcaatcctcctgcctgagtcttctgggtagctgtaactacaggcacacactaccacaaacaactaatttttttttttttttttacagattcttactatgttgccaaggctgatctgaaactctcagcctaaagtgatcctcccacttcggcctcctaaattattaggattacaggtatgagctgcctcaataggactggagtatgagtttttgaagatcagatggtacatagagctttggcccatgtccaacccaaaggggttctaatgagttcatcgtagttaccccttcctgaaagtgtaattgaagttgacaggttcaacagctgtcaggactcttacatttcttcctgacctgtataccaagggacattattgtaagcaggaccaaggggaggcttctgaaattctactttcctggcaataaaatgaataaaacataataactgcattctccaggaaacagaattggtcgctgccacaacaaaaaactcaaaagttccagggggcggtcgtccattttatatctttattcagttaacctaactggcctctgtcaaaaccagatggattataggatgaatgcacattagcataaacttaagtcacacttgcacattcgctctaggatgtggtatcttcactgagcagaatgtggtttccagcactttgtatgcggcttttgatttagctaatgctttttaatctacacacattgtggaggaaaatcaaaacaatttgctttggtgtggtaaaaacaagaacactgcttcactgttttctgtcagggctgtcacttctgctttcagtttaattgacattttgcaaaacatcatgttaattcaatatattaataatattacataaagtggtacccataagcaggaagtggcaagttccttaagtatagtaaaatattataacattgaacagaagtaaaatactggaagaagagacataaacttcagcagattcaaagacctataacatagatgaagtttataggggtccaatgcttctggtccttttgtcaaaacatcctttttacagtaaatggcatgttgccctatatatatatacttcctatcactaaaagggaaatacagttttatgggggcttattggggttttgaattcaacatataccacatttaaggatatttctctgactcactaaaggagtttgcaagggctgcttgtctcaagtcaaacccgaaacaaaaacgggctctatagcagatatagagtctggcccaagttgcttggccattgtgccagatgatgtaacagaattcaaagttgctacaggcatgcatagtgggcattataggactctgtgcatgcctctcacaagcccataggagtggggagagcaaactcctagcgaattagtggaagactattccttctccagcagaggactaccttctgtctgaaaaacaaaacagcaagtgcagaagattaatccaagcataaagcccctctaagcataagcacttctaagcacaagaccctgtgcaactgtgaagtcatatgcctataaagccagccatgattggagggcatgagccaatctgagttgcacaaggagtggacagtattgcccacaaacatatccttcctcagattatcttgactgtcttctcttttcttggtcagcaccttgcttgatccagatcatccttccatttgggacttcaatggaacaccacactgggggcatgaggtttggctttcataactaccaccaagggactggatgatggaacgcagaacagcagagatggtagttctgcctcagggaaaccctggccaatgggaaatagaagacagaagacagctgagcagatacattttctcttctctttctcttccgtggactaatgccggctgtggtttccccttgcagcccttctggaaaagtactgggagtcaagtccacgcatctgatgaccaccatgctgtctctctcatctcattgtgaagtggtcatcagcagagtcatatcatacatcacaagacatggtttcacatttgctttgcctcaatttccacatgtcctggccattgctgccctggacttatcttccaaataaatgttatcactttaacatcagacattggctctagttctagacacccaaggctaagatactcgtttagtgttataattgttatttatgcatttttctgtgggtttttaatatggcaatttaaatgttcatttagaaagggttttaaaatattctataaaagtcacgttttagtaaggtagttggtaactaactcagttttttttaatgaaatgccatttttgtttatacactaaccagctggaaatatcacaatacaaatatatcattcacaactgaaaaattgtatgcaaagata[450 bp omitted]acaaataactaaatcagatgtagagatgatttgtcccaaggtttagataatattgttaaaatttcataactccaagaattaatacagtttatagaatttaattgtttaatgatgttatacattttcttcctataatagaacttgctattactgaatatatcaacacactgtctcattgtattatttgcaactagattataatacaacatatattttagatgttttctatcattaatacatagatttcatagatgccattttaacatttgcaaaaagtttaattcaaatgatttttataatttctatactatttttacatagagtatttttctaaggtagggaagactcaagttcttttatgtgaagtttaaaaagaatttcaagtatggaagatagaggagatcattggcaattcagggactctgaggtggtttagaaaaaaaaacctgaaatacttgacatcagatctcaacttcaaaaaaggttttctttaactcaaaaactggaagaaatgacttttctaactgcatgttgagacttatgacaacataagtcatcacggtgtttctttcttcatccttattatagaaatgacttttttctcaaatgttcacatatttgtattaagtctattattcctcagtactgtttatggtagacatatacaaaatgtgttctaaatatatttgtcatccttgaatattattctgtgcatctttttctgaaaataattatgctggctataaactaaacataaaattagaattcatgatgaaataaaaactaccccaaagatgaaacctcattattgatttagaattgagtgtgcttactatcaaaaaatttagatgtttaagcacactgtggtacatatgtgtggtaaaaatcagtggaaaagagcaaagattttgagataatgtgtcacttcttaacaattataagtaaagatcacacagttttcaagtgaaacatgataatatgaaatgtatatgtgaaatatacatgggttcatgattctgaaaaacttcttaccatattttctataatttggcatcttgtgaaaatatgattaacattatgttattgtcaatgtcttttaagtctttcatatacagatgcacacacatagatacacttttagactaactttaggtaaaagacttttctaggtatgctttcagaaaatactcaaaaacatacactacagaaaaaacagtaaaaagtataaaatgttccagacactatcagtttgttttctcctagaatacacacacaatgtcccacttgtgaatctagagagttgagagtttcaggtcttttactcagcacctaatctgacacaaaatcaaaagaaaggtgtgttttagcttcttggttctccaaattaggatgaatgagtcgaatgcaagatatatgtttccaacagccttgctaaccatgacaaccgggtcattccgcagcctcctaggactccaaaccgaaacgattaggaatagaaagaaaatggcacataacaagaggaaggagatcagagtttgcaaagcttttatgtggaccttggtgctgagatcttgcgatccttctccatggagctgcatcttcttgagatgtttacacagagaacagattagcatcagaaaagatatcagggacagagtaaagggtatgaagctccatagggtagttacagtcaaatatgaaagatgtactgtattcctcaatttcatcttcccagtcatgtttccttcatattcttctgcccacatactctcatccatgtttgccacaagaagatgacaaaccaaaaatatcaaagtccccaacagtatcaccagaatgacactcctaactctcctctttaaatgaagaaaaagaaggttggagaaattggcaatcttgagcaaataaaatatgctgaggttagcagcaagccacatgctgaaatggttggttacaacccaggcattataagaagtaattcttaattctacactataaaaagctggattcaacacagttaaataccaatttaataataatgcccagagcaaaccaattctggagaccgccagagcagtgagaatttggtcagctgaggagatcttttttctcttcacccagtcaatgaaatttaccagtgctatgaagccattggcaaagtttccgagaacaaataaaaccattattagaattgaaaaaaaaatgtatagaaaagttatcatatctgagcagaaaaaaagaaagaaaatgcaagcctaatatcactggttgtgatttctttaatactctgaccttaaattttatgtgcatctgatttctgaatgtgcagtaacattctttttacttttaaacactgtgaccagtgtcaaacaagaaagtaccagcttatgctaatggatgagtttgatgtcatctttacggaaaacattcttattttcaaaacagctcaaattaactcattcattcaatgtccgttcttgtgatgggcttgaattattcataatgaagttgaagtgaaacctaaattttcatttaccagcatgcaaataaagacatattctctttcaatattttgcaatgttttccttgtttaaccgatacgtaatttgtgttcagcaacttcagctgttagatagggaaattttacccccgagtccatcgttcatacagtaaatgtctaagttctttaaaagaccttagtcataactaggatcaccaccataacggatttactatttatgctacatttaaacagacagaatccaaacttttaaatcaaaatcatccaaggttttcttgggaaccataagaagaccaaaacaccttaaaatctggttgctgctaacccaatacttttgtgtgaatttattgttaccatgttcataaatagatacaaacacagaaagagagagagagagagagagagagactgtgacacccctaagagatggaaggaattattttcttatactttccaaaatgggaagtaagtctcctggaggccatccacgtgaaattagtcctattttcccagtgaaaactgagggttttcagaccccccccaaaaaaatgtatcaaacatcaaacatatctttcatgcttaagcatttggtaaacttactctcaagtctatttaatgtttaagtatttattatttaattaaaatgttcaacaattttgtaaatattcctgagtaccacaccctatgacacataattttgcagtatcctcccaccataagcaggttgattatctgtcccctggactcggagctcactcacacaactttctttgatgaacagaaaattggtagatttcacaccgaggtttgagatggcttccatattggggtttcttgctcttttccattgatcatgagattatcacctggctagtacactgttttcagaatgagaatgaaaactaatggagtcagtttgcctgcacttgatccatcctaaattggccaaagtctaactagctccaagatgcagaacttggcccatctcaagtcaccagagctatccaccaaacccagcttagaaaacctgaatccaaagatatatgagataaaaatatctaacgtagttttggagggtttctctagtagaaaaacctaactggtacagctactatgctacaccaagagtgtggggaaatatatttgcccctgttttgtcaggaattcaggagccaaaagaaaaatagatggggagtggcaaagttttgtcatgtgaggtagataattaaaggtaataaaaaaatgtttgaaaggatttgtgtgctgcaggtagcatcatctgaaatttccatatgttgcagctaaaataaagttcctacttcaactctctaagagttgtataaaaatgtgtataaatggtgaattttttgcaaggtatacaatgagcagaataattaatattctttatggagcatttttccagttaataatttttaaatacaattataatgcacacttagaaatgggtgaaaactaagatggtaaacatagcaatgtgtcataaacactcatgcaaccatcaagcagggcaaaacatgtcacattgcaaatagcctaggtccacctccatgccactctccaagcccctacacctttcttcacataccctgaggagagcaatagccataatttagaatgatcatttccttgattttctttttttttgagacagagtctcgctctatcacccaggcaggagtgcagtggcgcgatctcagctcactgcaacctccacctcccgggttcaagcaattctcctccctcagccttccaagtagctgggactacaggcgcatgccaccacacccagctaactttttgtatttttagtacagacagggttttgccatgttggccaggttggtcttgaactcctgacctcaggtgatccacccgcctcggcctcccaaagtgctgggattacaggcgtgagccaccgcgcctggccttgattttctttatacattaacaactaggtatgcaaccctaaactctatgatacggttttacctactttaaacctttaagccatatgtaggtgtagtcctgtatgttcctgttcatggcttcttggactcacctttacgtttctgaaatttactcacatacttgcatctttatgtgattcatttcttttcacttctctatattattccattgtatgaatgtgttgtaatgattcattcatctttagttgatacatatttggggggtttcttttttgaagagttatgaataattctagtatgaccattctttcatatatcatttgattcatttcctttggatatatacatagaaagataattacagggtcatcaaatatagctttcaaattctcttcacagacatagaaaattccgaatttaaattaactaaattcactttttgatacctttacttacagactatatatggctatttctatatatcttattaaatacttaacccaaaaagacaccaccactttatacagtcaaaatttatttagacttatgcacatatttaccacttctattatttattattccttcatgcatgttcagctttatatttttagtaattttccttttatctaaaaaatattcttttgaatttctatttgttaaagtccgctatggttttgaaacacactgaagacatgattccattgaattctagcttcaattttgtctgttgaaaataagattgtcatttagacagttgtttctttttacataaagtttttcctctacctacttttcagattttcgattggtctttgatatcctgtggcatttgtttttaattggttttagttatctcatctaaattttaatggcttctgaaaatatacggatgtctcagaatagccaaagttatcctgagcaaaaagaacaaaactggaggaatcacatcacctgacttcaaagtatattacagagctatagtaaccaaaacagcatggtactggcataaaaacagacacatagagcagcgaaatagaatagagaatgtggaaacaaatccacacctatagagaactcatgacaaaggtgccaagaacatactctggggaaaggacagtctcttcactaaatggtgctgggaaaattggatatccatttgcagaaaaatgaaactagatgcctatttatcaccatatacaaagatcaaatcaaggaggcctcaatgattcagtgatgtttgatgagtgatagtgtttagtgttgatttctgagaaagagcattccgagaagaagggacacaagtacgaagtccctgaggcaattcttggtacattcaagaaattacacaaagtccagtgttgctagcatgggatagccaggcattttaggacagacaggcagacaaaatccgatcattcaaatgattataggactttgtaaggattttggccttactctaatgagatgagaagccactgaaaaatctaaagctgaagaatggcatgatcaaatttgcatcttcataggctctctttggctgctatcttgagagtacatcaggagaaaatgatgtgcagaactagaaagaataattaggagttgatggcaattatcttggctaggtatggcagcagtttagatgagtatggcaaaagtgatgacaagggattggattctgtatgtttttgagggtagaaccaacaagagggtagaaccaacaaaatttgctgatgccttagagatgagttctgaaagagagaaaatgttaactccgtgtttttggtctaagcatctgaaagactgaagtggtcattaacagaagagggaaaggctatagaagaaacaacgctggagactagagggaagatcactattttgatttggacatgttagttcaagttcttgttacgacatccaaatgaagatgtcaaatgacttcttagagaaaggattctagagaccaggattgacttctgagctgaagaattaaatattggcatcaacagcacacagaaagtaactaaggttatgactagatgaacttacctaagaagtgggagtaaaaacagaatgataaaaacatgagtgtagaccattatttcataccatatataaaaattaactcataattaattgatcatagagaaaaatataaaaacagattactgagatactaagacattaactgtaccaagtacaataagtcaaaatgggttaatcaatcattattctatctgtatatttccttacttatatcatttttttctataatgataatcccctgcctatcaatctacatggctattttaaataaaacttaattagctatctggtcaccatcactctgatttagcagaaattcaagtaaaaacattattgatgctccgaccttctccatagatttttagtattgtgacttttaaatgtaactttgacatttgaaaaaaagggttacataatttgatatatgtaactatatgtatataaataaataacatatatgaataatcagccttattcctctctattgaaccatgtggctacattatctgtaaggagactgcatgagatcaccaaaaaaaccagacataattgattagagattgaagaatttagaccttgggcaatctgatattttcagtttacagacaagaggaagaactagcaaaggagactaagaaattgtgccagtgaacaaggataaaatcaggagagggcagcatcctgaaatgcaaataaaccaggttcagtgctgctcatagagcatgcaacatgaaaactaaccattggcaacacagacttatcggtgatcttgcaaatgtcagatttaatggagtggtgacagtaacagcctcatttaaatgggttgatggaccgatagttgaagaggcctcatactttgctaaataattataaaccaagaggggacaagagttgcaaaagctgactcctgaggtcagcctttgacattgaaaatcaaaaacccttagccagttctctggactgagccagttcagagaagcagagttcaatgattgaaggaaagcttacatgccctcggtaaacaacactgaagattcaccacaaaaatattcaggaaatattcacttgaccctttctcaagcacctgtagccatttcacctgtagccataacagtacccagaggaaaggacatatatccatactctcagaattttaaacatggggcctgaactaacactaataatatttgagaactaaaaaaagacactgtgtttcacagaatggagtgggaggctttgttttcggttgttcgtttttttttgtttttagagacagagtcttgtttggttgcccaggctagagtgcagcccaggctggagtgaaatggcacaatcatagcttactgcagactcaaattcctgggctaaactgatccccctgccagaacttcctgggtagttggaactacaggcacgcagtactacaatcagtttattttctttaacaaacagggtcttgctgtcttgcccaggctgatctggaactcctggcctcaagtgctcctcccacctcagcctcccaaattgtttggattacaggtgtgagccacctcaccagtcctggagtatgagtttttgaaagtcagatgctgcataaagctttggctcatgttcaacctaaggtggatgtaatgggtttatatttattatctcttccagaatgttaaatgaaattaacagtttcaacagctagcagaactctcacattgcttccagacctgtatattaagggacattactgtaagtaggaccaaaaagagtcctcggtaattctcctcttctggcaagaaaatgagtaaaacatactaaccgcattgtccaaggaatagaattggtcaccgacatgacaaaaaactcaaaagttccaggaggtggttgtccatttttgatccctattctgttaacctatctggcttctgccaaagccagatggattatcagatgaatgcacattagcataaacttaaatcacacttgcagatgctctctaggatgtggtaccttcactgagaaaacatggtttctggttctttgtatgaggcgtttgatttggtgaatgctttttaatctacatcgattgggagagaaaatcaaaatgatttgttttggtgaggtaagaacaaaagcactgcttcactgttttatgtcatggctacgtcacttctgttttcagtttaattggcattttgcaaaacatcatgctaactcaatatattaataatattgcattaactgttacccataagcaggaagtgatgagtttctcaaatatagtaaaataccataacattgaacagaactaaataccagaagaagaaagatgaacaagaagattcagtgacctataacatagatgatgattttaggggtccagtgctcctagtccacatgctgaaacacccttttaaagtaaacagcatgttgctctctatacatctatttcctgtcactaaaaatgagacacaatatttgttgggcctactgggatttgggagccaacgtattccacatttgaggatactgctctgattcactaatgaagttgccaaaggctactggtctcaagtggaactagaacaaaaaatgcctctagcaaatgtaggctctagtccaagctgctgtgctcattgtgacagataatccagcagaattcaaacccgctagaggcatgcatgcatagtgggcattataagactctgtgcatgcttctcacaagcccacaggagaggggagagcaaacccctagccaattagtgcaagaccattccctctttagcagaggagtgccctctgtctcaaaaacaaaacagcaggtgcagaaaattaacccatgtataaagcccttctaagcgtgtgcgtctctaagcacaagaccctgtgcaacagtggaaattatatgctcatagtcagccatgattggagggcatgagcacatctgaatggcacaaggagtggactgcatgggacacaaacatgtgcttcctcagatttacttgactgtctcctattcccctggtcagcaccttgcctgacccacatcacccttccatttgggacttgaatggatcaccacattgtgggcatgaggtctgactttcataacctccatcaagggattggatgatggaaagcagaacagcagagatggtagttctgcctcagggaaaccctggccagtgggaaatagaagacagaagacagctgagcagatatattctccgtcctctgttgcttccatgggctaatgctggctgtgttgtcctctcgcagcccttctgaaaaagtcctgggagccaagtgcatgcatctgataaccaccatgctgtctctctcacatcattgtgaagtggtcgtcagcagagtcatatcacacattacagcacatagtgtcacatcttctcttgactcaatttccacatgtcccagccatttctgcagtggacctccttccaaataaatgtcatcactttaatatcagacatttgctctacttctagacccctgataagatattcattcagtgttataattattattcattcatttttccatcagtttataatatggtgattaaagtggtcatttagaaaggatattaaaaatactaaataaagattatattttagtaagatagttggtaactaaattttttaaatgaaatgtcatttttgtttatataataaccagctagaaataccacaatataaatatatcattcgcaatagaaaagatatgtgcacttatacaaaaatcttttatatgcttagtaaaaagtattgtaataaatgccatctttttattttccactttgtctttgtgtcacacatctgatatagctgcatcactgctatattatagtgatatttcccctagaattgtggaatagccaaacttttgctctgagaaattcttcttcttcttggataatcctgtaacttcaatctgaaaccagaacagaaatgtgcacccaactgtagattttgtgatgtgttacattttcattggttcaccaccccaatatagttcatattcattcattcaccaattaacttgttcatcaaagtatcatttttcaatacctattctatgtgctatctttatgtcttgggagtctacagtaagcaagatctatatgatctctacttttatggtatttacattgtaccaggtaagatatatgataaacaaacaaatcagatgtggagatgatttatcttaaggtttagataatattgttaaaattgcataacaccagaaattaatacagtcacacagaatttagctgttgaactaggttatacattttcttcttgtaatagaacttgctattagtgaatatgtcaacacactttctctcatttcattatttacaccaagattataataaaacatatctttaagacatttcctatcattaatatatagatttcatagatgccatagtttctataccctctttagattgagcttctttttaaagtaaggaaaatttgagctttttgaggaattttaaggatggaagataaaggaggaaattgacaattcaggagctcagaggtggcttagacaaaaaactgaaatatataacatcagatctcaacttcaaaaaggtttttgtttaattcaaaaactggaagagatgacttttctaattgcgtatggaaacttataacagcactgaaaagagctcatgatcatgtttcttcatcctttttatagaaatgattttttctaagctattaacatactatattaaatataatattcctcagtattgcttttgatacacataaaaatgtacactagatatatttttcacccttgaattttattttgtgcattgttatctaacaataattgtatttgctttatattaaacataaaataagaattcatcatgaatgtctataatcccagcactttgggaggctgaggcagtggatcacttgaggtcaagagttcgagaccagcctggccagcatggtgaaaccccatctctactaaaaaaaaaaagaaaaatacaaaaaattagccacgtgtggtagcgcatgcctggagtcccagccactcaggaggctgacgcatggaaatcacttgaaccccagaggtgaacgttgtggtgagccaagattgtgctactgcattccagcctggacaacagggcaagactccatctcaaaaaaaagaaaaaaagaattcatgattaaaaaaaaaacaaaaaaacctaccccaaagacacattctcatcgatttagaattaaatgtccttaccatccaaaaaattagaggttcaaacaatgatagttaaacagttaaacacactatggtacatatacgtgatacaaattacaacgaaaaacagcaatgattttacaacgaaaaacagcaatgattttctgatataagctgtcagttcttaattataaatagagatcataaattcctcaaatgaaatatcatataaaaaaatgtgtgaaatacacatgggttcataattctgagaaatttcttatcctactttggtataactgaacagtttatatgaaaagttgattaaaggtatgttatggtaaatattaaattttcatatacattcagacatacacacacacgcaaatgtatattatatatatatacttttatataataaacttaggtaaaagacttttctatgtcaacttttggaaattactcaaatacatagactac

SEQ ID NO: 1189 - DNA, 29740 bp, Homo sapiens
ctcctgacctcgtgatccacctgcctcggcctcccaaagtactgggattacaggcgtgagccaccgcacccggcccagtttatttattcatgtggagaggggatctcactatgttgtccaggctggtcttgaactcctggtctcaagggatcctcacaaagtgctgggattacaggcatgagccactgtgactggctgagcttccagtttagtagaacattcagacgaaaaaaaaatatttattttttacttttacttattttttggtacagggccttgctcaagtgatccttctgcctcagcctcctgtgtagctgagaccacaggcgagggccaccatgcctcgctgacatttttttttttttttttttggtagagacagggtcttcctatgttgcccaggttggtcttgaacacctggactcaattgatcctccttcctcggcctcccacagtgctgggattgcagacgtgagtcactgggtccagcttcccaaagcatatttaaaatgctatttgataaatgctagcctaggcggagcatggtggctcacgcctgtaatcccagcactttgggaggccaaggtgggtggatcatttgaggtcaggagtttgagatcagcctgtccaacgtggcaaaaccccatctctactaaacatacagaattagctgcttggaaagctgaggcaggagaatcgcttgaacccaggaggtggaggttgcagtgagccaagatcgcaccattgcactccagcccgggcaacaagaacaaaactccatcttggaaaaaataaattaattaaacaaataagtaaaatgctatttgataaatgccagcttaagtaggggaggggaggtgtaagatgctatggcttttattcctagtctgcagcaaagaaaaaagaggtgttatgacaaccttaatcttgaagctgacctctaaaaatagggtaggtgctgttactcccagggcagtgttcacagatgctacagatgctcaataaatgtttgcatgaatgttgaatccagtgcaagctcttgtcctctttgcccccacccaattgcaggcaggtgtcacccacgcttgcagtatgcggagagggtcctgtagcagctgtttcaggacacagcttgggacagaaagcagattggtagtggctgttctcacctataaagaaactaatttccatgtgctccagagaaatgcctagctagccctgaacttgagacagcctctgattatgagtcagcctttcatgatcaagcaacatagggcaagcatatgtcatcttactggcgagggggccagaaatagcttctgcctgactgaggagtgcaaaagctgaaccagcatgtggagtgaaaagatgattctagaaataacgggatcaaaggtggcacatttgttgttcagacccagccgatccaaaataaccgcagattgcctaagcacctgctgtacgccctagcacagtggacactgcaggtgatgtgaagttgagtaagacacactccttgtccttggggtgaaggtgaggaaagcagtagaaaggcagaacatacgtgccaagagagaggccagcccttgagacttctccagttctgcccatagatccccctggttgaggcacacagcccctgtgtctgtctcacccttgtccaaatcctcccacgtgaggtttcttgtctgtagcttccttctcgtccacagcccagcgctcctcccagctgcacaggttccctgcacacatgtctcccccagctcacccagccagtcgtcttcctggggcaaagtcccagagacccccccaaccttgttttctccctacatttgtccacctagtcctacattccccacctcatcttccactggggctcggtctgtgtaagagagtgatcaaagtgggcacctaccacctattcctcatagcctacccaaatgctctgtgttgataccctttttttttctttttctttcttttttagacagagtttcgctcttgtcacccaggctggagtgcagtggcgcagtctcggctcaccgcaacctccgcctccctggttcaagccattctcctgcctcagccacctgagtagccgggattacaggcatgcgccaccacgcctggctaattttgtatttttagtagagacggggtttctccatgttggtcaggctggtctcgaactcccgacctcaggtgatccgcctgcctcgacttcccaaaatgctgggattataagcatgagccactgcgcccagcctcttttctttttttcccttaagacggagttttgcttttgtttcccaggctggagtgcagtagtgcgatcttggctcactgcaacctccgcctcctgggttccagtgattctcctgcttcagcctcctgagtagctgggactagaggtgcccaccaccacactcggctaattttttgtgtttttagtagaaacggagtttcaccatgttggccaggcttgcctcgagctcctgacctcaggtgatatacccacctcggcctcccaaagtgctgggattacaggcgtgagccaccacacccagcctgacaccattttcttaaaataataataataataataataataataataatcaggtccggcacggtggctcacacctgtaatcccagcactttgggaggccgaggctgttggatcagaaggtcaggagttcgagaccagcctggccaatatggtgaaaccccgtctctactaaagacacaaaaaattagctgggtgtggtggcgcgcgcctgtaatcccagctactagggaggctgaggcaggagaatcactttaacccaggaggcagaggttgcagtgagccgagattgtgccactgcactccagcttgggtgacagagcgagattctatctcaaaaagaaaaaaaaaatcacatcttgtcattttctaggtgaaaggcttgtgctagatgagatgccgaggtggatacagaggagccaccccagatctctgcattgggcgacctgcattcaagggctcagcttcctttctcactttgagtacaagctacagcggctgacaaggccccatccatccccaggcatcatcctgttaattctctgacctcacctcctacaactctacccgtgctgtctctgctccaaatccactggcctccttgctcgtctgaaagcacagtccagctcctgcttcaagtctctgcacttccgcttcctctactgcagcacccatcaaccatatatttacatggctccctcccttacctccttaaggtctttattcaaatgttatcttcttggccaggcacagtggctcacgcctgtaatcccagcactttggaaggccaaggtggacggatcacgaggtcaggacctcatgaggtcgagaccatcctggccaacatggtgaaaccccatttctactaaaaatacacaaattagccaggcatggtgatgcatgcctgtggccccagctacttgggaggctgaggcaggagaatcgctcgaatccgggaggcggaggttgcagtgagctgagattgcgccactgcactccagcctggtttggcaagagtgagactgtgtctcaaaaaacaaaaaagcaaatgttatcttctcaatgcagccctctccgcccaccctatctaagactgcggtatccatccccacacacacgctatatcctccttcccctatttatttctctccaaaacagtcatcaccactgtgatagttaatactgagtgtcaacttgattgggctgaaggatgcaaagtattgatcctgggtatgtctgtgagggtattgccaaaggagattaatgtttgagtcagtgggctgggaaaggtagacccacccttaatctgggtgggcaccatctaattagctgccagtgcagctagaatatgaagcaggcagaaaaaatgtgaatagactgtcctagcctcccagcctacatcttactcccgttccagatgcatcttgcccttgaacactggacaccaagttcttcagtttggggacttggactggctctccttgcttcttagtttgcagatggcttattttgggaccttgtgattgtgtgaattaatacttaataaactcccctttacatatatatatatatatatatatatatatatatatatatctcctattagttgtgtccctttagagaaccctgactaataaaaccacttaatatcctattttatttttctagccaggcgtggtgacccacacctgtaatcccagcactttgggagactggtcgggggggtggatcatttgaggttaggagttcaagaccagcctggccaacatgatgaaaccccatctctactaaaaattctaaaattagttaggtgtggtggcatgtgcctgtaatcccagctactagggagactgaggcaggagaatcacttgaacctgggaggtggaggctgcagtgagcagagatcgcaccactgcactccagcctgggagacagagtgagactctgtttcaaaaaaaaaaaaaaaaaaacaacaacacaaaaaagccagctgattagcaaccttaattccatctgctactgtaattccctgttggcatatcacccaacaaattcctgagttccaaggattaggatgtggatatcttcagggaatcattattctgttaccacatcatagaaatctgtccacactagtggaaaaacaaagcatatcatatatgtatacatatatgaatatatatacacacatatgtacatatatacaaattatatgtttaagagacggagtcttgctctcttgcccaggctgcagttcagtggcacaatcataagtcactgcagccttgaactcctgggcttaagtgaccctcctgcctcagcctcctgagtaactgggattataggtgcgcgctaacatgcttggctaatttttaaattttttttagagatggggggggggtctcactatgttacccagcctggtcttgaactcttggcctcaagcagtcctctcgccttagtctcccaaagtgctgagattgtaggaatcagccataaatgggattacaggcatgaacaaccatgcccagccacctagtgcttttgattacccagtaaaccacacagaatcctctgtttccagctggcagaaaagagagtatggagagcctcaggagggtttttgtttgtttattttattttatttttttgaaatggaatctctctctgccacccaggctggagtccagtggcacaatcttggctcactgcaatctctgcctcccgggttctgggttgaagggattctcttgcctcagcctctcaagtagctgggactacaggcgtgcacctccacgcccacctaattttcatatttttgtagagatggggttttgccatgttggccaggctggtctcaaactcctgacctcaggtgatctgcccgcctcagcctcccaaagtgctgggattacaggggtgagccaccgtggtttttagaggcagccctcaggagggtttttagaggcagccagagactcaacagatcacttctgcacacattccattggcctgaagtcatcaaagggtctcacctaactgcagggaagcctgggacatgtagtccagctttgtacctaggaaactgagaagcggagttggggaacatagcaatctttgccactgtgggcaagtccctggcagtcatgacacgctcagtgaattaacgtggggttgaggaaatttggggtgcagcacatcaagaaattcacttttgccctgggttcttttttgtttgctgttagttttgcttcttattctagagagatgccctaggttctagatcacaaaaggctaaaatatgcagggcagaggccattattatggtgaaataaagactcaagggccagagaccaacacagttattaccaacataattatcgccttccgtatcatcatcatcaactttatcattttgggggttgttgtttggttgatatttttcctgcctctgggctccaaaagcaactgaaacatacctgggctgtcaaacctactagctggctgggcacggtggctcatgcctataatcccagcactttgggaggccaagttgggccgatgactgcagcctcaacctctgagtctcaagcaatcctcccatctcagcctcctgagtagctgtgccaccatatgcccgactaatttttgtgttttttgtagagatggggtctccctgtttcccaagctgatctcaaactccggagggtttttgtttattttctttcatttttttgagatggagtctcctggactcaagtgaccctcctgcctcagcctcccaacgtgctatgattatagccgtgagccactgtgcccagctggcactcttttatttgtattttttcaagaggtggagtctcactctgttgctcaggctggagtgcagtggcatgatcatggctcactgcagcctccaactcctggactcaagtgatccccctgcctcagtctctcaagtagcccagtagctgggactacagaggtgtgacaccatgcccagctgattttaaatttttttgtagagatggggtctcaccacattactcaagatggtctcaaactcctagtctcaagtgatcctctcaccttggcctcccaaagcactgggattataatcatgagccaccctgcctagcccagttttggaattttgatcatctcctcactttggaaccattagtccctgggagaatcacactgaagtgtatgaactcacaagatgcagtgacttttgaaagtaatagaatgatttctgctgccaatgcaactgcgtggtggatgcacaagtggtggtcaaagtgagctcatttgctgttgggcaatcagtatacaggttcgtcttattagtcaacaaattgaaatagtggctactgtgtgctcacttgcatgggtgcaacagaaagagatacaagacgaatttctaacactataaactccctgccctcaaagagcttattttctggatggcaaggtcagaggctgtatggggtcacactaggaaccagctcgagctctgtactcagacccagagttgaattcctgcttgccacttaacttccacaaaccttggtttttccaatggggataataattgctacttcacaagagctgctatgaagtgaaagtgaaagagtatgtatcacgggaggctatcgttaatgctttcaatatatcatgttactgattttttctaagagacagggtctcaccgtgttgtccaggctgtgatcatagctcattgcagctttgaactcctgggctcaagcaatcctcccactgcagcctccagagaggctgggactacaaatgtccatcaccatgccccaatttgtgcgtgtgtttgtgtatagacaggggtttcagtatgttgctcgggctggtcttgaactcctggctccaagtaatgcccctgcctcggcctcccaaagtgtcaggattactggtgtgagctaccactcccagtacctgttatttaattaatgaattttaagttccagggtccatgtgcaggatgtgcaggtttgttacataggtaaatgtgtgccatggtgatttgctgcacctatcaacccatcacctaggtattaagcccagcatgcattagctattcttcctgatgctctccctcccccaacaggcctcagtgtgtgttgcctcctctctgtgtctatgtgttctcattgttcagctcccacttataagtgagaacatgcagtgtttggttttctgttcttgggttagtttgctaaggataatgacctccagctccattcatgtccctgcaaaggacatggtcttgttctttttgtgactgcatagtattccatggtgtatatgtaccacattttctttatccagtctatcattgatgggcatttgggttgattccatgtctttgctattctgaatactgctgcaatgaacattacataagaattgcacattcattgtagataacacagtaacaaaactttttgtgcctttcccaagctgtcagtctctgaaatgtgactttactggagtagctataattgtgaaaacatgtccatatgcaagacactatccagggcttcaagttatcacagataagcaaattaaagagttggttttcctcatgcgcccgagtgttggatgcaggtggtggaagacccacttgcaaccaaaccccaggaaagtagccaggaggagggtggactgcactgaggaaggaagactccctgggaagtggcaggccactgttgagatggcaccaccatcttaatctgtgtattgcatggtttaaacgactgcaagccccagcctgggcaacacagtaagacccccatctctacacaaaacagacaggtgtgatggcatgcgcctgtgatcctagctacttgggaggctggggtgagaagatcacttgagcccaggaagtcgaggctgcagtgagccatgatggcaccaccacactccagtctggatgaaggagtgagaccccaactctaaaacaaacaaaacaccaaaataggctatacaccgccatttaaaatatttccccaaattttttttttgaaaaatttcacacccacagatgttgaaattataatattaagatacaattactgccttcacatgcaggatttttgattaaaaaaaagaaaaaccttggtggcctctgctctatgttaatatccagacaccttctctgtggttacaagagaagcttgagtgagggcactttctgtcctcagaagtctgtggaatgactttttggtagtgttttctcgtctcactgaaacacaacatggcaaggtgggtagcacaggattcattcttattttgcagctgaggaaacaagctcagagaggtcaacggacctactatctgctctccagctggaactggaactgaagacatctgacttcagtaactcaacattctactgccacttcctgtcctggatacacaacgggagtaatgccagagctgcttctaagaacaggtgcgcaaaggaagtgttttagtctcattcttctgacaattgccaaggaaatactcctcaggccttgtgtgcacagcattgccaaaagtctgtggttaggaacatacaaaaccacaatggagactgggagtgggaagatgcgcggagaagatactgggaggtctgtggcttgcccctggcttgagtttcacattgagtgcttacactgtcccaggtactgtgcctggaccacagagctgacagtgggatggtccaggagtctgcccggtggtgctctcattccagtgggttcaacagtgagccagaagctgccaataagagagtagtggactgcatcgggccgaccttagtgttttgtttggtccagatagtgtttagttatttaagttgctcacttctagcttctgtgaagcaatttctgctggattcctgaataagtagcagccaccccccatcctgcaggcaggacacaagcccgccctccagctcacttctgtccccaccttctactgccttacacccaggtaactgacccttcacacatttacggtgcccatctgacattcatagcatttagaggggggacgaagccaggttacacaggaccttgcaggccatggtaagaattttggattaagtgtttttagctaggcacgatggctcacacctgtaatcccagcacttggggaggccaaggggggtggtggatcatttgaggtcaggagttcgagagcagcctggccaacatcgtgaaaccctgtctctactaaaaatacaaaaattagccaggcgtggtggcacatgcctgtaatcccagctactctggaggctgaggcaggagaatcgcttgaacctaggaggcggcggttgcagtgagccgagattgcgccattgtactccagcctgggtgacaagagattgtcagaaaaaaaaaattgtttttactatttttggtttagaaaaattcttttggattttattccaagtgtgatgggaagccttggggggttttaactagggaataatgtgatctggttcacattttcaaaagatcattctgctatatagaaaagtaatgaggcaacagaggaagcaggaagatccattaggaagccatattatagtggcccactaggtgacagtagccaggaccaggatggtaacagaaaagctggagagaagcaacagcctcaggatgtcacatggagtgtaaccaaaagaacgttctggtgaacagatgacagctgtggtggtgggacagaagggataatgaatggggagtcatcaaggataactccacggttgtggcttgttccaacattgagaggtcaggggcaaccagggggggtcatagttttcgtgagagagatcaagagtttgacttgggatgaataaatttgcctacactcaagccttcccagatacctcatttcccttacctgccacacccacgcagccttcaaattcacaaatttaaacttctcaataccgactctcttatcaaatgtaccccttcaacttcaatacccattgcctctgtcctgctctggtcctctcttgccttgacatatataacaatagctatgaataaactaacacaaagcacttaataagggtgtatctctctctcccaccagccatctttgatggcagaaaccatgtcttattcgtatttaatccccagctcatatttatttgggcacagagtgggcactcaaatatctgatgaacttgatgaactgaaaagaggtctccttaaacaagatatcatctcccgaagagagaagtcccaaccatataaaatgtatgatcaagtcccagaaaactttgccttcccaaggaatgtgtttctaatttggtttcaaagcacactggttcccacttttaccactttcatgacattggacaatagtactactcttttctacttttcttccagacctggggacttgatattctcttagcctcatatcatctttgcaaggagttcacagagaggattattctccatcttacaaatagaactgaggcccagaaggaaatcccttagtgtctttttgatggaacacagttctgtgatgggaagctatcccagtctcccatccttgcaaaactgctgcttagtactcaggtgttctctaggttgttctggaacatttacaaacttctttgggtgtgaggatgtgctgccacaaggccaaaaatcacattctctctctctctcctctcctctctaccattctcctcagtgccaggtggggacagattccacccactgggcctgggaggaagaaaagcaccttggccactagtcagggaggagtcacagccagcaagaagagagagacctaagtagacaagagtagtttcaatgggaagaagcagggccaccagtaagaaaaccaggagactccttctgaaaggcttccacctgggaggaaagatggcagcagtgccatgaggaggccagatccctcctcctcaatcctctgcgccgggccctcccagagtcacttcttcagggcacccaggctcttcagggtctcttgggcctgggtcagctgctgctgcagcctctggcgggtgctctcgttggaggcccgcttcaggtggccctgcatctcctccaccatggctcggtggccaggagtgttgtgaaacagccgcaccgcccggtccccacaggaggccagaaagcggccagtgatgtcaaaggacaagttggcgatacactcgccatggacccgctcaaagcactcctccttctcgccccgccgggtattgtagagatgaatactactgccactggccaaggccaagacctgggcgttgggggagagggccaggcggcacggcgcggcacccgccgcctcttcaaagcggcctgtcttcagcaagtaggggtcctgcttcttcttgtattccacatctgtgtcccacagtttccatgtaccatccttggagacagaagccatcctgcaacacagaaaatcacagctcaagccccaacacaccctggcagggtaagcactggcccaacttgagcagctccagctaggaagctaagtcagcttcctgccgagggccaggcaccccaccctcttcagagccatggcacaaacagacagaaggaccctggttgtcaagaggggccaagagccactggtcagacatcagagcggattcactcacctccgtgagtcgttggagaaagcaaacgagtgcacagccgcggagtggccctttagttcgaaggctcgcaccacctcctggaactcccccttctttccaaagcagacttcccaaaccttcacatctggggtgaagccacacgaggctacaaatctgccatacaacccagaagcctttaaaacttcattttcggagcatgttgttcctgtaaaacccctcaatctctttcctgagaaagttgataatcctcatatctggataatataaacctttaaagagttattttggccgggcgcggtggctcacgcctgtcatcccagcactttgggaggccgaggtgggtggatcacctgaggtcaggagttcgagaccagcctggccaacatggtgaaacctcatctctactaaaaatacaaaattagccaggcgtggtggcgcatgcctgtagtcccacctactgggaaggctgaggtgggagaatcacttgaacctggtaggtggaggttgcagtgagctgagattgagattgcaccactgcactccagcctgggcaacagagtgagactgtctcagaaaaaaaaaaaaaaaaaggccgggtgtggtggctcatacctgtaatcccagcactttgggaggcccaggcgggcagctcacctaaggtccgacagtttgagaccagcctgaccaacatggagaaacctcacctctactaaaaataaaaaattagctgggcatggtggtgcatgcctgtaatcccagctacttgggggaggctgaggcaggagaatcgcttgaacccgggagacggaggttgtggtgagccaagatcctgccattgcactccaacctaagcaacaagagcgaaactccatctcaaaaaacaaacaaacaaccacaacaaaaaagttcttttatgtatgtgacctcagtttatcttctagccttgttctaagatatgtaacatccccgcccaaaggtggcttggcacagtggctcacgcctgtaattctaccactttgggaggtcgaggcaagaggatcacttgaggccaggagttcaggaccagcctgggcaacatagtaagaccccatctcaacaaaaaatacaaaaattagccaggtgtggtagtgcacgcctgtagtcccagctactcgggaggctaaggtgggaggatggtctgagcctgggaagtcaaggctacagtgagctgtgattgcgccactgcactcctgcctgggcgagggtgaaaccgtctcaacaaacaaacaaacaaaaaacaaaaattagctgagtacagtggcacatgcctatagtcctgactactcaggaggctgagctgggagaatagctacaacccaggagtttgaggctgcagtgagctatgatcgcaccactgtgctccagcctgggtgacagagtgagactaattttctaaaaaacaaaaacactgaagatgaagaaatagcgactaaggacatggggcgacctgcatgaaatcccactactgcaagtggggagagctgagacttgaagctcgggttcctgaccccaccccgtatgctcttcccacgcgatgaagctggctctctgttctgtgcctgctccccagccccagcctctcgtggtcccagacgccaatacccctccttgcccacctgccacagggagatacagcagcgtgtgtgttgttcatctggttggtgttgatggtagacagcacttgacccttcaggctccagatgaggacagtggtgtcactggaggcagtcatgataaacttccctgagcgggaagggagtgatgtgggtcacgggcagtgacctgaccaactgtcactctccaaagacacttacaaggcctctgctgcccgaagtatacatgtctcctcccaggccaagggtcactacagataaggactctgctgaagactgtggcccttccccaccttccctagggacctggtgtggcccagggactccaggggagcacagagccaggctgttcagagccagggaccccttgttcctctcaggttgagcagaactttcaggcagcattaactcattgaggaaatagaactggatctttccttcatgctttgggcaggcgccaccctctgaatgcctcttacctgtgttagcaatgccaatgtcgatgacaggcgccttgtgctttttagggaagtcctctggggtggctgtgaaggtgtagcccccatcctcccgcttggtcatcttgaagacacggagggtgtccccgttggccagccagacgatgaaggctctagagacaggcagcagacaagtcacgctctcactggacaaagaggctctgtgttccaggtcctgtgctgggttctcggggaagtcaagatctctcctcatgccccacagtctagccttaaaacttaagcccctggttccaaatctcataaaactcctcaaaaggtaagattctgatagctttggctcctttagtttctctctagggtttagaaactaaggctcatctggaagccaggccaaggtatttccaggtaggaagagacctccccctgtttccttgctgtatagcagcccagatctccagggagccccaggcagcgcgcaaactatgtggatgctctttctggcaccccaagggaggccctgggtccaggtccctcctcactacctcaaagcagatatgggaaggccaaagcctgggactaggcctctgcaggcaaacctgaggctccgtcttgtcccacctgcagtcagggctgaagcgcaccagggtggcgtggtccagctccacgttggctctcatgctgcggtgctctcgctgcaggaagtccttggtgctccagatgcggatggtgcgatcatctgcacaggtagccaggtatttgccattgctgctaaagtccatgcaagatatgttcccgctgtggctctaggggaagggtggcaggaagtgtcaataggagctcctgggggagatggggaagccaaacctggagccggggagatggggccctgtggcctggattaacagcaagctgagattgggctgcgatgagaggggacagaattaagcacccccgctgattctgatcagaggcaggagagcctgtaacatgcatggaatactccagaggaaaagcctgtggggctgagtctcagggtgcacgctgtgccaggtaccccacgtaccttcagagctgcagccaggaggcggtgggtgaagttgtgttgttgaggcttctccttccgaatccgctgatattgtttctgcttcttggatcccgaagatttgtcaggtggaaatccatttgctttttggcctataaggaagggccatgttgttctccagttactcactgataagcatttactgcccacctatgatgagccaggcattgagtggaacagcaggagattaaccagatatggcccttgtcttctggaggagaatgagtgtgatatgggcaaaaacagaggctttggctggctgggtatggtggctcatgcctgtaatcccaatgctttggatcatttgagcccaggagttcgaggctgcagtaagctatgatcacaacactactgcattccatcctgagtgacagagcaagaccctgtctcaaaaaaaaacaaacagaaaacagaaacaaaacagaggctttggaatcagacctgggtttggattctgtctctactactgactgactactgaggaggctgtttacagtaagtccacagagcaccttcatgtagagtggaaaaggcgcactctctgggttgggtgatgctgctgggcgggtacacagcacggccagtggagtgtggatccttggccagacatccctatgtagggagtaatgtgcacaaccatctctagcggccctgctttgggtaagttagtgaattgctctggaccttggttttttttttcttttctttctttcttttttttggagacagagtcttgctctgtcgcccaggctggagtgcagtggcgtgatctccgctcactgtagcctctgcctcccaggttcaagcaattcttgtgcctcagccttccaagtagctgggatcatgggcgtgcaccaccatatccagctaattttttttttttttttcagatggagtctcgctctgtcacccaggctggagtgcagtggcgtgatctcagctcactgcaagctctgcctcccgggttcacgccattctcctgcctcagcctcccaagtagctgggactacaggcgcccgccaccatgcccggctaatttttttttgtatttttagtagatgtggggtttcaccacattagccagaatggtctcaatctcctgaccttgtgatccacccgcctcggcctcccaaagtgctaggattacaggcgtgagccatggcacctggccccaatttttttgtttttttagtagagatggggtttcaccatgtgggccaggcttgtctccaactcctcacctcaagtgatctgcctgccttggcctcccaaagtgctgggattataggcgtgagccactgtgtccggcccagccttggttttcttaaagagaggttgagaactgggggcggtggctcatgcctgtgatcccagcattttggtaggctgagatgggaggattgcttgagctcaggagttcgagaccagcctgggtaacatagtgacaccccatctctacagaaaactttaattagctgggcatggtggtgtgcgcctgtggtcccagctattcggaggctgaggagggaaaattgcttgagcccaggagttcaaatgcagtgatcgtgccactgtattccagcctaggcgacagagtgagattctgtctcaaaataaataaataaataaataaataaaaataagggagattgaattggatgagatatctacaaagtgacaagcaaaagtaccgaacacaagcattaaaggctctatggaggccgggtgcggtggctcatgcctgtaatcccagcgctttgggaggctgaggcagctgctggatcattttttttttttgtttgatacagagtctcgctctgttgcctcagtctcgatctcctgaccttgtgacctgcccgcttcggcctcccaaagtgctgggattacaggcgtgagtcaccatgcccggcccggcagctggatcatcttgatgcccaggagttccaccagtctggccaacatggtgaaaccccgtctctactaaaaatacaaaaattagccgggcgtggtggcaggcgcctgtaatcccagctactcaggaggctgaggcaggagaatcacttgaacccaggaggtagaggttgcagtaagccaagatcgcaccactgcactccagtacctgaaagaactcggggatgagaagtcaacatctgttgagtcctgtgcgggggagtggagccagtcacttttgtaaaagatacttaattgagtcacaaagctggcatgtggtaaatgactgcagatgctccccaattccaacaggaaaaaagctcctgggccctgcaaacaaacacagccacaatctgtcctctgcttccttctctccaggcatgtctaacaagcccccctcctcacacttaagtcataccaaatgctgtttggggactccttgccttctcgggtattgccattggcaggaatgtcttttttccttggccttctggcaaactcttcttctagaaccatcctttgagaccccacactacctcatgtgccccctattctcagtaatgatttccctaacaaccacctcccccataaaagaacaggactcggccaggcagggtggctcacgcctgtaatcccagcactttgggaggccgaggcaggtggatcacaagaggttaggagattgagaccatcctggctaacacagtgaaaccccgtctctactcaaaaaatacaaaaaattagccgggtgtggtgtcggacgcctgtagtcccagctactcaggaggctgaggcaggagaatggcgtgaacccagaggcggagcttgcagtgagccgagatcccgccactagactccagattgggcgacagagcaaaactccgtccccctgcaaaaaaaaaaaaaaaaaaaatgcagggctggccgggcacagtggttcacgcctgtaatctcagcacttttggaggccaggacgagtggatcacctgagatcaggcgttcgagaccagcctgaccaacgtggcgaaaccccgtctactaaatatacaaaaattagccaggcgtggtggtgtgtgcctgtagtcccagctactcgggaggcagaggcagaagaatcgcttgaacctggcaggcggaagttgcaacgagccaagattgtgccactgcactccagcctgggcaagaagagcgaaactctgtctgaaaaataaataaaaagagcagggctgcccactgactctctggtgtttcccatttctagtactaacctcttctatgaaacttttcagagacaggctcttgccgtcacccaggctgaagtacagtggcgcgatctatcacaactcactgcagccttgaattcctggactcacgacaccctcctgcctcggcctcccatggagctgggactacaggggcgtgcacaaccacacccagctaattttgcgtagagatggggtcttgctatgttgctcaggctggtcccaaactcctgggctcaagcgatctccctgcctcggcctcccaaagtgctgggaatacaggcgtgagccacttcgcctggcctcagtgaaacttatttcaccgtgtttttcacttacatatttaggtgttcataatacagatgtacttctcctttactggactccttacagaaaaagaccccaaagcctatcacagggtcatagatgcccagtaaatgctgctgcacatcacagaattggtgctttttccgagatcgcggccacggagcaggctgaagagtttacggtgctctcctggccaccccggggacggcctggcctcggccacagagaaagccgcagtaaggggcccaggttggagccagtcccgccccaggaggtgcgcctaacccggcaaggcgggtccccgtctctggaagcgaagctcacgttaccagaggagaaactgaggcccatggagtcgccgggccccaccagccgcgggcccaaaccgcaggtcggaccacgaggaggccgggagccgggacaccgcgggccgcccccacccgacccggccccacttacaggcgggccggccgctcctctcctcccccgcgcgcagccacccccgcgctaccgccgccgtcgccatcagggccagcagcccaagcaacaccgacagccccatgagctccgacatctgcgagagctccatgttggtggaaccactgccacctcagctagtgagtacgcgggcgcccgcacggctctgccgggccgcgcacgcacgcgggggcgcggcctggccgttggggagcctcaagcggctgggcctggccgttagagcgcctgggggcggagcctggttgttacaacgccttcagggcggggcctggccgttaaagcacctcaaggggtggggcccggctgttgtggcgctcgaggggcggggcctggagttagagcatctccacccgccgagcctagttattagagcgcctcgagaggcagagtctggagttagcgcgtctcgaggggcggggctgggttgttagagcgtctcgaggggcagaacccggaggtagagtgtctcgaggggcggggcctggaagtagaacatctcgaggggcagggctcgacccttggtgcgtttcgaggggcgggtcgcctggcggttgagattgcagggctgcggagggcggaggaaggcgggatttgcgatcactgctcacgcctcctcctgaagaactcactgataattgtttattaaaggcattattccagccatcaccacactggatcctttcaaggaagcggggcggggattattattaccatttaacggataggaaactcagcatcagcgaaagttcagatgggcttttaaggaagagtaggccaggcgcgtggagtggaacagcctccgcaaagacctgagaagctgggatgtgggaaatggctagaggggcggaaaggtctgggggacgttgagcgctggctccatccaacaagctgctcattacagggagaggtggggcaaaagctgtgtctgaggattccctggatggacctttgtgtgaaaagaccaaaatcagaaaaccggcagtggcttcaaggatccgagagggaggtgacgagggcctggatttggggctggcctggcaagtcgaaagttaaaagggagaatttttaatagaaaacttattttatttatttatttatgtatttacttttgagacggttgcccaggttggagtgcagtgacgcgtctcggctcactgcaacctccgtctcccgggtgcaagagattctcctgcctcagcctccagagtagctgggattacaggcgcgtgccaccatgccctgctactttttgtgttttttatagagacgggggttttgccatgttggccaggctggtctcgaactcctgacctcaggtgatccacctgcttcggcctcccaaagtgctgggattacaggcgtgagccaccatgccgagctgggagattatttttattttttattttttgagatggagtctcgttgcactgtcgcccaggctggagtgcaatggcgccatctctgctcactgcaacctctgcctcccgggttcaagcgattcgcttgcctcagcctcccgagtagctgggattacgggtgcccgctagcatgccccgctaattttttgtattttttagtagagacggggtttcgctatattggtcaggctggtcttgaactcctgacctcgtgatccgcccgcctcagcctctcaaagtgctgggattacaggtgtgagccaccgcgactggcccagaccaggaaattttttcatagaaaacttatttttttttttgagacagagtcttgctctattgcccaggttggagcgcagtggcgcgatctcggctcactgcaacctccgcctcctgggtttatgccattctcctgcctcagcctcccgagtagctgggattacaggcgcccgccaccacgcccggctaattttttaaaaatatttttagtagagacgggatttcaccgtgttagccaggatggtctcgatctcctgacctcatgatctgcccgcctcggcctcccaaagtgcttgggggattacaggcttgagccaccgcgcccggccagaaaacttcttttaaggccgggtgcggtggcccatgcctgtaatcccagcactttgggaggccgaggcgggaggatcacctgaggtcaggacttcgagaccagcctggccaacatggtgaaaccccgtctctggccaacatggcgaaaccccgtctctaccaaaagtacaaaaattagctgggcgtggtgtcccacgcctctaatcccagctactcgggaggctgaggcaggagaatcacttgaacctgggaggcagaggttgcagtgagccaagattgctccactgcactccggcttgggtgataagagtgagactccatctcaaaaataaatataaaataaataaaaaaagaaagaaagaagaaaacttcttttaaaataattacagccgccaggcacagtggctaaagcctgtgatccccaacactttgggaggccaaggtgggaagattgcttgagcctagcagttcaagaccagtctgggcaacatagcaagaccccatctctataaaataaataaataggctgggtgtgattgctcacacctgtaatcccaccactttgggaggcccagattttagcccaggagcttgagcccagcctgagcaacatagtgaaaccccgtctctaccaaaaactacaaaaattagacgagcgtggtggcacatgcctgtggtcccagctacttgggaggctgaggcagaaggatcacttggacccgggaggtggttttgcagtgagccgtgattgcatcactgcactgcagcctgggtgagggtgagactccgtttcaaaaaaaaaaaaaaaaaagttaaggctgggcacggtggctcatgcctgtaatcctagcactttgggaggctgaggcaggcggaccacctgaggtcaggagttcgagaccagcctggctaacatggtgaaaccctgtctctactaaaaatacaaaaattagcctggcatagtggtgcgcacctgtaatcctagctactcaggaggctgaggcaggagaatcgcttgaacctgggaggcggaggttgcagtgagccaagattgtgccactgcattccagctggggcgacagagtgagattccgtctcaaaaaaaaaaaaattagccagacatggtgacatgtgcctatagccccagctaactggcaggctgaggtggcagaatcacctgagtccgggaggtcgaggctgtagtgagctgtgatcgtgccactgcactgcagcctgagcaacagagtaagaccctgtctcaaaaaaaaaaaaaaaaaaaaaaaaagatataaagatgcacagtggtttgaaaaagtgaacagggaggtctcatggactcttcctctcagtttcctccagtagtaacatcttgcataactgcagtgtaatatcaaaaccaggaacttgacattgatgctatctacagaacttattcaaattccaccaacaaggagacaatctgaaagacttattggtagaatttgggttgaacagtcatgctccgtgggtgtcccagtcccaaagcccagagtgagtcgaagtaccagagttggagattcctgctgcaaacatttccatccccacccaggagcctgccttcctgacagtccaggcccttcggcaataaaggaccctctgagaacagtggccgctgcagaggctagatgacagacagacacacccacaatcttgggggaggaaatggatccagtcagagagcaaatggagcagcctcatttccttcccttttgtcctttgcgggaaactggcattgactcagctgtgggcagtggggtagggaggggtgcgagggggtgtctagagcatcctgaggcttgtcctccctatcttgctacttaggactgtgggcccagccataagccactttcttcacaccatctacagacaagctacacttttcaaagtatttatttatttatttattttgagacagagtctcactgtgttgcccaggctggaatgcaatggcatgatctcggctcactgcaacttccgcctcccgggctcaagtgatccttctgcctcaatcgatcatcctgcctcagctcccaagtagctaggactacaggcatgcaccatcacacccagctaatttttgtgtgtgtgttttgtagagacaaggtttcaccatgttactcaggctggtctcgaactcctgaactcaagtgatcctcccgcctcaacctcccaaagtgctgggattaaaggcgtgagccaccaagcctggccaaagatgcacttttaagaagaatttcatttaccaagcattttgcatgtgacatttattgatccaggagcatttttttaataaagagagtctcactgtgtcgcccaggctggagtgcagtggcgcaatcacagctgattgcagcctgaaactcctgggctcaagcaatcctcccaccacatcctcccaagtagctggaaccataggtgctcaccaccacacccagctaatttttgaattttctgtagagacagggtcttgctatgttgcccaggctggtctctagaactcctggcctcaagcaatcctcccgccctcaacctcccaaattgctgggattacaggagtgagccactgcacctgtttgatccaggagctttgcgtttcatttcacttgctcacattcccttctcacagatgaggagactgatgctttaggaagttaagtgactttcccaaggtcatacaggtggagagtgagcctggggacaaatacatgtcctgtctggctgcaatctgtggatgtggggtaagaggaagaaagagtagcctctctttgtacagctcagttgaggctaccaaattctttcatatccttgaattcagttggcctttaagacaggccatgttataattttaatttttaagcagatggagagaaacactaggcttacatcaaataatatgcccaaggtcaacaaggaagcaagggaaataacccaggtctactacaggatccatactcgggcagggcactgtggctcacgcctgtaatcccagcactgtgggaagctgaggcaggagaatcacctgagcccaggaatttgagaccagcctggccaacaaagtgagaccccatctctacaaagtaaaaaaattaggcgtggtggtgcatgcctgtagtcccagctactcaggaggctgaggcaggaggattgcttgagcccaggagtttgaggctgcagtgagctgtgatcacaccactgcactccagcctgggctacagagtgagatcctgtctcaaaaaagaaaaaaaaaaaatccatgctcctcccagcaagccactctggctgtggcgtggccttgctcttactctcaagttttatgtagcccagttggaagccaagactgatacgtggaaggacaactgaggacacacagcgggactcaggaaagctgaatgcatcaggaagcaggggacttgccaatggatcttgaggggcagtgagacttgactgtagcttcagggatgggcatttagacaggtgaaacagcacgagggagtgctacatggaaagcgagaaccagccgaggtacggaggtggaagtaactgattctgactgggcacggtggctcatgcctgtaatcccagcactttgggaggccgaggtgggtggatcatcttgaggtcaggagttcaagaccagcctgaccaatatggtgaaaccttgtctctactaaaaatacaaaaattagccaggcgtggtggtacgcgcctgtagtcccagctactcaggagactgaggtgggagaatcacttgaacccaggaggaagaggttgcaatgagccaagattgtgccactgcactccagcctgggcgacagaacaagactccatcaaaagaaaaaaaaatagaagtaaataaggagacaggaggccaggcacagcgactcatgcctataatcgcagcctgtgggaggctgaggcaggaggatcacttgaggccaggagtttgagaccagcctgggcaaagtagcaaaactccatttgtataaaaaaaattagccaggtgtggtggtgcacacctctagtcccagctactcaggaggctaaggcaggaggaggatcgcttgagtccaggagttcaaggctgtgggtaagctatgatcatgccactgcactccagccaggcaacagacctgtctcaaaaaaaagaaaattgagaggccaaggcaggcaggtcacttgaggcaggagttcaagaccagcctggccaacatgatgaaactctgtctctactaaaaatacaaaaagttagccagtcatggtggtgcacatccgtaatcccagctactcaggaggctgaggcaggagaatcacttgaacccgggaggtggaggttgcagtgagctgacattgcatcactgcactccagcctgggtgacagagcgaggctctgtctccaacaaaagaaaaaaaagcaaaaagaaaagaaaaagagacaggaatccctaagcttgcctccctcatgggttgatcacacctttcaagagcaaagcaagatgagtcccaggtaccactggagattgaagacttttagggatgtgaggggagggaggctatggagagaaatgaggctggagggaaagcagggttggatcacaaagcacctcgaacacctgccctgaagcctggccttgtcagaggcaaacagtagccaaagaaacaactgaagcacacgagctccaacttgtattgtctggagtcctccctacctctggcctctctacattaggtgaaatggtaactttccaccttgtttaagtagtggttctcaaagtgaggtccctggaccagcagcactaggaatgcaaattctgtttttgagacagcgtctcaccctgtggcccaggctggaatgcagtggtgcaatcatagctcactgcagccttaaactcctgggctcaagtgatcttcctgcctcagcctcctgagtggctgagactacaggccaccgtacccagccaggaatgcagattcttagactccatcccagacctgttacttggtcagaaactctggaggtggggcccagcaagctgtacttttttttttttttttttttttttgagacagtcttgctctgtcgcccatgatggagtatattggtgtaatctcagctcactccaacctccacctcctgggttcaagcgattctcctgcctcagcctcccaagtagctgggactacaggcacacaccaccacacccagctaatttttgtatttttagtagacagggtttcgccaagttggccaggctggtcttgaacccttgacctcaggtgatccatctgcctcggcctcccaaagtgttgggattacaggtgtgagccacttgcctggccctctagctgatccttaacaagctctctagttaatcctgatgcatggtacagtttaagaagcactgatttaaactaatttgaacccctacatgtaatttgcagctcaaagcctctattacagtggttcttgaccatggctccatattggaatcactttgaagatgctgatgtctaaacatcatactggctgggcatggtggctcacatctgtaatcccagcactttgggaggcagaggtgggaggatggcttgaggccagatgttcgagaccagcctggacaatataacaagacaaaaaaaagtctgtagagtctctacgaaaaatttaaaaattagccaggcctggtggtgcatgcttgtgatcccagcgtttggcaggggctgaagtgagaggatcacttgagcccagaaggttgaggctgcagtgagctgcgtttgcaccactgcactctggtctgggtgacaggatgaaaccctgtctcaaaaaaaaaaaaaaaaaaaaaagtaaagccaccacgtttattttattttatttgtttttgagacagagtctcatctgtcgcccaggctggagtacagtggcgtgatctcggctcactgcaacctccgcctcccagattcaagcaattcttttgcctcagcctactgagtagctgggattacaggtgcccaccacgccaggctaatttttttttttttttttagatggagtctcgctctgtcgcccaggctcaagtgcagtggcgcaatctcagctcactgcaagcctgcaagctccgcctcccgggttcacaccattctcctgcctcagcctcgcgaatagctggaactacgggcgcctgccaccaagcctagctaattttttgtatttttagtagagacagggtttcaccatgttttccaggctggtctcgaactcctgacctcaggtgatccaccagccttggcctcccaaagtgctgggattacaggcgtgagccaccatgcctggcccacattattaataattaatgcatgtttaagtttgagaagctgttcactgtaagggatacaggaggctaatgcacatgtatggaagaggcgatgtcctattggaccagggcggtggctatgaaggtagatgttcaattggccaggcttccgtcctcagtgacagctagcgcagggcagcggggtgtgtggaggagctgaagatgatggtttccagcttgcacaagtgtccgggtggtggtgcctgtgccagggctggggcacacttggaggaccaggtttgagtgggaagattatggaagtggtgagttctgtattgggatccgtcagtgttaagggagctgcggagcgctcagagggagaagttagggtgatggtcggacatgtagttgtgtagctctggggagacagcgaggcagatacagagtcggggtcctctgcagagaggctgaaggggatgagatggcctggggcttgccagagagcaagaagggaatggctaaggaagggacaggcctagaaagaggctcacacagcaggacctgggagggcattggcagggaggaggaaaggagagcttggcaagaattctgttttgttttttgtatttttgagacagggtctctctctgtcgcccaggctggagtgcagtggcgcaatcatagctcactgcagcctcgaactcctgggctcagcctcccgagtagctgggggtacaggcccatgtcataacacccagctaatttttttgtagagatggggtctcactatgttgcccaggctggtctctaactcctggcctcaagcaatcctcccgccttggcctcccaaagtgctgggattacaggcatgagccaccgagcctggccgagaattctggactcccagggaaagagtggtttaagacggaggcccaagggccgcagaaaaaccagaatagcactatgaagcaggcactggatttcgcaaggagcgggtcagtcagaggtgagctcagtgacagcagagtcagcgcaggggtgaagctggggtgtgagggtggaggaggagcccaaacgtggggagccaagaggggagagggaagagaggagggagagtgagcacgtgtagatgactctttcaagggaagaagccatctggaagggacacggggtcaaggggatgtttgatggggaacttctggccgcgtgggagtgaaaacagcagcgtatacactgcctggaccctcccttgcggtgagccacggccagcctgtctgcagcagcaaagagcatgcgtgaaaggctgggcgcacctgccaccgtcacagcagagaagcggccaacggcagacgaaggcagttgggtgggcactgctgggctgcttaccagcccagcaagctgagtcaagggaccgaaactgtctgtgtctcagtttctcacccgtaaaatggggatgctgataattattacaactcattctcattcttacatagtgttatatatttataatatatattatatataatgtatataattatataatatatataaaatatatataatgccctgtagcttccatgcctcggttccagctctgccttcttctaactctgaataataactatatattatatatattataatatataattatatattatattatatattatattatatattatatataatttatatgatatatattataaattatatatattatctattatatataattatatttatatgtatttaatacgtatatataattatattgtatatttataatatataattatatattacatattatatattatacatatatactatattataattatgtattta

SEQ ID NO: 1190 - DNA, 43767 bp, Homo sapiens
ctctaaaattagaaaaattggaaaacaaaaaaaaagaaagaaagaaaaaaaaatcttcgagtgtagactcagaaatctgtgtttctaacccctgctccagggcattctgatgccgtagctctgctccagtgagtagggaaggccagccagtgaaggctcacattgctgtgggtggcagaagaggacagcaggagattctgaccaggtagatcttgaagacagcagcagcttgacaaatggaggtttccaggtagagggagcagcttgcacaaaggcacagaggtgagaaagttaggggtatgttctggagatggcaaatagagtgggtgaggtctgggtatggaggggctgtgcaagatgaggctggaaagattcaaatcgaggagggctttgagtgctaggctaaagcatcaaaatgtactcttgcctctggcatttatttgcaaaatagtggtacacgaggtaattgtaggtgatatggtacatgtagggagaacattctcttttcagtcccttctaaagtgcttacattgaggagaaagtttcaattagttgctagtctatctttaacacccctctgaacactgcctaatttcctttcaacatagagaaaccctccttaggcttagggccttagtgtgaaacaagaacaagtgtgaatgcctcatttccatgtctgaatgactgcttgctatttatggcaagggatactctttttctttttctttttttgagacagagtctcactccgtcacccaggctgaagtgcagtggcacgatctcggctcgcagcaacctccgcctcctggattcaggtgatttttgttcctcagccacccgagtagttgggattacaggcacgtgccactatgcctggctaatttttgtatttttagtagagacggggtctcaccatgttggccctagcctcaagtggtcttgaacccctagcctcaagtgatcctcctgcctggcctcccaaattgctgggattacaggtgtgagccactgtgcctggccgggatactgtttttttgagtattaaaattatataaagcttttcttttctttttcttttttttttttttttttgagacggagtttcgttcttgttccccaggctggagtacaatggggcgatctcgactcactgcaacccccgcctcctgggttcaagcaattctcctgccacagcctcccgagtagctaggattacaggcatgcgccaccacgcccagctaattttgtatttttagtagagacggagtttctccatgttggtcaggctggtctcgaactcccgacctcaggtgatctgcccacctcggcctcccaaagtgctgggattacaggcatgagccaccgctcccggccaaaacttttctttttaaaataagtttagttttaaaaaagtgagttgacaggagcaaaactgctaagtaaataatgcaaaaggcagtggtgctcaaatatgggaaaataatatgcaggtgataccagagtcttgcctttgggaaatgcagacccaggtccttttgtctttagagctcaccggcaatgcgaggtgtttcaggtagaaggaacagcatcaatggggtgttggctagtgtttaacagctggctctctgaaaaagcaaaataaaacacacacacaccaaatctgatggtctgtttccatgatgtgagtacctccagctgggccgaactgacatcactgaacacagtggaaagtgatgactgcagttgtctctcctgggagcttcaacacagtacaggctgacaaaagtgggcagggggtaagggcaggtggtgggagtggcctctacgccagagaagggaatggagaggtcaggctggctagagagtggggttgagtcgtccatgcccttgaatgccaggatgagggctaaagagtcaaatggaatgggtgacttcatatgcagaagtttttacaagagaagagaactcagtttggccaagagaagtggggtcgtcatgttggtaatcacgtaacagtgatcgttcagtcatgcggaatgctttcaaggtgttggacactgttcattttttatttttagtttttgaggcagggtctcactctgtcgcccaggctggagtgcagtggtgcaatcttggctcactgcaacctctgtctcctgggttcaagcgattcttctgcctcagcctccctagtagctcggattacagttgtttgccaccacgcccggctaatttttgtatttttagtagaaatgaggtttcgccatgttggccagactggtctcgaactcctgacctcaaatgatccacctgcctcggcctcccaaagtgctgggattgcaggtgtgatccaccacacctggccgcttgcagggtgttggacactgtggatatcacctcattcattctcctaacaacccaagagaagaggaactgaggcaaagagaagttaagcaagttgcccaaggccatacggctagtaaacggcagaacgaggctcaaacccaggcactctggctctagagtgtgtgttcctaaccactgtgctctagcacctcggaaccttagtctcttcatctgcaaaatcagcactgaggtgacaaggccaacgagcagagggttggagttacccagaacaacaacaacaacaaaagtaatagtaacacatatttggtcaaggcttagattctggcgtcatggggatctgggttcaaatcctaattctgccttagccgattagggtccctatcctcttaaagccttggtttccttatctgtaaaatggggatatcatgaagctgttagatgttaaatgagaaaatgaatgagaaaattgcatgtactgtccataaagttgaaaagataataggggtgggaaggagaacagtccgagtttgaatgcaggtgggccctggggcattgtctggactgaaggacaagggtcagttgaattgccaaagagctctgagactggctgaagggacactcgtcttgtgctagctgctaagaccaaggggaagcctgtgcctcgcccgaattttagtcttgcaaacagctgctcacccagtaggagagaattgtgataaaactcatagccaccatttcttgaatatctactatgccccgggacacagcagactattttagagaatttgcgaaggaaacacagtgacatctgttggacaccttgcaaactaccagctcaggatagttaaatttgaatgttagatggagggaacttcctttccacaatgacatgattttgtaaagctgagtgtatggcagttgtcatgattaaaagcaagtgccatgcagaagttattgtgtaacaggaaatgagattagatagcgtccaatctaatctcaaggtttgagtagctgtggacagcccaacaggcacaggcctcccgttagtacatccatacgagaagttaagaatgagtgaaaatagtttttttttttttaatttatgtgcattatttttttcaagcagctaccttgttaggacatacttaatagttatcttggcctacctactgcacttactaaacaactgttcactttttaatttttaattttcagatttttttgagacggattgttactctatcgcccaggctggagtgcagtggcgtgatctctgctcactgcaacctccgcctcccgggttcaagctattctcctgcctcagcctcctgagtatctgggactacaggtgtgcgccaccacatccagctaatttttgtatttttagtagagatggggttttaccatgttggccaggctgatctggaactcctgacctcaggtgatccacctgcctcggtctcccaaagcgctgggattacaggtatgagctaccatgtccggctgttcctttttttttttttctttttcttttttttttgagacggagtttctctctgtcacccaggctggagtgcagtgtcatgatctcagctcactgcaacctctgccttctgggttcaagtgattctcctgcctcagccttccgactagctgggattataggtgcccactgacaagcctggctaatttttgtatttttagtagagacgggttttcaccatgttggccaggctggtctcgaactcctgacctcaagtgatccacccacttcggtctcccaaagtgctgggatgacaggcatgagccactgcgcccagccactgttcgctttttttctcagtggttctctagtccattgccttaaccactcaccatgactacagctcttatttgcagtgactctcaagaatgcaaatgcaaatgccattcctgacctcgagttaattcagctttgtcccctgagcatgggggaaaggcaggctgggggctggaactttctgcttgtgtacctatctctttagactctggaggctcctccccaatctctgtcattccctctccaaccaaatccacctgccgtcccagactcaaatgctcagccacctaactgcctgaggacccagcagttaatgagtttacatgctgggggcaggagtcagggccaacactccttggttcctctggctccctggaaagggaaagtcaccaagaggcagctgcaggcagcaaagagaataagcaggagaacctcaaagccacaaagggacagcacacagcatcttccctgtttagcctggacttgagaatgctgtccccagcagtaagctgctcaacctcaaagcaacttgcacgggggtttacaaaaaaatgcacttggccgggcacggtggctcacgcctataatcccaacagtttgggaggccgaggtgggtggatcttttgaggccaggagtttgagaccagcctggcaaacatggtgaaaccctgtctctaccaaaaatacaaaaattagccaggcatggtggtgtgtgcctgtagtcccagctactcaggaggctaaggtaggaggattgctcgaacccaggaggcagaggttacagtgagctgagatcgcaccactgtactccagcctgggtgacaaagtgaggctctgtctcaaaaataaaaataaaacataaatgcactggaggaaagagggtaccactctccttaaggcgggggctgccaacttgtcctgcacagcccgtccgcctgcctcaggtggacttaaagcccagctctgagggactctgagcagtcatttaacctctctgagcctctctttcctcccctgcagaagggggattataacagttcctaattcatgagttgttcttggagtgaaatacattactggccaggtgagatggctcatgcctgtaatcccaacactttgggaggctgaggtgagaggattgcttgagcccaggagttcgagaccagcctgggcaacaaagcaagacccccatctctaagaaaagtaaataaataggcagggtgcagtggctcacccctgtaatcccagcaccttgggaggacgaggtgggcagatggcttgggctcaggagtttgagaccagcctgggcaatgtggcaaactcttgtctctactaaaaaatacaaaaattagcgaggcatggtggcacacgcttgtagtcccagctattggagaggctgaggtgggaggatcacgggagccccagaagcataggttgcagtttgccaagattgtgccactgcactccagctcgggcgacagaaggagaccctgtctcaaaaaacaaacaaaaaagataaatatataaatgaagctgggcatgatggtgcgtacctgtagttccagctacttgggatgctgaggtgggaggattgcttgaagccaggagttctaggctgaagtgagctatgatcatgccagcctgggtgacagagtaagaatctggctcttaaaaaaataaaaagtaaaatggaacaggtgaagttattttctttaatttttaaaataaaaagttatttttataaataaaattttaatttaaaccaaattattttaaactaaatataacattatatttgtataatatataaataatattttaattaaatctaatttaaaattattctaaatgttaactttttttttttttttttttttttgagagggagtctcgctctgtcgcccaggctggagtacagtggcgcgatctcggctcactgcaagctccgcatcctgggttcacgccattctcctgcctcagcctcctaagtagctgggactacaggcgcccgccaccacgccaggctaatttcttgtatttttagtagagacggggtttcaccatgttaggcaggatggtctcaatctcctgaccttgtgatccgcccacctcggcctcccaaagtgctgagattacaggcgtgagccaccgcgcccggcctaaatgttaacttttaaattgtcttttttttttttttttttttttttgagacagtgtcttgctgtatcacccaggccagagtgcagtggcatgatcttggttcactgccacctccgcctcccaggttcaagtgattttcctgcctcagcctcctgaggttaatttttgtatttttattacagatggggtttcaccatattggtcagggtggtctcgaactcctgacctcaggtgatctacccaccttggcctcccaaaagtgctgggattacaggcgttagccaccacgcccggccaaaattttcttaatttaaaaatttaactcaatatattttttaaaaattatcatttcaagaagtgacattagccatctttcaagtgcttggtagccacatgtggctggtgggtgagggcagggcctgtttttttttttttttttttttttgagacagagttttgctcttgttgcccaaactggagtgcaatggcgtgatctcggctcactgcaacctccgcctcctgggttcaagtgattctcctgtctcagcctcctgcgtgcatcaccatgcccagctttttaaatttttagtagaaatggggtttcatcatgttagccaggctggtctcaaattcctgacctcaggtgatccacccacctcggcctcccaaagtactgggattacaggcatgagccactgtgcctggccacagggcctgtatttagatgtttgctattttgttcagcacagattattttacattagttaaaaaatattttttgaggccgggcatggtggctcacacctgtaatcccagcactttgtggggctgagatgggaggatctcttgagtccaggagtttgagaccagcctgggcaacatggtgaaactccgtctctaccaaaaatacaaaaaaaaaaaaaaaaaaaattagctgggtgcagtggtgcacacctgtagtcccagctactcgggaggctgaggtagaaggatgatttgagcccaggaggcggaggttgcagtgagcccagatcatgccattgcactctagcttgggcaacagagccaaaccctgtctcaaaaaataaaaataaataaaaatgaaaaaaaaaatcagaattgcacacatgaaatgggtgaattgtatggtaagtatatctcaataaagctacaacaatatttttattgatttacataccatcaaactcgcccttttaaaatgtgcaattcattgggttttaataaagtcacagagttgtccgatatcaccacaatcaattgtagaacatttttatcatcctaaagaaacccagcaccatggagtggccactccccattcccttctcccacccaggccctgacaaccacaaatccacttcctgtctctatggatttgcctgttctggacatttcagataaatggactcacacactatgtagtctttagtgaccactttttcacttagcatcatgttttcaaggctcatgcatgttgtggcatgtactggaactccattcctttatatgaccaaataatataccattgcattggctggatgcggtggctcatgcctgtaatcccagcactttggggggccaaggcgagggcatcacctaaggtcaggagttcgagactagtctggccaacatggtaaaaccccatctctaccaaaaatacaaaaattagctgggcgtggtggtacatacctgtagttccagatactcgggaggctcaggcaggagaattgcttgaacccgggaggcggaggttgcagtgagccaagattgcaccactgcactccagcctgggcaacagagcgagacccccatctcaaaaaaaaaaaaaaagaaagaaaaaaatatatatgtctataccattgcatggtcaagccatattttgtttatatattcatcaggtgatgaatatttatgttttttccactttttggctcttgtgaataatgctgctatgagcattcacgcacaagtttttgtatagacatctgtttttaattctttggggttttgcattcattttaattttaaaaacatattgcataaaaatgttatttaccttgatgactgggttttttggcattcccttaaaatttgcacctgggctgccaggcatggtggcgcacgcctgtaatcctaacactttgggaggctgaggtgggcggatggcttgagtccaggagtttgagaccaacctgggcagcatggcaagaccctgtctccacaaaaaatacacacacaaggccgggcacagtggctcacacctgtaatcccagcactttgggaggccgaggcggacgaatcacttgaggtcaagagttcaagaccagcctggccaacatggtgaaaccccaactcaataaagaatacaaaaaaattagccgggtgtagtggtatgtgcctgtaatcccagctactccggaggctgaggcaggggaatcgcttgaacctgggaggcggaggttgcagtgagccaagattgctccactgcactccaagcctgggtgacagagtgagactctgtctcaaaaacacacacacacacaacccaaacacacacaacacacacacacaaaatcagctgggtgtcgtggtgcgtgcctgtagtgccagctacttgggtacttgggtggctgaggcgggaggatcacctgaacccaggaagtcaaggctgcagtaagccatgatcgcgccacagcactccagcctgggtgacaaagtgagaacatagctcaaaaaataaaaaaataaatttgcacctgaggcaagtgtcacactcatcccaactcagtctcaccttgcatgttttctgccttgctggctgtatgaccctggacaagttacttaaccgctcagagcctcgatttcctcctctataaaatggggataatctctgtaactgctcacagttggtagcagaatgcaatgaagtgaattcgccctcacagagccagcactgttcttggcacatggtaatcttaacatattttttcctacagggaggcctggtgtcaggccgggagtggggtggaagggtcccaaaatggatggaagggccccaaaatggccgtgagcatcctctgcccttgagaagagctagcccagctgtctagagctccctgctgctgccgctctcgtaagcagcaagcatttttggctctcctgtctcagcatgatgcccctacaaggttctttcgggggtgggacccaacgctgctctcctgatggcctccctggctcccagcaccttccatcccagctgctcagggcccctcacctgcgcctcccccaccctcccctctgcccactcccatcgcaggccatagctccctgtccctctccgctgccatgaggcctgcactttgcagggctgaagtccaaagttcagtcccttcgctaagcacacggataaatatgaaccttggagaatttccccagctccaatgtaaacagaacaggcaggggccctgattcacgggccgctggggccagggttgggggttgggggtgcccacagggcttggctagtggggttttgggggggcagtgggtgcaaggagtttggtttgtgtctgccggccggcaggcaaacgcaacccacgcggtgggggaggcggctagcgtggtggacccgggccgcgtggccctgtggcagccgagccatggtttctaaactgagccagctgcagacggagctcctggcggccctgctcgagtcagggctgagcaaagaggcactgatccaggcactgggtgagccggggccctacctcctggctggagaaggccccctggacaagggggagtcctgcggcggcggtcgaggggagctggctgagctgcccaatgggctgggggagactcggggctccgaggacgagacggacgacgatggggaagacttcacgccacccatcctcaaagagctggagaacctcagccctgaggaggcggcccaccagaaagccgtggtggagacccttctgcagtaaggagccctgccccgtccccgctcccaggagagcctagaggggcccccctcagctcctaacgagccccccttctgagttgagtccccatgaccttcagcctttagcctagttgctgggaagggggacagggcccatgagagcccaggggtccttgcttggaggtttgagcctccagcccctgaactgctcctctgcagagtcccaaatcccatgagcccaggcctttagcccagtccttgggcaagggggacatttcccaggggggtccaagatgggagaaaaagcaggtgagttcacaactcaaatgcctggagaactgggaggtggtggaaatttttagccactctgatcatttatactctccagaccctaactcctgcactgagtcctcagtgggtaggctccggggcccaggaagcactgccagggaggagggcccgaagctggggtttgggggctttcctggcctcctagggactcatgcgtttagccagggaagcccaggtctttcttacctgaggcagacagagcctcgaggtgggagctgctcccctttcctgtatggccacaggcaccccacctcaccagcaggcgccattagaggctgcccgttctacatccccatccgctggcggactccccgtctcctggagaactgggtgggtcctgagctcgatgcctcccctctcctcagcagagctgacctagttactaattacccatgtgctttattatttctcttttgttttataaatttataaatggcaaaaggctctgataaggtctgtgatcattaacttgtaggaatggtggcctggaaagatctgggccaacccacctcccacctagtgggggtgggggatgggggtgtgggggagaaggaaggatggcctgggggctacaggggccacccctccccagcggctccctgacctccaccctacagcgcctgcttgaggaggttcactacttcctgggcgctgtgctgaggtttcacaggaataatttcccttcatggtgaggagtcctgggcagaagctattggtgactctgcttcacaaatggggaaactggggcttagagccgggaaggagctagactaagttcaccaaactgaggccccaaacctactctgttcggtgctctcaattgctatgaccggggaccagaggcctgcagggggtggccagggagtcagagagagaccgagccccaaagatgctccaaaggggcccatctcttttctgtccaaggtcctgatcccagctggggtgggggagggctggtggattcctgctttcccagaggcctcagggagcctcccgagggcctggacagggggcaggggagcagtcagggccccctgacttggcaggaagaggagggcaaaggactccagagctgcaggggaggggcaaagagtcaggcatcccagacccagggcgaaggcaacctgacggggtggggctgggcctgacctgcccagggccccagatgggactgggggctttggggtgagggtgggggcaggggatgctttcttacctggctgagtgagctctctcggtcagcagccccctttggtgggatggtggggttggggaggcttgatccacagcatttgaaggggaagcagaggtcaaagtgcttcctagggaccagcagagacctggaagctgaggcagagagtgtagagagaggccattgggggagatggacagagaagctgggagaagcagaacggaggagccaggggggcgggggctcagacccagctgggagaaggggcacgggagagaatgaggcgccccaagcttgcaaggaggctggagtgcttcccgcctgccccgattgggttttctttaatgctaacagcatgctatttactttccatttaaatttgagatgttgctataaattatcaaccagctccttgttcctgcagagtttataactaactacctgggttacttattgttcaggtaacaaaagggatcggaaaacgccctgagtgaaaaaagtggggcctccagcgtcagggtcaggaaaggagccagggagagaggggcgggggacccctattgaaggcctgggccattggggaggttgaggctgggaagacggtacagaggcagaatgtctagtagaagctgtttcccgggagaagtcagtgtctgggaagaagccggggtgggtcctgggtcccaggcctccctggggtgccccatgttggtggccacagcaggaacctgagctctttcttcagatctcccccttagctccctgagtgaccttgggaaagtctgttcctctccttctgcctcagtttccctccctggccaaggaataaagtccaaactccctgccttggtttcgttcccctccctccaccccaccaaattcctggatctcttcccaggtctttctcttcctctcggcctttgctgcagtcattttggctttgctgttcctcagtaccccaagccaattcccaccccagggcctttgcacgtgctcttcctgctgctcagaacctctttccagatcttcccatggccgattccttctccttcagctccctgattgctccatccaaaagggggccccacccccgtcactctcttccactactgttgttcactttctctggttccctgtcaagacttgtgatcatctgatttgtttgttttctatctcctgccatgaaaatagaagctcttcaaggacaaggcccgtgttgccttatttaccacttgtacccacatcctgcccagtggctgatgcacagcaggaatgagtgagtgactgggattgtctgaggccctgaagatatctgctgccctgttggtcagggcccagcagcctgagacgtggccaagggagaaactgggacccagagttccttcctgggtgtcctcccgggtcctttctgtccctgatcagctcaaaccccagcgtgtttcttttttgttgttgttgttgttatttttgagacggagtctcactctgtcggcccggctggagtgcatggcgcgatctcggctcactgcaagctctgcctcctgggttcacgccattctcctgcctcagcctcccgagtagctgggattacaggcatgcaccaccacgcctggctgattttttgtattttagtagagatggggtttcactatgttggccaggctggtctcaaactcctgacctcaggtgatccgcccgcctcggcctcccaaagtgctgggattacaggcactcagagccactgccctcagccttcaaaccccaatcttgaagtattctgatcctgcccatcaggcagcatcagggcactgagactcaggaaaacagtagccacggcaggaggggggggggacagaggatctgacgtccccaacaaaagccagactgcctgcatcctaatcctagctctgcccctttctagcttgagcaggtgattttatacttctgagcctcagtttcgtctgcagggtagagatgacaatagcccttgtccacagggttaaatggcatggcacttgtagagtaaacatgtagtaactgcaatatacagcagttattattagtgatcccattttacagatgagcaaattaaggctgagagaggcagtgccttaccgaacgaaactcttccaaatgactgaaggcaagccaggacttggacctgggtcctcctacctcacgctccatacagcaacctcgaggtcacactttcccctccccagtcattcctgctgtttaagttgaccatcaactcacttccatacagtgctttggagttcacaaagggcttacaaaatgcgctaagctcattttttcctcctccccatctctgaagtctgaaatatcattagccccatttcacagatgcggaaactgaggcacacggaggttaagcaaagaatcaaggccaggtctaaagcccccacactgagaagtcagctcccctccagatgtggagatgaataccacaaccttgcatgccctgaaaccccaggggccagagggcaagaggctcaaagccttggacatccgattgaccctggaaagggtaggagagagaggaggaagatgtgggcgggtcttcacttctcctgggctctgctgtgtggggccaagggtctccagggctgcattgttaagatgatgatgatgacaatattattccacaaattcagcacttactgtgcaccaggcattgccctaagttcatcctccctatttgaagctcatttaattttcccagtagcagtgtgaggtaggggtggatttaccccacgttacagggcagatgtgggtcatgcaagagcacgcgtggctaggtcacagtggtgggatttgaacccacattggtttgactctcaaacccattagagtcaaagcaggagatgcctggagacttgtcctcttagttctttcctttttctttctttctttttttttttttgagatggagtctcactctgttgctgggggtggagtgcagtggcgcagtcttggctcattgcaacctccgcctcccgggttcaagtgatcctcctgcctcagcctcctgagtagctgggaccacaggcatacgacaccacacccagctaatttttgtatttttagtagagacagggtttcactgtgttggccagggtggtctctaactcctgacctcatgtgatccacccgcctcggcctcccaaagtgtggggattacaggcatgagccaccacgcccagccttggcctcttagttctgagctaggacagttggagaatctgccctcaaaaatagtcaggcccttgaagactctgtgtgtgtgtgtgtgtgtgtgtgtgtgtgtgtttgtgtaagagacacacagagagacagaagagagagagtgatagcaagggagtggggggtagggagagagagacatcgattcagtaggttctagaaaaaagtggcacaggtggcttctcccagaaaagggaaagacatgccctcttggttctctgactcctaactggcatttaaaattcacttttttgttgtggattttttgcccaactctactaggaattgtttaaaagtggaacgttcgtatcagctcactttaacagtttgctttccattttcacattcaaaagcctgtcttcggtttctaagggttgcacatgtatttgtgcagggtggctggcctttgttttattttcaagttcagcttaaatttgacctggcatgagagaatgagaatgagagagagagagagagaaagaaacagacagacatggaatcagatggacaggggcacatagaaaatctttggtttgagcccaggagaggctctcaagaggtgagaggaagactgaccctattctctttgtgggagagagaagggaaggagggaggaagggaggacacaggaggacatggcacaggagggtgatggctgcagatgggggaggggaggcatcaggcagcctggctctaggatcagataaacatgtttgccacagagcaccaggctggactttgtactgcccttccttctgagctctgactggcactcagcaaagcagggagatgaaggagagaggatcctaggagccccggaaagaagggagagagagaagctggggagaggcctgcgggggtggggtggtcctggcaacatgaaatatttttgagtcccaactagatcaccttgcacaagtgactgcacctttctgagcctcagttttctcctctgcaaaatgggcacaccgtctacttcctagggttataagatgtaagtggccagtcctcagcacggtgcctggctcacagtaaatcctcaagaaacatgagttctcagacttttttttttttttttttgagacaggatttcactctgtcgccaaggctggagtgcagtggcgcgatcacagctcattgcagccccgacctctcgggctcaagagatcctcttgtctcagccttctaagtagctgggactacaggcttgtgccaccacacttagctaatttttctattttttgtagaaacagggtcccactatgttgtccaggctggtctcaaactcctgggcccaaggaatcctcccaccttagcctcctgaggagctgggactacaggtgtgcaccaccatgcctggctaatttatttttttttttatagagacagagtctcactatgttgtccaggctggtcttgaactgcagggctcaagtgatcctcccacctcggcctttcaaagagctgggattaccaccatgagccaccatacccagtttacaattcagttttaaatattatatatgccaaggtgggaggatcgcttgagcccaggagtttgagaccagcctggccaacatagcaagaccctgtctctatgaaaaaaaaaaaatagaaaaaagaagaaaaagtacaaaaattagctgggcatgttggcatgtgcctgtggtcccaagtacttgggagtccgaggtgggagaaccaattgagcccaggagtttgaggctacagtgagctatgatcacgccactgtgctccagcctgggagacagagcaagtagcctctaaaaagaaaaataaataaataaaaataaatattggctgggcacggtggctcacacctgtaatcccagcactttgggaggccaaggcagatggatcacctgaagtcgggagtttgagaccagcctggccaacatggtgaaaccctgtctctactaaaaatataaaaattagctgggtgtggtagcgcacacctgtaatcccagctactcgggaggctgaggcaggagaatcgcttgaacctgggaatcagaggttgcagtgagctgagctcgcgccactgcactccagcctggccacagagcaaggctttgtctcaaaaaaaaaaactaaataaaaataaatatcatgtatgcatatatagtatatattatgtaatttacaaagtacacaaggacaacagagaaaactgtccttctcactcccatccccagcaccccgttctcctctggaaggaaccagagtccccagttccttgcgtgccctccggtattttacacgtgcacaaatatgtagaaatcctcttttacctcacttcaaattattcataagtagcagcacagcagacacaccagataaactctgctccacctgggcacacagagcttcctcagcggggttttttcagtggttgcattgaacagatgcacctccatttagttaatcagtatccttttgctgggctccttggtggcttccaatcttttgctatggcaagcaacgtggcaaggaattgccttctacttgtgccatttgtcacctgtgccaatattaaaagccacaaattctagaagcgaattgctcagcgaggcaggggaaagcacaggctttggaatcacgcagacccaagttcaaatcccagtctgcctgtttcagtgctgctgtattgagctgtatttatctgtaactttttgtttgtttgtttgttttttgagacggagtctcactctgttgcccaggctggaatgcagtggcgcgatctcggctcactgcaacctctgcctcccgggttcaagcaatcctcctgcctcagcctcccgagtagccgggattacaggcacctgccacaatatctgacttattttttatttttattatttttttcgtagagatggttttctccatgttggccaggctggtcttgaactcctaacctcaaaagacccgcccaccttggcctcccaaagtgctgggattacaggtgtgagtcactgcacccagcctatctgtgacatattggtaatataagttcaggagagggagagagaaagaggcagggattgagacagagcaggagaggaggagagaaaatttatatggctcaggcagtctgatcccttctgttcccccacagggagacccacagcagagacatgactcacaggtggcatcaggtccctttgagtctctctggtgggagaatctcaacccacagagtaggattccagtgttcacatgcatttttggtactatgaggcctctgaatgtcaaccctgtcacctgagactctgttgaaaaaccagccgcggccgggcgcggtggctcacgccagtaatcccagcactttgggaggccgaggcaggcagatcacaagatcaggagatcgagaccatcctggctaacacggtgaaaccccgtctctactaaaaatacaaaaaaattagccgggcgtggtggcgggtgcctgtaggcccagctacttgggaggctgaggcaggagaacggcatgaacccaggaggtggaacttgcagtgagccgagatcgcgccactgcactcgagcctgggtgacagagtgagactccatctcaaaaaaaaaaaaaaaaaagaaaaagaaaagaaaaaccagcctcctgttctggtgctgcagggaaacaggcctggccacagccaagggtgcagattttcaggaagcatttttaaaaatatatatatatatatatacacatatatatatatacagagagagagaagccactgaggcccacagaatttgcatcattttattccttgtccaaggtcacaggacaagcagagtcccacccacctgaaaggattcagttctaagacagcctttagggcaaaaagtcacaaagttgatctatctatctatctatctatctatctatctatctatctatctatctacgtgtttgcaccctaatcactggcagtaaatgcactttttttcttttcttttcttttttttgagacagggtcttgttctgtcacccaggctggagtaggtgtaaaattggagaatccatatttctttccttgttttcagatttaatgctttcctttttccagcaggtctccttcgtccatccatccatcatccatctacccacccacccaccaatccatccatccattcatccaaccatccatccatccatcatccatccacccacccacccaccaatccatccatccattcatccaaccatccatccatccatcatccatccacccacccacccaccaatccatccatccattcatccaaccatccatccatccatcatccatctacccacccacccaccaatccatccatccattcatccaaccatccatccatccatcatccatccacccacccacccaccaatccatccatccattcatccaaccatccatccatccatcatccatccacccatctatctgtccatccactctaccctaccatccatccaccagtccatccatctatccaccaattcatccatccatccacccattcgcccatccatccatccacccacccatccatccatccgtccatccacccattcatccattcatccattcacccatccatccatccacatatcttcatctgtgttgtgtgtctgtgtatccatgtttctaaacctttatctgttccagtgtctgtatccataggcctgtgtccacgtttgtcatgtgtgtgcgtctacaagtctctgtcctcatgaccatgtgtctgtgtccctgtgtcctggcataaatgaccatacctcaccgtccctgagtctatgtgtaggcccctgggctccataactgctttcatgcacagtccccaccctcagggttgacaaggttccagcacccaggaccgcagccccacctatggggagagacagcccttgctgagcagatcccgtccttgccctctcccagggaggacccgtggcgtgtggcgaagatggtcaagtcctacctgcagcagcacaacatcccacagcgggaggtggtcgataccactggcctcaaccagtcccacctgtcccaacacctcaacaagggcactcccatgaagacgcagaagcgggccgccctgtacacctggtacgtccgcaagcagcgagaggtggcgcagcgtaagtaatgaccctaccccgcatcttccctgggagggcccaggactctcccctaactcataggtgggggctggaagcttcaccatccccattacacagacaggtagatggaaaggaagtcagtgggattcaacctgcatttattacctattctgcgccaggcactctgtgggacgggagtagacttggtcctgaacatccaaagatgaatgaaatgggtccctgctttctttttctttttttagatagagttttgctcttattgcccaggctggagttcagtggtgcgacctcagctcactgtgacctcctcctcccaggttcaagcaattctcctgcctcagcctccggaatagctgggatcacaggtgcccaccaccatgcctggctaattttttgtagttttagtagagacgggggtttcaccatgttggccaggctggtctcgaactcctgacctcaggtgatccacccacctcagcctcccaaagtgctgggattacaggcgtgagccaccatacccggcctgggtccctgctttctcagagcccatggttaagtgggaaagtgggagaaaagctcattatgatccagcgagtcatgtattagaatgggacaacagcagccacaacaacaacaataatggccactatttatcatgcatttttggggtgcctggtccagtgcagagtattacacaaagcatttcagggtgctgagctgactgtcgactggggagtaacctgttcttcctcaggaaggcagaggtatcaggaagcctcacattgcaaatatgacctttagaatatgacctttagactaggtcttaaagtgggagttgaattttgacccatggagacgcagggaagggtgtttcaggcagaaggaacagcatcagtaaaggctcagaggcaaggtctacggtcaggaaatcctccactgcaaactcaggaagctctgggagccctattactcagggaatggtgggttttcttctccaggcctcataccccaccaaatcccaagggcactgtcaccttccaacctccatctatgtgtgacattttttgacatttcttttattaattatccaggttaatttttttttattatttttttatttttttgagacagagtctcactctgttgcccaggctggagtgcagtggcgtgatctcggctcactgcaagctccgccttccgggttcatgccattctcctgcctcagcctcccgagtagctgggactacaggtgcccgccaccacgcccagctaattttttgtatttttagtagagtcggggtttcaccatggtctcgatctcctgacctcgtgatccgcccgccttggcctcccaaagcgctgggattataggcgtgagccaccgcgcctggccttaattatccaggtttttaaaaaaggaaatagccaggcatggtggtgtgccataatctcagctactgaggaggctgaggtgggaggactgtttgagcccccaggggttcggctccaacctggacaacatggcaaggttcctcctctaaaaaagaaagaaaggaaagatgataggaaagggaggaaagataggaaagggaggaaagataggaaagggaggaaaggtaggaaagggaggaaaggtaggaaagggaggaaggaaggaaggaaggaaaagaaaagaaagaaaaagaacgagagaaagaaagaaaggcaatacacatttggttaaaaaaaaagaagaaaaacagagtttataagaaaaattagatgcctttaccctaaagcagccactggaattcccagactcttgtgtatccttccagagagattttctgcatatagtagcaatagatatgttattttcttgctctttttctgattaatgggaacatactagacacactattttacatgttgtgttttgtctcttggcaataaatcctgtatatcttttcatattggcactgagagattgatggatctcattctttataagggctgctggctgttatttgtttaactggccacctactgaaggacttttagggattttgcaatctgcgaatacaaccaactgcagcaaaaaacatccttctttatataagtgcatgttcacatgtgactgtgtctgtaggataaattcctagaagtggactgctggaacacagagtagctgctttaaaatcttgggtacatattggcatagttccttccaaagaagttatatcaatgtacacttccaccagcagtaaaaatcactgttgaaaaaaaaaatgtatgcaggccgggcgcagtggctcatgcctgtaatcccagcactttgggaggccaaggcaggtggctcacttgagggcaggagtctgagaccagcctggtcaacatggtgaaaccccatcttaactaaaaatacaaaaattagctggacatagtggcgcatgcctgtaatcccagctacttgggaggccaaggcaagggaatcgcttgaacccaggaggcagaggttgcagtgagccaagatcacgccactgcactccagcctgggtgacagagggagactctgtcaaataaatgtatgtatgtatgtatgtatgtatgtatgatgtatgtatgtatgcatgcatgcatgcatgcaatagacaactctagtccttactctatagctacccctcatcccaattattggggtgttcacactctactgtgctgtaatacacacttggaaaaacagtacattttaatactattttaatttgtatgagaagaaacaaagatttattctgaaaatctgttagaactagatttagtttctgagagaaatagtgttctcctaaaaccatcactagacgaaattttacaatattcgataaaatgcattaaaaaatttctaacagttagaaatgtcatcaaggacttcagcctagagctgagaatagagatgcaaactgtggcccaaatagctttccctgggggatttttaacttttaaggagaaattggagaatttgagatgcagagtcaatatatgactgtagtattaggactctttcagtaacaggggacagaaccccaactcaaatggatttaaacagaaaagggaatgaattgactgaagcaatgtgaggagtccagggctgcttcaggcatggctagatcaaggggctcaaatgaggttcacacagcatttcttgactcttttcttttttgttggcttcattctcagacaggctctcctcatataggcaaagatgggttctggaagccctgggctgccatcctaccagcttagcaaccttggaaggaaaagagctcttcttttcagctactttcagttgaatgactctttttatacttgataatgtaaacttttatttattttattttttgagatgaggtcttgccatgttgcccaggctagttttgaacttccgggctcaagtgatccctgcctcagcctcttaagtagctggaatggcaggcacacatcactgtgtctgctataacagaaacttttaaatgaagtctaacataaaaagtgcccaaatccaaagcatacagttcaatgaattttcacaaagtgaacacaccaatacagataaaaaatagaatattaccagctcccagcctggtgtggttgtacccacctgtaatcccagcacatttgggaggcaaaagtgggaggatcacttgagcctaagagttcaagaccagcctgggcaacagaaggagaccccatctctccaaaaaatacgaataaatgagccaggtgtggtgcagcaggtgtgtagtcctagccacttatgcccgctgctgtttcttggcactgagatggtgagggccctgctgctgctgctgcgcccctgattcagaatctaccttcctctcttctcataaagtgctgtcctagcacttgtgtgtcccagtcctttggtggcctgctcagggataagctggtagaccagtttccagtaaagtggtaccagctgatgaaggctggctgggtctcttcctctagctaacatttgcattttaagcctgattttcaagtctggaaagctgaatataattctgaatacactgaggacatatggctcaaatttttgctctactgcgtgactctggaaaaatatgtaagctctctgagcctcagcttcctcatctgtacaatggggatagtaaatgtgccaaatcagaacaaatgctaatgcttacctgcagtcttgtactgagaaggatggtgagatcatatcttgggttggtaggaaagcattcagggattgattagtgatgtttgccttgaacacaggttaagaaagtgatggcatgtgtgctgtgtgtttgtcatcagtagattagatgatttctaagttctagctgtaagctcctctggttcagcgccatggcaatgagaaagaatcaagggcaaggtcaggggaatggacgtgggaaggtgagagtggccagtaccccactcacggctttctgtgcctgcagagttcacccatgcagggcagggagggctgattgaagagcccacaggtgatgagctaccaaccaagaaggggcggaggaaccgtttcaagtggggcccagcatcccagcagatcctgttccaggcctatgagaggcagaagaaccctagcaaggaggagcgagagacgctagtggaggagtgcaataggtacaacggcgggcgggaaacagtgctggtttggtctgggctgcggcaaggccagggaaggggaaggtgactctaggtcctgtaaaaggctgtccagttgccgagaactcctgatattggcttagcctggcccagaaaattgagaatacttgaacctaagcccattcctcgcagcccccctgcaccctggacaccaagcaaccccttccatggatgctcacccaattcgattctctctacaatcctatggctcttttgctcactttatgaatggagagactgaggtcagacagactgtcaattgcccaaggtcacacagcagacctggcattggaacccagatctgccagcctcaaaccctccggcagagctcagcttctcagaaccctccccttcatgcccaggacagggttcctctgagcctggcctggaggctcatgggtggctatttctgcagggcggaatgcatccagagaggggtgtccccatcacaggcacaggggctgggctccaacctcgtcacggaggtgcgtgtctacaactggtttgccaaccggcgcaaagaagaagccttccggcacaagctggccatggacacgtacagcgggccccccccagggccaggcccgggacctgcgctgcccgctcacagctcccctggcctgcctccacctgccctctcccccagtaaggtccacggtaagtggtatgtggggacaagggacacgtgggaaggtgggagggttggggaggactgtcccagtgacagcagtcacctaaacctctttgcacttcagtttggttccattccattcatgccactccttatcactctacttcactctgttcattcatccattccactctatctcattccattcactctactcctttccactctattcactccatccaccacaattaaccccattccatccactccatccactaccttcgactccactccatccactctactccattcactccactcaactccactccatccactccactccgtccaacttcatcccatccactacattcaactccactccatccactctactccatctactaccttcaactctaccccatccatccactccactccatccattccatccaacttcatcccatctactacattcaactctactccatccactccactccatccattgcatccaacttcatcccatctactacattcaactccactccatccactccactccatccattccctccaacttcatcccatccagtacattcaactccactccatccactgtactccatctactacattcaactctactccatccactcccctccatccattccatccaacttcatcccatctactacattcaactccactccattcattccactccatccattccatccaacttcatcccatccactacattcaactccactccatccactccatacctggctccatccactccactccatctactacattcaactctactccatccactccatactctattccatccacttactccatccactccattcagctccactccatccactccactcactcaactccatctactccactccctctacttcattcaactctgctccatccactccactccacccattccatccactgcactccaaccagctccattagactccactccatccactctacccactcttctctccactcctctccactacataccattttattctatctgtcccatccactcaactccattcactccacatgactccacatttcatccattccactctacttcatccactcactccactctataccattccactccactctattcacatactccaccattccagtctactccattcactccactccaacccactcactccactccataccattccactccactgtgttcacacaactccatccattccactctagccactccattcattccactccacgccacactattcctcaccattccatccactccaccctataccattccactccactctattcctccccacccgtcctctccaccctttaccactccactcgactgtacccattccacttgatcccactcattccactcaattccatctactctactccacaccatccactccacttcatatcattccactcaactcaacctaagttgatttgggttaattcaattcaattcattcatttcagattgtatcaattcaattcatttcaattcaactaaattcagttaaattcagttcagttgtcttctactgagcacctactgcatgtcaggtatagcactaggcagtgggaggaatggagctaataaatgcagtcccagccttcaaggaactgggagcagctgacccagggcttggcaaaaggtagaaacaaaggcagatttgctggctgcataaaggcagacaggcagctggcctaagcaaaccaatggagtttgaagtgctgagggctgtggaggcaggggagggcagggaagtggggtgctgaggcaggacactgcttccctctccaggtgtgcgctatggacagcctgcgaccagtgagactgcagaagtaccctcaagcagcggcggtcccttagtgacagtgtctacacccctccaccaagtgtcccccacgggcctggagcccagccacagcctgctgagtacagaagccaagctggtgagtgtccttgcttgtaaggaaaacccaacctcatctttccttggcagggagattctggagcagtccctagggaggccctgtggggaccccggccccccggacacagcttggcttcccctcgtaggtctcagcagctgggggccccctcccccctgtcagcaccctgacagcactgcacagcttggagcagacatccccaggcctcaaccagcagccccagaacctcatcatggcctcacttcctggggtcatgaccatcgggcctggtgagcctgcctccctgggtcctacgttcaccaacacaggtgcctccaccctggtcatcggtaagctggtggggatgggtgggcacctgggtgggaggctcatggggcaaccgcagaatccaggagctggaagagccactgggactcattcattcattcatacaacatgtatttatccagtgcctactctggaccagtcactgtgctacatcagtgatacctgggtgaaccaaacagaccaaaatctcagcaactcaagcagggaggcaggcactaagcataatacatcaattctgtggtacctcagaaggtgaagggtctatgggcaaattacagcagggtaagggggactgatgttttctaagtttttgttttatgaagaaaaattaagcccagaaagcccttatttgcaggtacaattatgcagaagcccagtacataagatagataaggagctgctaggagaggggagcagagaactgaccccatggcctttgcactgctgtggaaccccagggctccagggaaccgcagtttgacaacttttgaacaagtcaccgcctgcctctcccactagcctagacaaagagctaaaggctcagagagggggaatgacttgccagagccacttaaattagtggcaggtcccagtggagggctgtttcctgaccaccctgccccctcctccaaaccacgggctctgggaaggagaggtggtgcccttgggaggtcttgggcaggggtgggatataactggggggcccagctgattccctccccttccactccaggcctggcctccacgcaggcacagagtgtgccggtcatcaacagcatgggcagcagcctgaccaccctgcagcccgtccagttctcccagccgctgcacccctcctaccagcagccgctcatgccacctgtgcagagccatgtgacccagagccccttcatggccaccatggctcagctgcagagcccccacggtgagcgccctgtgccccacacagcaggagatgatgatagaggttggctgtcaatggatgcaggggaaaggggtgcctggcaggcattgcagtctgcatgtgtctctgggacaagtgtgtttccgtgattgagggtgtctgcaggccagtgtgttcccatgtgaatgcacgtatctgtgtgtgtgcacgactgcttgtgtgagcagatccctagtgcgtgtctgggtgtgtatcggttgtgcatgcatttgtgtgcatgcctgtgtttctctgaaactcttagggccatatgaatttctaaaatctattcagattttagaaaggtaatctggggccaggcgtggtggctcatgcctgtaatcccagcactttggaaggccgaggtgggcagatcacttgaggtcaggagttcaagaccagcctggccaacacggtgaaaccccgtctctactaaaagtacaaaaattagccaggcgtggaggcacgtgcctgtagtcccagctacttgggaggctgaggcagaatcgcttgaacctgggaggcggaggttgcagtgagctgagattgtgccactgcactgcactccagcctgggcaacagagtgagtactctgccaaaaaaaaaaaaaagaaaaagaaaagtaatttggtggatatgccagctatcacataacactcccagcagggtttgagacagccccctgtgatcaaagcactgctatttctgcagccaaagataggatttccacaaggcagtttaaacactcataacctcataccaggttcaggctgggtttcgccaccaaatgagctctagtgccaatcttaaggaaatcttttggtttcagacctttttggaatttgggactgggttaagagatttggggcctgtgtatgtctgtgtgtacatggttgagagtgtatgcgtgtgtgtgtgttacatttttatctgagtcactgtgagaatatgtggtttatgtgcgttttcctagtgtctgtgtgtctcttgtagggtctatgtgtctcctgaggggtgggtggaggtgctgtaggcaaaacatggggttatatttggaaaggtggcctggagatggaagtactgctgtcctctgccttgctctttgacaggggccacctgaacttactacacagcacctgagtttagtacagtagcacctgtgcttagtacatagcacctgtgtttagtatagtagcacctgtgcttagtacatagcgcctgcatttagtacagtagcacctgcgcttagtacgtagcacccgtgcttagtacagtagccctgcacctgcacctcccgttccctttcatacctgctgtctccaggtgacaagaggagctggagttggtttctggcctcctccaggctcccctgcatcaagcgcagctgagcagttccctgtaatggggagagggtctgtccctttatctggagcctccagttttgaaaatcagccctggatctccaactgctgcccagtctggctgttcagcaggccccatgcccccctttccccagtcttgaggcctgggactagggctgtcaggcacgtctgccacgtctgcccctctctcccctgcggccagccctctacagccacaagcccgaggtggcccagtacacccacacgggcctgctcccgcagactatgctcatcaccgacaccaccaacctgagcgccctggccagcctcacgcccaccaagcaggtaaggtccaggcctgctggccctcccttggcctgtgacagagcccctcacccccacatcccccgggctcaggaggctgctctgctcccccaggtcttcacctcagacactgaggcctccagtgagtccgggcttcacacgccggcatctcaggccaccaccctccacgtccccagccaggaccctgccagcatccagcacctgcagccggcccaccggctcagcgccagccccacaggtgagaggccctggctccaccccctcccttactgtccctgcccccttccatgttggtcccaccccttctgttgctgtccgtcactgtggggctgtgcatgcagcaggcctagggctgctgtgaggaagcactggcaggcgtggaggggtggggtgggcttccatgaagcccaagaggcacaggcgaccccaggaagatggggcccaccttacaagaacatctcagggactggactgaggaaaatgatgaagtaattgttagaggcagtggagagtaacgataaggaccaggtctgtgagccagaagcgactcttgcatgtgtttggtttggcttggctcagggttgaacattctttgaatttgttgccaacatttcaaaatcaggaattttcacatagaaatccagatttctggcatcttttggaaaattggaaaaattcatattcccatataacagtgcaccaggcctcactgcatccactcacatcggctccaatgacccctggcggtggggcggtcacctgagtttgtaatctatgatgccattgtcaggagtgggcactttggagtcaggtgggtgggctttgcagcctgcctttttgcaagctgccccctttctataaggttcctggacccggccctggcagctgtcatgacagccactgaggccattctgtgtcctggcattcaccccatgaggcgtgtccatgaccacccccattttacagatgagaaagtggacactcaaggaggggagggacttgcctcatctcccacagctaccagatggcagggccaggactcgaacccaggtcccacctcaaagcccattctcttaaccattgccatcagtcagggttctccaggaacacagaaccaacagatttatttgaaggacttggcccgtgtctgcggggggctggcaggcctgaaatctgttgctggcagctctggggagtgaattctgcagccttgaggcagaattccttctctgggaaaccggtttttgctcttacggccttccactgatgtaggaggcccacccatattttcagggtaatctccttcactcaaagccaactgattgtggcattaaccacatctacaaagcacctgcattcacagcagcgcctagattagtgtttgactcagcctagccaagccaacacgtacaactacctacctcggcatctcaccggggcttctccagtgttcacactaagatgtactcaggccactccatgggcggccgtggaccctggctgggaggctccctttgaagaaccgagggtagaggtgtgactttggggttcctgttatctgctgtgatccaggaggtgtggccctgcctccccatcctgagtacccctagggacaggcaggtggggtgggtgtgggtgcctggtgggtggctagcagccttgtttgcctctgcagtgtcctccagcagcctggtgctgtaccagagctcagactccagcaatggccagagccacctgctgccatccaaccacagcgtcatcgagaccttcatctccacccagatggcctcttcctcccagtaaccacggcacctgggccctggggcctgtactgcctgcttggggggtgatgagggcagcagccagccctgcctggaggacctgagcctgccgagcaaccgtggcccttcctggacagctgtgcctcgctccccactctgctctgatgcatcagaaagggagggctctgaggcgccccaacccgtggaggctgctcggggtgcacaggagggggtcgtggagagctaggagcaaagcctgttcatggcagatgtaggagggactgtcgctgcttcgtgggatacagtcttcttacttggaactgaagggggcggcctatgacttgggcacccccagcctgggcctatggagagccctgggaccgctacaccactctggcagccacacttctcaggacacaggcctgtgtagctgtgacctgctgagctctgagaggccctggatcagcgtggccttgttctgtcaccaatgtacccaccgggccactccttcctgccccaactccttccagctagtgacccacatgccatttgtactgaccccatcacctactcacacaggcatttcctgggtggctactctgtgccagagcctggggctctaacgcctgagcccagggaggccgaagctaacagggaaggcaggcagggctctcctggcttcccatccccagcgattccctctcccaggccccatgacctccagctttcctgtatttgttcccaagagcatcatgcctctgaggccagcctggcctcctgcctctactgggaaggctacttcggggctgggaagtcgtccttactcctgtgggagcctcgcaacccgtgccaagtccaggtcctggtggggcagctcctctgtctcgagcgccctgcagaccctgcccttgtttggggcaggagtagctgagctcacaaggcagcaaggcccgagcagctgagcagggccggggaactggccaagctgaggtgcccaggagaagaaagaggtgaccccagggcacaggagctacctgtgtggacaggactaacactcagaagcctgggggcctggctggctgagggcagttcgcagccaccctgaggagtctgaggtcctgagcactgccaggagggacaaaggagcctgtgaacccaggacaagcatggtcccacatccctgggcctgctgctgagaacctggccttcagtgtaccgcgtctaccctgggattcaggaaaaggcctggggtgacccggcaccccctgcagcttgtagccagccggggcgagtggcacgtttatttaacttttagtaaagtcaaggagaaatgcggtggaaacttcttgcttgtccacaaatcattcagatggggtttgggcaggtagcgggaggctggggcaggccagaggcctgcgaagaggagacaggctccagcacccacgctctcacaccccacatctctgcttttcttgctctgctgagactctaatgacaaagccagatttcatcttaacctcaagcttctactttttaaaaaaattttgttttggagacagggtctcactgtcacccaggctggactgcagtggcattatacagctcactgcagccttgaactcctggactaaagggatcctcccacctcagcctcacaagcagcctcacaggcgctcactaccatgcccaactaatttttgtattcttttttttatagagacgaggtttcaccatgttgcctaggctggtctggaactcggctcaagtgatccacctgcctcggcctcccaaagtgctgggattacaggtgtgagccaccatccctggccatgagcttctacttcttttctttttctttttctttttttttttttgagatagggtcttgctccattgcttaggctagagtgcagtggcgcaatctcggctcactgcaacctgcacctcctgggttcaagcgattctcccacctcagcctcctgagtagctgggattacgggcgtgtgtcaacatgctcagctaatttttgtatttttagtagagatggggtctcgccatgttggccaggctggtctcaaactcctggcctcaattgatccacctccttggcctctcaaaatgcttggattacaggcatgagccactgcacccggccacaagcttctacttcttgcagaatgcctttgtcccatgaaacctagtccacgagtgctatgacacttcctgaagtcttgggtggggtgaacgcacaaatcctgggggtgtagagaggaggaggatgtttacttaaaatgtcttaaggttcagcattgacagagaggcaatatccaaatcactctaagttttgttttgggtcctctgacaattgagtttccataatctggtcggctcagagacaccatcatgtgtggtatattcacaaatgcagacaaagaaaattctagaaagccaggggtgaaaaagctctcctttctcagacgattctgtgaagtctatgtgggctaaggagagaagaacaaaagtttctctgggccttggcctcttggggatcccttctctcattttctaaaaactgtttctcacaccaggctaaggaggtggtggggaaggtctcccttcccctgcccacctcagacagttctagggagatggaggtttcaccacttggccactagtctcaaataactggaaggttccttttttcctgaggtcatgaaatgttctggaaccacagcgcccccgccagccctccgtgggagcacagaggggcaggccttgattggtcttctcaccctacagccacttttttggcccaactctcgagcaagccttcatcaccatcagggtctcatgggcagtctgggtttgccagcccagtccttgaacttggagagggaggtggggcttggaaatgccttgtccccagggtgggggggacaccttgtccttggagctggctgagccctgtgcccatggctgggttcagtttgcaggtatagctgtagcactctttgctggtgggaatggagaggtctcgctggccttctttgcctttttcttctttttggtcccaagcgacacctggtccccgttgagctcacctgacttctgcttctggactgtggccatgctggtgggggtggtggcagcgacagccgagtcgacactggccaccttcttggctttctttttcaacttccttttcttctttgcctccttctccactgttccagggctgtggatggctgactcctgtaggatgtcggacgccgacacagctgcctcccggcaccgccgccactcctcgtcactgtcctcactgctgcaacgagagggtaccctgggttagctggagtcaggacacagccccagagctgcctctcgctgtcctcccttggtccaggtcaccagaaggtggccgcagagagaggcaggtagtgagttcaggcttgggagtgaggccaacctggcttccaatactggcttctgggcgtagcagccttgtgacctccttaagtgacttaacctctctgactgtatcatctctaaaacggggatcttaacagagtccaggcctcccagggatgtcccaggaggcaactatgatcaagtgaggtgtctggcccaagacaggtgctcaaaagcagtaaacatccaaagctgccgccaagagggctttccctcccgctgagctcatgatttctccagctgcctgacagggccactgccttggcctggtcctgactggagtctgcttggctattccagggaacccaccaagacagaagaggagaaaaaaggaggggacgtgaggagaggtgtgagttctcacctggagctggagggctgtcgctttcggcggggttggggagactcttccttctcacggcctccagggacagatgtgaagaaaaggcggaaacctaagattcaatggggcagagtcaaacaaaaacaaaacaaaacaaaaagaaacataaaaaaataaaaaataaagaaacaaaaaagaaaaaaattttaaaaaggaaaacgaaagaaagaaaagataaagagaaacaaaaaaaaaattttaagaagacacaaaataaaaaaatttaaaaaagaaacaataacaaaaaaacccaaccaagcaaacaaacaaaaaaaacaaaggagcagagtcagcacccccagatgccagcccctcctcccaggtgccaggtgctgaagctgccccgcctctgccctcaggagctcctggtccagaggcaaagacccaggaatcagtcgtctaactacaaagtgattctgcatctgccaagggtcatgctgatgcctgatggagccagtggagggcgcgctggagcaggagccagcagccacatcagctcagcaagccctcagaggcttctggaagtcagcacttgagctcctgacctaaggcagccttcaaagtggcaaatgtgttggtacaggacagacgcagatgggcgaggctgtggagggcagcagtaaagtgctcctgctcagggtgacacagacgaggccgcctcaggcaaatgacttcgtttctcagggcctcagtctccttgtctgtacatggggttcaatcataatacctgcctcaccacaggggctgagcagatgaaagaatggtgaggtggcccatgcctgtaaccccagtactttggtagtctgaggcgggaggatagcttgaggccaggagtttaagaccagcctgggcaacatgacagaaccctgtctctaaaaaaaaatacaaaaattagccaggtgtggtggtgcacgcctgtagtcccagaactttggaaggctaaggtgggcagatggcttgaggccaggagttcaagaccagcctgggcaacatagcgagatcctgtctctaaaaaacataaataattagccaggggtggtggtgtgtgtctgtggtcccagctactcaggaagctgaggtgggaggactgcttgggtccgggaggttgaggctgcattgagctataattgctccactgcactccagcctaggtggcagagagagttcctatctcaaaaaaagaaaaaaaaaaaagaatataccaaaactgtttcgcccacctccagacacacattaggtgcttaataaatgatagcttctattaagtataaccactcaccatcatcctccaaagcgactttctgtaccttagcttttgctggctcctttgctgcttctgagatggtaatgaagctacagggagacgagacggttgatttaagatgagatttttggataacgacaaaaacaaaattctttttcaagtggaggggatggggtatgtgattgtaaatgcaaaagcgaaagcgtgctggcctagtaagagggctgatggtctggttataacatgctgaccagcctctgccacgcgaactgcagtgcttcatttctttaaagcccactttattccagtaagtgttgaagaagttttaaagacatagtaaaacaagatgaggccaggcatggtggctcacgcctgtaatcctagcactttgggaggccaaggcaggcagatcatgaggccaggagatcgagaccattctggctaacacggtgaaaccccatctctactaaaaatacaaaaaattagccgggcatggtggcgggcgcctgtagtcccagctactcgggaggctgaggcaggagaatggcgtgaacctgggaggcggagcttgcagtgaactgagactgcgccactgcactccagcctgggtgacagagcaagactccatctccaaaaaaagaaaagaatttaacaaaatgaatgcaatttcaaataggacaaagagatataagggcaagaggaacagaaagacctagaagtgtagtcaggaagtcctatacacttgttagagagagggcatacattttgctctgagcttcctagcagcaagcatgaaaagggaaatatgaccaatctagaaaactggttcagaggacagcttctggagcagggcagacctgtttttaaatttttttttttaattaaaagaaattggagataattgtagacatgcagtagcaacaaataatgcagatgttccatagaccctccatccattttctcgcaatggtaacattgtgcctcgctatagtacaacatcacaactaggaaatgcaaattgatccaattcatggacctcattcagacttcagagacctgggttttgaatcccggttttgtcacttattagctatgtcccttaagcaaatgactttatctctctgagtctctgttatccacctgtgcagtgggaacgatgaaggtccctacctcttaaggttgtcacaaggattgaaggggaaaatggatatcaagcacttgtggcacacggcctagccacaagtagctgctcagcaaatggtagctatgatgacgatgcagatgatgactgtcatcaagaaaagcttcagccttcacaggctctctaacataaaaataaaccacatttctctagaggcacaaggccaggaagcatgtgtctggtgagtgcagatggagatgccactgtgcacagcagagaacaaggctctcagcaatgccctcgaggcagacgcagcaatgccctgggtgctttccctaacctcccttcctgtatgccaaaggtgccccccaagccctgttcaggaaaagcaacccggggagagggagtagagatgatgccacccaggcacctgttcttgaccccacacagtggttcaatggtggccatcaggggcatttggcaatgtctggagacatttttggatgtcacaactggtggggtgagtgctactatcatctagtaggtagaggccagggatgttggtaaacatcctataatgggaagaagaaggatagacccccacgacaaatgctagtcaaagatgtcagtagcgccaaggttgagagacactgacctaacactagggaccaaatgcagtatcatttacatttccttttttttttttgagatgggatctcactctgtcacccaggctggagtgcagtggcacgatctcagctcactgcaacctctgcatcctgggttcaaacgattctcctacctcagcctcccaagtagctgggataacaggtgcacgccaccatgcccagctaatttttgcatttttagtagagatggggtctcaccatgttggccaggctggtctcgaactcctgtcctcaaatgatccacccgcttcagcctcccaaagtgctgggatcagaggcatgagctgccacgcctggcctaaggtatcatttagatttctttggagaaacatgaaaatgctgcagggaatattctaaccatggctgactggcatttctactgcagaaacatctctgtgactcagtgcaatgccaagcaggccctgttcagcctgaagccagagagtcacaaaggaaaactgctcccacaggctgaaatgcagctgccttcctaaacacctcctctactttctccaattgaggggaaccctgtgggattcaggctgcggggctctggcccatcattctgtctcagaagaatagctggttcacactttgggaaggctcatttgtcctttttgatatctactttgaatggaatgacaatggccccaaatcctgcctcatctccctttcaaaaccctgccagggctctgccagtcaggaacagatctagaccagtgtatccccagacctgttccgcaggttgttgactggttttccatgaaacaaaggcactgtggccaaacaagtttggaaaatgctgggctaaacagttacacaggtctcttcactacaggaattctcagagccttgaatatactactctggcttgcagtctgcaaggacacgtggaggtatgtagattgcagtgtttctcacgcttctttgctgttggacctccttttttctaaagccacgctttgggctagtgctagaatccaaatgtttgtgtcctccccaaattcttatggtgaaatcctcaccccagctgggcatggtgccttacacctgcaatcccagcactctgggaggccgagccggtggatcacttgaagtcaggagttcgagaccagcctggccaacataatgaaaacccatttctactgaaaatacaaaaaatacaaaaaattagccaagcgtggtgggtgcgcacctgtaaccccagctactcaggaggctgaggcatgaaaatcgcttgaacccaggaactggaggttgttgtgagccgagatcacgccactgtgctccagagggagactctgtctccaaaaagagaaaagaaaaagagaaatcctcaacccaaggtattaggattaggagatgggggcctttgagaggtgattaggtcgggagggtggagccttgatgaatgaaattgctgctcctataaaaaaggtctgagagagacccctcgcccatgccactatgtgaggacacagtaggaaggcgccatctgtactgggaagagggctctccccagacactgaatctgctggtgccttgatcttggacttctcagcctccaaaatgtgagaaatacatttattttgtttataagctacccagtttatgttattttgttatagcagcccatatggactcaaacaggttgtatccttgacacctactttaggaatgccaacctgaatccttaccgactgggttatcaacctgtgctgagaatgtaagatagagacctggcacagtgtctagcatacagaaggcacccaagaaataggaacacggtccttccttgccctcttgtggcgggaatgagcttctcgatgttcctctcttactctcatggttgcaggataatgcaggggttaagaacatgggcttggcccggcacagtggctcacgcttgtaatcccagcactttgggaggccaaggcaggtggatcactcgaggtcaggagttcgagatcagcctggtcaacacggtgaaaccccgtctctactaaaaatacaaaaattagcctggtatggtggcaggtgcccgttaagtccagctacttgggaggctgaggcatgagaatcgcttgaatccaggaggtggaggctgcagtgagccaagattgtgcgtgccactgcacgccagcatgggcgacagagtgagactctgtctcaaaaaacaaaacaaaacaaaaaaatgtgggcttggagtcagacgcacttgggtttgaggcccaattctgttccctcctgggttctgaatcctggctttgtcacttaatagcggtgtcccctgggcaaatgactttgcctctctgagcctcagttacccatctgtacagtgggaatgataacagtccctacctctcagggtcatcagaaggattaaatgagaaaatggacatcaagcacttagcacagagcctggccacaaacagttgctcagtaaatggtagctgcgatgatgatgtgacttcaggcacacctgtctccttgctgacagcctgtttcctcacctggaggataaaggtaacaacaggacccacatgataatgttctttataaatgcagggagatgacatatgccaggtgcctgccaccgtgccagcctggacaccgtgagctcccagccaatgtgagccattgctgttcatattaacaagggcaagagaggagaaactccacctttgtttacctgtccagcagggctcccagcttcttggctacgtgggctcggaattcaggggtggtctgaagctcgttgccatcttgttcatgctcattcaccttatgcctacgacacacacaaagagacctcacttcctgcccgctcagaagctgtccccatgagcacagggaccatgtgtgtcttgttcacctggaaatgccaggcgtgaagcctagcatctggcacacgcaggggatcagtatttgttgaataagtgaaacttgaacccaaagtgcatagtacctgaggctcggttgggaggttgacaactggctatttgcagcacctgtggaaaaatgaaaattagggcatttatagaggaaacaatgacagcaacaacaaatgcgtgccaggcactattttcagcagcttaaaatacatataactcatatatatacatacacatgtaactcatatatattatatttatatataacttaaaatagttatatacccataacttcaaatagttacatataatttagttatatatgtatataatatagttacatattttatgtaagtacattatatatatatatatcttagttatataacttaaaatatatatataacttagttatatatataaaacttaaaatagttatatatataacttagttatatatacataaaacttaaaatagttatatatgtaacttaaaatatatataacacatataactcagtgaatcttcccaacaacccgattggagggattacaattatcccattttgcagaagaaacgtcaaagatatgtaaaataacttggccagagtcaaatacctaataagtgacagggttgggctgggggcccaggccatctgactcctgagccccctcttaaccaccacgctgtgctgaacaggcaggtctaagtgtgatttgactgcacagtttaatgcctgcctggctgtgtgctaagtgccgtggaagagagagaagatggctcttttgtggatcacatttttcaagccaaaacggtggggatgcccggccttttggtcattccctcaaaccagatactgaatgccttttattaaccaggtgttgtcattgctgagcaacttactcgactatcactgtctgcaggagcttacattctagttggtggagagagatgataaacacacatacgtaaacaaaatgtcaagttggataatgctaagtgtatggaaaaaaacggaaacaaagtaggcgagagaggtggggagtgttgggctggggattgttaacataaaggtgggcagagagggcttcactgataaggcaacatttgaacagagatttgagagaggagagggagtgaaccaagtggacatgtgggacacagccttccaggcagagggaaagcatctgcaaaggccctgagactggagcctgctttgtgtgtttagaaccagcaaggaggtcagtgtgaccagagcctgcccagtaaaccgggagcagcagagatggagaactcagaggggccagatcatgaagggccctgacgtgggccaatgggaggacctggactttgaggaggaggagctctggaaatgagcagagaagggacataaactgacctgggttttgacagaacatctttggctgctgtgcagcgtgagactgttggggcaaaggcaggaacacggagtctgctgcagta

SEQ ID NO: 1191 - DNA, 68120 bp, Homo sapiens
ttctaggcagtaaaaacttaccatactcttccacagaaaaagaaaaagatgacgtgtggatatatgtttacttataataaacatgcatatatatgcatgcatgaatatgagtacaaggacatatgtattagaacattgtggtgtgcaaaagaagatgagaaaaactagtcataatctcgcagaagaagccctgataaagtatgctagggcaagtctgcaggcctctgattttagctgcttaactattggatacacagacagtgttgaaagattgtgttcaaggcactgcagccctcagagaactagccccaaagcccatgaccccacaagcaactttagggagctgctgtggatgaagtacctggccccactggaaaggcactagaaaatgagctcttactttgcagggagtggtcaggggaacatcaaggaaagaagaaggaatcatcaatggggcttggggctcactcaggaggagctcttcctgataggtgctttaaaggaatcagtgctcaaaacccctggatgtgatgagctcattcatccttgagggaccctttgtcgcctctcacctgtccttctgaggtcctccacgcgttccccttctctgttcttattccaaattcctctactacatttactcaccctggatttctgggtaaactttattagatttgttacatctattttcctttcccattagtcaatttttaaatgtggtagccaaaataatcaacatcactagtaattatacccatactcaaaaactcttctggtgaagaggcatggcagaactccacagggaaatcctattgtgaggattatataggtcggaaagtcatttttaactgacatgcatgataaagcacatgctacataccaatggaatttaacgttcaaatggaataataaactatgtttgcagtatacatttctagatccatacatgaaatcacatttccattaaacagttttcaagtcagtgaccaattccctcctacttctcctgaaatttatatgaacctggatcattttaataccactggaaagaaacactatacttagaaggagatgaacaacagatttaatattttttcgtttgcggtactaggaggcaagctggtaactctaatgccctgtgtgcctcgactcctagatctgagtagtcaataagaaagtagggaagggactaccagcaagaaaagaagcccactaatatttccttctccttccttctgtgttttcttctgcttaataattgagtctaatattaatggacaaggattgccagaaaaggcatgatctagaacaggggtcagtaaccttttctgtaaaggaccagagagtaaatatctgagcccttcgcaggccacatgggctctgttacaactactcaactgtgccattgtgccacaaaaatggacacagcattgctgtattccaataaaactttaattatgagccttgaaatttgaatttcacatgattttcacatcacaaatattaaattccaatcatttaaaactataaaaattattcttagctcactgatcctataaaaacaagcagtgggccagattcagcctataggctatagttgccagtccctggtctaaaacttttaatacattaagagtattcttctcattaaaaccactgaaattgaagtcattttctctctttctgcccatttacttttccctaagactttaatttttttccccacactctcattcccattctgatttaccaggacattacttctcctctctacctcacatatttgttttattgcactataaacctcactggagaataaaactatttgccaaagacccacctgtaaacacccagcactgcagcagccactaacaaagaggaagacacagaacctgtggccaatcatgtggacattggcaataatccattcccttctccttctttcttcctggtagagtccacctcttataatagtctgaagaaaacagattgttacttttccaccttcctggcaaacaaaggggtatgtctgtgaccaactcctggacagtaagacctgaagagaagtctgttggggtgcttctaggaaaggtttttctcactggaaaaaagaaagctacaagagcagaatccccaccctctccttgtttcctacttttagatgatatcatgtaaagagacagtgtttagagctgcagcagccattttgcaaccatgagggaaatccaggaattggtccacaggcataacatcattaattcaccaaagcacctccacagctctctccccctggacttcctgttgtaggcaataataaatccccaagatgggaattttgttgccatttattacaccgacagacttcattcttgcaaagcttacattgctagaggagtgatgtgacacataaaatgaaaaacccgttacaaaaaaacataaaatatcaggcaggacacagcggctcacacctgtaatcccagcagtttgggaggcggaggcaggtggactgctcgagcccaggagttcaagaccagcctaggcaatatggcaaaatcccatttcgacaaaaaaaaatacaaaaattggccaggcatgtagtggacacatgtaatcccagctacttgggaggctgagatggatcacttgaggccaggaggttgaggctgcagtgagccgaggtcgtgccactgcactccagcctgggtgacagagtgagaccctgtctccaaaaaaaaaaaaaaaaaaaaaaggaagaaaaaacctaaaataccataactcctccctccttggcagctctattcgacctaaatcaaaatacgttcatatctctcccacagagttactgctctatatatactttctgctttacagacaaacttcttaaaagttaatctgtccttagcagggcacagtagtgcacacctgcaatcccagctacacaggagactgaggcaggagtatcttttgaacccaggagtttcagaccagcctgggcaacacagcaagacatccccaccccaccccacctccgccactgtctctaaaaacccaccaacttatctacccttaccatctccacttcctattctgtcatcctcactcctcaaatagcaatactctgcccttctttcacccacattactccatcaaactgctttcaacagagtcaccagtgacttcccagttgataaacccaagcacagtttttagctcttatctggcctgacctctccacacaggtcaaaatagtcgatactatacactatacctcccccgcaccatactttttttttttggtttgtttgttttgagacagagtcttgatatgtcgcccaggatggaatgcagtggtgtgatctcggctcactgcaacctccacctcccgagttcaagcgattctcctgcctcagcctcccaagtagctgggattacagacgcccaccaccatgcccagctaatttttgtatttttaatagagatggggtttcaccatgttggccaggctggtctcaaactcctgacctcaagtgatccacccatctcggcctcccaaagtgctgggattacaggcgtgagctaccatgcccggcccacaaaaccatactttccagattttcttttgcatccttaagtatttatttctggcttctccttctactaggctcttaatactagtgttccccagtgttcctgtacccccctccctgttttttcttattttacccactctttttatatagtctcatctgtacctacagctttagtgaactaattagaagtaatttgtaattagcagcactgattttcctgttgaaagttaactactaaaatccctcgatgtgacagttcttttagttaggacaaacatgcccccaggaaatgaagtaatactattcatttgcttgcaaaccattttttccccatagatgaacttcagcccaaataaaatcaaactatccaaaattcccagctacttgggaggctgaggcaggatccaaattcatgtaattttcgtgtattttgcaagtttgttttatgccatattaattcattacactccacatcatattttcttagcaaatacatctagacacctggcactcagtaagggatattcctggcacgataatcattgttatcattagacattgcaggaaccaccatatggatggataaatgtgttgtttaatgaaggcaagcaattactttaagagatcctagttgttataaactctctctggacttcaagtttggtatatacataattattaaatgtatacataattattaattgtaacatgtcctcacaattgatttctggctatttttctaaggattttacactttatttagtaaaatatattaaagaggttaatgataatttttttatagagacccttagattgaaaatgactgatttttcacacctcttttcttgctttactaatcgtcagtgcctaattgctaaagcaaaatatcttctaaattctggggaggaaattctactttgggccaggcgcggtggctcacgcctgtaatcccagcactttgggaggccgaggcgggctgatcgtgaggtcaggagattgagaccatcctggctaacatggtgaaaccccgtctctactaaaaatacaaaaaaaaaaaaaaaaattagccgggcatggtggtgggcacctttagtcccagctactcgggaggctgagataggagaatggcgtgaacccgggaggcggaggttgcagtaagccgagatcgcgctgctgcactccagcctgggcgacagcgagactccatctcaaaaaaaaataataggaaattctactttgaattgcacactaatcaaaagactccagcttcatttacagagaccttatctgtgctaagtagtttttggaatagcttttttcctgtcacttaagcaccttcctttattattaatagtaaactaaataggagtccaaagtctgcctttcccagtgctagagtataaatgtcatcacacggtagaatgtaaacatcttttttttttattatttttatttttttggacagggtcttgctccgtggcccaggctggaatgcagtggcatgatcatggctttcactgcagtctcaacctcctgggcccaagcaattctgtcaccccagcctcccaagttcctggggccacaggtgggcaccaccatggctaactaattttttaatttttttttttgagacagagtctcacactgttgcctgggctggagtgcagtggtgcaatctcggctcactgcaacctccacctcccgggttcaagcgattctcctgcctcagcctcctgagtagctaggattacaggtgcccaccaccatgcctggctaattgtttgtatttttagtagagacggggtttcaccatgttggccaggctggtctcgaactcctgaccttgtgatccaccggcctcggcctcccaaagtgctgagattataggtgtgagctactgcgcctggcctgattttttaatttttatttttatagagatgaggtctcactatgttgcccaggttggtctccagctcctggctcaagtgattctcccaccttggcatcctaagtgctgagattataggcatgagcctccatgcctggcccctttatccatcttttaatgttaataattatatccatttctgtttccttcaaaaattcaagtggaaaacctgacataaataatggtaacttttttattatacctatatcaattaacacatatgtataaaacttctacttagttgtgccaaatatcagtgcacagtatgggtgatttcccccacttgcgaagaatggtgctatagtcaccgcacaggagcaggatagatccccactctcaaaattgggtttggatatcaaaatcaataatgccatcacacatgcagcaaaggggtttgaaaggtttattgctcacataatacgtttttttgggggagagtaagatgggcttccaagctggtctgaaaactagagagaacaagaaaggagaatggctttgggattcttattgtggttaggagtggggctgtggtgagggttcctgtacatgggctagggcttactgttggaactttgtgctagtgccaaggaaggagcacctaggcattcttatcagtttgctcagatgtggggcagagaggaagggaagtggtggggcttgagaactgtctgcagtcaaacatcaaaaattaagtcatactctgtattacaacaattagaaaagaaataaaatgtagtatatcagttctctattgctacaatattgttacataacaaacaacccccaaacctcaatggtatacaaaaataaatgtgtcctgctcacacatctggagtcaactaaacagctctgctgatcttgcctgaactcattcatctgtcagcttgatcttggctggctttgccaggggtgggctataccctgctctatgtctctcatcctccagtaggccagcacaggcatgctatcatggcaaaggcaaaggtgcaggagtaaaccagcccaataacacaagcactttttaagcctctgcttgtggcacttttgccaaaatcctgttggccaagcatgttacgtggccaagccatgagatgtgtacacagaaaaataaaagatgtgtacacagaagagcaaagaattggggccatttttgtaacctactgcacctattaatggattactaatatgtcacaactcttatcctagattacagtattaagagaaggaaagtcaattcaatgatatatttactactaaatgttaggtactgtacttggaattagagttacaaaactaaatgagataatcctaaggagctcacagttggatactggaaaaaaaatcaaacaaattaatacattattaaaataaatgaaataaaatccaatgtaagtacatgaatagatattttaataagaagtggcatggaaatgaaaataaactcttttgtctcctttatcatatatttcatagctaattaaattaattttattataatcaaatttactgtagacctgaggacataaagtttactgagactccctagcgaatggctgcataaaaatgcaagccctctaaaagcaaaaccagattgtaaattctgttaggctaacagaaagtcatttgattcttttgtttttccgttacacttagtagtcaaccaaaatttattgtgtgcctatatgtgtgtattagtcagagttctctagagggacagaactaacaggatagataggaaggggagtttattaaggagtattgacgcacgatcacaagatgaagtcccacaataggccgtctgcaagctgaggagcaaggaagccagactgagtcccaacacctcaagtagggaagctgacagtgcaacctttagtctgtggctgaaggcccaacagcccctggcaaatcactaatgtaggtccaagagtccaaaagctgaagaacttggagtctaatgtttgcgggcaggaagcatccagcacagaaaaagatcaaggccagaagacgcagcaagtctgctcttccgtcttctcctgcctgctttattctagccatgctggcagctgattagatggtgcctacccagattgagggtgggtccgcctttcccagtccactgactcaggtgttaatctcctttggcagcaccctcacagacacacacaggagccatactttacatccttcaatccagtcaagttgacactcaacattaaccatcatgatgtgcaagctattttgctgggaatttgctaggatcgaaaattcctagtttttttgttgtttgtttgttttggttttgaatctttaatgagaaaaaatactattgtgctcaagaacaccgtgcgtctggtgtgtcattgggtcaagggttggggacacacatggcagaattcagaaacagggtaacatcaacaaaaatacacacggtcataaaaagaaaaactggcacctggcatgatcaactctgtttcctcatcattcagcagcatgttggggatcctgcggctgatggggaacacacgtccagactctgggcactgcagggtgccctccaacacatctacctccagcagcacgtggtgcattgtcctcaccatggagattcctagcaaatactctaggtattttaaatagaagaaatttaatacagggaaatgattacatatatagtagaagaactgagatgtcaaacagaagagtgaggcaatccacattttagcaactgcagtaagtgacctccaatgtcatggctggagggtgcaaatggtgagaaggcagaagctagaatcatggtggaccccacctgcaagagtcacaaagaagatgcatccattcaggtcacagagaagtaaatactctagtgtctaccttctaccttcttattgctctctagtctcccattttatctagactgctgacaagcatgcagtggaaggtgagcaccagatctgagaggaaacaggcagtgtctggtggcacactacacaagaactctcacaggcatccactaggcttgcttggtgactcatttaaggagtaaccctattttatgtatcagagtagtctatggtgtgatatagcatattgctgcttttgatgtttggtttcatttgttccctgtaggcacctaatcactgttttttaaattccccaggagattctggtatacccaatcagctgagaaccactgaatagtggctttcaaaattttgagcatccaaatattgtcttcacagaaaatcttaatctctgaagtctactgtaaaaacatagaaaggcaaggctgttctgcttgaagcgtagcttgggagcctagattcctctcaaacccaggccactcctgggaacatggtctggagatttgaatgttcccaaatctagtttatctcattagtcgatatttatgcacatcctctgtgtctctcagtgttctctcatgtgtagacatatgccccattccaaagagtgactgtagtgtaatgtggcattaaaggaaccctggatagacctgtattggaccttacatattagagagctctgcagatagctcacaaatctccaagtcgctagctgtaaattgagtgataattggtgtcaggttattttagcacagtttggggataaaatggtgcattaatctcccagtttgtggcttattaaactttgaaatggaattatttgagacataaaagagatagcaatactttgctggatgttctccattagtcgagattgttacagaggagaaatttttgccactgtttatcaaatattttttcctctagttaatccatatcattccgggagctttgcccaggaaaaggacgaattacttgcgttcctccgatctctttcaagttctactcccgtacctttaaactgtcacacggaatctttggtgacagaggaatagaggtgggcaagcagggcgtttggaaaccatactgaaaacgaattatccataaagcacagattcaccagcctagaaatggctctgtctggatggattccttgagatgtgttttatctccattaaaaacacaacaactttcaaactttcactgtgtctcaaaatgatagagaaaaaaattcagcctttcaagtattcaagaaaagcttgaagaaataaaagaaactcgctgctctctgggccactttaggaggcagagcgttcctggagaacttcaggattcattcgcaagggaacccaaggtgggcattcaaagccgatccaaaggatattcttctttttagaaaacaaaaggagcgcaaggagtaggggactgaaggtgcccaaagctagtgggtcagtgtcactttcttcctccctttcgcccctttcctcccgctcctttctcccctgtggtctctgctcagcacccctttctctccagccccgactgcccatcttcgcccctaccctcgcgcgtcggggccgtgtctacacccaccccaggacctggtccgtccaggctccttcccatcctcacacccgcgcctttctccctgcggccccggctcgctgctccagctgcccagctcttcccaggacaggggatcccgccaagggggccgcccccgccccggccctcccccgcccggccgcaccataaagcgcccggccgctgccgcggagcccagcagccagctccccagcaccgcacggcggggacgcgagcgcgcccccgacggcagcccggacgccgagcacgggtcacctgcggcgccggcccgggcgccgaccgaggttcaacgcacggcccggggacccccaggcggggccaacgccgccgtcgcccccggcctcgcggggagcaggaagagccaacatgctggccccgcgcggagccgccgtcctcctgctgcacctggtcctgcagcggtggctagcggcaggcgcccaggccaccccccagggtaagtgggttcgggtcgggcctgggagcgccgggcaccgggtgccccatctgctgagtgagtggagggacttgctcggccctgtgctcctgtggccttgctcagcccctctctgtccctcccgggcccaatcaaagcatattgtgattggaggtagtgattagtctagaattttccgaaattcgattatccaatgatgagaacaattgcctaaatagttgggggatgcaaaattgtttcagactatgcaaagatgtggggtggggttgccttcaaaacttgctacacggtcctagacctcttaacatgttaggctctggtgtagggtgaattccgggtcctgcaccctgtgccggttccctccaggcagccttgctccctaaatccttcctcaggcggagcgatgtatgcccagagtctgctcttgacatccctgagaaagacgcagaattactctacttgccctgccacctgcattttctgctctgactttgcttgaacgacaaaaagaaagtttatttcaaggattggcttgatgtcttaatttctgaggtaaataggaagggctgagaaactggtctttttcaatgaaatcagttctttgcagcaagatggatgcagctggaggccattttcctaagtggattaaggcaggaacagaaaagcaaataccatgttctcacaagcgggagctaagcagtggatagatatggacataaagatggaaacagtagacactggggactccaaaagtaggggggaaggttgggaaaactaccaattgggtactacgttcactgggtgatgtgttcactagaagctcaaatcccaccttatgcaatgcacccatgtaacaaacttgcacatgtaccctctgaatctataatttaaaaagaaaaaagaaagaaattgatctttttctatgaaacggtaaaaattcaacaaataatgtgaaaagatacttggacaatcctcaaaccccttggtgaaatggggtgaaatagccattgggtagaaagcagttaaacagaattttttgtaaagaccaaaaggaagacatgatttaagcaaagaaagatcttagggctataactggccctaactggtcaggcgtgagcttcatctgtttgaacttggtgcctgggttgatttattactgactgtggaagtaaaactggaagagacgcacaacttgaagtaaaagttgtttttcctcttgtagccagagcaaagactgcctatgagggcgttctcaacttccctgcctctcgctgctggaatcacccatttaaactgcatttcgccaaataactcattttcattccagaccagacaaccagaactgtggtttcaggggttagagtactgctaacttttagtttgtgttgaagtatttgaaatgctgtagtccgtgccccatacttctaggaaggtaaaaaaggaagcttttaaacacttcaaaagtcttattgtgatgatatttggcaagttcaaatttataggtataatttttttgtgttatatacgttcttgacttttgaacatacagctttatggtgtgccttaggtatgtctcagacatacctgaccattttatggagatttgaactcggcctatacaacctaaattatctgggtaatttagttgctgtagatgatctgattaagttaagtttctgatagattcttttattgcattatctagtctgcaattatcaggcttaacaggataatttgattatctccttcttcccctgagcttcattgttggtcttaaattagtatatattcaatttacataccatggtagctgcgctcattggtagcagtaatttcacctctaacagtagagggttgtgctttgatcctggcacttaaacgtaataacattaatagaaaatggtagtgtctcatttccttttcaaaacactctctatgttcattactaactaatcccatctctgccgcttgagagagatgcaaatgaatcagacgaaccatagattgaaataccgcaagtttagcttgagttacatcatgaacctgatcatagtcaaaggaagaatcaagagtactaagaattttgttttgaatgtagttcccatactttaaatacatatctcttttctgaagatgttttgtcctgaatggaactttaaaacatattgccttatttccctttgccctcattagtggaaatgtaaagtttccaattctcttgaaaattaaaaaatccaatttcccttttgaaatgcagtaggcaacagtgtttatggtttagggatataggcactaagaggagcacagtaaatgttctgctttccaacacatctcatgttaatttcattattgtgtaaggacccctggtacatgtgaaaaatacagtatagatccagtttgaagacaaattgtcttttaaaaggggtaaatattcttgagtaactaggtttttgcctgtttgctttagaacttttattcattcttattacaaaagcaatacctgcccattgtagaaaagattaaagttagataagcaaaaaataaaataaaaagaaaagaggaaatttaaaacttatatttatgcaacccggggatagcttctattaacattaacatgttgttgtattgtctttcatttcaaatatttttctatgcaaaaatatatttcaaatggaattacgttatacatatagttttagaatccttttttcttaatgtatcatgaacatcttttcacatctgtaagtattcagctacattttaaaaataggtagtattctgctttttggaagaatcaaaatgtatttagccagggttgtaatatagaacccttaagttgttttcggttttgatattgtaaatattaatttattgaacaagtgcaggtgtcacaggatggtttgggatgagtttaaccatcccctcaatctcagccaagcccttctctttttttttgctaaggacagttaatgttttcatagcaaaatgctatgccaacagagctcaggtttacctctcttccaattagattttcacctaattctttcctaaatagaaattctagaattaccactagtgtctaatattcttgtacctaaatcatttaccatgttatccattatttccctaggataaattcccataagcagaattgctagatcaaggagcacatatgttttagggcctttgatactgttgtttaaactgtcttcaaaatgtttatactagtttaaatgttacacagtggtacagagagtgcccatttccctgaaccctcacaaacagttgagtactgttgtatttactaattttccaattcgatggtgaaaacaatacgttattgtttaagttagcaactcctgcatcattaggtaaatacatgaacatttatttatatacttaatggtcattgtaattctttttatgtaaattgccttttcatattccttgcccatttttctattaagatgcttatcattttattgatttgtaagaactctttatcaattgtcaatattacccatttaataaccagattattatatccaagagacagctgtaggtgctgaagtttctgcagcctatggaattgttcaaatgatatttgcgtctgctaatagatatactaaataacttccactgagtattacccaaatttggcctttgccttttaaatgactctgggcatactctctcatagctttcataaatattacaaagtttgtgagagaaagtactgcttgcttgatcaaaagcaacttatacaaatacaaatgcagattctgatttttgtagagcaattctatcagtcaagagacagaaaccacatcattttgttttgttttgtttccacattgggatttttttaaacagagaaatgttggagaattgtaaaggcacaaagggaacacttaggtctcacaaaggtggcaaatcactttctaccagcacatctaccaccatagccatgttttctgctgcatttcctgtcatttgtcactgaccaggaaaacacaattggctctggtcctggaggtgcctatgggactccgtgacagaaattcactgcttggggacatcagtaaagcaatggcttggatgctttcaccagtcccccttgtactttaagcctttagtgcttttcctggtgggcattttcagagctacttgttcagccaaacccaattatgtgtttgcaaattcagtcctctctcttgagggctacacccagtgatgaatattgtgctgtatttcttctggctcaaatgtccagccactataaaagtgacagggaagaactggtgagtttggcaatacggaaaagggattacaagattagtttacattactttgtagcttactgtcaaattgcaccccccccaaacaaagaaaccctgttttccccaaaattgaatctttcacttataccccttcttctcccttcttcccagtctttgaccttctcccatcttccagtcagaggctaaacccaggcgctctgctgccagtcctgacagaccccgccctgaatgatctctatgtgatttccaccttcaagctgcagactaaaagttcagccaccatcttcggtctttactcttcaactgacaacagtaaatattttgaatttactgtgatgggacgcttaaacaaaggtaagcaaatttgctgaaattattttcttaaaaatctcctttttctattccaggattaggggtatactgtctttgagatggtttccttgtacaattatattctcactcactagtcatttcagtttttaatactgaattcttcttactgtacatttacctatattggcgggggggtggggggcggttcaggaagaaagtgacattgggagaaaaaaagaattgctgtgaccaagatgctttttgacattgtctcatcctgatgttattctgaatccagttctggaacagagaggacaagggacaattcagccattatcttaggcagctcaggctgctataacaaaataccatagactttgtggcttaaacaatagacatttacatctcacagttctagacagtggtaagtctaagatcatggtgccatctcagtccattttgtgttgctataaaagactaccggagactgggtaatttataaagaaaagagatttatttagctcacagtcctgcaggctggaagttcaagggcatggccctggcttctgacaaggactttcttgtgtcacaacgtggtggagaaggtcaaagagggagcagacacatgggaagaggggaaaacctgaggggcaccgtagctttataataacccactctctcaagaactaattcattcccttgagaactaatccattttcacaagagctgaaactcactgtctcgagaacagcaccaagccattcatgagagatccaatcccataattcatatgcctcccacaaggccctacctcccaacaccgccacattggggaccaaatttcagcacgagttttgacagggacagacataccatatccaaaccataccacccgcagatttggctccttgtaagggcccagttcctggattgtagatggccatctttttattgtgtcctcacatgatgaagacagacagcaagctctcttgtgtctcttcttataaagtcactattcccatcatgagggccacaccctcaggacctcatctaaacctaatcatctcccaaaagccccacctccaaataccatcacactggagattaggagttcagtatatgaatttgatggggcgggaggaaggggacagatacaaacattcagcccatgacagccaccccatactattcttatgttccctttgaagccagtgctcagtagacctagctcctaactccttaagcacctacctggccgtgatggaaagaatatacctcaaccagtagaacaggatgaatagggctcttttctccctgtgcgtgccaatttacacaggcctgtcactggtttgatccctctgctgtcatttgttttgttgccgtagtgagttactataagcactgagaagtgagtcccaaagaaaatggtcactatttttcattgccttctcctccactccttccccgggggacaacacctgttcctgtttattaaggaatgtgacagatgcgtgttcctgctgcttcatgcatttaataaaataggagggctggttcttctggctgggttttatgtttatttcagtttgctttacaaagtggacacttcctagtgcttcaaactctctcttagattatatttgtgattgtacacttaaatctgcaggcattaggaaatgaaagaagtttctaattcttaactttcataggactctaaagttaaaagtataaatgaatgggactttaaccccttcttttctgtcagattccaacatgcttcttgcctgcttccacgctactcccaagtctgctttctctgtatgtgcctcatagcctgtcaggggccttgaggaggtgtcagataataaagtgagtctgaggacatggccagcagatgggtcaaccgttcctgtccccctttccccatcttcagccctaatgaggggggattctgcccatgtctctgccttgaatcaaacagccccattttgcctagcatctgctgaaggaactgctcatcttctgacaacccagctactcagtttgtgatcgtaaaaatcaccgttcttcatctgtggatcagcagcttctcctaacctgtctatttcagaggcattgcaaagatttttctttcggttcatccagcttaatggccagaagttcctctgcagagtaaaaaactgctccaagcttttgccctcactgcctctcaccctctatttctaaattggccagtatgtgtgagcccattgtggaaagtctgttgctgggaaacacaaggaagcaacttcccctgaacggatcctttcagtttgtatagacaagagtaacactggatttaatgggcagtaggtagagggtaaggggatcgttagtatgtttcctctgaagaatcaccagtaatatgagtcagctgtaaataccagttgatcaaatattttaggggctgtaatcccagcactttgggaggctgaggcaggcagatcacctgaggtcaggagttcgagaacagcatggccaacatggagaaaccccatctctactaaaaatacaaaaattagccaggcatggcagtatgtgcctatagtcacagctactcgggaggctgaggcaggagaatcacttgaacccaggaggcagaggttgcagtgagctgagattgtgccgctgcactccacacttcagcctgggtgacagagcgagactctgtctcaaaagaaaaaaaaaattagaggaaaagatgaaagggttgagatgaagaactgaaagatgaacatctccctaccctccaacctattaggaaagataaattgttcttagaaactgtgggggcagaaggagtcctggaagaatctagaaatgagaattctcataaggcaaagagggatttatgctgttattagagcttgaagagttgaagaatgacacagagaagttgtttcactggagcagtcggaaaaaatacgaagatttgccagcactggtgaatataaaagtttcaggaaagagaagtccattctgactggaacaataaaaagaagtcactgggtccatcagatccaaggaaaagacagagcctgtggttgagactccccactgcagtgttcagtggtggccatgctgacttgacataattctccccacaaccctccacaaattatctacctggacatggtaggctccagacagcattcatctggccaaggttcagctgatctcctcttttgctgatttgcgtggaaaacggtgaaacagaagaaatccaagtggatctctactgacttaaaacacctgagtaggaaataaaacacacccttccctccattaaagtccaggactgggagatgaaggagggtgactacacagcatcaaagagcagaatttggtcatctgggcctcatatgacctcctgaaacaaattaaaatgtagctaatgaagactgcaaagaaagagtttgccactgagctctctgcttctactctcaccctctccaagtcagcctaccccaggccacctcattactgttcacaaacataatttggatcaagatacatctgacctctgagacctctagtggccccctttccaaattgaataatgtacccatgtctcagcaaggcattcggggcttccactctgcatggccccaagcagcctttccagtttatccctcattccagcctccatgcagcctgagcttcaccaagataggctattgccattccttggggccgcacatgctgcctctcctccatccttttgttcctgctgtctgctccctcgacacatatcctgcatcacctcttgacacccaaatcctacacattcaagacccatctccagctccttctgatattctttctaatatgactttgtacctcttaaggaagacattcatcttagctcaccttgtacttgaattacttctaggtcttctctccatttggttgggagctctcttgagacagggactatacagcccttatctttgcatctgctgcagcacctagcaaggtgccttgtacatagaagtagttcatggatagattgaaaagaataaatggaggctgagaagagtagacttgtttgtgaaaaatgacatacaccattgtgaaattctgggattccacaatatctgacacatagtaggtaataaaaaaaaaattatttatttatttatgagacagagtcttactctgtcacccaggctggagtgcagtcgctagatatcggctcactgcagcctctgcctcctaggttcgactgactctcctgcctcagcctcccgagtagctggaactacatgtgcgcaccactacgcccagctaatttttctatttttttagtagagatggggttttgccatattggccaggctggtctcgaactcctggcctcaagtgatcctcctgtctcggcctcctaaattgctgggcttacaggtctgagccaccacactcagccaaaaaaagatttttttttttaatgaataaatattgaagggcttttggaataggatgtaagaggatacaggtagtatttctggtagaagtgatctgccaggttatgagtaatacagcctttaaatcttgatagaaataagcatcctgcagaaaccacctggctggatagaagatatggctgatgctcttctagtatctggcgtaaagacaactttccagtttgtatcctgagtttgagtcacaaactgcatcaccatgaatacatctctgaatctctcttagcccttgttgattgcctataaaatggggataataatagctacctcacaggctggttgcaagaactgaattatataaggtataataactttcttcagactatgaggcttaataaaattttcatactcttaaacagtattagagacagatttccactatttaggcaactgttttctaatgatgatggtttggtgaactcttggcttgccttgatgacaatttcacctttcagaaaaagaaacacaagaactgcttctttagtcttagtatgattgtctcagaacaacttggtgctgtgaagtgaaggaaacccaaagtgtttgctgtaatgaccagagagtgtcagtgaaactccttagcctaaggataggacatgtcaaatagttcagagtagtggttctgtagcttgcaagctaaagagaaatatagattaagagagatggtagagcttaaaaaataaaattatagacacaataataagtggaaaaaatgaggggcctcaaacattaataataatatttatggagtcttttttttttttttttgagacggagttttgctcttgttgcccaggttggagtgcaatggcgcgatcttggctcactgcaacctccgcctcccgggttcaagtgattctcctgcctcagcctcccaattagctgggattataggcatgcgccaccagacccagctaatttttgtatttttagtagagacagggtttctccatgttggtcaggctgatctcaaactcgcgacctcagatgatctgcctgcttcggcctcccaaagtgctgggattacagccgtgagcaaccatgcccggccctatggagtctttttaatgtaccaggactgtgttaaaagctcaaagcctatttccccttttaactttcacaatattcctatgacatgcccttgaattagcttaattttaaagtggtcatgtgcagaagatggaaagaattttaaaatttgacacaaaactataataattaggacaaaaaagctaaaacctaattgagtcaaagttggtgattcacacataagataataaaatggatgtttttagccatgttcagaataagatatggaagatatggaagaaataagcctacctcctggaataggtaatgggagattaacaggtgatagaggtaagtcatagatggctcttttgtttctgtcttacccatcaaggggagtgttcttcaaattgtcaagaacagttaaaagaaaacaaaaatccaagctagatgaggagatagcagaaaaacgcccactctctttagtgagattaactattcaggagcagatgaattacacattgggatatttagtgaagaaagtcatagtggagccactgttagttcatttagaaatcatggagaacagaaaggtcctaaaagacaggacaggcaaatgtttccatttttataaagaagggaagggtggattctgaaaaccacaggctactgaaatttaggacagagctccagagggttatatgattattcatgtattttgggattgcccagaaaagaaatctgggattttttctaagacaaagtggatttactaagaataaatcatgccaaacttttttttttcagtaaagtttcaaagctgatagattaaaaaaacatgctgtgagcataatgtatctgacttcagaaaagaattggatgaagtcgcttattatacctttctaaataatataaaaaagaacgagctaggtaatagtaccgctaggggttgctaagtcactgtatagcaaattatctagtggtttttgacagggctctgtcttgggtattgaactgtccaacatgtcagtgacttgagcaaagacagcattttatcgtgtttgcaattcaaagctagaaaacagttgaacatgttggatactatcattcatatttacaaagtcctaccagataatacaatgggccaaaatcaatcagatgaaatttaacaagaataaatgtaaagctatcaactaggagtgaaaagcaaattgcagaagttcaggatgtgagacatctgtcctaagagttctctaatcaacaacaaatcctaatcagtgttgaggatagtgcctgacacataatggatactcaaaaatatttgccgaatgaatgaatgaacagatactgtgatgcaactgtttataaaaagctccttacattttaggtttcattagtgcatacatatggccaggttaaagaagctaagagtcccactgtactcttaattgtccaggccacatctaatactgtgtctagtcctggacacatttcacaaggacactgtcaagtcaaagattaccttgaaaagagtcaccaaaagagcacctatctggaccccgtttttttgttttgtttggttttgttttttgttttttgttttctgttttttgtttttaccacatttaagtagaaaagttaaaggaactagagaaatgaagaagccagacagaagacatgaaaaatatgaaaattgccttacaatatttgaaaaaagggctaggtgccgtggctcatgcctgtaatcccagcactttgggagtctgaggcaggagtatcacttgagcccacacattcaagaccagtctgggtaaaaaattaagaattttttttttttttttttgagacagagtctcaccctgttgcccaggctggagtgcaatggcgcgtcctcagctcactgcaacttccacctcccaggttcaagcgattctcctgcctcagcctcctgagtagctggggttacaggcaggcgccaccacacccgcctaattttttttgttgttgtcgttatccttagtagagatggggtttcaccatgttggccaggctggtctcaaactcctgaccacgtgatccacccacctcggcctcccaaagtgctgggattacaggcatgagccaccgcacccagccaaaaatacattttttaaaaaattagcctggctcgctggtacatgcctgtagttccagctactcaggaggctgtggcaggaggatcacttgagcccaggagtctgaggcagcagtgagccgtgatcatgccactgcactccagcctgggcaacagggcaagctcttgtttcaaaaaaataaaaataattaaaaataatttttaaataatatttgaaaaatgtcatttggaatgaagatcagactaaatctctgtctagctctgaagagtaaaattaggatccattggtagaagacagaggaaacagatattggctctgtattaggaaaatcttggagagtgatccaaaagtgaaatggacttctctgcaaagtaatgagttccttgttactggaaatgtgctggtagaggctgcacttttattgaaggaatttgtgaagtgagatattaagctggatgacttataatgctaatattttgtcattgtaccaaggctagagaagtttcataggcacttaagaaattgctttgcacctctttcctgtaacatgaccttgggcttctgtgcacactcactgctttgttgtctactagatagttgcatactatgatgaatctcatactttttcaaaacacaaagtcctctgcagatgtttagcataattgctgtgtttcctttcactagatagatgtgtgtgtgtgtgtgtgtgtgtgtgtgtgtgttactctgtatactttacatttattcaaattgccataagaaaactttgaaacagactgcatttatcacagctaggagtcacccagagtactttcagaaaaagcaatttgctgatttaccttttgtatgtatttccaaagcactaaagttacaaagacctagtgtatagggcatgaagatgaataagcaaaggcaaacaagaatatccatcacaagagacattaatgtcaaggaggcaatttttaaatgtacaattatttaaaaagaagaggaaagattgacaatgatggcttccatcatatgtttaaaagtgccaaagagcaaagccatttgccaaacaaagcaaagagctccagactacctttgtgagtttgctgcctgcaggccaggccactctggactcctttgcccaagcagacaaaatattatcatttccagttctttaaagctggcaccctgcttcataactttgacattcaacatatcataatatttttgactaccaggtccacttttcaaaaagcatcttttgaaaattctttctgaagatagcaatatttcaaatcttcattgcctgggcttgctttttcatctcctgccagtcactgaaatcgtatttaatcagactgggctatgtggttcctgtgtccggctggtcccaagcatggaaatgtagctcttggacagtgccataaaatcaggcaatcctgagtagctggggttacaggcaggcgccaccacgcccacctaattttttttgttattgttgttatccttagtagagatggggtttcaccatgttggccaggctggtctcaaactcctgaccaaattgtcaattacacaaagatgccaagtttagagggaaaggatttatataaccaacaaagtgttccacattttaaaaaagacataattgtgagtaataaaagtcagagtggacacactctattttatctattttttttcacttcccataagtagttgtagtggtgccctcagatactatgggatgtgggaaaatcagtaagatatagacttggcagcatgaagggacttaaggtggtgggaagattagggccagtcctgggataaggagttgaaacattatttagaatccactagggagttattgaaggatttcatttgcttgcttgctttgaggaggcaataacgatcagaacagtcctataagaagttcaatctctcagtccaaaaagtccgtgcagaaagagacctaaagtaggaaggggagtcaggaatctaacagagcagcccagaggtggagcagagtcagagacaccgtttgagatccgagcacccactgactgacagccttcagttccaatccaatctgcactgcattctgggtactaaccctgcacaataaccagctgcaattgccaagaaaacctgtgcagctggtggtgagtgaaaaccaaggatgtgaactcaatgtgctgcagctgaagaaacagagttgtacctggaaccgcccagtgggttcaccttgcccactgcctacacagaacccatttatcaagacaggggaattgcaatggagaaagggtaattcacgtagagctggctgtgtgggagaccagagttttattattactcaaatcagtctccccaagcattcagggatcagagtttttaaagataattttgcaggtaggggcttgggaagtggggagtgctgattggtcaggctggaaatgaaatcatagtgggtcaaagttaggttttcttaacgtcttctgttcctgggtgtgatggcagaaatgattgggccacattactggtctgggtggtgtcagctgatacatccagtgcagggtctgcaaaatatctcaagcactgatgttaggctttacaatagtgatgttcccccaatttggaggtatttggggagcaatttggggattgctcagactcttggagccagaggctgcatgacctctaaactgtaatttctaatcctgtagctaatttattagtcctgcaaaggcagactggtccccaggcaagaagagggtcttcgggaaagggctgttatcaattttgcttcagagtcaaagcatctactgaattccttcccaaagttagttcggcctgtgcccgggaatgaacaaggaaagcttaagtgttagaagccagatagagtcggttaggtctgatttctctcactgtcataatttcctgagttataatttggcaaagacagtttcatacccagtgactgttttcctgagtgctttccagggtggtggccaggcagaggtgtggtcgagtcgggaggtgggatggttccagcctcaggggcctggcttcttcttccttcctggagggacaaaatggtcatcttcctcctgctgtagtgttttcccctgcgttttgttccttctgctatgtgtggatgtgttgggataagatagggcaagatgagcaccgggaaagggggctggcaagaggaagggaaccctgtctgttctcttccccttcccagtgatgctgcctctggagaaggtgaggaaaactcgcacccaacaggctgcaggctcctggggccagagctttctgctttttccagactccatatgactgatgtgaaaacgttgagtttcctgagcctgcttgccctctgggtagtctaactgctctgataataaaataagtgtagaggcactgaagtaaagaatttgcaataaaaaagaaaatgaaaaatggaagccataagagaaatgagtattggatcaagtgtgaagaatgggaaatgtcaaggcacttgataatttttctgctaacaaacagacattgtgaaggtggaagtttccatggttttccttccctgcgttttcttttgctattgtcatgagatctaggggcatgagggatttgtcatttgagtgttacattgcaacaaaaagcaaggcagaagtacagaatccacttaaatgagagtatgaacacaataggaggttttgctacctggaattagatgttgaattgctgctctctaaactttattttctatataaaaagctttaaatacaatcatttaattattcatttaaagtttatattaacaacatttagtgtgcacctgctatatgtaaagtatcccactaggtactattcatcaaattaaagccagctatttagttatgaaaataaaccatggcccacataccctgtgaagccctgttaaaagcaggcaacatgcccaagaaaatatgtttcctttgaatttcacagaaatcttagtttgaggaagaaaaatcaagagtttttgttataagccactatgtgtatgctctgaaacagttaatgtagagaacagaggtagtggccataactgaaataaggagatagtgagtgagtgtgtgtgtgacctaattcaagtttggtggtccaagtggtatttttcttggcctgtaaaaactacaggtatttgcaaaactgttctaaatagtaatgtaatagaagttttttaaaaattgagttagtgcatatgtttggactcaatttctccctcttttggttactatatatggttctaatttccagctgtgcagttactattgtaaattctcaacattaaaaaaattttcagatacaaattatttttattgatacatactttttacatatttaaggggtacatgtgaattctcaacaattaatattaaataaaaggagaagaattctgttctatcccagattagaaataccttagaatttctatttgtgtctatttccctccattccattattttcttcctcttcataccacatttatatacgtcttaccatttatttatatttatttaatactttacttcaggaaacttagtattgttctggaatcagaaagcccttctagctagtctgtcttgccaggtctttccgattcttctccctcaagaagcaagtggtggtgaccacgtcgacataagagatttcccgtctgactcctcccaccatctgtgtaggtcacagaacctcacgccaactggctctcttcagactgtggtcaactggaaaatcgagtcagatttcagaagggtgggaaaatgaacctagaaagtctaatgtggagaaagccttaaaatatatccttcatgttccacaatagtgattattatctttggcgatactgcaacataaataggtattcttggctagttcatctctggcggcaccatcttggcatttacactctacagaaaaggtacctgaggagaaagatggtccaagttacttgccacagatcacacagattaacagcagcacagtctgggtgtatatgtgtaatatatatctttttattatttttatatacaagtaatggttgtttcttgtagaaaagttaaaacaatgaagatgagcaggaagaaaaaaataccatccaaacacccagcaaataaccatactaatgtagacatattttcttctaatcttctaggtatgtatgtatacatatatgtacatatatatacacatgcacacttttttctaaacccatattgacctataacctccttttttttttacttaacaaaatactgggaatgtctttttgtgtttttaatattcagctattccatagtattccattttataattatactgtaatttaagtagccagccctctccttttggacatatatgttgtgccaagtgttgattacaataagtatttctgaaatgaacattctcacccatacatcttggtgctgcttttttttttttttctataacccaggacagtgctgaagtgcttcttttctttaatttcctcagttttagttcctagaagtggcaatgctgggctgttgggtttacacatgtttaaggttctgatgcatgtgactaaattaccctccagaaaagttctgctttaagttctacttaacgctttcccaccctgggacagctgaagactggccagagctttgcagctgcaatgatgtgtttaccacctcccttatccagcaacatttgcaattagcctccgaccttgttcctgggattgtttccggtgaaaattagccatgcctggctaatttttgtatttttagtagagacagggtttcaccttattggtcaggctggtcttgaactcctgacctcgtgatctgcccacctcggcctcccaaagtgctgggtttgggaatggtacctgtggatgcacctagaggtgtgtttagacactagctgaaatcactttggtctttctagcaaaccttagccaatgggctccactcacaaagggtcagcttccaagagcagattttagctcagggcctcttatgttcaggacaataatggagtaaaaaaacaaggctgaaaaccagaagatatgtgggcttaagcagatatgtgaatagctacccacataggaaaaacaaaacaaaacaaaacaaaaacaaaaacagaaaataaggtgggagtccttcttttacaaccatggataccttttcttttcttttctttttttttttttttgagacaggatcgctcttttgcccaggctggagtgcagtggttcgatcatggctcactgcagcctcaatcccccaggctcaagcaatcctccacctcagtgtcccaagtagctgggactacaagtatgtgccaccacacctggccttttttttttttttttttttgaaatggagtcttgctctgtcacccaggctggagtgcagtggtgtgatcttggctcactgcaacctccacctcccaggttcaagcaattctcctgcctcagcctcctgagtagctgggactatgggcgaacaccaccatgcctggctaatttttgtatttttactagagacggggtttcaccatattggtcaggctggtcttgaactcctgacctcatgatctgcccacctcagcctcccaaagtgctgggattacaggcgtgagccactgcgcccagcctggccaatttttttaaatttactttttgtagagatgaggtctcactatgttgcctaggttgatttcaaactcctgaactcaagcgattctcccacctcggcctcccaaagtgctcggattacaggcataagcctctgtgcccagccaatacctcttattatctaactgagcattgttaaattcagggatgggttgctgagggacgatatgacagattacactcgatttgatgtgtgctgactaaggcctgtgcatgcctagcattgctttagtcatggaatgaatcacactcaggttcagattctagtcctgccacttcctatgtccttgagcaagtgccttcatttatctgagactcactttccttgtccatagttattccaattgcatttggttgcagtgagtagaaattaagtatttaggctgggcacagtggctcacacctgtaatcccagcactttgggaggccgaggcaggtggatcgcttgagctcgggatttcgagaccagcctgggcaacatggcaaaaccctgtctctacaaaaaatatataaattagctgggtgtggtggctcacacctgtggtcccaactacttaggaggctaagacagaaggatgacttgagcctaggaggcagaggttgcagtgagctgagatcgtcccactgcactgcagcctgggggacagagtgagatcctgtctttaaaaaaaaaaaaaagggaagaaatcaagtatttaaagcacctaaggacagcccccagccccatggtagtgctcagcaagtgtttggtgaatgaatggattcatgctctacgcttatatagagtttactttgctttcagattgggttctgcttgctcattgtacttatcactatatgagaattgtattgtttattttcaaatttgccacatattgtctgtttctccatcaacacaaaacattctcaggagaagagttggttcccagtgcctgaaaacagtgcctagcacacagaagatggtgaatcaatatttgtggttatttctcactcacattccgtccagcaacccagtcttgttaccaggaggctgttcagcacaggacacttatcacaccatttgttgaccctccacttccccctctgccacttatcacaccattggttgacctgtgcttgcttccagccatcctccgttacctgaagaacgatgggaaggtgcatttggtggttttcaacaacctgcagctggcagacggaaggcggcacaggatcctcctgaggctgagcaatttgcagcgaggggccggctccctagagctctacctggactgcatccaggtggattccgttcacaatctccccagggcctttgctggcccctcccagaaacctgagaccattgaattgaggactttccagaggaagccacaggtaggaacccacaaaccattctctgaagtggaaaaatgagctgccagtgcctagggagtgcagaggagcgtgctgagaaattcctgctgcaggtcagtgggtctaatgccgcttgcacatcagaatcacctgcggagcttgaaaagcaagtgatagggggctgcccctaggacaaactgaatccgaatctgtcgggtggggcctagcatatttttatgctaggggcatcagcatatttttaaaataccaattctaatgtgatgccgaaattgagagcttgtgctttcaatgataagtagagactctggatacaattgtaacgttggaaaggaagggcaaaagtaaaaataactacctcagggtgatgacattatctattttcaattttctataatgaaaataaaaaagaatgattagaaactgccaagctttcataacagcattttcacaggtcttgtcagaacatccactaacaaaagggagcttagcttagctgcatttggtcttaagataccatcacctctgtcttctgttttactccaggttgatggtatttttattattctgtcattgcacctgctgtagaaattgccacatacatttcttttagaattttgtgctaggcagtgctttgttttctataaagaactagtattctttgtcctttccaataatgtataactggttaaagttcctgaatttcatccgctatataagccaatgtcaaatcagtaactatgttcttctgtaatggtccatattatttttgtctgctacctctcaatcctcactttccatttgttaattcattatattaatatatgctttagttacaagctactctgagccctttgtacagagaagcagggtgtaagcaataatttccattgcaagtaggaatgctgtgcagttttagatagtaatataaaaactatgaatctgatcctagaagttttgcccttgaacaacaggaagcatttttaatcagaaattccaagaaagctaaaatccgaggtttttggggatttttgtttttcagtcatatatagagagatttttaatgtagatttacatatggaaaaaaattaatagaaagatatgctaaactctctttctgcatccccatagtagcgcatgtaatcagaatgacagtcagaaattgtgtcactgcttatttcagaaattagtgttcaccaccaaataagtcaatttctaaaagtcaggactcacccctgacaaagtcatcagaaactgtacttactggaattttctcagaagctctacctccttagaccatggtagtgatcacagtggctcagtctcataatcacctactcactcattcagtcagtcaacaaatgggcacattctaggcattagtgctaccatggtgggcaaagccagtcattttcctgactctgcggagattatagtctgatgtccaatacaatatgtgttaaatagcacatgttgcctaaatcttagctaaatcaaaaagcagaattcctctgaaaatccttagctgtgctcatttctaaaataaggatgatgacttcactttggcagttaacataaatgttttgttgtatatagatataataaaggtgattgcaagcagcattcacaagataaaagggcaaggacattgactttttgactaacaatgaataatatcaacccgtaatataaaaatatgatgccaactacctaatgatcatagaagatatcatttattcattctcatatcccaaagaagtcagaggctttgctagacccttgagccaagacaaccaaaaaataatactgtttaaaattggggttaacaccttatttattattatctaaattccataaacaaattacagacaattcttaagaggctcctgccacaaaataactcctttaccatgtaggaaaagagcctttcgttttctcagctgtcttggtgacaatgccagcattttcctaggctactggctacttacatattcactttagtcaaaaagatagggctggcaggctttaggaaaaaatgtgatcctacaaaattatgtaagatgtcagagggtccaagtatacaggactacttgattatgaaaattgcgtgagtaggcaagcacattggcttttgaacagtgtcagcaatctgtggtatgaatgtgatttcttccaggacttcttggaagagctgaagctggtggtgagaggctcactgttccaggtggccagcctgcaagactgcttcctgcagcagagtgagccactggctgccacaggcacaggtgtgggctcttgggcagtttgcatgccttcatcaacacaaactccaaagaccctgaataggctgggtcccatcaccgaaaagtgggactgtcaacagagcagcccaacaaaacgtatctatgaaaatcagtctcttgaacaaaatccagggcacagaatattttcattatgcttttatttttatgattcacatggaatttagacttagtcagtggcatcattatcattattttttttagctgaattaaagaaattaccccaaattaaattcaaagattctgggtttttgaatcatcttgtcaggatgatttcctggggaataatttggttttgagtcacttagaaatgaccatcactggctgaaaactctttgccttttgctgttcctacaggggactttaaccggcagttcttgggtcaaatgacacaattaaaccaactcctgggagaggtgaaggaccttctgagacagcaggtaacaagcgggacatatcatcagaaaagccctcgtcttcttagagcagctccccacaagctagtggagctgcaggcctgcccaggcacgggggcagcctctgagccagatctccgggggcccacgcagccccgcacgccagggctctgctggaagttctctggaaatggggtccaagctcgtgatgaacacaccatggctctaagcagagcgggagccatcaagggctgctaacgctactgtaagaagtgttacagagagccaggtgcggtgcctcatgactgtaatcccagcactttgggaggctgaggtgggcagatcacgaggtgaggagctcgagaccagcctgaacaacatggtgaaaccccgtctctactaaaaatacaaaaattagccaggcatggtggtgcatgcctataatcccagctactcaggaggctgaggcaggagaattgctggaacccaggaggcggaggttgtagtgagctgagatcgtgccactgcactccagcctgggcgacagactgagactgtctcaaaaaaaaaaaaaaaaaaagtgttacatagatagctccacatggattctttcattcctggatgatatcaggcattccttttcaatccttttttccccttctcatttttaaaggttaaggaaacatcatttttgcgaaacaccatagctgaatgccaggcttgcggtaagtgcttttctagtaatgggctcgcctgagttggatgatgcaggctgatgaagggcttgcggtgaggctgtgttgaccgcagtttctgaaggtctaccacatagttggaggggagggaggaaaagttcaataggaaaccaaattttgttttgccttctgtatatcttcctggcggtgaatacgcctgtggatgattgtttttctctaggtcctctcaagtttcagtctccgaccccaagcacggtggtgcccccggctccccctgcaccgccaacacgcccacctcgtcggtgtgactccaacccatgtttccgaggtgtccaatgtaccgacagtagagatggcttccagtgtgggccctgccccgagggctacacaggaaacgggatcacctgtattgatgttgatgaggtaaaagttcacttagactgggaggggatccctaagtatcctcctcaccctgcagcttttggaaaaagaagccaagctgatgattaagggctgacttgggctgtcctccaggctccattgaaaccacttgcttggagaccctgagacaagggatggcggaaggagacatgacccaaggttatggctgcgtttgtcatttttcctctgtgtttccaactcttctactggtccattggctacagtgctgaggtttctgctttacacgctgacatttgcattggttatttctcttaaatagtctgtgctacaattttgtttttcccccacttttgcaaatgtggaaggggaggatttttctaagggtatatttcaggagtcaccgtggatttcttcaggcttcctaaaataaaggagcagaggggaatctcacaccaacaagggggaggccctgtaacctatgagtaactaaacgtgcccagggagggccccagaggaggcacatccagcaaataccagctatttgaccggctggcagagccccagaagagactgtttcaagaccctggttaggcaggccagcctagtggctgaagcctgcaatctcaacactttgggaggctgaggcaggaggatcacatgagcccaggagtttgagaccagcccgggcaacaagacaaaaccctatctctacaaaaaatatgataattactggggcatggtggcatgtgcctgtggtcccagctactctggaagatgaagcaggaggattgcctgaggcaggaggttgaggctgcagtgagccatgatggcaccactgcactctagcctgggcacaaccctgtctcaaaaaaacaaacaaaaaaaaacatggttaggcaatcaccagtccagttgcaaagcaatgttcatagcaggtagcaaggctgccaccaaaatgtgccttcaatgtgcctttctcctcccacccagcccaaggaaggctgaaaggagaagcgcaggggagagatgcaggtacataacttaggcacactgactccctggggctcctgcaggcccatggtaatgttagtaacactcagctgattaccttcgctagtagtaagcaattaagacggtctctagtaatccctcaattggagaaacaactgcatacatttcactgaactgcatctggtttttatctgtgaggtagaattttcctctttctgaaagggcaggaagtggtcatgttttttacattagttgaagtggtttaaaaaaaacaaaaaacaatctccaagattcctagagccttggaatagcatggacttgacaggacatggaggcaggcacaggccctgagggattacatggtaatgaagaggcaccggccctggctttgccttctcgaggtctttctgattgagtagttggtttgctgatgcttttggaggcatctaacagccagctaagtggtccagggacatagtcctttcacagagatttgcaaattccatgtcagaatatcagggagcttattacattgagaggtaggctggttaatatcaaggaccctttcaacatgcatgtgccattattctacagcacagcaaagcctactaaaaagcaacctcagattgtgtggtcagggattcagtgggtaactggagttggaagcctttatttccttttattattttttccaccaaaagatagttaaatgactaaacaagtatgtgcaaatagatgaagaaaagtttgagagtgttttctcggtgtggctaaagactttgaacttttttgtctccagtgcaaataccatccctgctacccgggcgtgcactgcataaatttgtctcctggcttcagatgtgacgcctgcccagtgggcttcacagggcccatggtgcagggtgttgggatcagttttgccaagtcaaacaagcaggtaggctgaagtcatggtttctattcatttctcatcttaacaaaacaactgtggttggttcccacctctttggtataaacctttacctccatgagcagtcaaggccatgtggaatgtcatggtgcaaaatgagcaaattaggaagtttttcaaccatttctgagtatttacatttataaaatctagaagggaggaagcttttaagaggggataatagagtatcactagaaaaacagtaaatggggtaatatggctattggcataatttcagtcttattttgttgatagctgttgagcattttgtcctgcagaataagttgagaaccacggagacaaaagctttgaaaaattaggtcacttttgtagagtcattgttgccaatcgaagctgtttcagagatgaggggattttaagagtagaaataatcccccaaggcaacctcccctttttcttatgtaagctataaattgccataaagcacttgagtacttcttgacagtctccatttatttcccaatgctctactatattctggtcattatttaactgactgactgtgaaattctttttgatgtttttagcccttaaaaatggttgttctataaatatattttactaccttagggaaattattagctttgaagaagggcaggggtttattatttcctagctgcctatcaaagggttctagagggcatgatttttttaagttattgttatactttaagttctagggtacatatgcacaacgtgcaggtttgttacatatgtatacatgtgccatactggtgtgctgcacctgttaacttgtcatttacattaggtatatctcctaatgctatccttcccccctccccctaccccatgacaggccctggtgtgtgacattccccaccctgtgtccaagtgttctcattgttcaattcccaactaagagtgagaacatgcggtgtttggttttctatccttgcgatagtttgctcagaatgatggtttctagcttcatccatgtccctacaaaggacatgaactcatccttttttatggctgcataatattccatggtgtatatgtgccacattttcttaatccagtctatcattgatggacatttgggttggttccaagtctttgctattgtgaatagtgccacaataaatatacgtgtccatgtgtctttatagcagcatgatttataagcctttgggtatatgcccagtaatgggatggctgggtcaaatcgtatttctagttctagatccttgaggaatcgccacactgtcttccacaatggctgaactagtttacagtcccaccaacagtgtaaaagtgttcctatttctccacattctcttcagcacctattgtttcctgactttttaatgatcgccattctaactggtgtgagaaggcatctcattgtggttttgatttgcatttctctgatggccagtaatggtgagcattttttcatgtgtctgttggctgcataactgtcttgagaagtgtctgttcatatcctttgcccactttttgatggggttgtttgatttttttcctataaatttgtttaagttaagttctttgtagattctggatattagccctttgtcagatggatagattgtaaaaatgttctcccattctgtaggttgcctgttcactctgatggtagtttcttttgctgtgcagaagctcttgagtttaattagatcccatttgtcaattttggcttttgttgccattgctttaggtgttttaatcatgaagtccttggagggcatgattttttagactagaaaagggaggccagctagacatataggaatgataagaagctgttaagagtcctctaaagacaaaatctctaagaacaaaccaaggaaacataaggtacttggtgtaaggtagtaaggagcacttctcaatagatttccagtaacaaggcagacagaactgaagtggaagggagccaccttgctaaatttaacagcaaatgttactgcattccaaagtcaaagaaaataaaaggaaatggcgcagtgtccagaaacaaagagaaaactcaaagccagaactgtgactagagctgatgccacagcagatcctgggaggtgggagttgggtccaggtcttagtaacagggacctggcttttaccacctgtgtggagtggatgcagcaatgtagtctgggaactttggaaaggcctaacacccctgcataagtccaggaccctcagagaaccaccttatcaattacaaggagacaggaaacctttagtagccctaagaaacaacaaagaagctctttagctttaatacatggttgacaaaaatgaaaattgcctacagcaaatcaaagcaccacacttgtaccacatacagttatgagttccaaatctgttatacatataatgcagaaacacaagccaaaaaattaaaataataaccagccatgaagaagtgaaatccccagggctctgactcaagtcaaaggcacaccactctgtaaagacatgccaaaattcagggccaatggaatgcccacaggcaaaatttgggctactgaagatatgcttataaacaaaaatggcagtttatataaagaaactcccatgaggaaacatgataaatgcaaagtaaatataaaaaggtaaagaaataaataccatacttaaagaatagggcaatgccccaactgggcaacatggcaaaatcccatccctacaaaaaatacacacaaaaaaattagccgggtgtgatggtgcatgcctgtggtcccagcaaccttgggaggttgaggtgggaggatcacctgagtctgggaggtcgaggctgccgtgagctgtgattgtgccactgcactccagcctgagcgacagagcaagaccctgtctcaacaacaacaacaaaaaaatatagggcaatgtgagaaaaacagataagtttgtaaaacagacaaataaaacttttatcaatggaaaatcgttgaacttaatagatgggcaaaacagattagacacagcttagcagggagttcatgggctaggaggtgaacctaaagaaatcatctagaatgcagcacagagaaataacgacatggagcatataaacaagaggttaggagtcaaaagaagatattaacaagaaagttcgatattcatccaattgtagttccaaagaaagactagaaagcagtcgggggaagctgagaatgttccagaattgaaaaaagctaagaatcctcatttaggagaactgcattgattcccaagcaagattaaaaaaaaaaataaaactttcctaacctaaaaaggtgatggaacagatgaattatacaagttgtcttttctgaataactttcaataccatgaaagcaattctcatttgcaattagattaagtacaaactggtacaaatgcaagggagatggcacaaataaccctcagattaccattctacccgaaattccgcatcttcacttcacacaaagatagcaaaacaaaggagatttatttgcatttctatttaagcagcatgtctcgctaaactttctttgaacttttctgcactaggtctgcactgacattgatgagtgtcgaaatggagcgtgcgttcccaactcgatctgcgttaatactttggtaagtatttctcacagctgttgttatcaaagcagaaccggttattaaaacaagtgtatgtttatagatcatagcttccaaacacacctagaacatgtgggcataatatatttgattggcagaataaaggcaaaagtttgtgctgaaaaagtgtttaatatgagtaattttaaaagtaatttttatgtaagaataattttataagtgccaagttctttattttctatcaaagttgcaatattaggctattagataactatttattgagtaaataattattactcctgtattttaaaattgtgaagagcttggtagtttatattaatagttcagtattttactggtgactacacaatccccaaatggcattatttattttcataaaactttcaatcatggggtcaggagatcgagaccatcctggctaacatggttaaaccccgtctctactaaaaatagaaaacaaaattagccgggcctggtggcgggtgcctgtagtcccagctactctggaggctgaagcaggagaatgacatgaacccggcaggcggagcttgcagtgagccgagatcgcaccactgcactccagcctgggcgacagagcaagactccctctcaaaaaaaaaaaaaaaaaaaaacttttcaaaacttttcattgtattaaattaaagtgcttagcacttagggatgcctataacttaagtattcagatatgggttttatttctgaaagttcctgtcaaactgtgtccaagatgagagatgtaccagagttgactatcaagaaaagaactactgattacgtgtatgactatttgaaagttatccagcctctaggttccttgtttccttgtaagtaaaaacactttacatttatcaagtcacttattttaatcctcacaacaacctcataaacagggattattattatccccattttacaattgaagaaactgagggacagaaatattacatcattaagtccaggcatggtggagcatgcctatagtcccagctcctcaggaggctgaggccgaaggatcatttgggtacaagagtagtttgaggctacagtgagctgtgatcgccactgcactctaacctgggtgacagagggagaccctgtctccaaaaagaaaaaaaagaaatgttacgtatttagactaaggtcacacatcttccaggttggctacagagcctgagttcttctccgcaatgctatattgcttaggaatagatggggatttattgcttctcagcttttaccaggacaaagtagtctgcaaatagatttgcgagatcttggtgtaaaggtaataactgagccacctagagagaaggaaagtagacagtaaatagaactccaggaaaccccaaaaacgaaggactaggccaaggaaaaagagcagaagccagaaaaaggagcgaactgatagcacagccagggaggctgaaagatcgagacaagtcattggaaagcatgcattggatttggcaactaagaggttgtgagtgacttaaatcattaaacaatatatatacttcaaatggatgtcttttacgacctgtaaatgttatgccaataaaactgcataagatgaaaaagatctaatgtacagcatggtgactgtagttaataatactatattatatatatgaaatctgctaagagagcagatcttaagtgttctcactgaaaaagaaaaaaaggaaggtaactatgtcagttgatggatgtgttacttaactgactgtggtaatcatttcacaatgtatacgtatatcacatcatcacactgcacactttaaatatattcagttttgtcaattatacctcaataaagatgaaaattttaattttcattttttaaacatattgtataatatttattacatatatagtgtgcagtgtgataatatatattatatatataaaagctaaaaaaacctggcccctgaagtgtcattgcagcggagctgacagctcatttgtcagtttctcagcctacctcatcagaaattctcaatgcaggccaccagcatttctctgtgcacccattcctttgtcattccattgtaaaagagccaaaggaacagcaataagaaaaattaacttgctttttaagcagatcatctccctgtccccagagtaaacttctcacaccacctcccaggacttcactggaacttttgacctgtcccctatgccctccacggtggcgcgggcaactcagtgtcattggttcacagtccagccttcttccttcacttctattccttctttgtctgagtggccggacgcagcctccagtctgatggtgttttcatcaacattcacatgatcttacatgtaagcaaagaagaaggcatggatctgatgcctgattcctgccagcaatgagtacctgtgaaaatatacacaataactgtacctttgctcaaactgtacctttgcccacagctttcagctcatcacctgatctttgttccttgcagggatcttaccgctgtgggccttgtaagccggggtatactggtgatcagataaggggatgcaaagcggaaagaaactgcagaaacccagagctgaacccttgcagtgtgaatgcccagtgcattgaagagaggcagggggatgtgacatgtgtggtaagttgttttttgacttcctctatcatttttcctcttccatttttaacaccacctctctccagtttctatgtgcttcagggtaaaagtactccaaaatgaaagcattgcaattaaatgagcatggagtgtaataggaacagggtccaccgagtttgtggggagcagcctgacatccatctaaccatcagctgccttttctctccctcttggctggggggcaaccctgtccacttgggtacctggatgccagagcctccggtgaagccccagctcccaagcaccttctatggaaaggcccagaagccagcagcagggaggtgaaggaacattcttctcccctttccttcttctgccccatctacctgcctgtataatgacaacatacctgctgtcatctctaactgtcctcatccttacaacttccagagtctgtctgccttgacgctcctgttgggggtgggccatcgtgtagaggtggggactgtcatagtccctccgggagaaaccttccgtctttggcaggtgactggcagggccagacggcgccatgctgtatgtctacctccactccaatcagggacagctccatgaatggtcacgcttcctgtgcattctccagccacggagctggtctggggaggggaggctgggaagagagtagagcagtcacagcagggcctgacatgggtcccatgctgagcttgtagtgggccctatgtgaaggagagggcatgctcctgccatccattcccaaatccaaggatccagagtcctcagcctgccatccattcccaaatccaaggatccagagtcctcagcctgccatccattcccaagtccaaggatccagagtcctcagcctgccatccattcccaaatccaaggatccaaagtcctggggatcctaggcactgaaaaatcagcagacttcagctgcccccctcctctgcacttcctgggatgccaggccctcggccggtggcccgtcagactctggggtcactggttcacagtgatcacccctgagtagcaagatggattctcggagcccttttccatctttatctcaaagttatgcttctttatctttatgcatacacaattttccacaatgagcctaccacttttcaaataggaaaaataagagtcaaaaatgagttaataaataaatataatgaagtcagccctccttggcaatacagatattctgtaacaaggtcagatggaagaatgtggtgtatcagagggggaataaccccagcaatttcctgaattcctcatggttgggcttgtttattaccaaaaagcagtcattgagaaacaagtgtatatctctgttgaaatccccattttctgtgaacaaattgacaactcccctgggatgatgggtgatggggctcttaatatgtttttgaatttgtaataaggcacaacgacagatggtaaaggattaataaacttggcgtgactactaaaataattgaatctgccagaaaatagctcattaaaaatgtatttgttcctagaggacattttttcctcattaaagtgagtcaaggatcagcctcgtggatcagccttccaggccttccaaaggccctgctggggcaagtgagcaggaaccaggagcccgggagggtctctctggagttctgcctcctaaatcctggttgcagagggagagcacagatgattgagaataagcaggctgtggctgaggaagtcactggtctgaaagcttttgggtggtgaggccaggaaatttaacctgtgctcacataagtctgatttcccttggcccagactctgctcctcagactctctccctcttccttcctttacctcccgtcccaggtcagctttctctccctctgcgtttccagttccctgtgaccttctgggtcccctcctcccatctcccttctgctgctctgcctgttcctggaagtgggagtgggagggagagttttctctctgagtctccctttatatctttgaatagtgaaccattacactattcaagtgcaattaaatagtttctaagccccacccaacaaggctgagtgactctgggccctccccctgggattgagcaaaggagcagagaggcccttgtcagccaccagcttcctgccaggctcagcttcccaggcctctgatgggctttccctttacagtgtggagtcggttgggctggagatggctatatctgtggaaaggatgtggacatcgacagttaccccgacgaagaactgccatgctctgccaggaactgtaaaaaggtaaggggtgtggggtggcagtaggcacacatgcactgtggctttccaaagtcacatcttctatggggagaggttctgtggatctaatttaaaattgtacttgtaaagtagctgcatctcagaggaagtgaaacagccaccaacaataaagccacagtgtcttgaggtcagaaacagttactggcttaacacaaatgtaggatgtcactcggaactgcattttccccctaaggacaactgcaaatatgtgccaaattctggccaagaagatgcagacagagatggcattggcgacgcttgtgacgaggatgctgacggagatgggatcctgaatgagcaggtacctgcttcgctgggagggcctgtgaattgccacgtaccagggatgatgggagaaagcctgtgatgtcaactatgtatatgaatcatcccaaatgttagtttccatgcctgcattccacagcactgcagctttttaccctataagattcacagatgtttgaaatataaaactgacaaacttgggccaccagagtgctgatgcttcacaacaatggaggaagtggatttagtaaaagtctgagtgatgttctgtcctttcatcttttaggataactgtgtcctgattcataatgtggaccaaaggaacagcgataaagatatctttggggatgcctgtgataactgcctgagtgtcttaaataacgaccagaaagacaccgatggggatggaagaggagatgcctgtgatgatgacatggatggagatggtagatttatcttgcttttgtcttttatttggaattcagttgaccttgttccattgttctctgagagagtaggaatagaatgactgattcggagccttccagctgtgggtggctcattgtggcctgcatctggaagacccaaggtggacttgtgtctatggaaggagaccccacagcccactccactacctaatggctctggatgtttccaggactctgtatcattgccagaaactttgtatgaccccttcaagcagtgtcttgtcagagtgtgtctttatggggtatctcccttcccatttctacctgtcctcactctccactatcctttctacatgtgagagacccagaagtggagaactgaatgagaaggcattgagcagggtcacagactatgcatcacaggctacacatcccattgtgggcccttgaaggaaaaacctttttgaaataccacctgccccaacacacacatacacacacacacacacacacacacacacacatacaccactccagaacatgcacacccccctaaaacatgacctcaccttctgcaagcctaactgatgacccatttccagtggtatatgctggtaagcaaatcacagaaagccctagttggtagcattttccagtttccatgatgtaactccgcattgtcctcattgctgatttcaagctaccaatgtgacatcatcaaacacaaaactgaaaagagagggacacaatggacccagctccagcacaacactgcctagagccctagggtctcagtcatagctcagatacccacgagatcctccctctccagggtcagccatacagccatcatgatcccctcctcgtggttgctatcatagcccttgacatcttggacaaattagaattcagtcgataaatacctctgagagctgttcatttttaagtctcccagaatccgtcctttgaagctacctctggataactgcagaaaagggtagtctctgtgtgacactggcccaggcagaagtgactcaccatgcgcctgatctctccagcacctagaagaagtcagtgacattcccctgactcaaggtagcatttctttctcacaggaataaaaaacattctggacaactgcccaaaatttcccaatcgtgaccaacgggacaaggatggtgatggtgtgggggatgcctgtgacagttgtcctgatgtcagcaaccctaaccaggttagtaggatactggggaattcaaactccaggctgaattcctctatgcaaagactcatttaagacgggtgtctagaaaaacagcagagcctcttagctgttgccacttacctaacaaagcagaggtggaaaaatgacacactgtgggcctgaagatggtgggatgaacaccacacaagatctgaagccctagggactatctcccaggctgtcgattgcctgtgaggttagtaacacgaacttcatgatgctcaatacaagtatttttcctgcagaaaggaaaacggagcatggaaattaaccattgggagccttgtgtccctttagtccctaaacccctacacagcctatgtatggacatttcagattaagttcagccagggatgtgttgcatctcccttctcactcctcctccctgtctggataattgggtatgatgtgtcatttatttttaaagccctgagagaggggagtcatggttgccctctgtgactcactcatgattttggccaaattgcaaattgcagaagcaaagcaaaatcaacctgccttctccccatgcctatggctggctccctgtgacccgtgccagagttccatgcctccacctgccaccatgctaccccagcgcccctttccaatcagctcatctggtgtgtgggcagcccatccatgtagcttgatattttagaaggcttttttgaaaattcagcattgtgcctacaccaatatggtgttgtccttttgcagttttgcaccaccccggttccagagaaataattccccaaatccaatgatgatgggtgaggtctgccttctctggaacattcggtacatgcaggcccaggaataaataacatgtgctgttctctttgcagtctgatgtggataatgatctggttggggactcctgtgacaccaatcaggacaggtatggcatgtctcccaactgcagagagacagatgcaaacatccggagagggtttttggtttgtttttttttttgaggcggagtctcactctatcacccaggctggagtacagtggtgcaatctcggctcactgcaagctccgattcccaggtttatgccattcttctgcctcagcctcccaagtagctgggactacaggcgcccgctaccatgcctggctaatttttttgtattttcagtagagacggggtttcaccatgttagccaggatggtctcgatctcctgaccttgtgatctgcccgcctcggcctcccaaagtgctgggattacaggcgtgagccactgtgcccagcccggagagggttttaaatttcagaacttcctgctgctccattccttgggatctttctgggtggactgagctgctggtgggataatagccctgcctctggtcagaattaccatgaaaattctccctgaaagttctgtatagggtataacggtgtcagaataggttactaggcactccagcaagtgagatctatttcaggagaggtaatatagcatcatgcttcacagatgggctctggaataagacagctagatataaatttcagctccttctcttacatgccagctaaccttaggcaaattacctaatacttttgcctcaattttctcatctgtaaaatgaggatgacaatagatctagctcataggaccatcgtgaagattgagttgatccatggaaagtgctcattatggtttctgttatatacatagcactcaatagacattagctcttttatttttatattctttcagctcaggaaaacttcaccatcatcccaaaatagaaggctgtcagtttgctgagggattgctattatttcctggtccttgaaatttttttaattcagttttccttatttaagtggaattgttctgtggaagtgagttttgtgaaccctcctagctcaacacgatggagtcccacattaagactcaaggctggatcaactgatcagattctggaagaacatcaccaaaaacagacgtgtgtcactcagccctagcggcacctgcaacccaaggttctaaacccttttgtctccatagggaattcttacaaaggcagccaggacaaggatgagagggaaaggattctaaaagagaaagcaaaaaaagatgcaatttctctcctgatacctggatcagaggttgccctgcagaaaaccagttcctgacccaaaccttactcaaggacagctcctatgaagccacagctctctctctctttttttttttttttgagatggagtcttgctctgtcacccaggctggcgtgatctcggctcactgcaacctccacctcctgggttcaagcaattctcatgcctcagactcccacgtacctgggattacaggtgtgtgccaccatgctggctaatttttgtatttttagtagagacagagtttcaccatgttggccaggctggtctcgaactcctggcctcaagtgatccacctgcctcatcctcccaaagtgtgcatctctttcattatgctctgtgtccttgctgcaaagtacatatagtcatccctcagtgtcccagggtattggtcccaggatacccctctgcccccaggataccaaaatcctcaaatactcaagtcccttatataaaatgatgtaatatctgcatataacctatacctgtcctcctatatgctttaaaaatcctctctagattacttaatacctaatacaatgtaaatgctaggtaaatagttattatactgcattggtttcttatttgtatttttttggtgttattttttattgttctttttcaaatcttttcaatcctcagttggttgaatctgcggatacggaaccgcggatacagaggcctgactgtactagctaagtgaacttaaacatatttcccagtctcttcacatctcaacttcttcatctgcaaagaggagataaataaatgcatcgcacaggttatggtgaaaaatcaagataatgtaggtaaagctcccggcacagtgctggcccaagggtgacatgcagaaaacaggggccgtgttattattggtatcacagtacaaggaaaggcacatcagcaacagagcctgacatcagatgtccctctcctcttccgagaggaaggtgggactgtatcctgacaactgccctaaatgatgtgcgtcaagaatgttccctggtgcaggtcatcttgcactctgactactatctacattaatttctaaaatatcctgtcccaccagcctctagatatttgcccaaaacaaatgactcattctgctatgttttaattcccacaaagttgaaccttggagaagaggataggaactgcttgtttttgcataaaaatgttcagggctacatagaacggctgctaatggaaatagctcagtcttgtgttttataaagcagacctgctgcatgcacagggattctgctgtttgagccacatcattttctgcttgtcaaggctgacttcactttcactggaccctttctgtccccctgtaccatgtggtaggtgtggccctagagcatggtctggtccctggcttccctctccaaaagggtgcaggggcagctcctggcccaggacaggccgcaggtggaccaggtctaaaggagtgctcattcttttccagagtaaccatgagaggtctcagactccaggacacctcttggaggcagggcagactcatcttcaggtggcccctcagcccagaaagtcaggtggacagagaaggagagttctgagaagtcctttagaccagcactgagcccggcctacacactctcctcgagaaggcgtggccctgttcactttgcccttctccccatggcgttcaggtctgaatcctcattggatccactagccagggattgtgaagagtaatataacggaaaacactgtagggcttcctaagagtcagcactttttcatatattgaaatttaatatgcaacattctgattttcatcatttaatctccataacaactctatgaggtaggtactattctcattttacagatgaggacactgagccatagagaggtcaggtgtcatgcctgaggtcacacgctgggcacagtggctgagccaggatttacactgaggctgtctggttccactgcctgtcattgttcccctcacacatcctctgagttgagtatcatctagcagttcccagggactgactgataggagcatctggtcataaatcatagaaatagacccttatcttctttagtaggaaatgactcacttgttttaagaggttggggatgggaaaattgtctctgaggcccatagggcagccttatctaagggaatgaccccagtgggtttgattttaagagccaaccctggtttaaaaaaaacctcaagcacagactctccttcctaaaaatggatccttcctgttccctgctgaactgtgagccacatcacctgtcctttctcctgcagtgatggagatgggcaccaggacagcacagacaactgccccaccgtcattaacagtgcccagctggacaccgataaggatggaattggtgacgagtgtgatgatgatgatgacaatgatggtatcccagacctggtgccccctggaccagacaactgccggctggtccccaacccagcccaggaggatagcaacagtaagcaggctcagcccagagctgcacagcacccctgggctcccttcagccaggcacatgggggcacgcctctctccaggcaccaactcagaatatccccagctcccatcagctgcttctctacacccagcttctctgcatagctgcagcttgtgtggacagcagatatctggtagacaccagtctccaactcagtcaggactgagctgctttgcatcttcctgaacaaccctaggatgccatcacacaggtcagggaagcagccacacactgtggctcagtccccaaagggcttggagagctgctccaccatcttacctgtcacctgccaccttccactgggagtcccagaaaaggagcaggatagagagaatggcacagtagaagtggtatatgctgggttcacaaacacagatgcctgcaggtgccaggcagataagaaaatgtctgcaccaagccagacatgagacagcagggagtgttggggactgaagtgacctggagagggcatgcccatccacagcagtgcacatgcaaaaatgccagcacgttagctgaacaacacacacgtgggggccaccagaagttagtgttagagatattctggtaacaataatttccctgttttctacacattacagtccagaaagtgctgtagacatttgcttatgtgaggtcaagcttaagatccaccagttggtgaactcaactgtaggtaataagaacttcttgaggacagagtggagggcaactgctcaaattgatctttcaaaaaactctgggaggactggcctggtcacccagtacaaggactccagaatggggcctggcaccagctcagacatgtccccagggctcctctcccaacactgatgggaaatcatggccctggttgtgggagcttgagcccttctgttcctcatgcagcccccttccctgccaaggagtggcggtgggtgtgagcgctattgagctcctgtcctttctccaccccactcaggcgacggagtgggagacatctgtgagtctgactttgaccaggaccaggtcatcgatcggatcgacgtctgcccagagaacgcagaggtcaccctgaccgacttcagggcttaccagaccgtggtcctggatcctgaaggggatgcccagatcgatcccaactgggtggtcctgaaccaggtgagtgtcacatgggcggcaatggctcagccttgcctctcaacagaggcccttctgatagtggtaggtcatgtttagagggtgcagacaataagccaggcattcttcacattcgctcttattcctcaacagccctatgacagactacttcaattatgcccattttacagaggatgaaattgtctgctacagctttcatgattgtagcagctttaatgatggtagcactgtggtaagtagctgagatgactggaattgggacccaggcagtctgaccctagaacccacacttctgatctctgcagcagactgccttctgcatatcctcctcattgtgtaactaagaagtgcaggcacagagaggcttagtagattttccagagtcacagagcaagtcacattgattagaagtatatgttgtatgctccccagttaagggcctgtccaatcagcttaagtgacagtctcagcaaacttatttctattcagctttgagcttttttttaacctttacaagcacatgctttctttgagcacataacacaatagagcaactatttcagataatgaaatctttatatggaggtcagacatcactggccactcactcatatggtgcctgaggttttgagcttccttaaggttacttggccccttcaagactgttctgaactccctcaactctctctgcagggcatggagattgtacagaccatgaacagtgatcctggcctggcagtgggtatgtccagggcctcagttgccactcacatagaattcttccagctactagtgtggtttgtctattgttctaatcttatctggtccctacagggtacacagcttttaatggagttgacttcgaagggaccttccatgtgaatacccagacagatgatgactatgcaggctttatctttggctaccaagatagctccagcttctacgtggtcatgtggaagcagacggagcagacatattggcaagccaccccattccgagcagttgcagaacctggcattcagctcaaggtattggtggtttgaagtcattcatctccctttcttctggacctctcatcttttttcagatattgtgttttcccatgtggtacttagttaatctaaaaaaaattgatgcatttatgctaacgttagagtcagggaagactacagttgacccttgccttcattcctgtgtgccagctacattctaacctctcatggtgggaatcccagcctacatgaggtcagagagagggaaggtttagagtgcatcttcaggcacactgtgttggaaactggctaataaatttcatcgataggtccaactttgtacaggagggctgatgggctacttctgtcactcctgctaggacacaaggctgacttaagtagccagacgtttgataggagccctcattgggcaaatgtagggagcaatggatgtgcagcaggaacaaacatggaatgtgtaatggaatactgggcaaggcttagtagtaaaaggttggggtcacctccatagaaatgacatttaagtgtttatgctttgttctgaatccaaggcagccggattataaccatgactataacctggatcatcacttcagatccaggaagcaggaagggtggtgcctgtgtcctgtcctaaaaccttgcttgtgtcatcatgcaggctgtgaagtctaagacaggtccaggggagcatctccggaactccctgtggcacacgggggacaccagtgaccaggtcaggctgctgtggaaggactccaggaatgtgggctggaaggacaaggtgtcctaccgctggttcctacagcacaggccccaggtgggctacatcaggtaggtagaggccccatctccttaccttgctctagaagcaaagcattctccgttctgcatcccagagccttcatttccctgagcaattctgacctaggatagtccccaaggacatgccaggacttttgtgaccgcaggatggggaacctagaaaagaggtgggagagaagatattcagggtcagaccacccggacaggacagtaggaccaagatggggatagaaggagcagagctgaggggacgacccagcgttgtggggttggtgcatttggatggctgtgcccttctgccatgctctgcagagaagcctgagggtggacatgccaatcggtatgaggtaagaggtgtggcagggtctcttctccacaccctcccctgtggcacctctgggccctgtgtaatcacttactagtgcacatttcaccctgactgcagcactatgtcccttacagtctgtcttccctgctggatcacaaactgcatgagagcagcgcttgtatctttttttttttttttttttttttttggagacggaatcccactctgttgccaggcaggagtactgtggcgtgatctcagctcactgcaacctccgccttcctggttcaagtgattcttctgcctcagcctcccgagtagctgggattacaggcacgcgccatcacgccaggctaatttttgtatttttagtagagatggggtttcaccatgctggccaggctggtcttgatctcctgacctcgtgatccacccgcctcggcctcccaaagtgctgggattacaggcatgggccactgtgcctagccatagcttattattttatcttgatctccccagtgcctagcacaaagcctgacatctactacacgtggcatgaactgatcatcatgtaggccaaagtagtctgacttctttctttataggacttttttgttgttgttttttaagtattctcgggagttaggaggcttagggctgtgtctttgaaatgtagatagtgttcttcttcatttgaacttgcagatcaacacccatcctagcctatgtaggatatttaggaaggagtactgagtgcattctcctcatcagggcaggaaagcagccttgtggaaaaaagaaaatcatgagggcaaattcatgttttgtttctctttgtgacattatgtcaaatgtactctttttgtctcacagtgagatgatcatgttctcagccctattaagcccaatgccccttttttattataaatattttgaaatgcccccttttccgtcccaaaatggaatcatagaaattacaacctacctacacgtataatctagaaaatcaatgtgagccctaacaatatcatagagaaataagaataatttataacaaaataatttaaatatttgagcacagccacaccagaagacaaaatgaaacagacacttgcacccatgcctagaatcactacgaaggtgacattctaacagactgttgtgtcagtgacttaaatgtttgttacactggttgatgacagcaatgtaaatttctcaaatggtacacattttagaatgttaattttcaaacaaattttctcaatttaccctggaaaatatagtttatattaaaatttgtgcaaaatatacttgctgtttacaagtgaaagtgagtcaggttctaggccctgatagttgctctttacctaccctggtgtctgaggaacactccagaagtgtatggaatgcaggacaggttttgattgttctcgccagggcattgctcgccatccagcatccctggctgccatcactcagtgccactgtgacaacccaaagtgtccccacagattcctccaactctacttagggagtgctgtctcctgtggagaatcattgctctgagattccaccaaaagatataaatcagaccaaaggaaaagccaaagtttttaagcatggtatctagacaaggcaactcacatgacaataagacacaaaactttctcactcaagatagcaggtttggtttggtttgatttttaactcaagtttgatagtgtgaccaacatcatgttaggccttgtgagagacagaagttgggaagaaacaccccccacccccctccacacacacacggacacacacggtccctgccctcaaggacttccagtctagtaagtaagtggcaacagctacagtacaatccaggtcagcgaaaaatggagcctaaaacagagcaaagaaagacgcaggtacgtataagaagtggggcccctgggcctcacagtgggcactttaccccgggttggatttcatggaggcccctccggccgtgttgtccgcagggtacgattttatgaaggctctgagttggtggctgactctggcgtcaccatagacaccacaatgcgtggaggccgacttggcgttttctgcttctctcaagaaaacatcatctggtccaacctcaagtatcgctgcaatggtaatgtgcattctcgttactgttcaacattgttactagaattagtcaaacactgccaccttatttttataccgcacttcccccccaaaagcccaacgctcataccacatagtcattaaaacctgatagtccctgtgtaccagaagtaaaaagcagatcacatttatcctattttatccatgtggaaattaagacccatagaatttaactgcatggtttagggtttggggttcagtgagaaatccagtcagatttaatttacaggaagcctttattttcatgtggttaaaacataatcacagatgcaaaatccattctgcctgctgattttctgcacggccgggaaggagcactcctgggctttaagccaacggtttgcaaagcagcctgcaggagaaaatggcggcgagggcctgcggggcgtcctgggcgggctaacagcgccccctacaggacgcctgagccgcgggcgggggtccggggtccggggtggaaggagcctcgctaacctccctgtgcccattcctattgcagacaccatccctgaggacttccaagagtttcaaacccagaatttcgaccgcttcgataattaaaccaaggaagcaatctgtaactgcttttcggaacactaaaaccatatatattttaacttcaattttctttagcttttaccaacccaaatatatcaaaacgttttatgtgaatgtggcaataaaggagaagagatcatttttaaaaaccgtgttgctcagacattgctctcacgtggctcaggctttgaggtgcccgttctcggagggatccctgttaacttgcagggtggtagtttcttctcagacccggtggccgataagatgagcctatgcgtgaatcacaaggcccaggccagaggtctcagctggggtccccccagtttgctccatacaaaacgcctaaccgttccatgctcaccttggcagcctccttatttcgggtaaggggtctcagaaacacgtgtttggggtggcaccttccctagggaggcgtttttctgacctagtcctgggacagatttgcccaattctttctgatgctgtcatcccatcccacaccttccacagacttctattctggccccttcaacgtaattcttaagcttatttatatatttggctccccctagtggactgtaagcatattgacaataaaggatcatgtcattacaatcaatatccccacagtacctggaatgtagtaaatagccagtaaatgtttactgaattaataaacgaagaatgaatgaatgaatgcctcttaaaggacagtagagtgtacatgatcataaaagtcctcctcaactcaaaaagtcacaacatatcctctatttgtggtaccagtagctggatgtacagcacagaaacttgcctaatttgtacactagcctttcttgtatttcaattgtaaatcaagatccaagcaaatttttataaattctctagaaattttgtttcaaagaatattgctgtgcggttatatattttcttattccagaattcctagagatatattaaatcatgtatgaagaaaaaaacaccacagttttatcatgactttaacagtgagaaaatacaatggtgcatgcatgagatctggaggatttctggacatcctcctctcatgtacagcctggagatgtgtgtggccttgtaatccaggacatctgatctcctacatcaaaaactccaatggggccaggtgtggtggcacttgcctgtggtcccaagcactttgggaggccaaggcaggcagatcacttgaggccaggagttcaagaccagcctggccaacgtggcgaaacccatctctactaaaaatacaaaaattagccaggtgtggtgccacttgcctatagtcccagctatttgggaggttgaagtgggagaatcacttgagctggggaggcagaggctgcagtgagcagagattgcaccactgtactccagcctgggcaatgagagtgaggctggtgaaaggaggcagcaacccacaccatgcccacccctggggcagcctccctgttgtcggctgtgcaagcccaagaacgcagtatgtccacaggaaacagactctcttggttaaatcttttgtgtctataactattttagaaaccatgggcccacaggagatccagaacataattccatcccttagggagcttattacatttttgggaagacaaaacttgttatttatgcaaaacaagaaacaaagacgcatgtagaaccagcagtgtgctgaagccaactcctaccagctcataagagccaactattcaagttttaggaatattgtgagccagttaaacggttggtagtttgaaattggccatggtgggagtatttacacagaaactggcaaacactacaaatcagggctccagagaactggttgttaaatatttatcagcacacaagtgattattctaccttgtcctattcctagttggccctccttatatttttgaagctgatgtagaaaacttgaggctttcagaaaatttcttgcataagaaatgaagtaagaaaagtgaaaatgggtggggtgctatggctcacacctgtaatcctagcactttgggaggcctaggtgggaggatcgcttgaggtcaggagtttgggaccagtctggccaacatggtaaaaccccatctctactaaaaatacaaaaattaggccaggtgcagtggctcctgcctatactcccagctcctcaggtggctgaagcacaagaatctcttgaacccgggaggcggaggttgcagtgagctgagatcgtgccactgcactccagcctgggcgacagagcaagacgtgtctccaaaaacaaaaacaaaaaaaaaaaaaagtgaaaatcaggaagcacttgagagaagctagccagttgcagactgacgggatgagctagcaggtgtggtatgctctcccccaggtaactccctgggcttcttggatacttgttatactcaaccttagcacaatgactcaaattcctattacagttccattaggttagtaagagcctcatttgaatcttacacctctaggactgagtggccatcagtctctcaccaactagtatgaattcattccaatgcccattcacctcctgacttttcatggagatcgagaagactgaggagctgggcatggtggtgtgcacctgtggtcctggctacctgggaggctgaatggggaggatcacttgagcccaggagttcaagtccagcatgggcaacatagcaagatcctgtctcactttttttttttttttttaagtactgggggaatgggaggcgtggctgggaaagaaaagaggcattgtcactgtgggggaatgggaggcgtggctgggaaagaaaagaggcattgtcactgtagggaaaagatcatggctgagtagaatcccacgggaagtgtgggagatctctgggggcaggatgagggcactgggggcagccagaggaggcctgggggcatgggagcaggtgcacaaagggatgtgcagccctttttgcctacactcaagaaaaaggaaaaaaaaactcttccttctccccatccaggttattagtcctaggctccagaagtattatggtgattatccttaggttaattttggagacaggctatagagttaaagagaatgaggaagatatagaatccagccacctgctattgaaacatctgtaggcattttttattgcctaggctagaagataactgggaacagactcaagcagcaaaaaagaatctggtccagaagtgaggccgtgggcaaactagatactgtacagcataaatctaggggtgagaggtggggtgcccctgtttgggatacacgcctggggtccccagtaacatcgggactgtaagggtggctcaacctttcagtggcatgaagaaaccccctgcagtgtccacagctccgcatcttacagccccgcccaatttggtcataggcaacctcaggagacagagacgctcaccccaaatttcctggggcagtatagtttccacagtgggtgagggtgttttattccagagaaataattctagtactatagaattaagtatagagatgatgaagtaaattggacccatcatcctaatatttttgtgtggtgttggggaattatgtttgaatatgtggcaacgtacttgaaatatctaagagaatttggcataattagagaatgcaaattgaacttgtgattccagtatagaatgcagacagatgctcttcaccttaaaatggggctatgtcctaataaatccgtaagttgaacatatcttaagtccaaagtgcatttagtactccaataaacccaagtcaaaagtttaagtcatccatcatgaagtccagatactcctcaatttaaatagggttatgttttgataaaaatcgtcaaaccatcattagttgggagttgtttatagttgaatatttggtttatcatcatcatcattattagtattattgagacaggatctcactgtcgctcaggctgcagtgcagtggtgcagtctcagctcactgcagcctcaacctcctggctcaaatagtccttccacctcagccttccaagtagctaagacttacaggctcataccaccatatccagctaattttttctatttttttttgtaaagatggggtcttactgtgttgcccaggctggtctcaaactcctgggctcaaatgatcctcctgccttggcctcccaaagatagtatttgattttagacttgtgattttaagtcagaaggtaggagaatttggttgaatatgaaaatattgagatgattaagataatttctcatccattatatacattttttaaatttacaagttatataagcacataggtaggtttcatcaaatgacaaaaaaatgcataaatgaaatttaaatatattgtttttaatgttacaaattagcatagtatgtcataaattaatatattacatttataaatgggatttagagtgtttaaggaaatttaattaagtttgcaaatgggactaaacattaatcaaaagcctaaaagtgattatatattttgctatagagtaataagtagatttgcatatttatagaatatagtaaagtaatacgatttttaagttgaattttttaacttaaggttttgtaatttgtaactttaatcagatactaattttaaaaccaaagtcaccataaattgtgttttctgtaaaagacaacctttccttcaggaataaggaatgcctcctacaagctccacattttaccacctcgcccaaatcgttggttaataacctcagacaattgacatgcaccccaaatttcctgaggcagtagagtttccttagtggagaagggtcttttattcctgagaaataattctacaattgtagaactaagtacagatatgctgaagtcaattggacccatcatcctaatatttttgtgtggtgcttgggaattatgtttgtatatgtgccaaagtacttgaaatatctaagagaatttggcatacagaatgcaataaattcaatgtgggattctagtttaaaatgcatacagatgctcccttacttaccatgtagttacatcctgggataaacccacggcaagtcagaaatatcataagtgaaaatgcattttatatatatatatatatatatatatatatttttttttttttttttttttttagatggagtcttgctctctcgcccaggctggagtgcagtggtgcgatctcggctcactgcaagctccgcctcctggcttcacgccattcttctgcctcagcctcccgagtagctgggaccacagacacccaccaccacacccagctaattttttgtatttttttagtaaagatggggtttcaccgtgttagccagcatggcatttaatatcttgataagcccatcataaagtcaaaaaaatcttaagtcaaaccattataagttggggattgtctgtagttgagtatttgatttcagacttctgattttaaatcagaaggtagggagaatttggttgaatatgtaaatgatactgaggtggttcagataatttataatccactgtataaatttttttaatttacaagggttatttaagtgcgtaggcaggttttgtcagacaagtgacataaaaataaaacattataaatgcaatttaaatttagtttataatgtattacaaattagcatagtatattgttataaatatattaaatttataaatggaatttagagcatttaaagaaatttaattaagtttacaaatggcactagacaatcaaaagcttacaagtgattataaattttgctataaagtaataagtagatttgtatatttatagatgtagtagagtcgtaagatttttaagttgaacttctatacttaaggttttgtaatttgtaactttaatcaaacattaattttaaaaaccagtcaccataaattgtgttttctgtgtatgaaagctacccttataagcaaataacaaaatcaataaaaaacagcacagtgacagtcagcactgattttttttttattgaggggtggagatctggagaactgcatcctcaattccaaataaggggctaacaatcatcccagaacactgcccttttctacattggggactgtcaccgcacagagggattaaggaccttgattcagctctccctgactccagggcatcaccaagcagctggctgcagcaacgctgggggcctgagctatcctgctgtcagctctcaaacccctcattttccaggacacatggcctgaagaatgcactagccccaacttggggccctggtgtggcgatgtggcaaggagcacctctctcttctccctactacatcaaaaattttaaggatgcctaaacatgtctgcttatctggagggctggggtgaatgagacgtccagaatgaaagctctcctattctgactgcgccacctgactgagaagtaactttagcttatttccttggctcatcataaaagaacgaaaagtattttcctcacattgtctacctcctcaactatggagtggacatgcatccacgccttcaactcaggtctttgagaaaaacaactttatttcccaaatttcaccttgtttttcttctgagaacttattgtgccaaactcaagagaaacataacctcagtctttcttggggttcccattcttcttccagaatcaagactctaggatgtcttctcagaaccaaggtgtttggggagggggacatctatccacacagattccttctaacgtgaccatagtcagcacccaccccccatactctaacagaccacactggggacctcaaatctgtgtgaacctttgcagccattcctttactggccccttacctatggactgcagaaagctcccacaggcctcccttccttctctctcagcatgggagaatccttctcaagtatgaggagggaagccttattctcccttttgcttttggccaagaaatcttatccattcccggtgttccttcacttacgccctgctatgacttgaatgtgccccctgaagttcatgtgttggaaacttaatccctaatacaacacttttgaaaattaaggcctagtgggaggtgtttaattcatgagggcagagcccttgtgaatggattaatgtcagttataaaagaccttgaggctgtgagttccatttcttgctctcttatactctctgcccctccatcttccaccaggggatgacacagcacaaaggtctttaccagataccagcacttgatctatcttggacttcccaacctcccatgtaaaataaatttcctttctttgtaagtcaccccatctatggtattctgttatagcaatacaaaatggactaagacactcccacaaaccccagacttcgactatgggcttagctctgggtacacaaaaactagaacagtttgcaagctggctctgactcacaccaccacagcctcactgaaatagtgggcccagagtccactctgccagaatgggaggactggggcaaagggaaatatgaaaaggaaatgggtcaatatctcaaagtgctaccacaacatattgtgaacaacttcaatagctaattttaaaaaattcttttttagaaatgaggtctcactatgttacccaggctggtctcacactcctgggctcaagcaatcctcccacctcagcctcccaaagtgctgggattacaggcatgagccaccacacgtggcctcctactgtttagatttgttcctaaaagatgcctatgtttaaaccaggccagatcactcaccctagaaattccacaaataaccaatgagctgatggctccaggcagacgggtggctgagcccagttcccatcctggcctggaggaggagacctaggaagtcacagcttaggatacactggggcgggcgggaaggtttgcttttatccatcatccaagctgtgattcagcgcataagtctccctttcattaagtttaacttgttgagtaacattaaatttatatactgcaaagcacaatagaatttcactgctgtgaacatacgcgttcacaagcatcatccaactaagtgtgagcatctgctgcctcattgggggtatttactagtcattcattatttatttatttatttatttttgagacggaaccttgctctgtcgcccaggctggagtgcagtggtgtgatctcggctcactgcaagctccgccccccgggttcacaccattctcctgtctcagcctcccgagtagctgggacgacgggcactcgccaccactcccggctatttttttttgtatttttagtagagacgaggtttcaccgtgttagccaggatggtctcgatctcctgaccttgtgatccgcccatctcggcctcccaaagtgctgggattacaggcgtgagccaccgcgcccggcctagttatttattttgcagcacctattagagtaaacagtagcagatatctaatgtctaagaaaaatttatggaaggaagatttgaacgaaaaattttctccattagcatatttttaaggagttttcctcacaacaattccatcccactcctacccctcctaccagaattctgaggatcagggcttgagaactaacatctccaaagtcccagtagctctgtggttttctacaggctcctggaggataaggaccgtgccatgtttatctcaccctccacctctcaataaagtacaaatttgtggaattggcgaggccaagaggcctcaaattcttgtatctttcatatcatccactagggggcagcaatcctctaaaaatagcccctaaaccagccacttttttagctaaaagatgactaaatttcattaaaagtagaataacaaacgcctgtaatcccagcactttggcaggccgaggcgggcggatcacgaggtccggagaccgagaccatcctggccaacacggtgaaaccccatccctactaaaaatacaaaaattagctgggtgcggtggcttgcgcctgtagtcccagctactctggaggctgaggcaggagaatcgcttgaacccggggagcggaggttgcagtgagctgagaccgcgccactgcactccagcctgggcaacagagcaagtatgtgtctcaggaaaaaaaaaaaaaaaaaaaagaataacaacaactacaatttattaaacacttactctgctcctagcactatgttatatgctaatagttcagggcttaagaacaattttattggccaggagtggtgtctcatgcctgaaatcttaccactttgggaaggtgaggcaggaggatcgcctcagctcaggaatttgagaccagcctgggcaacatagtgagacctatctctactgagaatgttttaataattcgtcaggcatggtggtgtgcactgtagtcccagctacttgggaggctgagatgggaggattacttgagcctgagtggacaggctgcagtgagctatgattgcacccctgcccttcagcctgggtgacagagcaagaccctgtctaaaaaaaaagaactcttatttatcaaaacgaacatctcaacaaaaagcaacaaccaccacataggaaggaaaccaccacctaaacgtgaattattgcaacttagtctctgaacgaacactgaagcctcgctttcttttaggtattgcttcgcaaagacttctgccttgtccctcagcctaaattcacaggatagagtcttctccatgagcaaagcaaagagccattcatctatccactcatcattcactcattcttcagacacacactgagcaattactacataccaggcactgtgctagatactgggagggattttaaaagtacacaaagccagtccattttagtccaggcctctgtatgactgaaagcctttgtcttactattaataatactgatcataactgcaaaattatagtgtagtttagaattaaatgaacctggccgggcgcagtggctcaagcctgtgatcccagcactttaggaggtggaggcgggcagatcacttgaggttaggagtttgagaccagcctgggcaacatggcaaaacccatctctactaaaaatacaaaaattagccacgtgtggtggcatgcacctgtagtcccagctacttgggaagctgagacaggagaatcacttgaacct

SEQ ID NO: 1192 - DNA, 22739 bp, Homo sapiens
agcaatcccattactgggtatatatccaaaggattataaatcattctactataaagacacatgcacatgtgtgtttattgcagcactattcacaatagcaaagacttggaatcaacccgaatgcccatcaatgctatttactctttatccttacaatctccttaccaattgccacttgaatagcaaaataaatgcttgattcaagagccgggcacaaaaaagtttgtgaaacagatttaagaaagtagggagggagagtggaaaggaagcagaggaaatcaattgtctataggtatttcagtacaaattcaatgttagaaaaaaataaagaaaagccttcttgctgaaataggatgacttttatgggctggattcatttctcaagccagcaacttgtcatgtctacctggcacaaatgagccccaataaactaaacctgtggaattaaaatttttctccttacatactcccagaaactttaaggttacatttaatttttaattattattttaaggatgtagctttggtcatgttactaatgtttgtgtccttttatgattcagttgttaaacatatttttaatacatccaatagaattaaaatgacatatcacatctgagagggataaattaattctgactataagaagcaggttttctgaagtgcagggcactctgccctagactggcctagattgtaatagcagcacattttgcccagcacacgcacttaagatttctactattaagagagcagatttttacctaatttgtggaaattaacataaaaaataggaaaaggtattggaccgaaggtaaatataaggtttaaaacaagtacattgattattatcttttaaatgctctttttatacagtataatccacagtatactgaagttaggttaatgtaaatctagtaagttcatggaataaatacacaccatgagagataaccaggaatgttactggtaaataaacagagctatggtgtatcagtgacaagtgggaatctgatacccacatgaaaaaatgcacatagtcgtacattatccaggaattttgtcacaagtcaagaaacagatgtctcctatgaatctaaataaatagtagggaaaaaagaaaacaatctactggtcttccagaaatacatagcaaattttaacttcctctatcttatcatacaaagcacaaatgagtgacagccatttttttttcttttgttttcttttctttttttgagatggagtctcactctgtcacctaggctggagtgcagtggcaggatctcgactcactgcaacctctgcctcccaagttcaagcgattctcctgcctcagcctactgagtagctgggattacaggcacgtgccaccacgcctggctaatttttgtattttcagtagagacggtgtttcaccatattggtcaggatggtctcgaactcctgacctcatgatccgcctgcctcggcctcccaatgtgctaggattacaggcatgagccactgcgtccagccgaatgagagtctttaccagatttcttctccttagtgagactgaaaatgcctttcataagtcttgaatattccacttcaaaaatgcatagacagataaggcatagagacttgtcagaacttgtagactgcatgaatcaggtgctaccatcttcagtattccttactgttgttcttggctttgctcccctgagatactcagcaacagtgttttgacaatagttgagtgatgggagaaaagactttattaaacaaaaattgtgatcattgccacgactccaatctataatatatgttgaattcataacatgtttttatgggttaaagtaacttcctacttacaggattcattttcaccaatattaggagtaaaacaaggaaaaacactatgatttactgctggttcatagtgacttcatttaaggaggttttgccagaaccagtattttgaagtattggttggtgctgtgacaatttcacaactgtcaatgaataataacattaagaatggaaagaagtatgcctttctttcgaaaagtagaaaaagggtaattatgaaagacaatattggaaatgatgacaggggtattcccaaacagatcagttttagaaacaaaaacatggacttcaggacctggaagcagacgcacttaaaatcttccatgccgacataccaagatccttccaaagtaggcctacctcagtttgaagactgtgaacttcactcgctagaagcactttaatgggatctctttagtttaacttcctataggacatttaataatatgatctctttaaatggaagattaaaaagaactataatccagatgtaacagcatcaagatgcaactgaatttttgtggaaattgtcagtctggttttaaaatttatatgaaaattaaaagaccagcaatagccaaggcaatcttgaaaaagaagaacaaaaagtggaggaaatggagaacttaactactgaatattaaagcttattataaagcaatgataattaaaacagtacagtatgagcatcagaatagacaaatagaccaataggacagaaacagatctacacatgcacagtcctttgatttgtgagaaaaataacaccatggtgcagtaagtgaagggatggtattttctttaaacagtgctatgtagttgtgtcaatatgaaaaaacaaatcgcgtctcgaccccaacttcacaccacacacaatgatcaattccaggtgaattgtagatttgtatgtaaaagataaaaatataacatttgcagaggaaaacataagaaaatatattcaataatcttggagaaagcaaagatgttttaaacagaatacaaaaagtgcaaaccaaagagagaaaaatgataaatagtacatcaaaattaactcttctgttcatcagaagaaactcttaagggagtaaaatggaaatacacatagtgacagaagatatttgaaatacctatattccaataaagggtgtatatccaacgtatatattcataaaaatcaacaatatacaaacaacctatagagaaaagacaaaaaccaaatgttgtggagactgaggtgtcacctgaacttttcttttcttttcttttcttttttgagatggagtctcacccaggctggagtgtagcggcaagatctcggctcactgcaacctccgactcccaggttcaagcgattctcctgcctcagcctcctgagtagctgggattacaggcacgtgccaccacacccagttaacttttgtatttttagtagagacagggtttcaccatgttggccaggctggtctcaaatccctgacctcaggtgatccacccgcctcggcatcccaaagtgctgagattacagacgtgagccactgcacccagtctattttctgacatgagagtataaattagcataatgactatggagaagtttgcaagaatagcaaataaaaatagaatacccatttatgtaaaaacatttggcagtatatactaaggatgaatatatgtacagccaatgaaagtaattctccttgatttatataaccaataaaaataagttaatgtgttccccaaaatactggtacaataatgttcatagtagcactacttgtaatagcccccaaataaatacacccacatgttcatcaacaatttaaataaatacactgtggcatattcatgatctgaaatactgtacagcagagaatgaaatgaacatcaagtataggttacaatatggaaaatttcataaacaccatattgagcaaataaacccagacataaaatagcatacactgcattattccatttacataaagttcaaagccaggcaaagatagtctatagagttagaagtttaaatagtggttatctttgaggaggacgaggaggtaatctgtggaaggggacaagaaagtggcttccagagtactgtagtgttataattcttcaggcaggtatgagttagataaatgtattcacttgctgaaaattcattgagctgtgcacaaatgatttgtgtactttattgtttgaatgctagacatcaaaagagtttattagatttttaattcaaaaatacatgaaaaagatttaatgtacatgaaaacaacaccatttctgtgagggcaggttggtataaataaagttaaagcattccaacatctttgcgtttgtccagaaagaaggtaaaagtaccaattaaccaaatcagcaaacttctaataaataaatttcatttctaataaataaaattcacttgttagctggttgaattagatgttttaatataatgaacatctaacatatatttggcattaattcctttcctagagagtagttgcagaggttaggtatgtgtgcaaagacttgacctatgccaaggcagtagaataaatttgcatttcctccctttttcttcctataattccagaaattggtcacactggtaaagctggagccacactattgctattttgtaacattttgtctttataaaattagtatttatactgcataaaaaatctatttaaatagaaaacataggccaggcacggtggctcacgcctgtaattccagcactttgggaggcccaggtgggcggatcaagaggtcaggagatggagaccatcctggcgaacatggtgaaaccccatctctactaaaaatacaaaaaagttagccaagtgtggtggcgggcacctgtagtcccagctactcgggaggctgaggcaggagaatggcgtgaacccgggaggtagagcttgcagtgagcagagatagcgtcaccacactccagcctgggcaacagagcgagactctgtctcaaaaaaaaaaaaaaaaaaagaaagaaagaaaacgtaattcagggggaaagtcaaatatgtggaggcaaagaggtataatgcaattgaaaaataagttttagaaacaaatagacaagtaacattttctttctgagagtaagttttctcatatgtgatgatggggataataatgaaatacatatttcaaaattattgttacaattatatgagatacataactttaaattcaggctctacaacatgctagctatgtgaccttggagaaattttgaatacataatttatctgcactttggcttcctcatctctaaaatgacaatacagtaccatttactattcatctagtaaatttctttaaaacatttaagtataagaagtatgataggccaggtgcagtggctcacgcctgtaatcccagcactttgggaggccaaggcgggcagatcacttgaggtcaggagttcaagaccagcctggccaacgtggcaaaaccccatctctactaaaaacacaaaaattagcaggatgtggtggagggcacctgtaatctcagctactcaagagactaggggaggagaatcgcttgaacccgggaggcagaggttgcagtgagctgagattgcaccactgcattccaacctgggcaacagagcgagactccatctcaaaaaggaaaaaaagcaaaagtagtatgataaacacacatgtgaatgaatgtctgtgtgtatgttagttttcatacacatgcttaggatacttagtttacttttgaaattaaaactactaatctgtaattcataacatagatttttgttaatcagtatattaaaataatttttaattgggggaatacgttgtgtccatgatatggatttgactggaaattgtatgcatatcactcaccatttgaagccatgagatataagaatctggatatctaaaataaaacagtcttattttagaggatccgtactccaagtctagagctctgtgtggtcatgtgtcttcagggaaggaaaacatcctttcaggcagggagattccgattaggtcagcatccattcttagtggtaggtgcccatgccatagtggctgctgcataattttgaattttacaaaatctactcatgcccctcttggagcaaacatttatccagggtgttggtcaaagtgcctcatattagagagtggcaacttccctgagcttacaacgcattgcatggctgcttttctgccttcttgcaaatgaatgtttgtatatctgtcagatttggttctaacagtttgcattcattctaatgtacgacatagtgatgaggttctctaaatttcagaaatacttgcatatgcaaaatacagatataagtacaatgatgcaccagctttaaccacattcaaaactcaaggaacatagagtcttccagccaaatgagagtgatttctcctctctcctttgcccctaccaacccttttctgatctacaactacagctagcaagttgtagaggcttggagaagggaagggaataggaaactgaaggcaacaacacatcctttcctgaggttcagcagctgctagccatagctctttattcaggtaaagtaaagcaaaagtcttaatattagtcaagacaagcattgcgcaatatgttaagctggacacattgtaatcactgaatccagattggatttttgtgatgtaaagtagctatagtactttctattacctaagagcaaatgggaatagtcactggatctctccaactttccatccagaaccacagttagtttacccacgttaaattccttttaaagggatagtgggaaacaaaaataaagttttgttttaatcttatcataaatcattttttcatgaacttattacaaaaatatttcaatattacaaatatgaaatttataatagctaaaaatattgtacaaagaattatgtttcttcttaggataaccagtttgattgcagttactcaactctggtatatgtaatcacaaaatagttttatttttacattaacctctatcatctgtattctgttgaaacctcctgtatcccacccattatgtataaattacgtttaatgttgtctgtaagttcataacactttcagtcattttcagtaattaaaacagctttattgtattaaaatttaactatacaccctttaaatctacaatctcagttttccctctctcccccgttgttataacagtgagagttgaagagagttctctcacaacttttctccatctctcttcccaatagtttctccaaatagattactgcccactctctgttaaacaaccctgcaaatctatgtaaaaactcagcaaggtttagagccaactgatcccaactgaagggtttaatagcaagtagatactctaacagttggtggtccttttctgggggacccttttctattgttcccaattgcaggcatcacacagaatttctgaggcatgtacctctctactcttagtgtggtgatctctgacaagcctgcaacctccaatcttattaacactctgtagtcaaatatagaggtggcctggaggcctgggcctcaaggggtgagcccttatcccctccacatgtctatactgtcaccctcatctctccccaatgctctctcccagggtttgcaaacgtttactctaaaaagtcaggttgtagcatattctcactcataggtgggaattgaacaatgagaacacatggacacaggaaggggaacatcacactctggggactgttgtggggtgggggaaggggggaggggggagggatagcattgggagatatacctaatgctagatgacgagttagtgggtgcagcgcaccagcatggcacatgtatacatatgtaactaacctgcacattgtgcacatgtaccctaaaactcaaagtataataataataataataaaaagtcaggttgtaaatattttaggctatgcagactataaggtgactattattactactcaactctgccaatgtagctccaaagcagccacagatgatacccagttgaatgagcatgactatgttccaataaaactttattcaaggacactgaaatttgaatttcatatgtcatgaaatagtactcctcttctaattgtttcaaccatttaaaatgtaaaaaccattcttatcttacagttatataaaaacaggtggtggcagattttgcctactgtcagtgtttgccaacctgttctgctctaacccaggagttctatctatggtcaggaaaccaagccctgtctaaatcaacatccaaccttgcaatgaaatacctgtctccctttcttggtgttaactccaaaccttgtgagcaattctcttatagaaactctcccctaccaatgtcagtaaagggaattggttcagtgcctccttccctatcttataggaggatggagaagatagtttctctctaagaacagtacactcttccattctaccacaaaaatgtgccaggacctttcttccatatcatgatagtaagggtcaccaaaacagttcaatacttctcaacttcccaaaccaacccctctctgattggactctggagaatttagtgattcctgtaaagttcaggaaactgagataactaaaactcagtgagtagttcacattactcttacataattttaaaatcagaaatattgattcttactttttaaaaaattatatttttttcccaaatagggctctccattgaagttccatatagcttaagagccattgatatatttaaataaggtaacataaaatgaaagttcagtgtactgattccttcttttgctatctctgagggtcacagaaatcaggaaatgaccagggagccattcaccatgtaaatgaccagtgtcactctcagatgactgcagcctttagaactgcaaacataagcaaggcagctgctggtgtcaacagctgtccctggaatatcaccaggttattgataatctaatagaccttcacagcaaaaacaatgaatagaaggccagagttaaaccagtgatcatgttgttcatcaaaagtacatcttcataagctttagcagtcaagggttagcatatgtcaggttgattctctcctaagattcccatggacactttaaagatctcagcacagattcaaagctagagaacattcaatatagcaaaactggatatgattcgtacttgaagaattgtggacataagactcacctgctatttcttctctctggagctcatagcctctggttgataacttgtggaacagagtctttacaagagagattcctaagggcttcccctccagctacaaaaaatataatttctggtggtgtctgagattccattagacataaagaatctgatctactgtcattattaaaggtgtgcttatgcatgtttggttggaaacagaccattttacatgcccactttcacagcatgtacagaaaacatgctgtgaatacaattaaatgatttttgtgtgtgtgaaacggggggtaaacatattttacttatttgcattttctaaacttctgcaatgattttatgtcaactttttatttctacaaagtaatttttaaatcttatgaaaaaacagagcaattttcgtaatcattttacaaaagaggaaattagcttagagaaaacgggtagtagcagatgaggagagcctggtttctctaattcccaggttagtattaatattttttggctctattatacctcctaagacaatgattgctgagacaaattggttatgcctccaaagaacttaatgagggtaataaaagtaaggaaataattacctgacatagacacagagtaatttaatttagtttggaaccttgggtccatctatgatttgcctgactggtactttcttgtactccaagcatatatttacacactgacagccaaaagtcaggagtctgcttaagggatggctttttagtccatacaatcttctctagtaacttatctccagcttcaacctttttccaggtttgcttctgggggtcatgactctctctgtttcttatttagacacaagttctccttatttaggatttcatcaggaagaaatcaaatcccacatacacagcacagactgaagtatctgatttttaaatgctttattacattaactttagtatcattagcagatgaatataatcagattaacaaactggtttggccacaaggaaaagaaaaaacatttctgaagcttcacaaaactatgtgtgtagtgtgcaaactagaaccagttatactttcatcacttcacagaacacaagtagtgtggtgcatcaagagatgttccactgctgcaccatcacctccaaactgtagaggagagatgaaggcaaactttggaggaatttccaaggcaactgcagtcaaacattatctgtaaaactgcaggtataaatggcattatacaaaagctcaaacatccttcaaaacttggactattgaagtctacaattaaatttcaatttttttaacttacaaggaaatcatactcatttaagatacagttacctctactttaatccccagctcagtcagatatttgtagtcttatcagaaatatttgtattaggtagttgttttatttcctattctattgcttacaattttaaaatccacattaataactcagagtaacatttatacatagattaacagaaaggtaaactttaatttccaaattaggaatgaagaaagatgttaaatggctttgctttaaaagaaacagtacaactgtataggtataaataatggttttgtgacaataaacatgaatttaatacaaagataccagtgcttttgggccaaagccaatagacttgactttttagaaataagcctagtttacttcattaaagtaagtgttacggctgctataatgtgtctggtactgattccaaacatatccagcaattcactagttttcccacgttgaggcactcctgacactgccagttgatgaacaaggatatcaggctccctggagacagctgcacaaacagcttctccaatgccaccttccctgtagtgatcctccactgtgataactcggccgcctgtggcttttgcactggagatgatggtggcggcatccaggggtttaatggtaaatgggtcgatgacacggacagaaataccttgttgagaaagatggtcagcagcttctaaggcttcatggagagtaactccagctccaattactgtgactttatcattgacaccgtggcggaccaccttggcctggccaatctcaaaattttcttgtggggtataaataactgcagtttctggttggctggttcgaatgaagcacattcccttggtattggcggctagataaatagcatgctctgtcgagatggcatcacttggatagaaaacagtacaattgggaatgcttcggaacatggctagatcctccagggccatctgggagactccatcttctccagtggataccccacagtgggaaccaataaggttgatattggcttgagaaatggctcccattcggagctgatcgaatgctctagtaaaaaaggcagcaaaagcaccagcaaaagcaatggttcgaccacgtgtagcacagcctagtgccacacttaccatgttttgttcagcaataatacactctatgaaacgctcagggtgttctttcctgaatatctcagaaaaggtggagttcatcgtgtcaccactcagaacaataactctttcatttgcacggcccagtttagccagagccaaaccatatgttttctgagtagctatcttgtcaccaactttgtaagcaggtggggaggtcatttttatatctgtgatgcttatttgaggtgagtcttccacaggcgattttggtatgagattctcattggtctgtatctgactctcaattaatttgacaattgcatctgctctttcttttggcactggctttccatgccaattttctgcatcctcaatatttggaataccccgacctttgaaggtcttggcaactatagcagtaggcttgttcttcacttgacttgcttgccaaaatgcttggcacaaggcctccacatcatggccatccactaagtaagtattccatccaaaggcttcacagcaattctggtagatgtctgcgccatgctcaaggggtgcagggccactttgtcccaagcggttcacgtcgaagaccgccacgagattgtccaagttgtagtgggaggcaaaagcaaaagcctcccacacagagccttctgaggattcgccatctcccataaggcagaacacccggtagctggccttgtcaaggtacttgccagtataagccattccacatgcagtacctaatccctgacctagggaccctgttgccacgtcaacaaacggcaatcggggggtagggtgtctctccaagtcgctgtgaagtttcctcaggttcagcaagtcagattcactgatgtcacccacctccacccaagcagcatagaggataggagcagcatgtcccctggagaggatgaaccggtcgttgtccgggtgttctgggtctgtctgtttatacttcatcgtgtggaagaagaggacagacacgacctccgctgcactgcagcacgacgtgagctggccagaaccagaggcacacgtggccctgatggaatggatccgcaggcggttggctgtgtcccgcagcacctgcacggtcttcacgtcgggcttggcgtcgttggccatcatctctcttttgtcggtttggcaaagcaaacggcgccgcagcacccccacaacccaccgcggcagtgctctcacgtgaccgccccgccctcgcctcccctctgcctgaaggcctgagctcagccaccagccggggcgcccacaacggagcttcccgcgagactgaggaaacggaaacgttggagtagcctgcaccctctgatgtgcaccgttccctctccctgtccacgcccagctgaatggatttttagtatttactttgtcacgtgcatgttcaacattaggaagcataattaaattttttacctttccctgtgttataaattcaagactagacatttttctgtgtattataggaagcgatttgtcaggctgtgcttttttaatgcattaacactatatccgagtcatcactctttcatatcagaacattaatagaaaggatacaaagtcactttcaatctgaccagtatggcaatgctatctcaacagagactttctcagagcaaccaaatatctgaatctcagacttatagaaagaaatgcaatgactaatttgaccaaaatttataggaagaacaaatctgaaaccacccaattgcagaatagaattgcaactccagtgtgccgtaaagtactatttctgtgttgaaataattagaaggccagtaggctgaggtagcttcagctccatgagttcctacctaaggaaaggaaacccaaatcagtgtaaatgataaaaaggaaatttaagcttaatcaatcagaaactgccagctaacttctaactggggactttccactgggatgacccaaataagtctagtactccactttaaccaatcaaatatctttcctttgcttccaaattcaccctataaaagccttctccttggctcctttatcaggagctaccagattcatgaatcactgaatggtcaaataaatgctttaatattttaatgtgcctcagtttatcttttaatgactattactacaaatcatttttaagacaaagttacttactttaaaaaactaaatttgtgggccgggtgctgtggctcacacctgtaatcccagcactttgggaggccgaggcaggcggatcacaaggtcaggagttcgagaccatcctggctaacacggtgaaaccccgtgtctactaaaaatacaaaaaaattagctgggcgtggtgatgggcacctgtagtcccagctactcgggaggctgaggcaggagaatggcgtgaacctgggaggtggagcttgcagtgagcccagattgtgccactgcactccagcctgggagacagagcgagactccgtctaaaacaaaaaaaactaaatttgtgccattgaactcttctagcaggccaaggttatggtttgtcatcaataaaacaacaattaaaaaaaacacaatgataatatatcataccttcccatattgcgatgttaaacctcttggtttcttgagcaataattcttaccttaacttcacgttaaaattagggcacataagaaacacaatgcctggttccatcccagaaaaatagaatttgaatttctggacctggagtctgggaagctatgtttctaaaatacatccattgattataatgggtagtcaaggttaataacataatctggagatagtctgagaccagtggttctcaacattagttgtagtttagaattatctgggaagttttaaaaacatctcatgtccatgctgcactccagaccaattatatcagaatttctaggcaatagatctaggcgtcagtaattttaaaatcttccccaggcaatttcaatgttcagtcagggttgtaaacaactaactcagggggtgttgttactctttatacttattatctcttgcattatatctcagaaaaatatttcaaatgttatttgctatttcaactagttctatcattttaacttttaaggacacatattagaataaatagtaataatatgacactactgattttaagacttgttgcaggaatgttggcattggagaagttcttaagaggtcatcatgtatccataactctccatgtcctttgcaaattaaagcttgtttatctttttagacaaataaaggaggaggaaatacaagcagactaggctagaactggtagtacagaagatgggaattagagaaaaaataataatcacagtaaaataatagcaaactactacaggctgacaggaaagtagttaatataaacacaggtagctcaccattattttggccaaaaagaactctaataaatccacacaattagtaaacatgatagtacaaaaatgatttatgaggcaatgttcccatgaataaaaacatgggacttcttaacatttctttccaagttcccacattctttcactcatttaaaacattgcacagctatttcctaaagtattaaataaaaaaattttaacattagcaaaggtcaattttattaagagaagaatgtagtcttggagatttaataccctagatagtgagtgtgaatttccctctatcattctgtgagaccgtgtgaattttttatactatatagaaaataatattttataaattatgtgtaaaatacttataaaccattctgagattttgtaaaaggaactctggaaagatatatatatatatatatatataaatatataaaagtatatatatagtaaaatatctggaaagatatactatatataaaagtatatatattatatataaaaactcatatcaatatatgtaatatatattaagtttatataaaattaattttatattaatatgttatataaataacatatataagctgttaattattttctttaagcattttagtcttttaaatttgaaatatattttaaaatatacaattgaaaatatataaatacaggtagagcatcccaaatttgaaaatctgatgtttccaatgctccaaaatctgaaacattttgagcactgacatgttactcaggggaactgctcaaaggacattttggatttgggatttttctgatttggaatgttccgttgttaagtataatgcagatattccaaatttttttttaattgaaatccaaaacacttctggtctcaagcaaataatttcaactaaagaatactcaacttgtttaaagtatgcacaatttcataatgcaaaattacccaatatggctgggaacacaacttcgtcaaataaatcaaacaaagacgtgataccaccttctcccctatttagaagacaaaataggggagccaaaccctatttggctgacaaaatgtcagccaaaaacttttaaaccagcacgccaaaaatgtagttgtcttggagaaaagttcattattcattttagagatcattttggaagccagtcaaaaatgttctgcaaataggaaaacattattcatttattattaatcttggtttatccagacaaagcagagattggcaaattcaagtgcctactgggataaggagttaccacgagtgcttggatgtcagctataagagggttagaggggcctgtgttaaactggagaatacaagaccacttaaaggcattcaaaattgaaaaacttataaacattttgttggaaaaataaaatataccttcaggctgccacttttgaccccaatttaaagtctatttaaaagcagcaataatttttgttttaactttgcttaaatttttcacttaattttttctcatagtatctaaaagtattcattatagcgtgtacttcacatgaaaacaaaatctaacaggattaccaatacaagtagctatgagggaaaaacttaaatagtagcaattgataagtgtaatttctactgagctgcagcagagaaaacagaacacacaattaccgattactgagtaggtctacactgatttgtgaaaatagatattttgccatgtgagggtgagtgatatttaggagttgggaacgctgaaattttacttaaatcttatttaaactgttaagttttgttaaaatggaattatataaaatacataaatgctgaattcatcttttgcttccactgtttaaatttggttggctttggaagctaaagtatggagcaaatgagaataagattcttgtgtaaggcaataagtctcctggaaagaaaaatgtactttatcttcctggattattgctttgaaaattttaacagatgctattatgatgcatctgtaggatgctatcccactttttccacagttacaagtccttattttgcggtggagagagaaggggcagaagagagaggtggcaacaaatttaagaaacttggcccagctcctagtcccaggagaaaatcataattaatgtaggaccagcatcacaatgccattccctttggctagtaatggcagtcagcacttattgacccagttctggtcaataagatgtaagtaaaagtctgctttgggtgtaataattctcatcgtttctttcttttagagatggggtattgctatgtttctcaggctggttttgaactcctggcctcaagtgatcctcctgcctggtctcccagctggtaataatttctattaaagattttcttcctggtaaacaggagagagtacaagaagaactgtgatctcttcttttttttttttttttgggatggagttttgctcttgttgctctgtcatttagtagagacagtgtttcaccatgttgactaggctggtcttgaactcctgacctcaggtgatccgcccacctccgcctcccaaagcgctgggattacaggcatgagacaccacgcccagccattcttttcaacccctctaccaccaccaccagaggatgtgttggagctatagcagccaaaagcctaaggataaggccaggcgctgtagatcaattattagccacttttcctgtaaacctaaaagaaattaaaataaatagtgcaggccgggcacagtggctaacgcccagcgctttgggaggctgaggtgggcggattgcctgagggcaggaatttgagaccagcctggccaacatggtgaaagcctgtctctactaaaaatacaaaacttagctgggcaacgtgctgcacatcagtaatcccagccacttgggaggctgaggcaagagaattgcttaaacttgggaggtggaggttgcagagagctgaggtggcgccactgcactccagcctgggcgatggagtgagactccatgattaaaaaaaaaaaaaacctacagataaaagttaacgtgcttagtacggtagactggaaaaatagaaagtatgagttcttcataacttcgtgggtccacaagccttgagaccagcttcttctagactccttgttaagaaaaaaattaaatattcccactttatgaatgagtttctgttatcttcaactgaaaacatttctgggagatacaaaaatagatcccctaaacaagctcctgtaagtctagtaatcagggaaaaaaacaagaaaaacaatcaagacggctcacagtagaagagaaggggctctagaaaatgtagtttactcagtatttttattctcagtgcctggtcccacccacacacctacaactttggtcttttttgtataattactattgctatgttgctgttgttgttattacattgactatctcttcaaaaactaggatttttaaacttggtacatgggctttatgtatagaaaacactcagataccttatcatattcatttgctgtctggcctagatggttgggtatgatggaaatatgaaaatgatatagctggatttattctcatatagactagctacatttagtggagaaaatgcttttccttccatccagataataaccttgaagtagattacaacaaaatctcttacttttgaaaactaaaatataataacaaatgatagcaatagtaattttttaaaatccaaggtattagacttatattactgattgtaaatcagtatgatcagctttaaatatatgagaggaatttaattcattctataaaccatttttattagatactactattgtatgcattaaatagtggattagtacttgcgccatgtcccacctaactccttcccatcctcaggtcaaattcagccctttgttgagattttattttggctagaatattttagcaaatgtattgagttacaaacaacaaacaataacagtaataacattaatccatttaaccaacaaattaatgaattttggcaaatgtttatttctatttagctatcacaacaatcaaaatataacttcaatatttctatcgtcctcaaacattcctgtatgctttggcattcagttattcttcaccctaggctccactgatttgctttctgtctctgaggttctgttcctttttgttttttattctttccccttctgaacttcagtttggatagtttctattgcagtgtcttaaagttcactgaatttttcttctgcagtgtctaatctgctctgaatcccatcctttgaattttttatttcaaatattatactttttatcattagaagttccatttggttcttctttatatcttactgtcctcataatattaatctccttttaattcttctagaatatatatatataaatatatatatatatatatatatataaaatttctttttttgagacagagtttcactcttatcacccaggctggagtgcaatggagcaatctttgctcactgcaacctttgcctcccaggttcaagcgattctcctgcctcagcctgcccagttactgggactacaggtgtgtgtcactacacctgactaattttttgtatttttagtagagacggggttttgccatgttggccagactggtcttgaactcctgatctcaggtgatctgcctgcctcagcctcccaaagttgttggtattacaggcgtgagccactatgcctggcccttctagcatattttaagaagatttttttaaaagtccttgtctactaagcctattattcggtctctctgtttccattaactaatttttcttctgataatgtgttacactgtccagttttatggaatatctagtttttaaattaaatgcttgacattattttgggaggttggattttattttattgtatatttttaaagagtgttggactttgttctgagaagccactcattcctttcgagtattttaagtctgttaaggcaaatgtagggtatgctttactctagtgttagtttagctcccctacaaaagcataatctctccagggtttccaccgaatgcgccggtgtgttcaatcaggcccctcaactctggctggctaggactcaagtgtggcttagcttctgtgagttctgggaactgtttggttatcacctttcccaagttgtcattttcctggccatgtaagatgtatgctttatgcaaaggtactctaaagatttctggagctctttgggcagtttctccttataatcattctgccttcaaaatgctagccaacataggattcctgagctccaatctctgttgccttatttgccatgctgtgtgtcagatgcccttccctgtagcactgtctggaaagggcctctaggaagaaagccagaaagataatgttttctctctttcatagaccacgatcctgtgctgcctgttttccaatatatgaaaactattaccttataaactttgtctagctttctagttgtttatggctggagggtaaatctcattccagttacttcctcatagcctcagaacagcatttaaaatgttttgaatgttaatactttatactgggcatatattctccagaaaacggtatcccaactcacactactccttatgtctagcacccctctgattcccacatttatattacttcttgaacccagaagactttggaatttccaattacaccaattgttactaacccttatggtgtcattttaaaaagatgtccctcaaagcatggtctaatgaaattttaatttttaagaactatcaaaaaaatttcattgttatggttaaattttccagagagatttagtactgctctgataaacccaaaaacccttggcatttgtatgattttaaattaaattctctaaaacatatcaaataactgcctttcttcttataaaggggatgtggagcattaaccttttctttgatgactaatggtcatcattatgaccactggctattaagctttattgaaattcaatcaaataaatcaaaattactattgagaatggtgcttaaggaaggttattccagcatctttgttcagaataaatgttcaatttttattactctactgtagtatatttttcagggtatgtagctgtagtaacaaaataaccaaaaaaaaaaaaaaaaaaaaaaaaaaaggaagtggctcaagcaagatttaagtttatttttccttcacataaatgctcagagtatgcttggaagtcaggcagctctgctcaagtgggttttacagggtcccagattcttttcatggctgcctagtcattgactcaggtgttggcctcatctgcaaaattgaagccagaaaccacttgggccaccaaagaatagaacaaaacgagaatacagggggacaatctatttctttttcaggaagcaacccagaaattgtaaatttcacttctcattctctgttggtgagaacttacttgcctagccacagccaacattaagggagtttgtgaaatgaagcaatttgcccactgatctgctgaaacttaggagattataatacaaagacaaaaggaagaaccaatactggtggacaagttataatctccaccacttattattttaacatttaacttttggttgtgctttgtagacaaacaaccttgtaacattgtttatagcatttacaagttaaaacagtttatcttcaaagcaatgcttttacatgctttagaaccaaagcagatttttttgactgaatagtgaaaatttattcatttctttattgcatacttgatacataataaccttatgtaatgctctatggaggagttgaagatggttcttgctctccagatactggactttaatagggaagacaaagtaggcacaacacatgattacagtagtgtgccaataggtgccaaatgttataccagggcatagaaacaagtgcttactcttagatagtgaccaggaagatgtcattgaaaaggtaatacttccactgaagatgagtacagttgtagaatgagtacaatttttgttagagtaaatatgagaggaagtcaatgcaaagttatgagaataaaaagagagaatttctaatctgaaaggaaggaaagattcatcctgagaacagtagagaaagcaggaagatcaattttgaaaaggcctcgaaacacagacaagtaagaggttttgctatgttctcttgctttggggctgagggtgaagtacaatggaaattttttcatcatttgagtgtcttgatcagagtagtgttttttaaaattgttttggtagtgttaggaaagataggtcaagttgagaaagaaacaggaaggaagataattttattgcagaaacacagaagtcagataataaaggactaaagtagggagttctttgtcttgtaagttccataacattttttaaatgatagtactgatcatcagatttaatgcaagcaagtggaattacttgacaagattgagaagaaggagtgaggaaggcagtggatgtgctctgatgaatgtattggtttgctaggtctgctacaacaaagtgtcacaagctggatgacttaaacaacagaaacttactgtctctcagatctggaggctagaagtcaaaatttagtgtatcaatagggttggttctttctgatggctgagagatggatctgttcctgatctctctccctgactttggatggctgccttctccctatgtcttcacgtcatcttccctctatgtatatctctgtgtctaaatttccccttttcataagaacatctgccatattggattagggtacaccctaataccctcatttttacctttctgtaaagaccctaaaactacctctgtaaagatc

SEQ ID NO: 1193 - DNA, 32510 bp, Homo sapiens
cttggtataagtcacaatccaggcggcttcctttggtctgcccacatgcaaatgtctgaaaaatatctgaaaaagaccaatcttaggttttgaaaatagtgatgttgtctacagaagcaactggggaagttacagatcttgtgaactctggctacatgactcctgagcatcagggaattacagaagaacggctggttatcatttaactatgcctgcattttagtggaattcatgcccctcccataatcctatcattgtggccttttattagtcttacaaaggtggttttagtccccagaggggtcacttctgagaagggactgctgtcatcctttttcaacgttaaactataaactaaattcctcccatagttagcttggcctaggcccagccagatttctttttttttttttttttgagacagtcttgctctgttgtccaggttgaagtgctgtggcgtgatctcggctcattgcaacctctgcctcccaggttccaaaaatgatttttgtggagaatgaggtctcgctgtgttgtgcaggctggttttgaactcctgggctcaagtgatcctcccacctctgcctcctaaagtgctgggactataggcgttagccaccatgcccagcctaggtttcaattagatttagattgaagttagttttgaaaacacacattttgaaaattgttgataattcccttcttctttgcaaaacatttaattatttgtttatttacaatagatgagacatacatatgggaatgagtgtatggtgaaaattctctcaccagaccccacatacccaatttcccttccacagaggaagccactggtaccagtttctgtgtcttcttccagaaacataggccgtgcaaatacaagctctatgagtgtgtgtttacatgtatctttgtatttttgctttattcgcttaacaatatatctcagagcttatttctttcatagctgcacgtatgcatttggttttgtcatataaataaatatatatatatatatatatatatatatatttttttttttttttttttttttttaagagtctcactctgttgcctaggctggagtgcagtggctcgatctcagctcactgcaacctctgcctcccaggttccagcgatgctcctacctcagccgcccgaatagctgggattacaggcatgcgcaaccatgcccggctaatttttgtatatttagtagaggcgggttttctccatgttggtcaggttggtctcgaactcccaacctcaggtgatccacccaccttggcctcccaaagtgctgggattacaggtgtgagccaccgcgcctagcctctccctttcttccttccttcctttctctctctctttctttccttccttccttcctttttttctttctttcttttttttttttttttgacaaagtcttgctctgttgcccagactaaagtgcagtcatgagatcacaggatcttcccacctcagcttgctaagtagctgggactacagggacaggccactgcatctggctaatttttaaattgtttgtagagacacgatctggttatgttgcctggatagctggtctcgaactcctgggctttaagcaatcttcctgcctcggtctcccaaagtgtttttgtttgtttgtttgtttgtttgggtttttttttttgagacggagcctcactctgtcgcccagactggagtgcagtggcgcaatctcggctcactgcaagctccacctcccgggttcacgccattctcctgcctcagcctcccgagtagctggaactacaggcgcccgccaccacgcccggctaatttttgtatttttagtagagacggggtttcactgtgttagccaggatggtcttggtctcctgaccttgtgatccacccgcctcggcctcccaaggtgctgggattacaggagtgagccgccacacccacccccaacatgttgtgattataggcctgagttaccgtgctcggccttggatttctttttagcccatttttccatgtgagacccagagagctggggggcccactcaaggccttgccaaaagccagaagccagtgcagaccagaacccagataccccatttcccacccatcactggccaaagggttaatggctgttggcagacacaatgtttttgttttttattgatttgtgtgtttacatttgacttcccaaaagtgtctgaggcaactgccactgaggtatcaggacttgtgtttgcttttaccgcactccctcctgctggtagggaacccagacagtccgagccatcacagccaaactagaacggagtcaagctgcagcccagggccaaggccgagggaggcaccaagagccaggggccaaaccagatcgatcacatttgccatcaggccaagcaccatgtcaccaccacagccaggtgtgagctacaggcccaagagccaggccaagcagagagtgtccagggcacacgccccaccaatccccagaatacagcgccttctgatactcagccccagctctgggctgaatcttacctggaggcagatatctaatggatggagaggcagggcgcggtggctcatgcctgtaatcccagcactttgggaggctgaggcaggtggatcatctgaagtcaggagtttgagaccaacctggccaacatggcgaaaccccgtctctactaaaaatagaaaaattagctgggcgtagtggcacatgcctgtaatcccagccacttgggaggctgaggcacgagaatcgcttaaatgtgggaggtggaagttgcagtgagccgagatcgctctgtcatccagcctgggtgacagagcaagactccatctccaaaaaacaaacaaacaaacaaaaagaaatggagagctgaggataaaggtaggaaacttgtgacccaggaaactggaatagccagagaaggtacaaaggcggaggagctgatgaaagtcaggctcaggccgcttgcggtggctcatgcttataatcccagcactttgggaggccgaggcggggggatcacttgagatcaggagttcgagaccagcctgaccaacatggtgaaaccccgtctctattaaaaatacaaaatacaaaattagccaggcatggtggtgcatgcctgtaatcccagctacatgggaggctgaggcaggagaatcacttgaacccgggaggtggagtttgcagtgaatggcgatcacaacactgcactccagcctgagcaacaagagtgaaactctgtctcaaaaaaaaaaaaaaaaaaaaaaccaaaaccaagagcaaaacttcgtctcaaaaaaaaaaaaaaaaaaaaacaggtcaggctcaggattgcccacccagccttgcaaccccaccaagccctgcactgttatcaggctgggtcctctcttccttcgtccagaggggaatggaacaggtatggagacaggatgtcattttggagacccaggtttgaattctggtgcttccatatcttggctttggcatttgagcaaaatcattcactcttctatgcaacaaatatttattgagcaactactatggtaaggcattagccaggttctagggaacaaagatgagtaaaccacggtccccccctcatgacatgagagtaggagagtcagatgagcccagatggtaacatgatgagatagtggtgtggctggggcaaaaacaggcatctgtggagctcagagggagcccctatccagggagagaaggcccaggtagagtctcctggggaattcccttggaccacccattcattcaacaaatacataaagtgcctactgtgtgtcaggcactaagcaagacaccagagaaacaatggtctacaagacagacttggcccctgaaccagtagaacttcacggttgagtgagggaggaagaccagaagtgcgagttgtgagaaatgcaatgatggaaacacagcattgtcatcgagactaacacaggggatacatatatgggacaggggacgtgaggcagaatgttgtgatgttggaccaaaattagagtgtccttgtgaacttatgcaatatgtatctatcctatctttgtctgctaaaagtcctcacttccaggaatgctgagtttacccggtgcccagatcttagttgctaaatatccttctccgtgaaagggcaccgttccctgaagaaatggcttctgatctcagggctggtgctgaggaagtacaaggtgcagctggaacatcttattatgaaagaaaggaatggaaggatggaaggaacagagggaggcagggaaggaggggaaggaaggattatagcatttctatatgaagtctatttgtgataccaagcttggtaatataatgaatgaaccagcttaaatatagcacatttatgttcttaaaataaccagtgaaggaaactagaaggcagaatggtaagaggccaaggaaggaggacttcagaatgagagtgggaaacaatcgtagaggctgcaaataagtaagatgagggccaaggtgtatctgctggatttagtacgagagagacctgtggtgatgaccaaccacgtggagcccatgttcactggggaagtggggagaagaggacaggagggtcatcagtgaagagaaggtaggtaaagtctggggaagagcccaggatgatggcacacgcctgtaaacccagctacttgggaggctgagacaggaggatcccttgatcccaggaatttgagaccagcctaggcaacataacaggaccctgtctcacataaataaataactaaacaaacaaacaaacagataaatacagacagacatacatctagggaagacggaggtggcaggtagaagtggaaagagaaagaagcccaggacagggatttgagttgtttgattgactgattaaagcttaaataaagcttaagaattttgaccaaaagtgagtgtggtggtggcttgggggtggcatttagtcctctcttgggtctgttagcaactcatcctggtttttccagaactgtcctggttttagcattgaaagtacctcatcctgggaacctccttagtcccggcaaactgggatggtcactgtccactctcaggctgctactatcaccatattcagtagtcactgccagactgggaaggctaggccatatttattcattcaacaaacttttgctgaccctggaaatacaatgcctgcaaagcatacacagtccctacccttacagactacgtgaaattctttatttgcatttaagtgatttttttttgagacggagtttcactcttgtcacccaggctaaagtgcaattgcacgatctcagatcactgcgacctctgcctcctgggatcaggcgattctcctgcctcagcctcccaagtagctgggatctcggctcactgcaacctccgcctcttgggttcaagctattctcctgcctcagtctcctgagtaagggggattacagacatgcgtcaccacacccggataatttttgtatttttagtagagacggggtttcaccatgttggccaggctggtctcaaactcctgacctcaagtgatctgcacgcttcagcctcccaaaatgctgggattacaggcgtgaccaccaggcatggccttgcatttaagtgatactaatcaagctggatatccaaaaagaaaaacaaaaaagaaaatgacaaagcctttttttcctttagtatcttggttgaaaatgtgaaaagtaagaaaagtgtaaaaaggcaggaataaaaaatattagcagatttcctttcagtatttttcctgcatgtttcccaagttacttcctatcagtgtcctaaaaaatgcaagttaattttaactttggccgcaaaccaagaacaaaaaggttaagtgtattgaattaatttttcaagccaaagttaaaggatctgaggatgatctgctgtctccaaggctccagtccctgtttttttcctttagcaggtgtgatcacacgctggctgagatgagtaatgactttccctctcctcagcacgcttgctgctgtacaatttttttctttttacaaattaaaatgctgcattcacctgataataaaaatcaagtagaggctgggtgcagtggctcacgcctgtaatcccagcactttgggaagctgaggcgggtgaatcacctgaggttgggagttcgacaccagcctgaccaacatggtgaaaccccgtctcttccaaaaatacaaaaattagcctggcatggtggtgggtgcctgtaatcccagctactcaggaggctgagacaggagaatcgcttgaacccgggaggcagaggttgcagtgggctgagatcacaccattgcgctccagcctgagtgatgagagtgaaactccatcttaaaaaaaaataggccgggcgcggtggcttatgcctgtaatcccagcactttgggaggccagggcgggtggatcacgagatcaagagtttgagaccagcctggccaacatggtgaaaccctgtctctactaaaaatgcaaaaattagccaggcatggtggtgcacgcctgtaatcccagctacttaggaggctgaggcaggagaatcacttgaacctgggagggagaggttgcagtgagccaagattgtgccactgtactccagcctgggtgacagagcgagactccgtctcaaaaaaaaaaaaaaaaaaaaaaaaaaaagtgaaaattgtgggcatttgcagtctttgctgccattaagtcttctggatttttctacaggttgactctaaaagttgaaatccagtcaaagatatttacattattatggccacatgaacgttgtttaccctcaggccaaacaatgggctggaattacacttgcttctccacacactccatcccataatccatgtgtcactcaaaggacaatgtggcaagcaagcactaaggccctaaattgatactgtatcaattaaatacaattatgttgtgttatagcttgtgtttcatttattttattttattttttatttttatttttctgagagatgaactctcactctgtcgcccaggctggagtgcagtggcacaatctcgcctcactgcgacctctgcctcccaggttcaagtgattctcctgcctcagcctctcgagtagctgggattacaggcgtgcgccaccatgcccggctaatttttgtatttttagtagagacagggtttcaccatgttggccaggctggtctcaaactcttgatctcgtgatccacctgccttggcctcccaaagtgctgggattacaggcatgagccactgcgcccggcctatttattttatttcaagcagttctcctgcctcagcttcccaagtagctggaacttcaggcgtgcaccaccatgcccagctaatttttgtattttttagtagagatggtgtttcactacatgttggccaggctggtctcgaactcctgacctcaggtgatccacccaccttggcctcccaaagtgctgggattacaggcatgagccactgtgcccggcctatttattttattttttatagagacagggtctcactctgctgccgaggcttcggttcaatggggtgatcatagctcactgcaacctcaaactcctgggatcaagtgatcctcctgacttagcctccacagtagctgggactacaggagcatgccatcgcacctggataatttttcttgtattttttgtagagatggaaaggggttctcactattttgcccaggctggtcttgaactcctggcctcaagagatcctctcgtctcaacctctcaaagctctagggttacaggcgtgagccatgatgccctgcccgtatttatttatttttattttattatttatttattatctttttttttttttgagacagggtcttcctctgcagcccaagctggagttcagtgcccagatcatagctcatggcaacctggaattcctgggctcaagcgatcctcctgcctcagtttccccagtagctgggactacaggtgcacaccatgatgcccagcctgttttgttgcttttttttttttttttttttttttttttgagatggagtcttgctctgtcgcccaggctggagtgcagtcatgcgatctcggctcattgcaacctccacctcccgggttcaagcaattctctgcctcagcctcccgagtagctgagattacaggtgcccgccaccgtgcccagctaatttttgtttttttagtagagacagggtttcaccatcttggccaggctagtcttgaactcctgaccttgtgatccaccgaccttggcctcccaaagtgctgggattacaggcgtgagccaccacaactggccccagctgtttcttatttacattgtgatttcagttttgaaaattttctggagattctaactgcttttctttctttgcatactcttttttttttttttttttttgacagggtcttactctgttgctcgtgttggaatgcagtggtgtgatcacagctcactgcagcctcaacctcccaggctcaggtgatcctcccatctcaacctcctgagtagctgggactacaggcatgcaccaccatgcccagctctatggatgctttttcttgactctctttaagtatattaggtagtactctttgtatcctgaattatctctgtttcctccaatgtcaaattttgtttgttaattttggtctttctttctttttttttttttttgagatagggtcttgctgtgttgcccaggctggagtgtggtggcgtgatctcagctctctgcaacctctgtctcctgggttcaagcaattctctgcctcagcttcccgagtagctgggaactacaggcgcctgccaccacgtccggctaatttttttgtatttttattagagacagggtttcaccatcttggccaggcaggtctcgatctcctgacctcgtgatccacccgcctcagcctcccaaagtgctgcgattacaggcgtgaaccatcgcgcccagccaattttggtccttccttccttccttccttccttccttccttccttccttccttccctccttccctccctccctccctccctcctttctttctttcttcctttctttctttctttttgagacaaggtctgttgcccaggctggagtgtagtggtgcaatcacagctcactgcagcctcaaactcctgggctcaaacaatcctcctacctcggcctcctgagtagctgggactacaggcgtgggctaattttttaaaacttttctgtagagatggggtcttgctcttgcccaggctgatcttgaactcctggcccccagccttggccttctgggattacaggcgtaagccacctgccggaccaattttggtgtttcttttgcatgctgctggtcctcctcagatgcttggcaatcattggtaatgatgggcttcagaacgtgctaccggcacagtgagtgttttaagctgaaggaatttgagaaaaccgcagaagccgaaggatctttcttaccttctcctgcccttcttccctgaaccaggtcatacaacctggaactccctgcccttttcctgaagaagcaaataacagcctcctgcgagaggcgccctccctgcacctgggggaaaggagggtccttatctctgaagacacagggacacagaagaatctgaaccaacaggccttcctgagttccccacctccccgcaggaggtgcccgcacacgcatagccccgtcgctcccgcggccgcacgcaacggacctcgccctggtggtgcacgcccgggctgggcgctcagaggtcgggtgggcgcccactccgttcgctgcgcgcacagcgcccggcgagaggctcggagtttgatcacacacagcgtccggcttcctgtccccagcgccccctcccgccccgtttcccttgcccctccctctccccggcccgatccgcccgccggctccccctcccccgatccctcgggtcccgggatgggggggcggtgaggcaggcacagccccccgcccccatggccgcccgtcggagccagaggcggagggggcgccggggggagccgggcaccgccctgctggtcccgctcgcgctgggcctgggcctggcgctggcctgcctcggcctcctgctggccgtggtcagtttggggagccgggcatcgctgtccgcccaggtgaggccccgctgcgcaccccttcttgggcacatcaggagctgagactgcagaggggccgctgggggccgcgtgggctgaaggcaaggggaagggaggatgggtggagggtgagatgtcaggtggagcggcacagggtgacgctccctccttcccagcaggagcctgcccaggaggagctggtggcagaggaggaccaggacccgtcggtgagtgggcgtgggcgcggtctgcaggctgctggggcatgggaagtgtgcacagccgaggctgcaggtgtgtgcagctgtgccagccgtactcgaggtgtgtgcagggtgtgtgtgaacacagtgcgtgcatgggtgcgtgtctgcaggggtgtgtgtgcgtggtgacaactctgtgtgaggggtttgtgctggggttgtgccacctgagtctgaggtgtttattggctgggggtgacgtggttgtataagatatgtgagtctgcgtggaagaggggtgcggttgtgtacagggtgtgtatcctctgtgcgtggtgactgggtgcgggcatgtgtgcaatgtgccaattgaatgcagggtctgcgttggttgtgtgtgtgggtgggaaagtgtagctggtctagaggaaagggtgaggactggggcctgactcccagcttcacctttgcccggggccccagctgtagttggctgaggggcttaatctgtccctgacttctgtgtctattgctggctggtggctctcctgacaggccccgtatgtctcactttatatctctgggagtctgtggttgaaccctgccctaattcccctaggaactgaatccccagacagaagaaagccaggatcctgcgcctttcctgaaccgactagttcggcctcgcagaagtggtgagcatccctctatcccaacctcaggaagcgggcagagcaaaaaccattatccacagggagaaactgaggcacggagggtgaaaggagttcagagtcatgcagctaaccagccaagactcaaacctagggattctcgccctcctctgaagctccttctgtcatatggatgtgctccttcagaccctaccccaaacaggaaggcagggtggccatgagttagaagaactactgggatcctgatggagactaggcctggcagtcagaggcctgggccccggtaggcaaagagacttaggaatgggatgatggggtggccggatgaccacgtgtccaagtcggcatgcagttgtcctggcccccacctgttatctcggtgtgattaatagcagcttcccgttttgctctcagcagtatcccagtgtggatgacaaattatagtcactctacttactgaggaagatgaggcctgagattctaaggccaggagtctggacaagaataaggatgccagggttcctgagaggggaatggggctgggagagttgctctgggacccccactagggcccgctttgctcatctgtctttccttgatcctcagcacctaaaggccggaaaacacgggctcgaagagcgatcgcagcccattatgaaggtgggtgatgggtgagccatacccaggaggagaggggcaggtggcagagggtcagggcaggtctcaccagccttttcctgtactttacagttcatccacgacctggacaggacggagcgcaggcaggtgagaccccatcccccgacacagcactggcctcctgggaaaagggcccttgaaaacctttgacctcccactcccttcccggccatcagtctcagaaccacagaagccagttcatgaaggtcttggttctctctgtgacccaggcgtgggaccccatgaaagacccctactcttccccagaactctgcccagttcccccagcaaatcactgtcccagctctctccttcagccctcattcttctccaagaagcacttttcattcttttttcttctgtctcctccatattccacgttctgatgatctttttctctaaatgctgctagtgtctgctcatcttttccatttctaccccaccctctacctcagcaccgtgacctcagaacctcaaatccagcctcttgctgcttccccactccacaccctccctacccctccactccatctgacctgtgctgccatgctgagcccctaaacttcacttttcttgtggtattggctctctacatggcttccagtctcttcgtggtctggtctcaacctaatttccctgcactcttatgctgtcttcatgtttgctgcgctgacacccctgctcccggtgtgcctcttctggactttgcacataccatccccctcaccagaatgtctttccactgtgagaggcagggaggcatgaggagtgctcagccgaggggttcacagcagagatggtgagaagtggatgggttcagcctgtgtcctgaagatattactgacttatgggttggaggtgaagaataaaagaaagggaggaatcacagatgacttctagattttttattttttttaagacagtctcgctctgtcacccaggctggagtgcagtggtgcaatctcggcttactgcaacctctgcctcccaggttcaagagattcccgtctcagccttccaagtagctgggattacaggcgtgtgccaccacgcctggctaatttttgtatttttagtagagatggggttttgccatgttttccaggctggtctcaaactcttgacctccagtgatctgcccgcctcggcctaccaaagtgctgggattacaggcatgagccactgcacccagccagcttctagatttttaacttgggtatctctgggaagaatgatgccatttcctaagaagggattgaccaaggaataaataggttgggaagtatgtaagataattattaacgttgagaagtctaaaataaacaagcggataaatgacaataaagtaaattccagaaatggatggctggacattgtcgactagcttaggctaggtcaggacggataaagccaggagtcatggccatatggatggcttttttttttttttttttgagacagagtctcgctctgtcacccaggctggagtgcagtggttcgatcttggctcactgcaacatctgcctcctgggtccaagcgattctcctgtctcagcctcccaagtagctgagattataggcgggtgccaccacacccagctcatttttgtattttttagtagagacagggtttcaccgtgttggccaggctggtcttgaactcctgatctcaggtgatccgccagcctcagcctcccaaagtgctgggattacaggtgtgagcccttgtgcccggcctatcgatggcatttaaagccacaggattgggtgagacgccaggagaaagaagggccccacgaatgaagccctgagactcttgggcatcttgaagtggagctgaggggaaaaccagcagagactgaaaagaagctggagagagaggaagaaacccagggagggtggcatcctggattcggagaaaccactgtttcaaggaggatgtggctgtctgtgttgaatgcagctgagagatcacatgaaatgagaacagagaaatgatggctgggtttggtaacgtgaaagtcctgctgaccttaaagagggtggtttcagtggcatagttagaacaggaaggcagtgtgcattgggttgagaagaaaatgagaaataaggaactggaggcagggacaacctttttttttttttttttttttttttttttttttttttttgtgacagagtttcactcttgtcacccaggctggatccagtgcaatggcacgatctcggctgaccgtaacctccacctcccgggttcaagcaattctcctgcctcagcctccccagtagctgagattacaggcatgcgccaccacgcctggctaattttgtatttttagtagagacagggtttctccatgttggtcaggctggtctcaaactcccgacctcaggtgttccacccgcttcggcctcccaaagtgctgggattacaagcatgagccactgcacccggcctaggacaaccctttttagaagtttctctgtaacaaggagcagagaaataggccagtaggtggaggggtgtgtggaccaaggaaaagtttagttctgtgaacaatactattttcatctgatctaacatgtactgagggctttcttgagataggcactgtgtctggcacttgtgtttggtcttatctaatcctcacaacagccctaaaaggaagatactctaattacctccattttacagatggaggttacacaacttgtctgaggccatgagatactaagtggtggagccaagatttgaacccagctagaatgtgcctgtgtactggacatggtctgcatgaaaggcgaggtggctggtgcaggggtgaggggtccatgcaggggccacatccaaaaaggggagagggaagtttccagaaagaagagaggacacatctcccaccattaccagagggtcaaaggagaacaagagaccaggtgggtttgtagatttgctggggggagatgagggaacctttgctcgatgacttctaggtcctctggacaactagggagatggagacaggagatttgaggagaaatggtacaaaatctcaacttgctgattatgaaagcaagcttcgtgggggaatgtaagattgccaggcaggacggaatgtccaggtgaggtttgtggctggagacaagtgatataccaggcaagccctccgtgctcctgggcacaccatgcccttaggctacaagcagcctttgcttaggctggcttcgtagctaggaatgccctctcttctctgccctccctactcttcatgcccagatcagccttcctcccctctgtatagaccacttattttggcaattatccagacattcattcattcattgactcaacaggcattgaagacctactgtttgctaggggccaggctaggtgcccacagcaactaatatccagactcttttttttttttttttttttttttgagatggagtctcactctgtcgcccaggctggagtgtagtggcgcgatctcggcttactgcaagctccgcctcctgggttcatgccattctcctgcctcagcctcccaagtagctgggactacaggcgcccgccaccacgcctggctaatttttttttattttttagtagagacggggtttcaccgtgttagccaggatggtctcgatctcctgacctcgtgatccacccaactcggcctcccaaagtgctgggattacaggcgtgagccaccgcgcccagccggtcagacccatttttttttttgagatggagttttgctcttgttgccccagctggagtgcagtggcgccatctcggctcactgcagccttctcgggttcaagtgattctcctgcctcagtctcccgagtagctgggactacaggcgcctgccaccacgcctggctaattttttttttatgttttagtagagacggggtttcaccgtgttagccaggagcgtctcgatctcctgacctcgtgatccacccaccttggcctcccaaggtgctgggattacaggcgtgagccactgtgcccagcctcagaccaactcttaaggagtcactgtctaggagaggaaacaagcatataaatttgtaattacaggaacatacaaaaaaaattagccaggtttggtggcacatgcctgtaatcccagctactcaggaggctgaagcatgagaatcacttgaacccgggaggcggaggctgcagtgagccgagattgtgccactgcactccagcctgggtgacaagagtgagactccatctcaaaaaaaaatttgtaattacagtggaatatgacaagaacaataataaaagtggccaagatacctggcaacacaggggaagacagacatggctgtggagtcagggattctctccctgcatcgcaaggtgccgctgggccttgaagcaggagcgtaagacaagacaggcaaggggtcaagaatggtgggtgcaagcagaagcagcccctggggcaaaagccccgggtttgcccagagcatgatgaggctgggggactctaagttcagcgtggcagaagcagaaagtgctagaggagcgagatggggatgaggctggagacagaagccaggccacacggtggcatgtgggaactattctgaggtgagccatcggaaggaggaaggcgaggcgaggcgggcttacgtctgcatcttagagactcattctgtggctttgtgtagggaataaactggaggaagccagaatggaaacagggaatgctgtgaaaaccagacagaggcaccagatgggggagagaggggagagagctatttaggaggcaggatagataggaactggtgatcgattaatgatgtaggtaaaggagagggaggcttgaatatccccctggtggcaaaaccagaagccaaatgtggaaaacagacagtaaagcaagagtgggatgaggggggtcagctcagtgttggttgagatgagtttgaggggctattgctgttcagatggtgcagttggcagggtaaggaagggaaggaaacttcagggctggagactctgcagagcacaggttgtgggaacccattggtggaaataaaaatgcccagtgagcgttttttttgtttttttttttttttggagacagagtctagctctgttgcccaggctggagtgcagtggcatgatcttggttcactgcaacctccccatcccaggttcaagtaattctcctgcctcagcctcccatgtagctaggattacaggtgcctgccaccatgccctgctagtttttgtatttttagtagagacggggtttcaccttgttggccaggctggtctcgaactcccgacctcaggtgatccgcccaccttggcctctcaaaatgccgggatgacaggcgtgagccactgcacctggctgagcatgatgttttcaaggcacatctgtgccatagtgtgtatcagtacttcactctttttatggccaaataatattccattatatggatagacattttgttgatggacaattgggtttcattttattatttttagttgtactaattcagataatgtatgtttacatcctccatataaaagaagcaaataatatagatatccatgaagtaaaacattaaatcccctcacgcttctccttcagttctactcttctccccagaagtgactgcaggtgacaatctgccctgaatgtctctggccatatacattagattttttcacataacttcctagtcaactatgggcatcataggggatgggtcctcccttgcccggggtgatctatgtgtcttctgggtaaagtgggcgccgaatgttcatatgctcaatggatccctggggagtgtgggggagtcctgtagagagacgtttccttatctctgagcatccgtgttcaggtgtggacgggacagtgagtggctgggaggaagccagaatcaacagctccagccctctgcgctacaaccgccagatcggggagtttatagtcacccgggctgggctctactacctgtactgtcaggtaagccccatctggctgcatgggtaacgcagtaagagagtggcgaagggtttgccaggagagtgggggacaagctacagggctgggagggtgagttggggtttgggtgggatgggatgcctgcgtcgctgaggaaattggaaattgaggcgagggcaggcagaggcctggactcggcctgttgtccccaccccaggtgcactttgatgaggggaaggctgtctacctgaagctggacttgctggtggatggtgtgctggccctgcgctgcctggaggaattctcagccactgcggcgagttccctcgggccccagctccgcctctgccaggtgtctggtctgttggccctgcggccagggtcctccctgcggatccgcaccctcccctgggcccatctcaaggctgcccccttcctcacctacttcggactcttccaggttcactgaggggccctggtctccccgcagtcgtcccaggctgccggctcccctcgacagctctctgggcacccggtcccctctgccccaccctcagccgctctttgctccagacctgcccctccctctagaggctgcctgggcctgttcacgtgttttccatcccacataaatacagtattcccactcttatcttacaactcccccaccgcccactctccacctcactagctccccaatccctgaccctttgaggcccccagtgatctcgactcccccctggccacagacccccagggcattgtgttcactgtactctgtgggcaaggatgggtccagaagaccccacttcaggcactaagaggggctggacctggcggcaggaagccaaagagactgggcctaggccaggagttcccaaatgtgaggggcgagaaacaagacaagctcctcccttgagaattccctgtggatttttaaaacagatattatttttattattattgtgacaaaatgttgataaatggatattaaatagaataagtcatagtctctctctttattggggctcaggggacactctcagggtagctgggggccacgtgaaggggggcgttgcggagcggcacagctggaactccgggatgatgttcaggcttgggggcggggacctccatgcctccagcccccaggtgggagcagaggtaggaaggcacactgcccaggaaaaaaatcaatcctccgcccaaggtacagcagaagcggcctccttggcctaggaggcagacttcctcctgcggggaaatcccttcctggctgggaggagcaggggcccttcctcttggtggcctcggacattcagcaggtgctggcacaggccctggctgggaggtggggcgggcaggagccagcctggaggaggggctgagagtcagcaggcacacgggaacccggaaccctgtgtgctggggaggaatcccgcagtggccggggggcttgaggccgctgctttgtctcttcgtccagagccttatgtaagagcttttctcgggaaacaggaagtcctgcttgccaatttcagcacagggagtagtgcaggccttattccaacacacccggcccagccttaaccccagaactcagccagtttcttgcttccgtgcccctggttctcctccccatcgagcccacccctcctttcccaccttcagtcacccctagtgaactgccccagcgatctctgctgtgcttgaccccgagggtcttccaccctcgccctgaccctggacactgcccagcttggccccccatcctgctcctggcacaatgccctctagccagccaaccttccctcccccaaccctggggccgccccagggttcctgcgcactgcctgttcctcctgggtgtcactggcagccctgtccttcctagagggactggaacctaattctcctgaggctgagggagggtggagggtctcaaggcaacgctggccccacgacggagtgccaggagcactaacagtacccttagcttgctttcctcctccctcctttttattttcaagttcctttttatttctccttgcgtaacaaccttcttcccttctgcaccactgcccgtacccttacccgccccgccacctccttgctaccccactcttgaaaccacagctgttggcagggtccccagctcatgccagcctcatctcctttcttgctagcccccaaagggcctccaggcaacatggggggcccagtcagagagccggcactctcagttgccctctggttgagttggggggcagctctgggggccgtggcttgtgccatggctctgctgacccaacaaacagagctgcagagcctcaggagagaggtgagccggctgcaggggacaggaggcccctcccagaatggggaagggtatccctggcagagtctcccggagcaggtgagtgaggggaggagggtgtctgggagaggatggttagcatggggggtctctgggcctcctggtctgcaaagtttcaagggggtgcaagagagggtctccggtttggaagtcaggggcgcggccattccaggaaaggaaactgttaaaggttaatgcttctcatacctaacaaatcctggagggcagccagcaccaacactcagggtgctgggaaaaggtgcgtgagagatctgaggcatctcgggggcaggggagggctgggaaggcaggctggctgggaccctcgcatcttaacctaaccttgaccctctttccatgagcagagttccgatgccctggaagcctgggagaatggggagagatcccggaaaaggagagcagtgctcacccaaaaacagaagagtgaggcttccagggtgcagcaggggtgggaggtgatcaagcagcgtggggattgtaagcccgagtcagggtgagggtggaggctgccaacagcacaacgggggaaagtggatgcggctgagattccctccttctctcctcagagcagcactctgtcctgcacctggttcccattaacgccacctccaagggtgagcactattttaaataatggctttggggaggggcaataaccaggaactcgggctggcacttgggctcaaggggtccttataggtgaaagggaaagaaccaaaaagcacctgagagtgccaagaagtcctgaccgacacactctcacctccagatgactccgatgtgacagaggtgatgtggcaaccagctcttaggcgtgggagaggcctacaggcccaaggatatggtgtccgaatccaggatgctggagtttatctgctgtatagccaggtaaccccagccacactctgagcttcacagagggcctctttggccccctactgagggttcctgacccctctattcataccaaacccagcagacccttctttcttccctcgttagcgctcctgaggcctcccagaactgagccaggccatcctgttttcttcaacatctcccttccctgccaggtcctgtttcaagacgtgactttcaccatgggtcaggtggtgtctcgagaaggccaaggaaggcaggagactctattccgatgtataagaagtatgccctcccacccggaccgggcctacaacagctgctatagcgcaggtgagagccgtgtgggcagccgaaagcaggacgtctctgaccgggggtagcagtgcagggagctaccgctaggagggaggttggaaacctaaacagaggcgggtctgaggagtgaagtgcagaatgccgggtccttacaggaggcagaggaacggtggagctggagaaggcagggggaaacagggcatctggatggctgtgcttcactgcgaatctactttctctcttttctcaggtgtcttccatttacaccaaggggatattctgagtgtcataattccccgggcaagggcgaaacttaacctctctccacatggaaccttcctggggtttgtgaaactgtgattgtgttataaaaagtggctcccagcttggaagaccagggtgggtacatactggagacagccaagagctgagtatataaaggagagggaatgtgcaggaacagaggcgtcttcctgggtttggctccccgttcctcacttttcccttttcattcccaccccctagactttgattttacggatatcttgcttctgttccccatggagctccgaattcttgcgtgtgtgtagatgaggggcgggggacgggcgccaggcattgtccagacctggtcggggcccactggaagcatccagaacagcaccaccatctagcggccgctcgagggaagcacccgccggttggccgaagtccacgaagccgccctctgctagggaaaacccctggttctccatgccacacctctctccaggtgccctctgcctcttcaccccacaagaagccttatcctacgtccttctctccatctatcggaccccagtttccatcactatctccagagatgtagctattatgcgcccgtctacagggggtgcccgacgatgacggtgccttcgcagtcaaattactcttcgggtcccaaggtttggctttcacgcgctccattgccccggcgtggcaggccattccaagcccttccgggctggaactggtgtcggaggagcctcgggtgtatcgtacgccctggtgttggtgttgcctcactcctctgagctcttctttctgatcaagccctgcttaaagttaaataaaatagaatgaatgataccccggctccatttcccccactgcctcgcctcagcccggtcctcgtacggggatctcccgccctcctggctctcctgtggcgcgccccccgccggatcaaggtactggggatgccgctagggtcaggcccgcgagcgcggagaagacagagcgcggcgcaaaagggaaagtggcggggccgccacgcgcggccgggcggcggatgtgcgcaggcgcagcctcgcgtagcgctctgggctggccagtcccgtggcgccggcgtcctcgggtagacgggaccgcgcgcttggtggccgcgccggcgctcttcgccgggtgtgacgtactaatcgtgcgccaccgctgccggtgggcccggggctcgcgggaggggaaggaggagggggggaggagtggcggcggcggcggtggcgctggtggcggcggtggcggaggtggaggtggaggtggaagctgaagctgaagcagagccagaggcggcgcggcggggtgctcggcggcgcggcacgcggcccagaagcgttggaatcctgaattgagacggctgcgcctaaagacagcaggagtggcggggccgccgccgtcgccggagagatgagccgggaagcttgaggccggagacgcccgccttcgggcccgtccgcccggcttccccgctcccggtgaggacgccccctcccctccccccagccctgccttggcctctcccattcctgggcctcgctcccaccgaaccggggcccagaggcccgcataggggcttcttaaggcccgtgtgcgccgagccatccaagctcgtgggaccggactggtgccgggttgcattctggtccccgaggatgaagtaggagggggctgggccggcctggcttgtgcgctccgttctgtcccagcgtcttgattcggttctctttaagtttccttcaaagttcttccccgtttatcagcctctgccccctgaaccatatccctggcatctgcacttgagatgaccgcagccttcccatgccccccgttcatccagggtgttagagaactgtctcccattccagtccagtttccacgtgcaagttgcattctcctcaagtaccacggttatcatgtccctgaggaaagaaactgcccttgttgggccctcaaaggacagccctggtggtattaaaataaagacgtagaacctggcagtgctattgggtttggcctggtgatcttagaaataagatctctgaggcctgctgcttagccattttcccttgtctctggactggggagagatgatggcacagaccctgaagggccccttgtggaccgcgttaaccgggaagatcttaagttaggagttttgcgttttttcctcttttctttatttgcatctgaatccagaggaggcatggccaggaagagaggcaggatctgcggtggggtgatgcttagattttgataccctgatcttttgtttttcagggtactggaagatgaaagagactatacaagggaccgggtcctgggggcctgagcctcctggacccggcatacccccagcttactcaagtcccaggcgggagcgtcttcgttggcccccacctcccaaaccccgactcaagtcaggtggagggtttgggccagatcctgggtcagggaccacagtgccagccagacgcctccctgtcccccgaccctcttttgatgcctcagcaagtgaagaggaggaagaagaggaggaggaggaggatgaagatgaagaggaggaagtggcagcttggaggctgcccccaagatggagtcagctgggaacctcccagcggccccgcccttcccgccccactcatcgaaaaacctgctcacagcgccgccgccgagccatgagagccttccggatgctgctctactcaaaaagcacctcgctgacattccactggaagctttgggggcgccaccggggccggcggcggggcctcgcacaccccaagaaccatctttcaccccagcaagggggtgcgacgccacaggtgccatccccctgttgtcgttttgactccccccgggggccacctccaccccggctgggtctgctaggtgctctcatggctgaggatggggtgagagggtctccaccagtgccctctgggccccccatggaggaagatggactcaggtggactccaaagtctcctctggaccctgactcgggtaaggtgggaaaggggtgtggggttgcgggggaggggttagggagggttaagagcctggagcaccaggagcctgttgccatggtgagagctgggcttaaggaaagtaggatggaagagtgccggctccagaagagctgcgaaatgtctccattaagccccactttgagcagaaagtaagcctgggagtgagcctggcagtttcccaggcagagctaggaaacagatgccctaagtaggtatcccgtggtcttgagcgcagatgagaaagggagatgtggtttacaaaaatcctgtccacacgaaatcccttgtcggcctctcagtataagaacccccgtgtatacatctccagagggtaccattcccaaagtgacgggatgggatctctcccagtagtggagtacatcatcttacagttgtgaaagaatatttccctttcggagaactccagccaaacagtttcaggctctctaggtctttattacatattctagtattcattgagcctttacaatatgctgggtactatgctgggtgtttggcatatagtggtgacaaatatcccgaagttttcatttctaaatgctaatcctttttctttcttcctgtctatgagtaggaactctctctccatccctgtagaatctcttggacatgtttatctcatgcttatggggtccccatttcttggagtgggattgacattggtggattctgcttcagtgtatccttcttgcggtcttatttgcatgcatgagtcaactgtgtgcatcccattgtgctttccccaggccagtctctcatgcccattccatttcccctgccctataggcctcctttcatgtactctgcccaacggttttgggggacaatctgggccagaaggggagcgcagcttggcaccccctgatgccagcatcctcatcagcaatgtgtgcagcatcggggaccatgtggcccaggagctttttcagggctcagatttgggcatggcagaagaggcagagaggcctggggagaaagccggccagcacagccccctgcgagaggagcatgtgacctgcgtacagagtaaggagcccttaagcaactagcctctctcccttctccgactcctagaggagagtctggaggcctcaccccctcctctctccctttccaccaggcatcttggacgaattccttcaaacgtatggcagcctcatacccctcagcactgatgaggtagtagagaagctggaggacattttccagcaggagttttccaccccttccaggtgaggcttgaaagccctccttgaaagaagggctggggccttggggatgtggagagaatactgctgccttttcttccatagggctgtagttggggaggaggaagctagagctgaaggggaggactctgcaggcaggtgccaaatccttggaagctgatgggagagtctttacctgggaccctgaaatgttctacctgagtagtcatgtttatctttctggggagtgggcctttcgcaggtcctcagaaggacccatcatgagccagaaaaaagggagtcagttagaatttgtattccagggagtagtaggtatttctgtgtgccccagctgcatcatcttttgtgtgactccacccttggcctactcaggaagggcctggtgttgcagctgatccagtcttaccagcggatgccaggcaatgccatggtgaggggcttccgagtggcttataagcggcacgtgctgaccatggatgacttggggaccttgtatggacagaactggctcaatgaccaggtgagaaagggtagagaaacaggcctgagaggggattcagggagcagggtgtctggggccctctgcatgggggagccctgtacccatgccgcaccctccatggcaagctgcctcccatcttctccccaggtgatgaacatgtatggagacctggtcatggacacagtccctgaaaaggtaggcccaaccagataggtcagtacccagaggaacttctgcagttttaagcagctttttaagctcctttcatctctttcattttacacagagagggtctctgtttcagggagagaggtggtagtggtagtgtattaatttcaaatccgtaatcttgggctctggatttatcagttgttttcctttctgccagtatttagtgtttttcgctatggccagccccaaggattgggatgggttcctattgtaactattgtaaaacaagatttaaaaaaaaaaagaaaaagaaaaaggccaccgggcatggtagctcatgcctgtaatcccagcactctgggagaccagggcgggtggatcacctgaggtcgggagttcaagaccagcctgaccaatatggagaaatcccgtctctactaaaaatacaaaattagccgggcatggtggtgcatgcctataatcccagttactcgggaggctgagggaggagaactgcttgaacccgtgaggcggaggttgcggtgagtcgagatccacgccattgcactcccgcctgggcaacaagagcggaattctgtctcaaaaaaaaaaaaaaagacaaaaaacaacttcggctgggtgcggtgactcattcctgtaatcccagcactttgggaggccaaggcgggtggatcacccgaggtcaggagttccagaccagcctggccaacatggtgaaaccctggctcaactaaaaatataaaaatacaaaaaagttagctgggcatagtggcgggtacctgtagtcccagctactcgggaggctgaggcgggagaatcgcttgaacccgggaggcggaggttgcagcgagtcgaaatcatgccactgcactccagcgtgggcgacagagcaaggccctgcctcaaataaaaaaaaaaaaaaagcctggtttgttgactcatacctataatctcaatgctctggaaggccgaggcaggcagacagacagattgaggccaggagtttgagaccaacctgggcaacatagtgagaccctgtctctaccaaaaaaaaaagaaaaaacccagaatttgtttttactgtcagtggactgaggaggggagacttagtgggagagtctgaggtcttttaattccattgagcttttttgtgtcattggcacaggtgcatttcttcaatagtttcttctatgataaactccgtaccaaagggttatgatggggtgaaaaggtggaccaaaaacgtgagttttgaattcacatccacttgtgtaatgccttgcctctaaagaatgagagtcttgttttctctgagccctttccctgaccgtgttcattcagtctttcaaagattaaacgtctcttgtgtgtgtaggcactaaggatacagtgttaaataaggaaaacttgcccttaaagttaaattgcagctagtgataagtgctgtgggcagatcaacacagagtaacgtgaggctgggcgcagtggctcacgcctgtaatccccagcactttgggaggccaacacgggcggatcacctgaggtcaggagttcgagactagcctggccaacattgagaaaccccatctctattaaaaatacaaaaattagccctgtgtgatggcaggtggcctgtaagcccagctattcctggaggcggaggcaggagaatcccatgaacctgggaggcagaggttgcagtgagccgagaccccgccattgcactccagcctgggcaacaagagcaaaactccgtctcaaaaaaaaaaaaaaatcacagtaatgtcatagcgtgggaagtgggtactttagattgggtgatctaggaaggcctctcatagctgagacgtgaatgatgagcagccagccatgcgcagacctgggaatagcaagtacacaagacccatagtgaaaaaccatggctgaggaacagagggcttgtgggggtgacctgtgtagttggcgcagagtgagcaaagggagatggatacaaaattcggtcagagagtagatcatgtaagacatgtacggtaggctgaggaggggggattttattgcgtgtatactgagaagccattgagttttaagcaggctgagaagtgccttctgttttaaactcctgtttcaatgacagattgaaaggggggcaagaatggaagcaggaacagagcacagtagtccaggtgagaaacttgaactggagtgctaaaggaagagagagagagtagttttatgtaggataaattttacgagtaaaaccagtaggactgacaggctctgtgatactgagagatacatatttggtctcctgaccaggctcctggcattcaacttctaaaatccttggaatctccagtgatgtgtgtttttgtgtgctgatgagttgattcatggctagcccctctaggtggcttcatgattagagggttggaactttcagcctcacccccaccaacttcctgggaggggaatggggccaaaggttaaggcaatcactgaggatcagtgatttaatcagtcatgcctagtagtgaagcctctaaaaaccggaaaggggccgggtgcggcggctcacgcctgtactcccggcactttgggaggctgaggcagatggatcgcaaggtcaagagattgagaccagcctggccgacctggcgaaaccctgtctctactaaaaatatgaaaattagctgggcgtggtggcgtgcgcctgtagtccccgggaggctgaggcaggagaatcgcttgaacccgggaggcagaggttgcagtgagccgagattgtgccactgcactccaccctgggtgacagagtgaaactctgtctcaaaaaagaaaaaaaaacccgagaggaggagtttggagacattctagatagctgaaggcatggaggctcccacaggatggtctccaggcctcttcccggtacctttccctgtgcatcttttcatctgtactctttgtactaccctttgttaataaactggtaaatgtgtttccatgagttctgtgagctgctctagcaaattaatcaaattcaaggagggggtcatgggaacgctgatctaaccagttggtgagaaacacagataaaacaacctggggcttaggactggcatcagaattgggggcagccttgtgagactgagccctaaacctgtgacacattatctccaggtagatagtgttggaattgaattgggggatacccagctgtgtccaccgcaaaattgcttgcttggttgttggtggagagaaagccccacaaacacttcttggtgaccacaggttacagaagtattttgtgttgtgagagtatagtaggaaagaagatttgtttttttgccgggcgcggtggctcacgcctgtaatcccagccctttgggaggctgaggcgggcggatcaccaggtcaggagatcaagaccatcctggctaacacagtgaaaccctgtctctactaaaaatacaaaaaattagccgggcgaggtggcacgtgtctgtagtccaagctacttgggaggctgaggcaggagaatggcatgaacccaggaggtggagcttgcagtgaggcaagatcacgccactgcactccagtctgggcaacagagcaagactccgtctcaaaaaaaaaaaaaagatttgttttttcctccgcaggttggatgtgggaaatgaagaaaaagaaatggaggatgatgcctaggtttttggcctatgtaacgggaaaagtgggagaggaacaggttgggggaggaaaatgaagagttcttttctcttctggtttccctgccctcccattcaaaggccaggaaatttctacagctaggcaggatgattggctccggcattccttaatttcagtcctcaaaatcaagagcttacaccctcagggatcttcttgcagtagagggaagggtggtgacgtacagtgaaaaacatgttggccttcttcatactgagtttgagtcccacttctgccatttctttctttcatgaccttgtgcaagtcacgactttccaagctgcaatttcctcatctgttaggttgaatgttgagaacttcccggtaggattgttatgagcattaactgcgtgtttactttgtgctgtgtcttgttctaagtgtattatggatagtcactagtttaatcctcatatcaaatggatgaggtgtaggtactactatttacactctctgacagataaggaaactgaggtatagaaggttattaagtaggttgcccactgtcataagccagtaaatggaggagctgtatttgaattctggcaggctccagaatcctgggcctgggttcttagctgctaagtgcttctccctttaaagtgtgaaaagcgcctgcccatcatgggttctccagtgttcgttctgatgtctcctccattgtctgaccttcctcccttaccccgaagaaccgaaacatgcagatcctgagcttgcccacaatctaggccttgggtcttctgttctttcacttggttcccttacctgtgtctctgttcctctctagaaccttcatggcaaaaggcaagacttctgtttgttgtacctgacctgtggcactatctctttaggtggacatcttcaataaggagctactgctaatccccatccacctggaggtgcattggtccctcatctctgttgatgtgaggcgacgcaccatcacctattttgactcgcagcgtaccctaaaccgccgctgccctaaggtttgagggggtaggagagagatgggcaaaatgtggggcggtgcagtggcaaggcattgcaggaagaagggtgggctttgggtctttgaggggcgacctgggcatggtgtctgccagcactgtacccaccatactgtgttcaattgagaaacttagggcatcactttcttttcccccatccacatagcatattgccaagtatctacaggcagaggcggtaaagaaagaccgactggatttccaccagggctggaaaggttacttcaaaatggtgagtttcctgagggaggggtatagggtgttggtggggacagtggtagaaggcagaaattgaagtcctacccctgggagtctccatgtgaagggcctgctttctttctcttctctagaatgtggccaggcagaataatgacagtgactgtggtgcttttgtgttgcaggtaagcagatgatggggccacctcccctagctctgaagtcagttgggttaaagggtcgggaggctgttatgcatcccctcatttggctcatagtcagttgtggagcaggaagtaatctgttttagaacaccaaaacactggcttcactggttctcttctggacttctccatcccacattgggactgggtctctagtcttgggcctctggccttcatagagctccctgctaacctccaactcagtgtattttctccatctaaaacattctatcaagtaagaacactagctttagagtcaggctgtttttgaaccccaggctgtgggaccctggctccctttggggatgttctctgaaggatggagacacatctcatatgaaatgtgtagcacaggtcctgacacggggggtttctcatggcttgctttgttaacacccagtactgcaagcatctggccctgtctcagccattcagcttcacccagcaggacatgcccaaacttcgtcggcagatctacaaggagctgtgtcactgcaaactcactgtgtgagcctcgtaccccagaccccaagcccataaatgggaagggagacatgggagtcccttcccaagaaactccagttcctttcctctcttgcctcttcccactcacttccctttggtttttcatattt

SEQ ID NO: 1194 - DNA, 23303 bp, Homo sapiens
gcagcctcaaactcctgggctcaaacaatcctcctacctcggcctcctgagtagctgggactacaggcgtgggctaattttttaaaacttttctgtagagatggggtcttgctcttgcccaggctgatcttgaactcctggcccccagccttggccttctgggattacaggcgtaagccacctgccggaccaattttggtgtttcttttgcatgctgctggtcctcctcagatgcttggcaatcattggtaatgatgggcttcagaacgtgctaccggcacagtgagtgttttaagctgaaggaatttgagaaaaccgcagaagccgaaggatctttcttaccttctcctgcccttcttccctgaaccaggtcatacaacctggaactccctgcccttttcctgaagaagcaaataacagcctcctgcgagaggcgccctccctgcacctgggggaaaggagggtccttatctctgaagacacagggacacagaagaatctgaaccaacaggccttcctgagttccccacctccccgcaggaggtgcccgcacacgcatagccccgtcgctcccgcggccgcacgcaacggacctcgccctggtggtgcacgcccgggctgggcgctcagaggtcgggtgggcgcccactccgttcgctgcgcgcacagcgcccggcgagaggctcggagtttgatcacacacagcgtccggcttcctgtccccagcgccccctcccgccccgtttcccttgcccctccctctccccggcccgatccgcccgccggctccccctcccccgatccctcgggtcccgggatgggggggcggtgaggcaggcacagccccccgcccccatggccgcccgtcggagccagaggcggagggggcgccggggggagccgggcaccgccctgctggtcccgctcgcgctgggcctgggcctggcgctggcctgcctcggcctcctgctggccgtggtcagtttggggagccgggcatcgctgtccgcccaggtgaggccccgctgcgcaccccttcttgggcacatcaggagctgagactgcagaggggccgctgggggccgcgtgggctgaaggcaaggggaagggaggatgggtggagggtgagatgtcaggtggagcggcacagggtgacgctccctccttcccagcaggagcctgcccaggaggagctggtggcagaggaggaccaggacccgtcggtgagtgggcgtgggcgcggtctgcaggctgctggggcatgggaagtgtgcacagccgaggctgcaggtgtgtgcagctgtgccagccgtactcgaggtgtgtgcagggtgtgtgtgaacacagtgcgtgcatgggtgcgtgtctgcaggggtgtgtgtgcgtggtgacaactctgtgtgaggggtttgtgctggggttgtgccacctgagtctgaggtgtttattggctgggggtgacgtggttgtataagatatgtgagtctgcgtggaagaggggtgcggttgtgtacagggtgtgtatcctctgtgcgtggtgactgggtgcgggcatgtgtgcaatgtgccaattgaatgcagggtctgcgttggttgtgtgtgtgggtgggaaagtgtagctggtctagaggaaagggtgaggactggggcctgactcccagcttcacctttgcccggggccccagctgtagttggctgaggggcttaatctgtccctgacttctgtgtctattgctggctggtggctctcctgacaggccccgtatgtctcactttatatctctgggagtctgtggttgaaccctgccctaattcccctaggaactgaatccccagacagaagaaagccaggatcctgcgcctttcctgaaccgactagttcggcctcgcagaagtggtgagcatccctctatcccaacctcaggaagcgggcagagcaaaaaccattatccacagggagaaactgaggcacggagggtgaaaggagttcagagtcatgcagctaaccagccaagactcaaacctagggattctcgccctcctctgaagctccttctgtcatatggatgtgctccttcagaccctaccccaaacaggaaggcagggtggccatgagttagaagaactactgggatcctgatggagactaggcctggcagtcagaggcctgggccccggtaggcaaagagacttaggaatgggatgatggggtggccggatgaccacgtgtccaagtcggcatgcagttgtcctggcccccacctgttatctcggtgtgattaatagcagcttcccgttttgctctcagcagtatcccagtgtggatgacaaattatagtcactctacttactgaggaagatgaggcctgagattctaaggccaggagtctggacaagaataaggatgccagggttcctgagaggggaatggggctgggagagttgctctgggacccccactagggcccgctttgctcatctgtctttccttgatcctcagcacctaaaggccggaaaacacgggctcgaagagcgatcgcagcccattatgaaggtgggtgatgggtgagccatacccaggaggagaggggcaggtggcagagggtcagggcaggtctcaccagccttttcctgtactttacagttcatccacgacctggacaggacggagcgcaggcaggtgagaccccatcccccgacacagcactggcctcctgggaaaagggcccttgaaaacctttgacctcccactcccttcccggccatcagtctcagaaccacagaagccagttcatgaaggtcttggttctctctgtgacccaggcgtgggaccccatgaaagacccctactcttccccagaactctgcccagttcccccagcaaatcactgtcccagctctctccttcagccctcattcttctccaagaagcacttttcattcttttttcttctgtctcctccatattccacgttctgatgatctttttctctaaatgctgctagtgtctgctcatcttttccatttctaccccaccctctacctcagcaccgtgacctcagaacctcaaatccagcctcttgctgcttccccactccacaccctccctacccctccactccatctgacctgtgctgccatgctgagcccctaaacttcacttttcttgtggtattggctctctacatggcttccagtctcttcgtggtctggtctcaacctaatttccctgcactcttatgctgtcttcatgtttgctgcgctgacacccctgctcccggtgtgcctcttctggactttgcacataccatccccctcaccagaatgtctttccactgtgagaggcagggaggcatgaggagtgctcagccgaggggttcacagcagagatggtgagaagtggatgggttcagcctgtgtcctgaagatattactgacttatgggttggaggtgaagaataaaagaaagggaggaatcacagatgacttctagattttttattttttttaagacagtctcgctctgtcacccaggctggagtgcagtggtgcaatctcggcttactgcaacctctgcctcccaggttcaagagattcccgtctcagccttccaagtagctgggattacaggcgtgtgccaccacgcctggctaatttttgtatttttagtagagatggggttttgccatgttttccaggctggtctcaaactcttgacctccagtgatctgcccgcctcggcctaccaaagtgctgggattacaggcatgagccactgcacccagccagcttctagatttttaacttgggtatctctgggaagaatgatgccatttcctaagaagggattgaccaaggaataaataggttgggaagtatgtaagataattattaacgttgagaagtctaaaataaacaagcggataaatgacaataaagtaaattccagaaatggatggctggacattgtcgactagcttaggctaggtcaggacggataaagccaggagtcatggccatatggatggcttttttttttttttttttgagacagagtctcgctctgtcacccaggctggagtgcagtggttcgatcttggctcactgcaacatctgcctcctgggtccaagcgattctcctgtctcagcctcccaagtagctgagattataggcgggtgccaccacacccagctcatttttgtattttttagtagagacagggtttcaccgtgttggccaggctggtcttgaactcctgatctcaggtgatccgccagcctcagcctcccaaagtgctgggattacaggtgtgagcccttgtgcccggcctatcgatggcatttaaagccacaggattgggtgagacgccaggagaaagaagggccccacgaatgaagccctgagactcttgggcatcttgaagtggagctgaggggaaaaccagcagagactgaaaagaagctggagagagaggaagaaacccagggagggtggcatcctggattcggagaaaccactgtttcaaggaggatgtggctgtctgtgttgaatgcagctgagagatcacatgaaatgagaacagagaaatgatggctgggtttggtaacgtgaaagtcctgctgaccttaaagagggtggtttcagtggcatagttagaacaggaaggcagtgtgcattgggttgagaagaaaatgagaaataaggaactggaggcagggacaacctttttttttttttttttttttttttttttttttttttttgtgacagagtttcactcttgtcacccaggctggatccagtgcaatggcacgatctcggctgaccgtaacctccacctcccgggttcaagcaattctcctgcctcagcctccccagtagctgagattacaggcatgcgccaccacgcctggctaattttgtatttttagtagagacagggtttctccatgttggtcaggctggtctcaaactcccgacctcaggtgttccacccgcttcggcctcccaaagtgctgggattacaagcatgagccactgcacccggcctaggacaaccctttttagaagtttctctgtaacaaggagcagagaaataggccagtaggtggaggggtgtgtggaccaaggaaaagtttagttctgtgaacaatactattttcatctgatctaacatgtactgagggctttcttgagataggcactgtgtctggcacttgtgtttggtcttatctaatcctcacaacagccctaaaaggaagatactctaattacctccattttacagatggaggttacacaacttgtctgaggccatgagatactaagtggtggagccaagatttgaacccagctagaatgtgcctgtgtactggacatggtctgcatgaaaggcgaggtggctggtgcaggggtgaggggtccatgcaggggccacatccaaaaaggggagagggaagtttccagaaagaagagaggacacatctcccaccattaccagagggtcaaaggagaacaagagaccaggtgggtttgtagatttgctggggggagatgagggaacctttgctcgatgacttctaggtcctctggacaactagggagatggagacaggagatttgaggagaaatggtacaaaatctcaacttgctgattatgaaagcaagcttcgtgggggaatgtaagattgccaggcaggacggaatgtccaggtgaggtttgtggctggagacaagtgatataccaggcaagccctccgtgctcctgggcacaccatgcccttaggctacaagcagcctttgcttaggctggcttcgtagctaggaatgccctctcttctctgccctccctactcttcatgcccagatcagccttcctcccctctgtatagaccacttattttggcaattatccagacattcattcattcattgactcaacaggcattgaagacctactgtttgctaggggccaggctaggtgcccacagcaactaatatccagactcttttttttttttttttttttttttgagatggagtctcactctgtcgcccaggctggagtgtagtggcgcgatctcggcttactgcaagctccgcctcctgggttcatgccattctcctgcctcagcctcccaagtagctgggactacaggcgcccgccaccacgcctggctaatttttttttattttttagtagagacggggtttcaccgtgttagccaggatggtctcgatctcctgacctcgtgatccacccaactcggcctcccaaagtgctgggattacaggcgtgagccaccgcgcccagccggtcagacccatttttttttttgagatggagttttgctcttgttgccccagctggagtgcagtggcgccatctcggctcactgcagccttctcgggttcaagtgattctcctgcctcagtctcccgagtagctgggactacaggcgcctgccaccacgcctggctaattttttttttatgttttagtagagacggggtttcaccgtgttagccaggagcgtctcgatctcctgacctcgtgatccacccaccttggcctcccaaggtgctgggattacaggcgtgagccactgtgcccagcctcagaccaactcttaaggagtcactgtctaggagaggaaacaagcatataaatttgtaattacaggaacatacaaaaaaaattagccaggtttggtggcacatgcctgtaatcccagctactcaggaggctgaagcatgagaatcacttgaacccgggaggcggaggctgcagtgagccgagattgtgccactgcactccagcctgggtgacaagagtgagactccatctcaaaaaaaaatttgtaattacagtggaatatgacaagaacaataataaaagtggccaagatacctggcaacacaggggaagacagacatggctgtggagtcagggattctctccctgcatcgcaaggtgccgctgggccttgaagcaggagcgtaagacaagacaggcaaggggtcaagaatggtgggtgcaagcagaagcagcccctggggcaaaagccccgggtttgcccagagcatgatgaggctgggggactctaagttcagcgtggcagaagcagaaagtgctagaggagcgagatggggatgaggctggagacagaagccaggccacacggtggcatgtgggaactattctgaggtgagccatcggaaggaggaaggcgaggcgaggcgggcttacgtctgcatcttagagactcattctgtggctttgtgtagggaataaactggaggaagccagaatggaaacagggaatgctgtgaaaaccagacagaggcaccagatgggggagagaggggagagagctatttaggaggcaggatagataggaactggtgatcgattaatgatgtaggtaaaggagagggaggcttgaatatccccctggtggcaaaaccagaagccaaatgtggaaaacagacagtaaagcaagagtgggatgaggggggtcagctcagtgttggttgagatgagtttgaggggctattgctgttcagatggtgcagttggcagggtaaggaagggaaggaaacttcagggctggagactctgcagagcacaggttgtgggaacccattggtggaaataaaaatgcccagtgagcgttttttttgtttttttttttttttggagacagagtctagctctgttgcccaggctggagtgcagtggcatgatcttggttcactgcaacctccccatcccaggttcaagtaattctcctgcctcagcctcccatgtagctaggattacaggtgcctgccaccatgccctgctagtttttgtatttttagtagagacggggtttcaccttgttggccaggctggtctcgaactcccgacctcaggtgatccgcccaccttggcctctcaaaatgccgggatgacaggcgtgagccactgcacctggctgagcatgatgttttcaaggcacatctgtgccatagtgtgtatcagtacttcactctttttatggccaaataatattccattatatggatagacattttgttgatggacaattgggtttcattttattatttttagttgtactaattcagataatgtatgtttacatcctccatataaaagaagcaaataatatagatatccatgaagtaaaacattaaatcccctcacgcttctccttcagttctactcttctccccagaagtgactgcaggtgacaatctgccctgaatgtctctggccatatacattagattttttcacataacttcctagtcaactatgggcatcataggggatgggtcctcccttgcccggggtgatctatgtgtcttctgggtaaagtgggcgccgaatgttcatatgctcaatggatccctggggagtgtgggggagtcctgtagagagacgtttccttatctctgagcatccgtgttcaggtgtggacgggacagtgagtggctgggaggaagccagaatcaacagctccagccctctgcgctacaaccgccagatcggggagtttatagtcacccgggctgggctctactacctgtactgtcaggtaagccccatctggctgcatgggtaacgcagtaagagagtggcgaagggtttgccaggagagtgggggacaagctacagggctgggagggtgagttggggtttgggtgggatgggatgcctgcgtcgctgaggaaattggaaattgaggcgagggcaggcagaggcctggactcggcctgttgtccccaccccaggtgcactttgatgaggggaaggctgtctacctgaagctggacttgctggtggatggtgtgctggccctgcgctgcctggaggaattctcagccactgcggcgagttccctcgggccccagctccgcctctgccaggtgtctggtctgttggccctgcggccagggtcctccctgcggatccgcaccctcccctgggcccatctcaaggctgcccccttcctcacctacttcggactcttccaggttcactgaggggccctggtctccccgcagtcgtcccaggctgccggctcccctcgacagctctctgggcacccggtcccctctgccccaccctcagccgctctttgctccagacctgcccctccctctagaggctgcctgggcctgttcacgtgttttccatcccacataaatacagtattcccactcttatcttacaactcccccaccgcccactctccacctcactagctccccaatccctgaccctttgaggcccccagtgatctcgactcccccctggccacagacccccagggcattgtgttcactgtactctgtgggcaaggatgggtccagaagaccccacttcaggcactaagaggggctggacctggcggcaggaagccaaagagactgggcctaggccaggagttcccaaatgtgaggggcgagaaacaagacaagctcctcccttgagaattccctgtggatttttaaaacagatattatttttattattattgtgacaaaatgttgataaatggatattaaatagaataagtcatagtctctctctttattggggctcaggggacactctcagggtagctgggggccacgtgaaggggggcgttgcggagcggcacagctggaactccgggatgatgttcaggcttgggggcggggacctccatgcctccagcccccaggtgggagcagaggtaggaaggcacactgcccaggaaaaaaatcaatcctccgcccaaggtacagcagaagcggcctccttggcctaggaggcagacttcctcctgcggggaaatcccttcctggctgggaggagcaggggcccttcctcttggtggcctcggacattcagcaggtgctggcacaggccctggctgggaggtggggcgggcaggagccagcctggaggaggggctgagagtcagcaggcacacgggaacccggaaccctgtgtgctggggaggaatcccgcagtggccggggggcttgaggccgctgctttgtctcttcgtccagagccttatgtaagagcttttctcgggaaacaggaagtcctgcttgccaatttcagcacagggagtagtgcaggccttattccaacacacccggcccagccttaaccccagaactcagccagtttcttgcttccgtgcccctggttctcctccccatcgagcccacccctcctttcccaccttcagtcacccctagtgaactgccccagcgatctctgctgtgcttgaccccgagggtcttccaccctcgccctgaccctggacactgcccagcttggccccccatcctgctcctggcacaatgccctctagccagccaaccttccctcccccaaccctggggccgccccagggttcctgcgcactgcctgttcctcctgggtgtcactggcagccctgtccttcctagagggactggaacctaattctcctgaggctgagggagggtggagggtctcaaggcaacgctggccccacgacggagtgccaggagcactaacagtacccttagcttgctttcctcctccctcctttttattttcaagttcctttttatttctccttgcgtaacaaccttcttcccttctgcaccactgcccgtacccttacccgccccgccacctccttgctaccccactcttgaaaccacagctgttggcagggtccccagctcatgccagcctcatctcctttcttgctagcccccaaagggcctccaggcaacatggggggcccagtcagagagccggcactctcagttgccctctggttgagttggggggcagctctgggggccgtggcttgtgccatggctctgctgacccaacaaacagagctgcagagcctcaggagagaggtgagccggctgcaggggacaggaggcccctcccagaatggggaagggtatccctggcagagtctcccggagcaggtgagtgaggggaggagggtgtctgggagaggatggttagcatggggggtctctgggcctcctggtctgcaaagtttcaagggggtgcaagagagggtctccggtttggaagtcaggggcgcggccattccaggaaaggaaactgttaaaggttaatgcttctcatacctaacaaatcctggagggcagccagcaccaacactcagggtgctgggaaaaggtgcgtgagagatctgaggcatctcgggggcaggggagggctgggaaggcaggctggctgggaccctcgcatcttaacctaaccttgaccctctttccatgagcagagttccgatgccctggaagcctgggagaatggggagagatcccggaaaaggagagcagtgctcacccaaaaacagaagagtgaggcttccagggtgcagcaggggtgggaggtgatcaagcagcgtggggattgtaagcccgagtcagggtgagggtggaggctgccaacagcacaacgggggaaagtggatgcggctgagattccctccttctctcctcagagcagcactctgtcctgcacctggttcccattaacgccacctccaagggtgagcactattttaaataatggctttggggaggggcaataaccaggaactcgggctggcacttgggctcaaggggtccttataggtgaaagggaaagaaccaaaaagcacctgagagtgccaagaagtcctgaccgacacactctcacctccagatgactccgatgtgacagaggtgatgtggcaaccagctcttaggcgtgggagaggcctacaggcccaaggatatggtgtccgaatccaggatgctggagtttatctgctgtatagccaggtaaccccagccacactctgagcttcacagagggcctctttggccccctactgagggttcctgacccctctattcataccaaacccagcagacccttctttcttccctcgttagcgctcctgaggcctcccagaactgagccaggccatcctgttttcttcaacatctcccttccctgccaggtcctgtttcaagacgtgactttcaccatgggtcaggtggtgtctcgagaaggccaaggaaggcaggagactctattccgatgtataagaagtatgccctcccacccggaccgggcctacaacagctgctatagcgcaggtgagagccgtgtgggcagccgaaagcaggacgtctctgaccgggggtagcagtgcagggagctaccgctaggagggaggttggaaacctaaacagaggcgggtctgaggagtgaagtgcagaatgccgggtccttacaggaggcagaggaacggtggagctggagaaggcagggggaaacagggcatctggatggctgtgcttcactgcgaatctactttctctcttttctcaggtgtcttccatttacaccaaggggatattctgagtgtcataattccccgggcaagggcgaaacttaacctctctccacatggaaccttcctggggtttgtgaaactgtgattgtgttataaaaagtggctcccagcttggaagaccagggtgggtacatactggagacagccaagagctgagtatataaaggagagggaatgtgcaggaacagaggcgtcttcctgggtttggctccccgttcctcacttttcccttttcattcccaccccctagactttgattttacggatatcttgcttctgttccccatggagctccgaattcttgcgtgtgtgtagatgaggggcgggggacgggcgccaggcattgtccagacctggtcggggcccactggaagcatccagaacagcaccaccatctagcggccgctcgagggaagcacccgccggttggccgaagtccacgaagccgccctctgctagggaaaacccctggttctccatgccacacctctctccaggtgccctctgcctcttcaccccacaagaagccttatcctacgtccttctctccatctatcggaccccagtttccatcactatctccagagatgtagctattatgcgcccgtctacagggggtgcccgacgatgacggtgccttcgcagtcaaattactcttcgggtcccaaggtttggctttcacgcgctccattgccccggcgtggcaggccattccaagcccttccgggctggaactggtgtcggaggagcctcgggtgtatcgtacgccctggtgttggtgttgcctcactcctctgagctcttctttctgatcaagccctgcttaaagttaaataaaatagaatgaatgataccccggctccatttcccccactgcctcgcctcagcccggtcctcgtacggggatctcccgccctcctggctctcctgtggcgcgccccccgccggatcaaggtactggggatgccgctagggtcaggcccgcgagcgcggagaagacagagcgcggcgcaaaagggaaagtggcggggccgccacgcgcggccgggcggcggatgtgcgcaggcgcagcctcgcgtagcgctctgggctggccagtcccgtggcgccggcgtcctcgggtagacgggaccgcgcgcttggtggccgcgccggcgctcttcgccgggtgtgacgtactaatcgtgcgccaccgctgccggtgggcccggggctcgcgggaggggaaggaggagggggggaggagtggcggcggcggcggtggcgctggtggcggcggtggcggaggtggaggtggaggtggaagctgaagctgaagcagagccagaggcggcgcggcggggtgctcggcggcgcggcacgcggcccagaagcgttggaatcctgaattgagacggctgcgcctaaagacagcaggagtggcggggccgccgccgtcgccggagagatgagccgggaagcttgaggccggagacgcccgccttcgggcccgtccgcccggcttccccgctcccggtgaggacgccccctcccctccccccagccctgccttggcctctcccattcctgggcctcgctcccaccgaaccggggcccagaggcccgcataggggcttcttaaggcccgtgtgcgccgagccatccaagctcgtgggaccggactggtgccgggttgcattctggtccccgaggatgaagtaggagggggctgggccggcctggcttgtgcgctccgttctgtcccagcgtcttgattcggttctctttaagtttccttcaaagttcttccccgtttatcagcctctgccccctgaaccatatccctggcatctgcacttgagatgaccgcagccttcccatgccccccgttcatccagggtgttagagaactgtctcccattccagtccagtttccacgtgcaagttgcattctcctcaagtaccacggttatcatgtccctgaggaaagaaactgcccttgttgggccctcaaaggacagccctggtggtattaaaataaagacgtagaacctggcagtgctattgggtttggcctggtgatcttagaaataagatctctgaggcctgctgcttagccattttcccttgtctctggactggggagagatgatggcacagaccctgaagggccccttgtggaccgcgttaaccgggaagatcttaagttaggagttttgcgttttttcctcttttctttatttgcatctgaatccagaggaggcatggccaggaagagaggcaggatctgcggtggggtgatgcttagattttgataccctgatcttttgtttttcagggtactggaagatgaaagagactatacaagggaccgggtcctgggggcctgagcctcctggacccggcatacccccagcttactcaagtcccaggcgggagcgtcttcgttggcccccacctcccaaaccccgactcaagtcaggtggagggtttgggccagatcctgggtcagggaccacagtgccagccagacgcctccctgtcccccgaccctcttttgatgcctcagcaagtgaagaggaggaagaagaggaggaggaggaggatgaagatgaagaggaggaagtggcagcttggaggctgcccccaagatggagtcagctgggaacctcccagcggccccgcccttcccgccccactcatcgaaaaacctgctcacagcgccgccgccgagccatgagagccttccggatgctgctctactcaaaaagcacctcgctgacattccactggaagctttgggggcgccaccggggccggcggcggggcctcgcacaccccaagaaccatctttcaccccagcaagggggtgcgacgccacaggtgccatccccctgttgtcgttttgactccccccgggggccacctccaccccggctgggtctgctaggtgctctcatggctgaggatggggtgagagggtctccaccagtgccctctgggccccccatggaggaagatggactcaggtggactccaaagtctcctctggaccctgactcgggtaaggtgggaaaggggtgtggggttgcgggggaggggttagggagggttaagagcctggagcaccaggagcctgttgccatggtgagagctgggcttaaggaaagtaggatggaagagtgccggctccagaagagctgcgaaatgtctccattaagccccactttgagcagaaagtaagcctgggagtgagcctggcagtttcccaggcagagctaggaaacagatgccctaagtaggtatcccgtggtcttgagcgcagatgagaaagggagatgtggtttacaaaaatcctgtccacacgaaatcccttgtcggcctctcagtataagaacccccgtgtatacatctccagagggtaccattcccaaagtgacgggatgggatctctcccagtagtggagtacatcatcttacagttgtgaaagaatatttccctttcggagaactccagccaaacagtttcaggctctctaggtctttattacatattctagtattcattgagcctttacaatatgctgggtactatgctgggtgtttggcatatagtggtgacaaatatcccgaagttttcatttctaaatgctaatcctttttctttcttcctgtctatgagtaggaactctctctccatccctgtagaatctcttggacatgtttatctcatgcttatggggtccccatttcttggagtgggattgacattggtggattctgcttcagtgtatccttcttgcggtcttatttgcatgcatgagtcaactgtgtgcatcccattgtgctttccccaggccagtctctcatgcccattccatttcccctgccctataggcctcctttcatgtactctgcccaacggttttgggggacaatctgggccagaaggggagcgcagcttggcaccccctgatgccagcatcctcatcagcaatgtgtgcagcatcggggaccatgtggcccaggagctttttcagggctcagatttgggcatggcagaagaggcagagaggcctggggagaaagccggccagcacagccccctgcgagaggagcatgtgacctgcgtacagagtaaggagcccttaagcaactagcctctctcccttctccgactcctagaggagagtctggaggcctcaccccctcctctctccctttccaccaggcatcttggacgaattccttcaaacgtatggcagcctcatacccctcagcactgatgaggtagtagagaagctggaggacattttccagcaggagttttccaccccttccaggtgaggcttgaaagccctccttgaaagaagggctggggccttggggatgtggagagaatactgctgccttttcttccatagggctgtagttggggaggaggaagctagagctgaaggggaggactctgcaggcaggtgccaaatccttggaagctgatgggagagtctttacctgggaccctgaaatgttctacctgagtagtcatgtttatctttctggggagtgggcctttcgcaggtcctcagaaggacccatcatgagccagaaaaaagggagtcagttagaatttgtattccagggagtagtaggtatttctgtgtgccccagctgcatcatcttttgtgtgactccacccttggcctactcaggaagggcctggtgttgcagctgatccagtcttaccagcggatgccaggcaatgccatggtgaggggcttccgagtggcttataagcggcacgtgctgaccatggatgacttggggaccttgtatggacagaactggctcaatgaccaggtgagaaagggtagagaaacaggcctgagaggggattcagggagcagggtgtctggggccctctgcatgggggagccctgtacccatgccgcaccctccatggcaagctgcctcccatcttctccccaggtgatgaacatgtatggagacctggtcatggacacagtccctgaaaaggtaggcccaaccagataggtcagtacccagaggaacttctgcagttttaagcagctttttaagctcctttcatctctttcattttacacagagagggtctctgtttcagggagagaggtggtagtggtagtgtattaatttcaaatccgtaatcttgggctctggatttatcagttgttttcctttctgccagtatttagtgtttttcgctatggccagccccaaggattgggatgggttcctattgtaactattgtaaaacaagatttaaaaaaaaaaagaaaaagaaaaaggccaccgggcatggtagctcatgcctgtaatcccagcactctgggagaccagggcgggtggatcacctgaggtcgggagttcaagaccagcctgaccaatatggagaaatcccgtctctactaaaaatacaaaattagccgggcatggtggtgcatgcctataatcccagttactcgggaggctgagggaggagaactgcttgaacccgtgaggcggaggttgcggtgagtcgagatccacgccattgcactcccgcctgggcaacaagagcggaattctgtctcaaaaaaaaaaaaaaagacaaaaaacaacttcggctgggtgcggtgactcattcctgtaatcccagcactttgggaggccaaggcgggtggatcacccgaggtcaggagttccagaccagcctggccaacatggtgaaaccctggctcaactaaaaatataaaaatacaaaaaagttagctgggcatagtggcgggtacctgtagtcccagctactcgggaggctgaggcgggagaatcgcttgaacccgggaggcggaggttgcagcgagtcgaaatcatgccactgcactccagcgtgggcgacagagcaaggccctgcctcaaataaaaaaaaaaaaaaagcctggtttgttgactcatacctataatctcaatgctctggaaggccgaggcaggcagacagacagattgaggccaggagtttgagaccaacctgggcaacatagtgagaccctgtctctaccaaaaaaaaaagaaaaaacccagaatttgtttttactgtcagtggactgaggaggggagacttagtgggagagtctgaggtcttttaattccattgagcttttttgtgtcattggcacaggtgcatttcttcaatagtttcttctatgataaactccgtaccaaagggttatgatggggtgaaaaggtggaccaaaaacgtgagttttgaattcacatccacttgtgtaatgccttgcctctaaagaatgagagtcttgttttctctgagccctttccctgaccgtgttcattcagtctttcaaagattaaacgtctcttgtgtgtgtaggcactaaggatacagtgttaaataaggaaaacttgcccttaaagttaaattgcagctagtgataagtgctgtgggcagatcaacacagagtaacgtgaggctgggcgcagtggctcacgcctgtaatccccagcactttgggaggccaacacgggcggatcacctgaggtcaggagttcgagactagcctggccaacattgagaaaccccatctctattaaaaatacaaaaattagccctgtgtgatggcaggtggcctgtaagcccagctattcctggaggcggaggcaggagaatcccatgaacctgggaggcagaggttgcagtgagccgagaccccgccattgcactccagcctgggcaacaagagcaaaactccgtctcaaaaaaaaaaaaaaatcacagtaatgtcatagcgtgggaagtgggtactttagattgggtgatctaggaaggcctctcatagctgagacgtgaatgatgagcagccagccatgcgcagacctgggaatagcaagtacacaagacccatagtgaaaaaccatggctgaggaacagagggcttgtgggggtgacctgtgtagttggcgcagagtgagcaaagggagatggatacaaaattcggtcagagagtagatcatgtaagacatgtacggtaggctgaggaggggggattttattgcgtgtatactgagaagccattgagttttaagcaggctgagaagtgccttctgttttaaactcctgtttcaatgacagattgaaaggggggcaagaatggaagcaggaacagagcacagtagtccaggtgagaaacttgaactggagtgctaaaggaagagagagagagtagttttatgtaggataaattttacgagtaaaaccagtaggactgacaggctctgtgatactgagagatacatatttggtctcctgaccaggctcctggcattcaacttctaaaatccttggaatctccagtgatgtgtgtttttgtgtgctgatgagttgattcatggctagcccctctaggtggcttcatgattagagggttggaactttcagcctcacccccaccaacttcctgggaggggaatggggccaaaggttaaggcaatcactgaggatcagtgatttaatcagtcatgcctagtagtgaagcctctaaaaaccggaaaggggccgggtgcggcggctcacgcctgtactcccggcactttgggaggctgaggcagatggatcgcaaggtcaagagattgagaccagcctggccgacctggcgaaaccctgtctctactaaaaatatgaaaattagctgggcgtggtggcgtgcgcctgtagtccccgggaggctgaggcaggagaatcgcttgaacccgggaggcagaggttgcagtgagccgagattgtgccactgcactccaccctgggtgacagagtgaaactctgtctcaaaaaagaaaaaaaaacccgagaggaggagtttggagacattctagatagctgaaggcatggaggctcccacaggatggtctccaggcctcttcccggtacctttccctgtgcatcttttcatctgtactctttgtactaccctttgttaataaactggtaaatgtgtttccatgagttctgtgagctgctctagcaaattaatcaaattcaaggagggggtcatgggaacgctgatctaaccagttggtgagaaacacagataaaacaacctggggcttaggactggcatcagaattgggggcagccttgtgagactgagccctaaacctgtgacacattatctccaggtagatagtgttggaattgaattgggggatacccagctgtgtccaccgcaaaattgcttgcttggttgttggtggagagaaagccccacaaacacttcttggtgaccacaggttacagaagtattttgtgttgtgagagtatagtaggaaagaagatttgtttttttgccgggcgcggtggctcacgcctgtaatcccagccctttgggaggctgaggcgggcggatcaccaggtcaggagatcaagaccatcctggctaacacagtgaaaccctgtctctactaaaaatacaaaaaattagccgggcgaggtggcacgtgtctgtagtccaagctacttgggaggctgaggcaggagaatggcatgaacccaggaggtggagcttgcagtgaggcaagatcacgccactgcactccagtctgggcaacagagcaagactccgtctcaaaaaaaaaaaaaagatttgttttttcctccgcaggttggatgtgggaaatgaagaaaaagaaatggaggatgatgcctaggtttttggcctatgtaacgggaaaagtgggagaggaacaggttgggggaggaaaatgaagagttcttttctcttctggtttccctgccctcccattcaaaggccaggaaatttctacagctaggcaggatgattggctccggcattccttaatttcagtcctcaaaatcaagagcttacaccctcagggatcttcttgcagtagagggaagggtggtgacgtacagtgaaaaacatgttggccttcttcatactgagtttgagtcccacttctgccatttctttctttcatgaccttgtgcaagtcacgactttccaagctgcaatttcctcatctgttaggttgaatgttgagaacttcccggtaggattgttatgagcattaactgcgtgtttactttgtgctgtgtcttgttctaagtgtattatggatagtcactagtttaatcctcatatcaaatggatgaggtgtaggtactactatttacactctctgacagataaggaaactgaggtatagaaggttattaagtaggttgcccactgtcataagccagtaaatggaggagctgtatttgaattctggcaggctccagaatcctgggcctgggttcttagctgctaagtgcttctccctttaaagtgtgaaaagcgcctgcccatcatgggttctccagtgttcgttctgatgtctcctccattgtctgaccttcctcccttaccccgaagaaccgaaacatgcagatcctgagcttgcccacaatctaggccttgggtcttctgttctttcacttggttcccttacctgtgtctctgttcctctctagaaccttcatggcaaaaggcaagacttctgtttgttgtacctgacctgtggcactatctctttaggtggacatcttcaataaggagctactgctaatccccatccacctggaggtgcattggtccctcatctctgttgatgtgaggcgacgcaccatcacctattttgactcgcagcgtaccctaaaccgccgctgccctaaggtttgagggggtaggagagagatgggcaaaatgtggggcggtgcagtggcaaggcattgcaggaagaagggtgggctttgggtctttgaggggcgacctgggcatggtgtctgccagcactgtacccaccatactgtgttcaattgagaaacttagggcatcactttcttttcccccatccacatagcatattgccaagtatctacaggcagaggcggtaaagaaagaccgactggatttccaccagggctggaaaggttacttcaaaatggtgagtttcctgagggaggggtatagggtgttggtggggacagtggtagaaggcagaaattgaagtcctacccctgggagtctccatgtgaagggcctgctttctttctcttctctagaatgtggccaggcagaataatgacagtgactgtggtgcttttgtgttgcaggtaagcagatgatggggccacctcccctagctctgaagtcagttgggttaaagggtcgggaggctgttatgcatcccctcatttggctcatagtcagttgtggagcaggaagtaatctgttttagaacaccaaaacactggcttcactggttctcttctggacttctccatcccacattgggactgggtctctagtcttgggcctctggccttcatagagctccctgctaacctccaactcagtgtattttctccatctaaaacattctatcaagtaagaacactagctttagagtcaggctgtttttgaaccccaggctgtgggaccctggctccctttggggatgttctctgaaggatggagacacatctcatatgaaatgtgtagcacaggtcctgacacggggggtttctcatggcttgctttgttaacacccagtactgcaagcatctggccctgtctcagccattcagcttcacccagcaggacatgcccaaacttcgtcggcagatctacaaggagctgtgtcactgcaaactcactgtgtgagcctcgtaccccagaccccaagcccataaatgggaagggagacatgggagtcccttcccaagaaactccagttcctttcctctcttgcctcttcccactcacttccctttggttttt

SEQ ID NO: 1195 - DNA, 149261 bp, Homo sapiens
cagccctcctcagcagtggtacctccatagcagtggtgcctgctgtgtctcagaattgttgcaggaggctgtgctcacaaaaatgccatgcaccgtgggtgggggacactggggaacaatgggctggtgaccctcagagttctttggaactacctgtggctgcagctgcccccttaccatgtgaacttcaggacgcttctctgtcaagcaaggctcttagaagaacgtggtcccgtgacagtcccgagagcggctcacagatggctccatctccctccttccgagcacaccgtgggttcacatttcactgtggtgtgaccacctggcatgctttagtgggagtggtgtgaccagagcacgccgggccccaccaaatctcccctctgcacgcagcggcagcatggaaacggtggctgccccatcagcctgggaccctgcatggtcaggatgagcacagccccttgacaaagcttgggatgggggcctgtctgttactgcattaaccagcctgcaccaattcagagtcttctcaactttcagttttggatatatgcaatcttgcgtgaacttatgcatggagcggagaatctaatgtacccatagctatggatctcccgagcacagatcatgccaaaggtaaaacccgtgttgtatgtgattctgaaactggaagtggaggggctaagagacaccaggcaagcatttttttcaccctggaatgcacatgtacagaccttgccaggtgttctccttagattcctatcacctgtgttgcacgctgtctcaagggaggaaatgtgttctccttagccaattgtggtaatgcagtagcccattctacatctttggtacccaaagaggagtagacagggcctcctctgctgtgacccagtgagaggaagattcctgctctcttttactgcagcctgtttgggactgaactgtgtccccagggttcctaagttaaagggctgacccccagcatttcagaatgtacctggagataaggttgtcaaagaggtaattaagttaaagtaaggccattaggtttggccctagttacatacaactggtgtctttaataagaagaggagattaggacacagacacacacagagggatgactgtgtgaagacgcaggggaaggtgaccagccagggagagaggcctcagaatgaaaacaacccggccaacatctgactcttggatgtttggtctccagaactgtgaagaaacaaatgtccgtggtttaaaccacccagtctgtggtactttgttatggcagtcccaggaaattcatacacggtcatttctttctttctagaaggctgcagcattggttttctattaaatcattctattgaatttatcacaaaaagtaaggtattttataatccagtccttttttcttacctttcaagattaattttatagcgctggttattatctgtagttcacccttacaataattcaatcagttatttaaatatgtcattcatttattcacttcattcttttatccatcgacccattcacacatgtacccacgcagccatccattcctttattcactcatccatgcatcccacccacccacccgcatagacatcgagtcatccatcggcccattcacccatccacccattcaatcatcattcgcctatccatccattcatcatccacccacccatttatccattatccacccacccatccacccattcatccatccattcatccatccactcattcattcatccatccttccatttatccatccatccatccatcatccacccacccattaatcactcacacacacatccatccatccatcatccattcactcatccatgcacccacccatccatccattcatcatccatccacccactcgttcatccacccattcacccatccaccccctcatccatccttttattactcacccacccatccatccattcttcatccacccatctactcatctatccatccactgatcagtttctccatccatccatccattcacccattcatccatctatccacccaccacctccccgcccatccatccataatcagaacccaccccactctcccagatttctttccaccgaccttttatctcccccagaacatttcctcattatttcagcttgtcaggtgccctcttctgttttctcacagattcacccccaagattctaatagggaatgtctcccactccacagaaattaattgcttctttatcttcctaactcaactataacttttacaaagttaggaagaacatcttattcatgttcacacttgtcaagcacagaacttgaccctaaagaagttctcagtaattatttggtttattcaaaaagaaatatgagtcatttattttacttaatagaagcaatatccactggacgatattctagattaggcttctttttagacctttgtggttttttctacagtcaccacaatacaatcccaaatcagctagaaagaaaacacgcatcctttcaaactgtaatttggtcaaaacaacattatttcatttttagttttgttttgttgtttccctaaattgattgacttggctggttcaccctactgtaacctgtgtctctaattcaacaggaacgcacattgcatcattttctggggaagctcaatgcctgcaagttgggagctgtttagtgatattcacatcctcctctagaaattacttaagtgtatttaccgaccttcaccactcagattagggaaatccacttggcaagggaagccatgcattctaatgtgtatagatgctagggccttttatagaaactaacaattttgaacctgattgaagtattgggcttaaaaaagtaccattttttaaaatttatttttccagggcacctgtgttacattttgttatctttttgtgactattgtaagacacaaagaacttagcttagccatcctattatccacgtgaatattgtccactaaccaggtccttctctgcttccagacatggtctggcttggacctgccatgcctggcttgcagcccccatcacccctgagcaagacacagccctgggcctctgagatgctcttgctggccatggctctgccttgtgttttacagagctcatcggcctgagggcatcttcctctctattaatctcacttagggtcacaacatgctgtgaaacaaaggaccaaatgccattcacaatattacccctagaaactccttcagggactggagtcattttcctttcagtaatgtaaatacaagctcctgttctgccattagcaagtggaaggtgaagactatgggagaggccaagggtttggaatgagatgagcttgcaccttagacaggatgtttctcaaaggaaggaagtacttgtttggaccagatcattatttgaaagatcatcagcctggagggaacatgagtatgtatttagtcctcaccacactgtttcataaatgtattatgtgcaggacaatgaaaaatttattttgctgcaggtggaggttgagaggcagacacaggcactggacattgatggagaagtgagggaaggtgagcaatgtaagtattgtgactgcaagggtttgtaaggaaaatatggcaacacagacatgcagccctcaagacaaacgtttccaccgggtttaccagtggctttgatttctgtttatgttaatattgacaaattgtatgtgtactattactttccaaatacccttagaaatacattcaagtcagcaaagtatctttctaaataccactttgttcgtaaaggaactgagatctgtacctggggaaagtgccaaaacctgaagtttgttactggcagttgtggaatattctactggaacattgagaaaaggggtgtgttatggggcttgtggagacagctgaaaactggtgaaacatttttcaaagtgcatctctgaattgtttctcgaattgaccaagcagatgtgtcctttgtgtagttgtcaatctaacaaaagccaaatgtttcattttctttctttttagaaatggcacatttatttctaagaagtcttccaaactacccccttttcttgtctcttagcaggttgttaggtgatgcaggcatttcaggaaagtcacaaagttacttggtcatacctcaccaaatatcagtattcttaacacacaatataaaactgaggctatcagaatatttaataaaccagatgagcacaacatcctcttaatgatcactaatgtttccattatcccttgtggcaatttaaattcactaaaataagaacaatcatgcaaccttctttttggcttacatcaaggaagattccatttctatgaaacccacatcttcaagattacactgtaaagacaaattgaactaaaactttgaagatttctacacaaatgcaaagaattcagatctgggattccatcttttattctaatgcatacttgatctggttgtattctgaatcctccttacaggaatgtgatgtggactgacacgtaatttggaaactactagaaggctcttgaatggaaccagggattcttcacacttcatagagcagctgaaagggacttgagcactacttgggccttctgacgccagagttacagaatgctcttttgccaaatcatggatggccactcgagcacacagatattcaggatcctcttgtccccgtgtgcagagaggcctggtgctggatatcgtttatgtgagttgagcggatagctgaggctatgtggatgcatgtaactagttagagcattttactaagttaatgaccgaaatcagagctctcaggtcactactggaatcagctcctctccctgtgaagtagttaactgtggtcatgatctgccctctgcacttcccagttaattgcacctgcttcctgttttcacgtggggagagcatcctcacccagccttggaagcactgacattcgagttgtgcgtgggctgctgatgaatcctggttcagtgagcttagctgcctaggcagggtggtaattagagtacggagttttacaggagaatctactgcataattcatgaggaaactgaaacgcaaaaaagatgtgtagttaaagccatgtgctcctgtgagtgggtgggcacgtgcagtcactctgcctgcaatagcagaggcggaagagccgcagagacccgtgggctcaagaaaagtacattcattaattaattaatcttataacataaaaacttttgatgttcaatcggcctactcagacattcctcaccaaatagaagtaggaaggacacggggaaatgcaacttttcaatgaagcatccatcagcaatttaatgccttgttttgtccacttttccttcttgtgaagagtgtaatgtcgaagttagagccacatctccacctttagaaagacgtggctgaaatgtctgaagggcaggagaggtgacccttggtgagaagatggctctttgctgatataagtcacccccgatggcatgggtccctggtcaggaggctgttttacatccttagcttgtagaaacgcaaagcacaggggaatggtgtccccagagtccatgagaggagcttcgcacagggacagactgcggtccccagagtccatgagaggagcctcacatggggacagactgccgtccccagagtccatgagaggagcctcgcacggggacgtgactgctgtccccagattccagactcctacctcctactcagaaaaactggagccattaaaatggttactgctgaatgtggagctttttgtggtgtgagagagccccatgtttatttcctgaatttcaattaacaaaaaccctcctgtatttgtctttagttttatctgactcatataaactgggaaattacctacctgagtttgaacaaagctgaataatttttcaaattttacaggggaatttaattaagtttgaatgacagcattttattttccaaatttgttttaaaatgaattgagctgtaataagagttggaagataacacagagctcccaaacctccttcacccacctgctcagtgttaactctatgcacggccacagcacagcaaccaggaccagggagtggacgtggatccaatgctggtgattacatctcagagctcaccctggtatccccagcttttccatctgcatcctttcctcttccaggatccagtcctggcactgtgcagcccacggccgtcgggggtcatcaggtccctgagtctcctctcatccatgttcatctcttaaaaaataaacttacaaatttaaaaatacaaaaaacagtgcgcgcacacacacacacacatgcacgtgcacatacacacacaagccaggcaccaaaagacaaacacctcatgatctccctcctatatggaatctaaaagtgtcgagctcatggaagcagagagtggatggtggacacctagggttacggggcaggtgcggtggggggcaggtgtggtgggggctggtgccatgggggggacaggtgccgtgaggggcagaaagatgctggtcaaaagtgagggtttcagttgcaggataaaaatgttctgggatctaatgtatagcttgatgactattgtttatttgaaaatcgctaggagaatagatattaaatgttcctatcacacacacaaaaggatgaatacgtgaggtgctgtatatgttaattagcttgatttaatcaccccacagtgtttacatgtatgaaaacatcatgtgaacataaatatgtataatttgtatttgttaatgatagcttgatgaagctgggggcgaggaaaacaaaaactaaaaagtgaatggcaagtaaaaaaggcaacatcaggctgtagtttgaagaacacaaggcagtcaggccctggccacatgtcaggtgagtcaagtgtgagcccaccctggatcccttttctgttacagtcacaggcaagggcctattacaggtggtcctgggcctcggttagggagagcctcttgtctgtggacagaacacacgatgtctgcagggagaaaggtggcctttctatggagacatcaagcaaaatgtgtgatttgctgtttctcatgcattgatcaaggtattcagtaatcagatttccccaggatatcaaatagttcattggcacttgccaaaaaatggaagcgtgcttgtcttctcggtgggcccgggactggaccgcagggctggtgccactccttcactgagacctgcttgtagcagggccctgcattcccccatcctgccatgtgtgagttggcttcttactgtatcatgcgttccttgcagatttctgtcttctttggagctccttgatttttctcataatgggagaagacgtgtatttttttctttccttctcatggctaaaactgtcctctttctcactgagtctcccctgcaatctctctgctctccattgctgggtggccacgtcttcccaatgctcctttctgacagagactgggggcttcagccagatctttagttgcctctctttcattctcccattatgtgatagcctcgggttttccacgtccccctgcagaaatcttccttcccaagtcccccgtcttctttctcaaaaatgtgtgtgctatccagtgggcctcctgcaaacccgccattctcagacttttctccgctcccctctcaacatttccagtgtaacagcttccattgtacttgatgcattatttatattgtttaattagtattaaaataagcacatcatgtaatccagctaaaatatgtattttcaaatgatagatacatttctcatatttgtgcggggtcaaatggtaacagcaacttagaggagaggctacaaaacgacctggagagttgatgtgccggctcggcctcccccagctgtgcatgcaaaccccctcttcccaggtctccatcggcactcggcattttcaagcgtccttctgtgatgaaaagagcatccagtcagtatttactttacattttaatgctttcttcttcaaactcttccttgagtatttgccccacgctgtctcattttaccacccacctttctggctgtgtgaatttcctgcgaatgccttaacaaagggccacgtgcttagtggctttactccatcagctccggaggtcatagatccaaatgagacttttggcagcaaggtccagggacaggcctggttgtgcctggagaccccagaggccctgctcctggcctcctccagtttctggaggctcatggccacggccctccagtctcagtttccatcatcacttccccctttctcccctcagactttcccacctttgtcttgtaaggagctgtgtgctaacactaaggccagtggataatccaggctaatctcccctcctcaaaatcttaactgaatcccatctgcaaagccccttttgccatgcaggttgcagtcacaggctgggggactgtgtcccctagacgctggtgctctgagctactcttgaggtcttttccatccacattctcccaagaagaatcccattcactcacagtccactactgtatcccccctcaggactcccaaatgtgtctttttaagctggacttcacccaacagctgaaagtacatttccaaatgcccaagagctcactgcccgcctgtgccacgggcacctccaacacaattccaagcctgagtctgctgctcctttgcttgtcacagccagtctcctttcttctctggccttcctagggccagtacatgagattttcacttgcttaggcatcaaaccgaggatggctgaatcctcagaggctctgtgcttttcttctgttcccaacagtaactcatcattgagccatggaatcctctttaatgagccaccgagtctggtccttcctctctatccaaaccccaccctcctagtgaccattctcagggtgcgtggggggattatatcactgttggctgatctcctccctgctcttcagagcttgtctaactcatttgttatcttcacccatttgaggggtgagtgatgaggattgaggggagaatgttaaaggcaaatcatcacattcttgggcttcagaacatcttctaacaaagattaatgttctgaagcctttgcatcgtgttttagcatttggtttcaaattacctagaggaagcatcagtcacatttggagaagggaaagaaaaggagaaagatgaagatgattttcacaaactagaaacccataggacttccgggggcatgaagaggctccaagtctcaggagcaggtcattgaagatgtgttattttatcattttcatgatgagatacagcctgaaagcagatcacccatgaaaacatgtcatctcccagtgttcggaatgcagtcatggtgaccttcctacagaacatctctgtctttgtggggactcttttgatgggtgcatgatgaggattgaggggagaatgcatgctggtgaacacacactgaactgtgctcatttttcacctcaacaaattggaaaaaagtgtactttattcacctcttagtgataagaaaactaggggcttggggacaggaagcaaaaggctcagagttgtagagcgagtcatcggtgggcctgggagctgcacccaacccaatcctcggaagattaacagcccctttttcacagggtatttaactgtgaaagtaagagggaggaaaatgcaagtgtcacaagtctggatttagttggtttattctttctccctgtataatttttcccctcttcttcctaactcattcggccagaggctggactgcatgtggaccccgatgacatggcactttgtttctgaccagtcaggacacacaagaggcccggcgcaaacacaacaaagcccgcagacattctgtccccacgaagaacggacgccactcgacttcctagcatcttgacgggctatccaagcgcggagtcagtttataaggtgggtaaccaagtccctggaaggcaattaaggcgcccatttcagaagagttacagccgtgaaaattactcagcagtgcagttggctgagaagaggaaaaaaggtcaggttgtaaagctttttatttttccattttctaagagaaattcatcattggaacttgtaaagtggcccaagagtggctgtaatttgggccattatagcaggtatgggtggcgtctctcagcaaagctgactgactgactgatgagtgctgtttgcaatgacctccgctggaacatgtgagtcctgtagggtcgattcctagatcaccgtctactgagacacattcctgtcagcatggactcactggtgctatcctgcttaacaaaattagtggctcaaaaatagccacagaaagcctaagagaagaaaacaaggatttgaaagtagaaatgatgaattttgaatcttctgttttgtcttaacaactagaattctaaaatcattttatggacataagaatgctttaagaaattcaataggcatttaggggttttatttatcacttttataaagactaaatttctaatagtactcactttttgccacatagatgcattaggggaaacagatttttttcattcccaataattattcccagtactgttacactatttgacattaccaaaaatttaaataggttattactgagatatattggcaactggagctgccaacataaaaactctgtttttgaataatgggggcctgggaggcctgctcagcgctgcagtttctgtaacctcctgacatggacggcgactctggtctcgcagaccccaggcctgtgagggtcgctcactgcggtagaggctgcgtggagtcagtggagggagcccctcagcagggagacaaggacacagcggttcccatggccttgtcagtgcttgattacatactctgtctccttccgttaattttagaatgagagcgctcgctgtgctgtctgtcacgctggttatggcctgcacagaagccttcttccccttcatctcgagagggaaagaactcctttggggtaagtagcaaacacattgcggtcttctggccttataaagttatttttcacacttactaaaatagagggcataatggtagctcctgagagtcactttaggcccctgtagtgtatgctttgttatgcttaagaaaaaaaaattgtaattcttgattttagaaggattgaaatatgtacatttctttctttaaaaaagagctgattttccttggatgacacaatagacaattttcacttttacctattcatataactgaaaaaaaaattctttgggagtgtttttcttcctttgctacagaattattttttattaaataacttctgtgatgtattttctggaatcagtgtgctactatgtgaaaacaagttaagaaagctactgagatgcagtggttaaaataatcacagatcaagctctttgcttttcttttaataaaataaataaagttccaaaccctgagaacaagtttcactggagtgaatactgcaggggcatttgcctggacattttaccccatggacaccgctggccccgggagcaggtgacacctcgctgggcaggtccctgggcctctgcacacagtcccggggcccctggagcaggtgacacctcgccgggcaggtccctgggcctctggacacagtcccagggcccctggagcaggtgacacctcgccgggcaggtccctgggcctctgcacacagtcccggggcccctggagcaggtgacacctcaccgggcaggtccctgggcctctggacacagtcccggggcccctggagcaggtgacacctcactgggcaggtccctgggcctctgcacacagtcccggggcccctggagcaggtgacacttcgccgggcaggtccctgggcctctggacacagtctcggggcccctggagcaggtgacagctcaccgggcaggtccctgggcctctgcacacagtcccggggcccctggagcaggtgacacctcgctgggcaggtccctgggcctctgcacatagtcccggggcccctggagcaggtgacaccttgccgggcaggtccctgggtctctggacacagtcttggggcccctggagcaggtgacacctcactgggcaggtccctgggcctctgcacatagtcccggagcccctggagcaggtgacaccttgccgggcaggtccctgggtctctggacacagtcttggggccatggcacagcactggcacctctgccctcaccagcctttcccaggactggaggccttgtctgtcgttcagggtcacagaatctggagtcctcgctgttcccagccacacccagcccagcctcctgctgggggccacattttaccccaatttttctgcatctcaggacttcacaaccatattaggagtggcagtgaagtccataacagactcgtaggctccttaaaaaaactctccctccacagcccccaggacttcctggtcactgcccgctctgagatcagggaagccgtggggcctctccctgccagcttccatccatgccccaaggatgggctactcacccctaattcctgtccctcccctgcaaatggagaacactggaaaattactcatcgcagtcattatttgtgagcaagaatgagatacttcatttaaagcggtgaatgcagtacctcggcaatcaccaaaaaacaaaaaataaaaatggagtcacaatataaagaacctcaggaaaaagtgattttgcatcttcccagaataaatcagtcactctatcacctggaacatgctagatgttcagccaatggtttgtaaattaattactttgttattttatttcatatttagtaggacctggttgtataaaaccagagtaaaacatgttagaagtcaagagctagttctgagcaagttgtgatacatgagagctattcaacaaaatatttaaaactttgtaacatgttttttaattttaaaaatcacatttaaaaagccatcaggaatgcagtagccacagcttttgctaaaacagtttttaaaaattatttttccatatctgggagatttgaccttttcgttttgcttaaacttttggttgacacatcacgagtgcacaggacagcagctgacaactgccccgcgtgctgggcacatgcttctgcctgctccaatatttcaaagctgacttattgtttgcttgaaatgtgaatgagttactgaaaaaatattatgtgtctcacagtatttctattttacagcctttaatagttgttttgcagctttaaatctgtttggaaaatgatgcccaatgactgtgtgtgggtttatgtcacctgtgctcacagacatgtgaagcaaaaaccttggcctgctccccagcctctgtgcaggacaagccaaagagcaggcagcggcagggccaagaggatccaggctccccctggaccacacacggtcaccgtaagcacatggtgctccggggggtcctgcttggtgggtggctcacccttatgtgtcaggcacccattttatagatcaaaacgtagaggtctggaagtctcagaagcagcaaggctgtggccgctcagtctcacagtctcacgtcccaggtctttacagagaaccaacacacatcctcatacttgaagctcgatgataagtactcagcgaaaagtatcaggccagtgccgtgactcacatctgcaatcccaacacagtatcatcaggccagtgccgtgactcacatctgcaatcccaacacagtatcaggccagtgccgtgactcacatctgcaatcccaacacagtatcatcaggccagtgccgtgactcacatctgcaatcccaacacagtatcaggccagtgccgtgactcacatctgcaatcccaacacagtatcaggccagtgccgtgactcacatctgcaatcccaacacagtatcatcaggccagtgccgtgactcacatctgcagtcccaacacagtatcaggccagtgccgtgactcacatctgcaatcccaacacagtatcaggccagtgccgtgactcacatctgcaatcccaacacagtatcatcaggccagtgccgtgactcacatctgcaatcccaacacagtatcaggccagtgccgtgactcacatctgcaatcccaacacagtatcaggccagtgccgtgactcacatctgcaatcccaacacagtatcatcaggccagtgccgtgactcacatctgcaatcccaacacagtatcaggccagtgccgtgactcacatctgcaatcccaacacagtatcatcaggccagtgccgtgactcacatctgcaatcccaacacagtatcaggccagtgccgtgactcacatctgcaatcccaacacagtatcaggccagtgccgtgactcacatctgcaatcccaacacagtatcatcaggccagtgccgtgactcacatctgcaatcccaacacagtattaggccagtgccgtgactcacatctgcaatcccaacacagtatcaggccagtgccatgactcacatctgcaatcccaacactttgggaggccgaggcgggaagatcacttgaggctaggagttcaagaccagcctgaccaacatggcaaaaccccatctctactaaaaatacaaaaaaaaattagctgggcgtggtggtgcccacctgtcatcccagctactcgggaggctgaggcacgagaatcagttgaacccaggaggtggaggttgcagagtcgagatcacaccactgcactccagtctaggtgacagagtgagaatccatctcaaaaaaaaaaaaaaaagagagagagagaaaaaaagaaaagcatcagtcctggatagagtttaggttgtatcaacttgcctgcaaactgtaggaaggtgagaataagaagggaaagatcttggctggtgctcagactgggtgggtgcaggagagactcttgttccagagcaggatcccctagggtcaaagcacaaagagaaataaacttcagcacctgaaaattctgtaataagagtctttgaaaatggaaaaaaaatctatgcttgaccattgttgtctaagagaagtttgctatcaatccctcctctaacgccctgaacagaatgttcttcaccagaaccctgtgtattcatcaccacacaggctgagaggcattccagcatttgtgcaacatcaagatttatgtgcaattatctttatggcaaatgttccacaagttatagctgttaaaagaaaataagatgcaaatgaacaagaagaagcagaggcgctgcctgcagcctgggaaaatttgggaagctagcctaatgagtgaatttgttttaaaaggaaagttggcaaaccttattccagttcattaaatttcaacaaacagcaaggattaaagtaagaatcaacacacaactctaaacaggaatcaagcgcttagaattaggagcaaagctctggccctgggggcttatggttttggagaagaaagattttggctttcatatatatatttaacataaacagcctttggaacaaggcaacttccttcttctttctgaaatgtggtatgttcttgcctaatgtgtccctgaattccacctcttttatgaacaatatgaatatgcataaaggagaatttgggggaaccgtgccatgcgcccctcagagcaggagcaatcttgagaaggcgcaggcagagagcagcgggcggcttctccagagcaagtaattaagtcccgtgactccctagaactcagtgttcagttctgaaaaaaaacttcgggttcaaactccctaagtctatggtccttgcatcagacgcctcttccctgggattgctgggaactgaggaaggaagggcgctgcagagctaacgatagcaaggggctcagagctggccaccccagctccctggtggcaggagagctaatgtgagctgatggaaactgagaagcagcagataaaggaaaagccatctgccctgcctctattgcctaaaagtagaacataaatccgcaaaagtgaccatttccctctccaacagaaaggacagaaattcatcaccagggaccccaggccctcaacagcctggaaccagccccagaggcatttgtgtggcaaacctctgcagccccggcctcccttcctgtagttgccccagagaggcctcctcaaaacgtgtttcctgggaactcaaagtcctttgctttggtcttgcagcttcttggaaaatgattgttcttttgctgaggggctgtgcagcagagttctaacgatccattcgagtttccatcttggggcgctcagggggctccctcgtggaagcaggagtccaggctaataacccctgtgagttttcctcctgtgactctgccttttgtcagtctaatttcaatgccccagaaaattaatctaagatgcagggagagaaaaggtttcttcttcccctacagatggatgtcagtcatctctattcagccaagaagtagttaacctaaacaatgaaaacaccaccggttccagtagagacttgagactatctgatgagagttatgtgtctctgggaggaagttttcaatacagaaatggatttattttatgaaacttaaaagactaataatctgcaagcctataagaatgttttaattctgtaaaatattttacaataagaaaagaaactagagactaagcaacatatgatcagttaaacttgaataacaatatattaatattggtcaataacaaggaatgatctctctagtaactgccgtttccaagcatagtagagaaggataagcatgtttctttatatttaatcagttggttcttaaataattgtcaagtgcctgctgaaaaccagcctttggtcttggtcgtgaatagcgcagaactttgcagagccctgaagagactctcagtgataggatgcatatacacaggtggtgtgagtgacagagctaattttttttctggtacctaaagatcagcaggatcaaaatttcataaaggaagagctgggagcttgagattgacaatttcatgagatgaaggataaattgtgcgttacctccacagctctgcaacatggagattggtcttgggcaggtggtggacgtcctggattctgaggaagacctgcacgcaattcagtgggcatcaggagccttcagatgctttcatcaaaggcacaggcacaagcaggccttggtttagaaaggtcacttgggtgacagcaggagggacagaaggatggtggggagatcagtgcaggagccagtcaagagctccttctactaaggcagtagaaagtgagactgacaacggccaggcaggagcagaacgttctcccagagacattatggggaaattcacaccacatggtgagtgaaaggcaaggaaagccacggctgggcttcttgcttggggacttgagctggtagggtggttatttcaggctgttaacacccctcaacagggaacagaggaggatggcgtgactcaggagagaagttcaagtggaaaacgggcgtttgggagaggaccaaaggagggtgagaggagagggcaaagatcagaggagccagaaatgcacccgaggtgacactcacaggagggagaccatggagagaagagagccacagtgaccgaggctgagagagagagtggccagagactgaaagcaaaaggcacgacggccgggagcactgaacgcttgccaggccctggaccaaaagccgtgcaaacctctctgtaaaaccatcctaagacgtaactctgtgcacttgccaggccctcagcccagagccgtgcaaacttctctcttcagagcacacttgcgaggccctcggccaagagctgtgcaaacttctctctaaaaccatcctaagatgtaactctgcagctaggagagaaaaccgcgccaggtgaagtgagctgccgcgtcactcggagattgatttgtctcactccagagcccatggccgtcacccctctgccacttaagaatgccggcaacatcccaaaagcaccagagtcctggggaggtggggggcggggctggttactgcatttggcaaataagcggtcgtgactgaccacagaatacaaaatgtgagttgagttgcctgggcagttgcagtgggtttagaaggaaataagaggaaaataaaggaaaattccaggtgtcttatatctcaagcttttgtgggaacaggaggttccctgattcttgagagctgaaagaaatctccataaagcccggaatgctggtccttgaggtccacacctgccaccgatcctgcgacgcccaggccgcccctcccctctcggctcctactcactcttggtggcatcgtcccacattgcactgtccccagcacgcacacattggcgtaaagccaggtcccctcttcagattccacacccagagcctgcagctctgacggctgtgctgggggtccccggcgagctgtgagcccgtgctaggtgttcctccctccctcctgcccttgccccagggagccccacaccggggggctctgttcattgctctctgcccaaccctgaggggtcaccctctgccccaagtgcttaaccactggttactcatcccagaacccaagagagatccagcacggaggttttcttaactttgctgtatcacactgtaagaaactgggtggccaatggaacagacggagcagggcagagtgagcaggaagaaatgatgctggggaatttgtgtgctccttgggtggggacgagcatggaaggcgcgtgggactgaagccttgaagaccccgcaggcgcctctcctggacagacctcgtgcaggcgcctctcctggaccgacctcgtgcaggcgccgcgctggaccgacctcgtgcaggcgccgcgctgggccatggggagagcgagagcctggtgtgcccctcagggacttctatttgcttttaggagccaattcattcctttggtgaagtattgatgctacgcaggtgaatttagtaacaggactgacgtgtgaacatggccggaaacacttgccgtcttcctgttaccgcgtccggaacttcacggtgatacccagaaatgggatcttaacctcttacacattccaggtgctaaaacaaataacacaggagtgctttcattggaaactactggtatagtggaattattttatcttttattaaatacacaagataggcaaatcttatcaactttaccactggctcaggtaaccagtgatgaatgttcagaacaaaagttattcggaatcatttgaagtggtttgggcaagtgcgaaattaaggtgagtagctctgatcccatcctccaggcagctccgtgcagtgggggtggacgcccctctgtagcggggaagtgaaggcctgtggagggaagcgaccccgggacctggctgcctgcctgtcccggaagccacgtgggcatcaccgcagcaagatgggcttgaggaacaaagcaacactgtcagtgaatcgctgaactgtcattgcgctttgactgtgtgacattctgttccgtaggaaagcctgaggagtctcgtgtctctagcgtcttggaggaaagcaagcgcctggtggacaccgccatgtacgccacgatgcagaggtgagccttgcggaggggccgccgccccaaatgccaccgacaggcgcatcctccctgacatccacacacgtgtggcctgattttcgcaattgcagatgaaaacctgaagcttgccattgttaatttacttccccagtgtcatgtgcaagcagcagacagaactggtatttaatctccaatcctttcttaagcaagacacaaaggaggagcaccctgatgcaattagcaattacgtataccctggttaaaagacagtagaggctgacgtcctgatagcaaaaccagcctctcttctccaggattaggacagattaaggaggaaaagagagacctagatcccagatctttggtgttgtgatataactgtaacattacctgtggcatagaataaagaattaaatggggctctcccccatttttgaaataattagcatttgtaattatataacagacaccactattaagaatattgtggtctcatattacctgtctagaaaaagaaaagaaaaacaaaaaacaaaaaacctgtaaagcagtttgccctcccaagcttattattttgtaggaagttgactaataattatataagttcttgagatacaaaatatcaaaagacagcagttaatttattccaaatttctattattccagccagaaaaataccttactgttcatattggctgcaaacaaattattatttattttctaaaaattgaatcaaagggaaaagaaagagaaacactatttctcataaactcacgcacactttaatatgtctaaaatgggcaggaattcctggggaagacatggcagtgggggtggataccaagtgcgtagtaagaagtgtgtgctgctctcttagtaacaatttgtgaacccaagtatctaagacagatctcagtcaatttagaacgtttattttaacaaggataaggatgcacctgtgacgcagtgtcaggaggtcctgaggacatgtgcccaagatggctggggcacagcttgcttttacacatcttagagagacataagacatcaatcaatacgtgtcagatttacatggtggggagcttccaggtcataagtagatgtaacagttttctgactgacaatcagctgaaggaattattatcagtaggacggaatgtctgggttatgttaaggggttgtggacaccaaggttttatgagcttcacagagaagagatggtgaatgtttcttatcagacttaaggtctgtgttgatgttgatgctggaggggtagaaggaggtgtgtctgacccaccaccttccatcgtgacctgacccagcttttcaggctaactttggaatgctcttggccgagaggtgggatccactcaggtggttaggcgaggacattagaattttatttttggtttacaaattgcatgttaacagaacccttttgaaatcaatgccttgatcctaaggatgcattagagtgagggaagaccaggagaggcatcaactggggagactattggaaagatttgccttttgatagctctcaaaaaaatacactatactatacacctattccaactatgtttctttccttaagaaatactgtttctactgtggaacagtcattgttctagatgccgggatacagagatgagttcgatcatttcatatcctcagaagtccgtgctccttctgtaaagtcattgttctagatgccgggatacagagatgcgttagatcatttcatatcctcagaagtctatgctccttctgtaaagtcatttttctagatgttgggatacagagatgagtttgatcatttcatatcctcagaagtccatgctccctctataaagtcattgttctagatgccgggatacagagatgagtttgatcatttcatatcctcagaagtccgtgccccttctgtaaagtcattgttctggatgctgggatacagagatgagtttgattatttcatatcctcaaaagtctgagctccttctatgcagtcattgttctagatgccgggatacagagatgagttagattatttcatattctcagaagtccatgctccttctgtaaagtcatgttctagatgccaggatacagagatgagttcgatcatttcatattctcagaagtctatgctcctcctgtaaactcattgttctagatgccgggatacagagatgagttagatcatttcatattctcagaagtccatgcccgttctgtgcagtcatttttctagatgtcgggatacagagatgcgttagatcatttcatattctcagaagtccgtgccccttctgtaaagtcattgttctagataccgggatacagagatgcgttagatcatttcatatcctcagaagtccgtactccttctgtaaagtcatcgttctagatgccgggatacagagatgagtttgatcatttcatatcctcaaaagtctgagctccttctatgcagtcattgttctagatgccaggatacagagatgcattagatcatttcatatcctcagaagtctatgctccttctgtaaagtcattgttctagatgctgggatacagagatgagttatatcattttctatcctcagaagtctgtactccttctgtaaagtcattgttctagatgccgggatacagagatgcgttagatcatttcatatcctcagaagtctatgctccttctgtaaagtcattgttctagatgccaggatacagagatgagttcgatcatttcatatcctcagaagtctgtgctccttccgtaaagtcattgttctagatgccgggatacagaggtgagtttgatcatttcatatactcagaagtccatgctccttctgtaaagtcattgttctagatgccaggatacagagatgagttcgatcatttcatattctcagaagtccgtgctccttccataaagtcatttttctagatgctgggatacagagatgagtttgatcatttcatatcctcagaagtctatgctccttctgtaaagtcattgttctagatgccaggatacagagatgagttcgatcatttcatatcctcagaagtctgtgctccttccgtaaagtcattgttctagatgccgggatacagaggtgagtttgatcatttcatatactcagaagtccatgctccttctataaagtcattgttctagatgccaggatacagagatgagttcgatcatttcatattctcagaagtccgtgctccttccataaagtcatttttctagatgccgggatacagagatgagtttgatcatttcatatcctcagaagtccatgcttcttctgtaaagtcgttgttctagatgccgggatacagagatgagttcgatcatttcatatcctcaaaagtccatgctccttctgtaaagtcattgttctagatgccgggatacagagataagttagatcatttcatattctcagaagtccatgctccttctgtaaagtcattgttttagatgccaggatacagaaatgcattagattatttcatattctgaaaagtccatgctccttctgtaaagacagacacctgaagaaggcacttcatttagggatgaatttattagatcatcaggaaacatgatggtttgttggttggagaactgacttactttgagtaaaagttttaataataataaaatacttttatccttcaaaacacatctagttactttagagccgaaaaggaaaaaaaataacttttctaaataataatatccaaaactagagtgtgcctaaatcatttcttccactcactcatggacagtggtatggccctaggcttttggaaagtgataggaaagcacagagcctgcctacggaagtgtttacgaaaagggagagtctgagaccaccctaccccctcattcatcacttcacttacctggatagcatggggccagggacaaagggactttgctcccaaggtagatggggccagagttttagtgtttacgctcattccctgagaccagctcccatagagcaatggaaaggagaccagggcaggctgcacacagaaggggccacatctggggaggggggccctgtgcctggggacccagatctttatgatgtgcagtgagcttgccggcccaggctctggggaagagcatccctgtttgactggagagtgcagtgtgttctgaaggaagatatgatgtccagggaggcaggggagggttctggggcctgcggcccaggctgcatcagcaaccaggttcacctgcagcagccagaccctgtgagggaggcaggcattgtgtctgggccacctggccaggtgtggctggtagtgagtggccccatgagtgtgtgggggtgagggtgagtgtgcccttgacctggcaggcacccctcggacagggcagtgtgcttttctcccaccatggcaaagagcgggcactgcagatctgctccctccacctgccgtgagagtgggagcaactgtctccctttctccgcttcataattttataatttcggcatggacagaagaagcgtctgcatgaggaggctgtgggtccgggagaccagaggccgaggaaccaaatgctcccatcagtctcagttgctcaccccatgatctgtctgggctcacactccttgagcagtaaattcattcccttttagcattcagggaccatttccaatattcacaatttgctgtgagttccagggtgtattcagcctggaatatctgcatctagattggtgataccatttgagtctgtttactgttcacggtgaaacactctgggcattactgggatgacagacagaagagctaaaggagtgttattatttaatcaaatgaagctattggatgatgtccccaaaccgagagcgatccagagaattcgtgggaacatacatttgatgcatggctctgtgtgggctcttcacattaagaatgcgaaaccagctagagtcaaagtttccctaatttgagtttgattttcagatattttgctgcaattaagagcctgaaagtgtcacctattaataccttgcttatgttctgaagctgaggtcttaaagtaacatgcagccctgggctgggctgcaaactgtctgcattcggaatgacccatggctggggcccctgggaaatagcagcagatgaacagagcagactgtggcttgtggggtggttgaagcacctttccaggctctcctgaactgagctccccacaggctgggctctgcagaacatggacatgacgggaaagtgaccagccagcaagggagagtcctctgagctacacggcagttgcagggacaggaagggctggcatgggcagcatggcctggggacctatccgggggatccactgggtgataccctccacgtcactgtcaagagctgagctcagtttcccagacccctgctttcctgacgtaccccttttgggcccagattgtgttgtcccatgggtgccaggcaaaagaagggatgagacaggtgagccctcgagtgggtgcaggtgatgttctaggaagcagagaaagtggatttcatcaaaaggagcacccttggccttcagatctccagagaattcttgttcttcctattagccaaatgtcttgctcagatagattttagataaatgtctccaaggaaagcacgcgttttggggagggttgctatcctgtctaccatggcgagtcctggggaacctgcacaggtgcttacactctggctctgctgctgctgtgactgacaatgtcacttgtgtctgggccgagagtctcctgtctttggctggcatccatgaactatggctggctaatgtgttagttgtaagtagctataatctcagtgtcctcaaagttcatgactatatagtaccttttacaaacatgtcagccgatataaaacacgtgttttatattttaagttaaatgtcatacgcatttgtatgtacatgaagttatttctaatatatatggtgagtgatttgccccatcccgttggtgataagggagtttttgctcagttacttcacgtgagatctggttgtttaaaagtctgtggcatctcccccactctactctcctgctcctgctcttactccgggacctgaccactccccattcaacttctgccatggttgtcggcttcatgaggccctcaccagaagccaggcaggtgcaggagccatgcttatatagccagaagaaccgtgagccaattaaacttcttttctgggtaaattaccaagtctcaggtatttctttatagcaatgtgaaaatggcctaacacagaaaactggtactgaggagtagggtgtttctataaagatacctgaaattgtggcagtggctttggaactgtgtaatggcaggggttggaagagtttggagggctgagaagaagagagaaagacaagggaaagtttagaacttcctagagacttgccaaatgactgtgaccaaaacgctggtagaaataaggacagtgaaggccaggctgacatggtctcagatggaaatgaggaacttactgggaactggaggtagaggccgcctgtgctatgcctcagcaaagagcttggctgcattgtgtccaagtcgtgggcatctatggaaatttgaacttacgagtgatgacttggagtatctggcagaagaaatttctatgcagcaaagaattcaaggggtggtctggcttcttctaacaaccaaccatcagatatgagagcaaagaaatgatttgtatttggaaattatatttaaaagggaagcagagcataaacatttggaaaatttgcaggctagccacttgatagaaaacaatatcctgttttcagggaaagaattaaagggggttgttggagtaaccatttactagagagattagcatgactaaaagggagccaagtgctactatccaagacaacaggaaaagggcctcgaagaaagcatggtataagtcctcaggacagcccttactgtaacaaggccagagatctaggaggaaagaatgacttcagagtctagaccttgggcctctttgtcctgtgcagcccagggacactgatccctgtatcccagctactctggctctgggcttggctcagaggggcccaggtactactcaagccacagcttgaacagtccaagccgtaagtgtctatagctttcacacggtgttcagccttcaggctcacagaatgcaggagttaaggaggcttagtagcttcccctagatttcagagaatccatgaaaaagcctagtgcccaggtagaagcctacttcaggggcaaagccctctcagaatgactctactagggccatgctgagggggaatgtgaggttgaagcccccacacagagtgcccactgagacactgcttaatggagctgtgggaagggggccatcgccctgcagaccccagaattgtagatccaccagcagcttgcactctgcaactgaaaaagcctcaagtgctcaactccaacccatgagagcagccaggtgggctgtgttcagggaagccacaggggcagagctgcccaaggctatgggagcccattcctcacaccagggtacaggacacggagtcaaaggagattgtttcagagctttaagatttaatgaattgcctgctgagtgtagactggtgtggggcctatcaagccttcctgttggctgatttctcccttttagaatggaaaaatatacccaatgctggtgcccccattgtatcttggaaacatataactgcttttttatctcagaggctcataggtagaaggacctcatctccagatgagactttggacttgggattttgagttaatgccagaataaattaagactttgggggactgttgcgaatgcgcaattgtattttggaatgtgagaaaggtgtgggatttgggggaacgggtagaataataaggtgtagatgcttttcccccttaaatctcatgttaaaatgtgattctggatgttggaggtgaggcctggtgagaggcgattggatcacaagggcaaatccctgatgaatggtttagccccatcctcttggtgatgagtcagttcttgcccaggaagtccatgtgagacctggttgttttacgttgtgtggcacctgcccgcttgacctcttgctccttctctcaccatgtgagacacctgctcctgctgcaccttccaccatgactgtggcttcctgaggtctccccagaagccaagcagatcctgggtccatgtttgcacagcccgcagaaccttgagccaattaaatcccttttccttatgaattacccattctcaggtatttctttacagcaatgcaaaaaataggttaacaagtaagctttttaaaaatttatttttattgtatgtatttccgatgtgcaaaatgatgttttgatatacaaatacataatgaaatgatcactaccgtcaaacaaagttaacatacccatcaccttccgtagtgattggtgtgtacatgtggtgagagcacttaaaatctctcttagcacattagtttttagtattcaatattattaactacggaaggaatacaagtgcttagcacagcacctaaaactttattttcactcagtaagcactatgtattttggggttattattaataaacaaaaatataaacaatgcatttaattatggcagaacaactgaagagaacaactaggtcacttttcccaaagccacagtaggtgattctgagccctgagcctcatgtctaacttgcagagggaaggaggttctcctgccagctctgtagttctgtctggcgtctgacactcgcacacctgccaacacctccccaactctactctcttgctcctgctcttgctctaggacctgtccactcacacacctgccgtggtcacttgggcagtgctggcctcctgtcagctggagaggccccgccctgcaggcgactcagccagggcagctgtctggagcccccagagcacagtccgctgtggtcactctgcttcttctttgaggcctggccctgccagctttgctgccaaaggtgattgactcaacattcagacaagaaggatggtgaacttgatgtagtcctcccttgggtcctggggactcagtaattccattctgcaggtgcctggacaatgctctgatccacccaggtgttggcagcattgttgcaaaggtcacctctgtgctttctctccaggttccccaggtcctcaaatgctagtaggcaagccagttgtgaaaccttggattggttccgtgtagctgctgctgctgagaatctaaaaaggccaggtgcttgtgtgggagaccaggagtaaggggaggcctgcaggtgaggggaggccccaggtgtggagaggcctgcaggtgaggggaggcctgcaggtgaggagaggcctgcaggtggggtgaggcctgcaggtgaggagaggcctgcaggtggggtgaggcctgcaggtgaggggaggcctgcaggtgaggggaggcctgcaggtgaggagaggcctgcaggtggggtgaggcctgcaggtggggtgaggcctgcaggtgaggtgaggccccaggtaaggagaggcctgcaggtgaggggaggcctgcaggtgaggagaggcctgcaggtgaggggaggcatgcaggtggggtgaggcctgcaggtgaggagaggcctgcaggtgaggagaggcctgcaggtgaggggaggccccagatgaggagaggcattcagatgaggcaggcttcacatatttcttattctatgagggtgtgtttagctctcactgtgaacagctttgctgccccgttctagggctgcattgagccaatgctctgcactggagtgggaagggaagaagttggagctgggacacatgcagcttctgcaggctttggctctgagatcagggcagggctgtgcgcttcccagtctcctgtttcattagctgggatgtaaacaaatcatatcttggtttggatgtgatggcctgtccgcaattgttatgagaatccaattcattctgatttggcagttttgtaaagggcaagtctgtgccattttcctcatcattcaatactgatgcatcacttacaccctattcctgttcctaaacccagtgaccccgtggacagcaactgcacatgttttacctgtgcacaccccgcagtgcctgtcacattgtctgggacacagtagttactcaataaatgtctgcttaattaattagtaattaagtaccaaagataccatagacaaataatctattttatatcttctttatgtgccatagaaacctcaagaaaagaggaatcctttctccagctcagcttctgtctttttccaaacttcctgagccaacaagcggagtgattgcccgagcagcagagataatggaaacatcaatacaagcgatgaaaagaaaagtcaacctgaaaactcaacaatcacagcatccaacgggtaatgtgtgcccctctccccactgaggagcggcaactcccgaaggaggacaccttgactttgtgcaggggctgcttgctcagggcatgttttttacttgagaccaagcaggatgggactccagctctttcaaagcatacaagctgcaatttttaaaaatgcttaccaaacagtctcaatatcttatttttgttactctggaaaatagccatttctctcctatccaaatcaaatttgagaagtagctcaataagctaaacatccattttttatggtataaaataatttaggaattttcccatagcccccctcttagttaaaacttggcaagctcattcataaaacctctacagtgaaaggacttcatgtgtgaggcagcgcattgcagggagccccatcttcccactgagttgctggtgcctcagcagaactacccaggacatttgagagccaatttactcatctctaaaatgaggacagtggcactgctcactccaatggctatcagaagaccagtgcataaaccaggagcaaatgtcgtcatttcttcagctctaaagcactctatgggcataagatactgagatggtaatgcaggcattcaaaagtcatattggtgcttcctatgatgcagagcaagtaagcgaaatgtctttttaattaatttatcaagaattttttctctgcagcgccatgagctacttggcctctgagttcttccttctaactagctatagatcaatttggtgctggttacttagcttttagaataagacaaacttggctaaatcagtattgaccagaattctcaaatcctaaacttaacagtgaagtttaattaatttcatagcaagctaagattcaccactttgaaatgtcctttctttcaaaccatatggctgaacgatgtttctaagaactctcggtccactgtcctgttacgggacactgtcctgtccactgtcctgtcaggcctcctatggaaatggcagttcctgacgtcagaagatgtgggtctttctggtccatgccttagagccacatgctcactgccgggtctgtagacatcgatgtttaggagaataggctgaggtatttggtccaggctataatgtagaacttaagaactccataatttagaattttttaaaatgatttccgttgtaagtatagcccatcttgaaaatttagaacacgaggaacctaaaaaggtttcccattacttcatcaccaagacagaattccattaaaggtcagtgcctgtccttctaggctgctccttcatgttggtcttgtgtgttacatgactatgacctcatagttcttttcttctttttttttgttgagatgaagtctccctctgtcgcccaggctggagtgcagtggggcgatctcggctcactgcaagctccgcctcccaggttcacgccattctcctgcctcagcctcctgagtaactgggactacaggcactcaccaccacacccggctaattttttgtatttttagtagagacggggtttcaccatgttagccaggatggtctcgatctcctgacctcgtaatccaccctctttggcctcccaaagtgctgggattacaggcgtgagccaccgtacccggccaatggttcttttctatcgcacatgatttgttgtctgcaagcacctgcttgagggcattcctgtcaagaagaatctgtgctcagctttttgaagaatgcgtaatcctccactaactgaatgcacactgcagtccaaggtttacttaactgttcccatagagccattcccgttggactgttagtgagcattcatgattgaaagactagtttgtttctctcatatctgaaaatggaatgcattccttcctggcttttttttcttttgaatatctcaatttcactggtatcttgttaatcaaagttttgtggcattatcctcaaagatttatataaaccatattggagaagtaatcgatgattacctctactaatggacaataaagccactctcaccttgatttgttgaataacatataaattatagtgacagaattaatccaaaaaaaagaaaaacaggaaattgtttcctgggttctcgtctcatctggaaagatttacaagggaaccaaaaatcaatacaaaggaaaaacgaaaggttttatagataagcgtaccatcttcatcaaggcaagattttttctacattagggttcgggataaattctactcctcactgtcttctaaagcactggggccattactaggcacacatgcctcactgttcgaatatgatgaatgagccctggagatgtgcttagtgagagttgatggtaactgcaaagttacttgctggcttatccccctgagggctgagagctcctagattgcttttctgaaagatcacagagcaaaaataaattttaaaacccccacatttctagcaataaggaagctcaagggaattaaatgagtgagcacttgatgtaaagggagaaggcagattttctcaaaaacagtgaccccagttacatatgaatcccaaattcagatgctggagtcacttttgagactgcaatagaatatttgttaggtggatttgtggttacaagcacagaattcatggtttcctatttttcacagatgctttatcagaagatctgctgagcatcattgcaaacatgtctggatgtctcccttacatgctgcccccaaaatgcccaaacacttgcctggcgaacaaatacaggcccatcacaggagcttgcaacaacaggtattgtttgtggattttcttaatcttctcgtgaaagttggatctgaacatgactagatgccatcatgaaggaacttctaccaccactggtggatctgtatccacccctgagcccctggttcctgtccttggcctccccgacatggcctcctgcatgcctggtggtgcctcaagcagcgtgccaagcagtactgtcattcccagccacaacgtcccatccacataggtgcttacaggtgactcttaacttcctaaccccacaaattccaccgcccttcacctaagagctcaagccacgtgcttaggcgccatccttgatttcgctagctccgctacccattgtttccaatgcacccccaagactgtcacttttacctccaaaatgagtcctctccactccctgtcaccttagctgaagccaaaataaccatccagctgccatcacgtggtggtcccctcactggttctcctaatttaactcttgctttccccattcacgctccctgttatggccaacaccatctcagcaccctccttctcaactcctccctcagtccccactgcactcagagtgagttcagatccgcccaacagtggtgactgcccacctcctctggtccacaatggcaggagatggacaggagctttggccacacacagaggcatgtgattcagtctggggttcagaatggttttctgaagaaggtgatatgcgagtgagccaaatcttaaaggatgagtgggcatttctcaaatggtccacagggtagagaagagggctttgcaaaggccggaaagagcaagatgcgtttgggctgaaacgtgcagcctttggcacacagaggggcagagggagagcagccgggattgtggcgcctgtggggtctgggggaaacagtgtgcccggtggtcacctagaagctttgtcacaatagtgtggcgccaggatggctgcaggcttgatgttcaccgatgcaggcagcaaaggtgcttagcatggaagaactcctcaaagggactcgagctcctcactgctgggtgtgctgaggtcagaaggaagatgccccccccgagagagggatcagcgggacccaggcagagccctggcttggacaggccctgtcctgagacagagagcaggggctttgcgacaatgaacaggaatcggggtcctgggtatatgatgatggttaagaacaacagctttgcaactggacagccctggatttgaaacctggaatcaccacctatcagagggcagtttgtttcaattctttgagctgtaagagcttgtttgttaagcccacagcaggaatgcataacctggccatgtgtgaggatctgatcttaggactgcggagccccggctggaagaggcagcctgtgctgaacacagagatgggtcagggccacacaggaggctgctgtccacccctcctgccctgaagcctgggggggggtctgtgccttcccgtggaagtgggctcagaggtggagatggcatgtgtcctgtcctcagagctcagtgggagacatagatgtagacaaaggatgcacaggagatgatgcctgggagtatggggacactgagatggctggtgggatgcacggctggagggaccaggcctggatggaggaggggatggggctggagggcctgggtggaggagggcagggggtaggtgcactgttgagtcagaagccggagcggagatggcttggactacacggggaggagcagggtcttcagaaggacagggtggggtctaacgtgcaggtacatgttgagggtggggatcccgggggacagtggcgttggagatgtgggggcggggctgctctctgaatgggtttcatacttctgattttattaaagaaatataagacattgaattctgcattcctaagcacaattatcttaagaatcagcgagtcatactttccatatgttttcaacacctctagcgtgtcttaaacagcgttaacaagtctgggactctccgtggcccgaagcactttcaccagaggggtccgtgatggagctccttgggttctaggttttccttgagacctcctaacttttttccatttccttttctgcctgctgccttctgtctgtcagccatgacccagacctcaggtgcattctgatggctctccctacggaggtcgacccaggggccaccccccacccacccccaccctgccccacgtccctcctccacgtcagggggatgatgaattcagccatgtgcaacatcgtgggcatccttaaagcaaattgcagtggagggtgaattacagtgcttggggaatccctgagcaaagccagtaggcctcacacatgatctaaatcttgcttgatttgcaaacagaagagaaacttaactggagatttttttttttttttttgcaaatgcctggattaaagaaaaatgaaatataagcccgaccattccgaaactgccaactaacctgtttaactaggaaccttccagcaggacagaccaaataatgcgaaactgaagccagtcaaagcttttctccaatgacgtctacatccacctgcaaagcctgcccctgggtcctgcagtagagcctgaacctttctttggtttgatgcttcctgattcataaatcatgatcactcaaaaaaaactctttaaaaaatgtattgtgcctaagtttacattttaacaacctcaagaccagggcctcagccggcagcagtgagttcctgctcggcccttctgaaaggccctgctgctgtcttgggcgcctctgccccagctgctgggcgggctccactgacgctcctgggagaatctctgctgaccacacaatgacattggcactgggagctgtgatctggggacacttagatctgagctggtttctctccttctgtggtaacagctacagttttcattaagaattcacagcatctggatctaaaatctcctacgttcaaggcttcacacattgtattccaccaaaaataaaacatctgctcagaaatcggtcacttgttgttataaaagtgagccacagagggcccctgacccttggcccctgggtggtttattttttctctgcaggcctgttagtgccaaagcccaccaagaccaagctcaaatttactcatgcccaattgtgataaaaatagcccaaacaagcagacttttagccacttggagcctacctctttgcatcttccacaaaacctctcccagcatctcaggccgttggtaagatacagcctcgtggtcatcagaccccaggtcgctgctgtctctggagttgcctgcccagagactccccctctccccctcaccatgttgctgagtaatgtcaccagacatggagaccctctgatgccccactgtgagttcctcgccatcctccccatctgggtggcggtccctcaccttagcctctggatggtcccctgccttgagggatgtcccctcttctgcacctgtgcccaagaaccaccccaaaggcatgtgtgtgtctctgcctccccgatcctaacttttgccttgctcagccctgagttcccagagcttccccacacccactaaattgctaagttcccccccagcggtctcctaagccgcttcggcgtccctctcagtcaccagcacctggttccccacccacaccttcccatccttgtctgggctggtgctgcatttccaatgtgctgcgtttccactgtgctgcgtttccaatgtgctacatttccactgtgctgcgtttccaatgtgctgcgtttccaccgtgctgcgtttccaccgtgctgcatttcctgcattccaaagcgacctttgggtgttggctgcaatgacatctttaagacaaatgttagttggaattaacttttgaaattctaaatgtcgaaatggtggattttaaaactcatccatttctactagttttcttgctttatggtgtgatgtctgcatgtcacaagtggatggcagggtttctaaggcttgtttttcctttgttggtattttcctaattgcctaggacgtatcacataaaattacttaacaagtagtggaaaagaatgatttttctttcaccatttcacctggacattttgtttgtatggtgtagtcggtgccgcaggagctaccttgttgaaagagaagggggcaggctgcttctcctttgtgtggtgtagctaatgccacacctgtacttcttgtttgtatgaagtggtcagtgccacaggagctaccactttagaagggaatggagcaggctgcttcttgtttatatggtgtagtcagtgccgcaggaggcactatgttggaagagaatgggcaggcttcttcctgtttgtatgatctagtcagtgccgcaggacgtactatgttgtaagtgaatggagcaggctcattcctgtttttatggtgtagtcattgccgcaggaggtactacgttggaagcaagtagggcagggtccttcttgtttccatggtgtagtcagtgccgcaggaggcactacgttggaagggaacagggcagggtccttcttgtttgtatgatctagtcattgccacaggaggcactatgttggaagggaatagggcagggtccttcttgtttccatggtgtagtcagtgccacaggaggcactatgttggaagggaacagggcagggtccttcttgtttgtatgatctagtcattgctgcaggagctaccagttgtaaatgaatggagcaggctccttcctgtttgcatggtgtagtgagtgccgcaggaggcagtacgttggaagggaatagggcagggtccttcttgtttgtgtggtgtagtcagtgccgcaggagctaccgtgttggaagggaatggggcagactccttcttgttggtacggtgtggccaatgctgcaggacgtaccatgttggaagagaatggggcttgagtttgttttgctttacactttgtcataaaggaaattatcagttctctgcataagcccctattttttaacaagggggtgtgtgtgcatgcacggcaagctggtccctttaaacattttagaatctctaaatataaagcttaagatattaggaatgctgttgataactgtgcatttggggtgaaggtgttttggtagtatcatttaaaggatttccagcttctttctgtttctgttaccaacctgtggagacctcttcatcatcctggactcagatcagggtcctcgactctgctgcgctcccagccagctgaggctgttgttcctcacctgtgtgtttttatagaagtctaggagctggggggtaggaggtgggtgtgggcaggggtcacgtcacttgcaggttgcctttgctagaagcagtcacattggctgagaacagaatccccagggcctgaggatgtcctgcagaaatttgggttttagtgtgtagcttggcatcagcctagagataagacaaattctattttaaaaatcaagtgctccatggcgggatggtgatatagttggctgtgtccccacccaaatctcatttgaattcccacatgttgtgggagggaccaggtgggaggtaattgaatcatgggggcaggtctttcttgtgatgttctcgtgatagtgaataagtctcacgagatttgacagctttataaggggaagttcccctgcacaagctctctttctgcctgccgccatccatgtaagacatgacctgctcctccttgccttccaccatgattgtgaggcctccacgtggaatcgtaagtccattaaacctccttttcttctcagactcaggtatgtctttatcagcagcatgaaaacagactaatacagatggagtaggggagggctactgaagaaatgaagcctctcagctactggaaatagatgcaatcagggtggaattactcacggacagtcctccagaggcagtggggtcattgtggagatctgtgtgccacaacagccagaaaacaaaggggccacgagccactgtttgctctgtggtctaaatcaatggactatcttaccacatgcaatgttagacagtgtattacatatgattattcataagcagaaatacaaatatatattatatactgtaagacagtattcattatatgataaatatgatgaattcacctagatacttcatatagaatttgccttcagttttagattgatacatgtgataagaacttctctgtgtgttcttgagaaagtgctcacattcccatgcataatggaaaggacattgtattttgaaatagaagacgaaattccagccaccactttgtcagttacaagctgcttagacttcatgtcttgcttagtttctcaaattctctgcacctggaaactggcaaagatagtgatgctcatttctagggttgtcatgaggctgaagtgagacaatgcagcagaaataatttgtgagcaataatgatacaaaggtcagtgattgattatgtaaataatggccacctttgaagcccctttcttcaaagagtctgagtcttgattcttgaagaggtgtgatttttctttgaaaaattgcattatttcttgctgggcactttggctcacgcctgtaaagacagcactttcggaggctgaggtcgggggatcgcttgagcccaggagctcaagaccagcctgggcaacaaagcaatacctcatctctaaaacaaacaaacaaaaaattgtgttatttcttgagttttgatctgatgaactactgcagtaaaccactgtgtctcacagtgttggaagggaatggagccagctccttcttgttgtatggtgtaggcaatgccgcaggaggtaccgtgtttgaagggaatggggcaggctccttcttgtttgtatgatccagtcattgctgcaggaggcaccgtgttggaagggagtggggcaggctccttcttgtttgtatgacccagtcattgctgcagaaggtaccatgttggaagggaatggggcaggctccttcttgtttgtatgatccagtcattgttgcaggaggcaccgtgttggaagggaatgggcaggctccttcttgtttgtatgatccagtcattgttgcaggaggcaacatgttggaagggaatggggccggggccttcttgtttgtatgatccagtcattgctgcaggaggcaccatgttggaagggaaagggcaggctccttcttgtttgtatgatccagtcattgctgcaggaggtaccatgttggaagggaacggggcaggctcgttcttgtttgtatgatccagtcactgctgcaggaggcaccttgttggaagggaatggagctggctccttcttgtttgtatgatccagtcattgctgcgggaggcaccatgttggaagggaatggggcaggctccttcttgtttgtatgatccagtcactgctgcgggaggcaccatgttggaagggaatggggcaggctccttcttgtttatatgatccagttattgctgcaggaggcaccatgttggaagggaatggggcaggcgccttcttgtttgtatgatccagtcattgctgcaggaggtaccatgttggaagggaacggggcaggctcgttcttgtttgtatgatccaatcactgctgcaggaggcaccatgttggaagggaatggagctggctccttcttgtttgtatgatccagtcattgctgcgggaggcaccatgttagaagggaatggggcaggctccttcttgtttgtatgatccagtcactgctgcgggaggcaccatgttggaagggaatggggcaggctccttcttgtttatatgatccagttattgctgcaggaggcaccatgttggaagggaatggggcaggcgccttcttgtttgtatgatccagtcattgctgcaggaggtaccatgttggaagggaacggggcaggctcgttcttgtttgtatgatccaatcactgctgcaggaggcaccgtgttggaagggaatggagctggctccttcttgtttgtatgatccagtcattgctgcaggaggtaccatgttggaagggaatggagctggctccttcttgtttgtatgatgcagtcattgctgcaggaggtactgtgttggaagggaatggggcaggctccttcttgtttgtatgatccagtcattgctgcaggaggcaccatgttggaaggaaatggggcaggctccttcctgtttgtatgatccagtcactgctgcaggagtcaccatgttggaagggaatggggcaggctccttcttgtttgtatgatccaatcactgctgcaggaggcaccatgttggaagggaatgggcaggctccttcctgtttgtatgatccagtcattgctgcaggaggcactgtgttggaagggaatgagcaggctccttcttgtttgtatgatccagtcattgctgcaggaggtaccctgttggaaggtaatgggcaggctccttcttgtttgtatgatccagtcattgctgcaggaggcaccatgctggaagggaatgggcaggctccttcttgtttgtatgatccagtcattgctgcaggaggtaccatgttggaagggaatggggcaggctccttcttgtttgtatgatccagtcattgctgcaggaggtaccatgttggaagggaatggagctggctccttcttgtttgtatgatgcagtcattgctgcaggaggtactgtgttggaagggaatggggcaggctccttcttgtttgtatgatccagtcattgctgcaggaggcaccatgttggaaggaaatggggcaggctccttcctgtttgtatgatccagtcactgctgcaggagtcaccatgttggaagggaatgggcaggctccttcttgtttgtatgatccaatcactgctgcaggaggcaccatgttggaagggaatgggcaggctccttcctgtttgtatgatccagtcattgctgcaggaggcactgtgttggaagggaatgagcaggctccttcttgtttgtatgatccagtcattgctgcaggaggtaccctgttggaaggtaatgggcaggctccttcttgtttgtatgatccagtcattgctgcaggaggcaccatgctggaagggaatgggcaggctccttcttgtttgtatgatccagtcattgctgcaggaggtaccatgttggaagggaatggggcaggctccttcttgtttgtatgatccagtcattgctgcaggaggtaccatgttggaagggaatggggcaggctccttgtttgtatgatccagtcattgctgcaggaggtaccgtgttggaagggaatgggcaggctccttcttgtttgtatgatccagtcattgctgcaggaggtaccatgttggaagggaatggggtaggctccttcttgtttgtatgaaccactcattgctgcaggaggtaccatgttggaagggaatggggcaggctccttcctgtttgtatgatccagtcactgctgcaggaggcaccgtgttggaagggaatggggcaggctccttcctgtttgtatgatcccgtcattgctgcaggaggtaccatgttggatatggtaccatgttggataagtggcacagtggatagaatccatcgccatagtgaccatgagtggattcctgctattaaattggggtacgacttatgcagggcttgggggtgaatctggagggacaggtggccgagtcttccatgggcctgcacccccagatgagaagcccccaggtgcagatcgagaactgtacaccccagagggctgccttctggcccctcctaggttttgacatctacccagaggtgaccattgctttgatcttcatcaccatagttagttttccctgacctggcttttataggaaggaagttagatggtaacccctgggcctggcttctccacctccaggatttatttgctcctgccttgctgagggagacactcatcgttacagggcaggcatgggcgcctctctgctgagcactggtcaatgcttccaagtggctgctccaatctgcattcccaggagcaaagtgtaagagccccacagccctcaccaatccccgtcactgtgatccctttcattttggcccttcttgaggggagggtggcatttcctgtggtttaacttcacattttcctggtgactaattgtcttgagcacttttaaaatacattcattggccatttggagactctttttcgggatgtgccagttcaaacatttttcccattttttaatgaatcttttttgatttatagatgctcatattttctaaatatgtcttcagtgagaaatatgttttacaaatgtcttctcccagctgagattggccttttcactctccatgctgtcttttgaagaaacgttgttcatatttttaatgaagtcccctttatcaattacttatttcatggaaagaaaacttttttgttatgtttaagaatcttgctttctctgaagaatgtgaaggtatttttcttgtgttttctgctgaaaatgttattgttttacatgtcacatttagatctgtgacccatctcattttatgttttctgcaacatacgaggtggcaaccatgaggggtgtgtgtgtgtgtatgtgtgtgtgtgtattgtaaaccaaaaataaaattctaagtcttgcgatcatctgaattgacccctcctgttggcaagggtgttccaaagctaacctgaaaaactaatctgaccgtgatggggagagtgaggtcagacgtgcctcatgacaccctcctcccttttggaatttctgctagaacagacttcttaactctgagaagaaacatttacagtctcttctctcagaagcctgctgcctggagacttcacctgcacgatgaaaccttggtctccacaacctgtgtcttaacccagacagtcttaagtccttagacgataactttactctttcaaaaaattgccactcagaaaatttttgaatctacctttggcctagaagcccccgcttccagatgtcctgcctttttgtactgaaccagtgtacatcttacatgtatttgattgatgtcttgtgtctccctaaaatatatgaaactaagctgtgcctcaaccaccttggacacaagttctcaggatctcctgagggctgaatcattggccattggtcactcatatctggctcagaataaatctcttcaactattttacagagcttgactcttcactgacaatatctataagtgtttgtgtatatatagaggcatgtatatataggtagatttgtatgtgtgtgtgtatatatctataataaacacaggtctatatagaggggtgtgtgtgtatgtatgtatagatatgtgtgtgtgaaagcatgtgtatatgatatttattcagaaccatcctttacccagtgaactgcacccatgcctatatcatgaatcgagtagccacatgtgtgtgggcgaggactgctagactcttaccattatgtatacaattatgagagagagggagagaacctgagttaaacaattagccacatttctctttaagcctactgagaaaaagacacagggacccagcagacatcagaacaccttgttggggcagctcgcactggggcgcaggtggcagaagcctcacgggattctgtacagcaggaagagaggccggcttcagcccctcctgcctgacagcacaggggtcttgcctggcctgggaggagccgggattggaggcaggggctgctcctgcctccagaggtttccaggagactgcatgttgtgccctgccggcatccacacatttgtgtagtacccactcccagacaaggacactcatagacttcctccggcctcgcgtgggagccgagcctgtggtctgcatctcgctgtgctccacgcagctcctgcatgcagctcctgcacgcatcggctgggctcgcagatgtcaggtccgcctcctttcctcttccctgagcctctgccgagccctcccgacccgagggtcggctgctcccttccccgcctgagtcacttccgtgactctcttcatcctcagagccatccccttcctcatctgtaatgtgggaagaacacccacctcgcagggttgtttctggttgaaaggcagcacttgtcaggctccttgcacgctgtccacagccggccatcgtaagagttacggcgactgtcacctctcagccactcctcggcatcggacctcttggctcctggccatggcattgaccacagaatgtcataaacagcccagtgtgtttttccacgagagcagtggtcggaggctcctgcaggtaaatggctggagattgattgacgtgggaatatcacggcatcacagaatcagagcacatttgttcacggtgcaggaataacatcaagtgagtggtgagctctaaaggacctggccctcgaggtagctcacaccctcgatgatgaatggagccaggccacaggtgaaatttccatccaggcgggacagactcaagccgggactgggttcccctgacgcccggcttcccaaatgtgcttccctcccggatgcacagagaacgaacgtggcatggacattgtgagctgcaggaagcgatcccaccagggatcaaaaagccaacttcctccagcggccattctgcactaagcctctttcgtggagttcacgttctgtccaatacagccttaaagcccatgaacaattctgggggagacgatcaggtctgaaaggaaaattccatatgggtatttaagttattggaagaacccttaagatctacctgggtttaacatagaatttgctatatgtaacttggtatatcattctctatagtcatttgcctaaaaatcatcaaaagtataaattcaatgttgcatctcccatccagatattttgtgttaaaaacacctcatatctgatgtctgacagctattttctttttttctatgtatttgccttgaattcacattcgtagtcaccttttttccctctcactttgtttttcatttgcattttgacctaattcatgaaattatccagcagggagagacctgatggagttttgctggaatgaagctccttgacacaatcgtctcctttttagaagtgcctgtagattgaaagttcaattgctcaaaacagtttgctaaagaacaaatgtgtgtctattaagagtttaagttgcacttgtaaatccaccaatggcactaagatatcatttagcaatattgacacttgaagtgataaaaaaacagaaaatacctttgacgtcaaataaatgtattagtctttaagaaaaaaagaggtggaattgaccttggtgtcttatgaaatcgcagaacatatgatgggtataaacaatgccagaataaacaagattttcaaagtttttggaaaaagctgagctcatgccgattatagaaagcatttgcatcttttgaagggttttcctctgagggttcaaatgtccctcagggatcatgctggtgataatcccagctcacaaactgactggtcttaattgccttcaatcaagtagctccagcaggagacgggaaaaatcaccgctgagtttcctcatacttctggccacctgacagggtgtcaggcgtttttggggacaaaatgaatcctcgcacacctggcccagcaggatgagggcatcccgtgtcccgctgctgccccgctgagaaagaggtgccgttacaggagtggaaagctgacttcgtccacagtttctctcccagcatttcacactgcattgctgtttgcttcttttcatgggcggcacacatctctggcactcagcgtgtccatgtgctgttactggatggccatacctggcaaacatattgacctgtgtcttgcggcctcagtccacagctttatgctcaagcgctcttcaagatggaagtttagaatttcttctttttggaattcagaaatcacaaagtctccagtgccaggtgcctgggagaggggaactagggtcccagggaaatcagagtgactcggagcctcagcaggagcacagacctcagtctccctcataaaactctcctccagaaatgtttctctttgttcattttgtcagctttatgagcctttttccaatgctgccattaattcagatctaagaaaggaacagtgtggtacaatagatttccactgggaaaggatctttccaacaggagctgatcaaagtctcagagggacccttctcagtcctgctgacctgctgaccgtgaaggtcaggtgacacatttgcggagggtccacaacaaatgtctgtgagtgcccttgagccattgtaatgtcctagtgaactgctgacatataaaagtcaatcagcaaaaaaaatcactgcttaagcagttaaattaacattatttttaattgagtaatctaacacctccctatgagccatactttatggaatttcaataaagacaaaccaaccataacgaatctgaacactttattaaagcaatctttccaatcttcagttgctgacgtattgcagctgattatatgcattactctcccatacatttttgcaaattgagccactttggtgtgctggagattaatgaagtattaataacagaattattctccccttatggtccctgcagacatagagaagtaaccatgtccccaagcctcctgccgctgctgaccactcatcatccaatgtgtcctggatgaggtagcagctggtgcacaacagtaagaataaaagctcctctcctctaatgtacggagctgcgtggtggccttagagacttttaaactggaagagtctcagctcttcagtctacctcaaggacaaaacggatctttccttcacaaatgttgcccaggttacaaacagttcttagtagaaccttagtcctttcattcctgtgcagaacatctaaatcggtcacatttaatacgaatgactaatgtatgttataaccataaaggcgatggtaatttatgacaaaaccactaatttttaaatatttatattcccaaacactccaaatgttttaaaaagttatttatcttgtcacgattcttgtagacttcactccttgtattttttaagtgtgtacatatcagatacatgggaggattttcaaagcctgcatcctagtcacgcctgactcttttgtcatgtgccttgcaaagcctcccaataccagttgtccatgatgcagcttcagactctgcagactcagccctggttgtgttgcatgactctgcagctgccacacacagaacctcagtgctggttgttcccacacgggcgtgactgacagataccaatggaacccggatatcatgacaatgttagacccaaaacaatctgtatttatttttaacaaaaggaacctacttttttccacaaaaaatttctatttttttctctttgaattgacttttatattctaattctctcatatttccttccaaatgcagaataatttatgccttataaattgagccattttcttccaaatgtagaatattttatacttgagaaatcctttatttttaataagttttacatatttctttacctatcctctacagatatgtatgctcatgttatatatttgatacattcatttatatattcttcacattcatatagtcttaccatgcatttatatatttgaatatgtattttattttgcatgttactttttatgtattttataaatttaaatttcatatttagaaaatgttcagtgagcacaagggcctcagtgttcattgttttcttcaagatttagttattttttacacattattagaacacaattgatttaataagcacggatctatgacagatgttggtaattattatgcatagagataaatatttattggaattagtttattgatgagatgggtggagttccagttagttccttcatcagttggctgaacatcacctgtgggccaaggggccatgcaccctggttacccgagatccttcctatttatgccttctgtcccaggaaattattaataactaatagtgctcctgtctcctcaaaagtattccactttggttaggaattatacggttgccctacatactatagatgagacagttcagcagcaaccctgtgattatttttacctttgcagatggaaggtgcctagaaacctgctcctgtgactatgtcgctgggaacagttttgccataggaatgccatctggccctcaaaactccttctgagatatagaagaaaatgaacatgtaatgagctatcattaaaatgatttttattcatgtatcagcaatcaattcaataacattgtcctccaaatttctaaacaaaatattggaaaatacctcatttgcacaaaggattagttaccaatctttagtcttttatttcctcagtttctagaagatgctctgagacatatcaagtgactgttaattgtgcctacaccccttcaacttaggggcaccttgcttaacacagtacactcggaactaagtgtgaaatcaaaatattcaacacacctttaccttatcatgcacttcaaatacatttttgtcagaatatattttgaccaatagaacaaaactgcagaccagcctacttatgggaaacttcaccatctagcctattggctgaagccattgtcatcgccaaatcaaacagccaaatacaactgactctctctctctctcaggagagacttaactttatttttaacttactttattttaattcaaattcatttattaatggttcctttgacaacccgctcacttctgaaatcagaaaaccagcaacttcctcagttcccacaagttcgcctggacaatcacacgggcaggaacaggcgcgacaccctggtggcttcatggtgctttgattaaaggatgttttatgccacaggatttcaaatgatctctttgtttggagtaccagaagtttctgtcctccagagaactgcccctggtacattctagaagggtgggagaccctccttcggaaaacaggggagtgggaaggaaccctgcaggcagccacctccagacagcatgtgctgagctcgggagagggtgcctgtgggaaccaagcctctggaatgagctcccttgaagccagtcatgacctgggcctccaggaggcctttcgggtcttctggggagctgtgccccttgggcctccggagagaccccacttattctccctgagaatggtgtcttatatctggaactcactgcttctgtgttcttctcccccatctcaaacacatccttgcatttgtctccacagagaccaccccagatggggcgcctccaacacggccctggcacgatggctccctccagtctatgaggacggcttcagtcagccccgaggctggaaccccggcttcttgtacaacgggttcccactgcccccggtgggtactcagaacgctactatcctggactaagattgggtcctgtgatgctgagggagggaaatagccttttactgggttcttgctcgtgctgggtgctgcgtgcaatcccttcagatcctcccagcctccctttgatgtagcaatcactgtttctgccctatggcttaggagccaaggctcagggagattgaaatctcttagtgagtggaaccctgcagatttaaattaagttttctcaaccctaacgtttctgttcctgaaaatcacttcagtgttttcagataaattcctttatccatcatgtgggctaggtacatcccaagatgattatgagttcagcaatccacttgttgatgtaaagatgactgctttactcccagaggtgaatttatttgctggacactcatagcctagtagaatctactggtctatttggtcaaaaaatgggtcattttgcctgtaatttaactactcatttcaatgaataagccagcctgtttgctcttgtgccatgttcagtgatgaaattatctagaaatacatcagtggatgttctgtttagcccaaagagcgcaggtggtgggactcaggtctgactcagaccagctgtggacagatacaccagcacagagttcccctacaaaagccaacaactttacctaggcaattttcctaggcgggcttttagtaagaggacctggtattcccagaagccgtgagaagccctgggtagagctggaggctgtgtcactgaagacggctcggtgctcccagcagcagggacaaggcaattgggctcacgctctgctcccactggcttcctgcaagtcgctttccttcttggcctcagttggacaatccctaaaatgggataagactgtcttacccaccttatgctcaacagtggaccagttcaacccccgaggctttttaaactctcagtattatgagattgtgattctgtaaacccatatttgctcagaattatttcactattgagaaaaatcagagttcaagtgtctttaaatgaaattgtgttggttttctacccagctgtgacaaattgctccaaatttagtggctgaaaacaacataaatgtgatcttccaatttcacaatcagtgtctgatgtctcacttggctgaaatcaaggtgttgcagagctggttctttctggaagctccaggggagatccctttcctggcaattccagcttctggaggtgcctgcatcccctggctcatggcacctccttccaagccggcaatgttgtctgtctctgtgcctttgtttggagtcacatctccacctcccgtcaggagagggcctccaactttaaggacccatgtgactggattggacactcgtggagacccaggacaaccttcccatctcaaggcccttaatgtaatcgcatcagcaggctccaaggattagcgaatggatgttgtgcgagaggcatttttctgcctccacagatgacccactgaccctcaaagattcatatccagtccacatgcctaacatgctcaccccattccaaggttcccccaaaccccatcccatgacggcaccaactctaggcccaaaatccaatccaaatctcaccacataaatcatccacatcaggtagggcaggctcagggtaagatccatccaggacaaaattcctctccatctggacctagcctgtgagacagggaagcttgtcgtctgctctccagatgccctggcggaacggtgttaaacataacagcaacagatgtctgcgtggagaatggaaaggaaggggagtcactcctcccaacccacgttgaaatccagccaagcaactcccttaggcttcaaggccaaggagtactcgcttgtggctggaggctctgccctctgagtcatgaactcaactgtcctaaagcctggctgttttgtcaatgactcttcacttaatccccacaacaacactgaaagctcaacctttccatattaacttacagatgaggaagtgagggctgagggaagttaatgccaggccctccagccaccacaaatcaaggcagggattcaagtccaggggcatctgtcttcaaagcttatgctcctcctgccctaactccagggcacagatctcctaggggcacctggagctctgtgaacaagaaccacaccaggaagtgcatgatcccaaagggtcatctttctgctaccacagggtcctcctatgtcctgaccaatggtctcttcctacccaggtccgggaggtgacaagacatgtcattcaagtttcaaatgaggttgtcacagatgatgaccgctattctgacctcctgatggcatggggacaatacatcgaccacgacatcgcgttcacaccacagagcaccagcaaagctgccttcgggggaggggctgactgccagatgacttgtgagaaccaaaacccatgttttcccatacaagtaagttttagaaaacgtttctatgtttgttatgaaactaagtgctatttaaaacgtcaaacagaatggtataaaacaaaatgtgaaagtctgtttctttgtcctattcccaggggtagcagttgtgaatatctggtgcatctcactggaaattccctgggtacacgtatatatagcatgtatgatagtgtgggtacacatatatatagcatgtatgatactgtgggtacacatatatatagcatgtatgatagtgtgtgggcagatgtgtacatagcatgtatgatactgtgggtacatatatatatagcatgcatgatagtgtgtgggcagatgtgtacatagcatgtatgatactgtgggtacacatatatatagcatgtatgatagtgtgtgggcagatgtgtacatagcatgtatgatactctgggtacacatatatgtagcatgtatgatagtgtgtgggcagatgtgtacatagcatgtatgatactgtgggtacacatatatatatagcatgtatgatagtgtgtgggcacatgtgtacatagcatgtatgatactgtgggtacacatatatgtagcatgtatgatagtgtgtgggcagatgtgtacatagcatgtatgatactgtgggtacacatatatgtagcatgcatgatagtgtgtgggcagatgtgtacacagcatgtatgatactgtgggtacacatatatgtagcatgtatgatagtgtgtgggcagatgtgtacatagcatgtatgatactgtgggtacacatatatagcatgtatgatagtgtgggcagatgtgtacatagcatgtatgatactgtgggtacacatatatatagcatgtatgatagtgtgtgggcagatgtgtacatagcatgtatgatactgtgggtacacatatatgtagcatgtatgatagtgtgtgggcagatgtgtacatagcatgtatgatactgtgggtacacatatatagcatgtatgatagtgtgggcagatgtgtacatagcatgtatgatactgtgggtacacatatatatagcatgcatgatagtgtgtgggcagatgtgtacatagcatgtatgatactgtgggtacacatatatatagcatgtatgatcgcgtgtgggcagatgtgtacatagcatgtatgatactgtgggtacacatatatagcatgtatgatcgtgtgtgggcagatgtgtacatagcatgtatgatactgtgggtacacatatatagcatgtatgatcgtgtgtgggcagatgtgtacatagcatgtatgatactgtgggtacacatatatgtagcatgtatgatagtgtgtgggcagatgtgtacatagcatgtatgatactgtgggcacatgcatatatagcatatatgatagtgtgtgggcagatgtgtacatagcatgtatgatactgtgtggtcacaagtatatagcatataggattatgtgtgggcacatgtattggcacatcacaggtgggctcgtgtgtatatagcatgtatgatattgtgtggtcgtgtatatagcatataggattatgtgtgggcatgtgtattagcatatatgatctcgggtgggcacgtgtgtatatggcatataagatagtgtgtgggcacgtgtgtatatggcacataagatagtgtgtgggcacgtgtgtatatggcatataagatagtgtgtgggcacgtgtgtatatggcatataagatagtgtgtgggcacgtgtgtatatggcatataagacagtgtgtgggaacgtgtttatatggcatatgagattgtgggcacgtgcgtttatggcacataagatagtgtgcaggcacgtgtgtatatggtatataagatagcgtgtggacacgtgtgtatataggatataatatagtgtgtgggcacatatgtatatggcatataagatactgtgtgggcacatgtgtatataggatataagatagtgtgtgggcacgtgtgtatatagcatataagacagtgtgtggacacatgtgtatatagtatataagataatatgcggacatgtgtgtatatagtatataagacagtttgtgggcacatgtgtatatggcatataagacagtttgtggacatgtgtgtatatggcatataagatagtgtgtggacatgtgtgtatatggcatataacatgctgtgtgggcacatgtgtttatagcatataagacagtttgtgggcacatgtgtatatggcatataagacagtttgtggacatgtgtgtatatggcatataagatagtgtgtggacatgtgtgtatatggcatataagatactgtgtgggcacgtgtgtttatagcatattagtttgtgggcacgtgtgtaaatagagcctattatcccatgtgtacctgcactttttctcatcctctgtgtcacatcatgtgcatgctcagtgcctggtaaggaccacttagcaatagttcttatacatgtctgcttaacattaagtgaacagaaatgtaattgtttacaacttagtattccatttgtgtgtgcattataatctatctaaccactttccctattaatgagcatgagttgccttctgcttcattgctgtttttatgctgtcacaaataatgaagcaaagagcacacttggccctcaatctttgtgcccatgtgcacacctgatagatccaggggtaagattgctaagtcacggtggaggtgcctgtggaattttgataaatattgcagaattactctccattaatattgcacaaatgttcactcttaccagaaaagaaagagacaatataggtagatttttaattttatttctctctggaaaccagccttgaagttaacaagggacattttctttttttttttttaagacagggtctcacccagtcgcccaggctggagtgcagtggtgcaatctcggctcactgcaacctccgcctcccgggttcaagcaatacttctgcctcagcctccctagtagctgggactacaggcaggtgccaccacacccggctaatttttgtatttttagtagagacggggtgtcaccatgttggccaggctggtctcgaactcctgaccttgggatccgcctgccttggcctctcaaagtgctgggattacaggtgtgagccaccgtgctcagccaacaagggacattttctacttaagagcacagatggtttcgatctcatgtcctctctaacattcattcaataaaacttcactggcagttattctgtgccatgctgtgctgtgtgctaggcaggctgaaaaggaagacaggctggtccctggaaggtgggcaggacagttacataaaccagcagttacaaaattctgggcatctgcagaggaggtcccagtgggcaaaatcaagacatctaaacaaaatatcccaaaaggaataatattgggggaaaggtggaaaaggagcaccataaagactgtgtcaatcatagaaactgaatttcagccaggtccagcctctgtccctgggaggaggtctctctctctcacacgctggggctcagaccctgggagacagggggccccttgctcttctctgcagagccccctcaccagggcggccccctgcatgtgttccctgctgcatgtacctctaacctgggattctttctttctttttttttttttttgagctggagtcttgcccaggctggagtgtagtggcgcaatctcagctcactgcaacctccgcctcccggatataagcgattctcctgcctcagcatcctgagtagctgggactacaggcatgcgccaccatgcctggctaatttttctatttttaatagagatggggtttcatcgtgttggccaggctggtctcaaactcctgaactcaagtgatctgcccaccttggcatcccaaagtgctgggattacaggtatgagccactgtgcctggccctagtgttattcttcaccactcaggaccccaaagttctcatctgttaacattagagctgttagatcttgcagaagtacctgtatcttcagcaatgaacagtctgccaagcagaggccctcgttcccagctaagtggctccccagcagaatctgtgcaaaaaaatgactgagttatgcagcctggagaagcagtggagatgggcacctattatctatcaggtcttgggttccaggcttgccttgtaacttattatctgcgtgtatataggtttgttgtccataaaaagagtatatttcccaggctggccttgtaacttattagctgcatgtatataggtttgttgtccataaaaagagtatatttcccacctaataatgtagcaattagaatgaaatgagatcgaatttgcaaaaccaggctcagagaaggaattcaatgaacgtgtattgttattgctgtgttgctggaagcgtagacctctgagagggatgtggggtgattagggaagctcagcagggagggagcacgttgggtagggagctgcactgagagaactactctgtgtggaggttgggctcccctggagctgcactgagagaaccactgtgtagtggggtgggggctccacctttgggctcccctggagctgcactgagagaatcactgtgcgtgggggctccacctttggggatctcctggagtttcgctggtttgggcaagagctggtgaaaagcagccttggaagaaggagggattgttcttgcaagtctgcggctgctattggggtaatttatgtttgtccagacaggtgggacagttgggggccaccatctgggtgggaaggacacgggtagccctgaggccagacaaggaccccaggaaaagcccagcccttcagggccacacacaccgtgggggaggttggggggcctctggccagggcatcatcctgggcacgttctgctggtatccagggtcacgtgatggttgtggtgagccccacacacccgcccccagaggctccttcctccacccacaatactcagttatgtggatggctgcgttcgtataaagataaatatattaatgtgggttcaaacgttctttggcctaaatgtttattattttcttctgattttaaagcaagttaaagattttgtgaccacacttgctcctgtggccctaggcactgtggctatggtgccgcctgggtaggctggccctggggaaactggacttccacctgcctcaggggaggaattggcctttcgtcctaagaaaagtctcctcagaagaacccgagtgggagtgaaaagcaaaagtgagttgggccccagggccccctgccccaccgggcataaatatacccacaggcatgcacacactcacaggcacaggtgaccgtgaccgcccgtacacctgtgtgcacgcccttgtgcacacacacgcacacccacccacacccatacacacacgtgcacacaggcacacgcacctatacatgctcatgacacacagacccacacacacacctgcacacacctcacatgcacacagctgctccaggatccttctgctgacatgcggaccctgtgtaactcaggagtgtattggacgagggcagggggggccgtggcgaggagcaggatactgtgatgcccgtggagacccccgcagaggttccggggggtccgggcactggctccttcggggctccctactggatctcaagggaaaggcgggtgctctcatcagccatgtcactctccagtgtcctcctttctttttagggctcagttagagtgagcccggtcaccccaggtaccgtctctctgccctatttcaactttctcttctggctcttctgggccagcctgtctttcgtggggcaggactggggttgacagcacttcccttccacacggagcacatgcttgtgggaccctgaaggcagagaggctggggcaggtgctgcgggcagcaggcggggaggggctggaccatctcaggcggggagcctgcagggcttgttcccaggagctgaggagctgactccagacctcagggctctgcgctaaggtccctggacacaaactcagggcacagacaagaggcaaaccctcaggggacgacttgaaaatatggaatcacaaggaattgttatcttcattctataaagagctcttataaagcaatgagaaaaaaataaacacccaatggaataaacacccgatgtgaacaagaaaattacaagaaaacccaaatacgtgtgtgtaggtaaacacacacacacacacacacacacagatatcaatgaaagataaatgaacagcaagatgctgtttttaaacatacagactggaaagaaattatgaaattttaatttagtgttgttgagggtattgagaaatcatttgcatccatgcattgctgtgcaaaagtaaactggtgaatacattcgggacacgatgtgacataaggtatgaaatgaaatcaggcccattcacagcaccacaagaatcttccctagggacaatgtccaaactgcccttaaaagtgggtgaatatattagtttgtcacgattgtttatatcaccaaaatactgaaaaactttaaacgttgatcacaggctatgagcatgagaaacacaagcaactttagacaatcatgttatacagtgatattatggaaatggtaaaatgttgcccagcttagtaaaattttagatgatattgtacttgtcacttttcttatttcaaaatgttcattattgagcatatattatctttgtacttagagaaaaataacaataaaattatttgtaaacaattttaaaaataaaaggcaagaccacatctggcagggaggacacctgcgtgcccgtgggtgagaacgtgggagaggccccagggtgggtctccagggcactttccagggctcttggtgtcaggcatgaacctcctggcttgcagttaagagtgtccatcaattattcagatcctgtccatccccagggcagccttcagtagttgagtgattgagctaacagtcactccagtgagatgaaaaatataccgtatactctaggagtagctccataaacccaatagatgacacatcataaatcagtgcttttaaatgtttgatgtcctttacactcaaagcatccagtttggtctctgagtatttacggtggagtgagagggtggaagttcttagtgagcttggagcaagttgggacttttgaatcccaaagcaaaacagaaaatgatccacacaatttatcatatctatgtttattcagttttcctaagagaaacatgtttccagcaactacacgagactataaattaaagtgttttgagtctctgactactgatcactcagcccagggagctgtgagagctttgcagcatcctctattttaggactgggcttttcttcatgaccttgctccttctggtctcggctaagtgggggtgcaggcagcccgatgatgttccactgggtgctgcaaaccccccatccactgcagaaaatatgtagctatgaatgtatcgacaacctcaaagctatgcaagcctcctcatgcacaccaatgtgtatctctaggtacatattacaaagtggagttagtgggttatgaattatgttcatgttggaattttttatttccataagttattgagaacaggtggtgtttggttacatgagtaagttctttagtggtgatttgtgagatttcggtgcacccatcacccaagcagtatacactgaacacaatttgtagctttttatctctcactcccttcccaccctttccccctgagtccccaaagtccactgtgtcattcttacgcctttacatccccatagctgaggtgtcacttatgagtgagaacataaaatgtttggttttcaattcttgagttacttcacttagaataatagtctccaatctcaaccaggtctctgcaaatgccattaattcactcctttttatggctgagtagtattccatcgtatataaaaaatcacagtttctttatccactcattgattgatgggcatttgggttgcttccacagtttggcaattgtgaattgtgcggctataaacacggatgtgccaatgcatttttcgtataatgacttcttttcctctgggtagatacccaggaatgggatcgctggatcaaatagtagttctacttttagttctttaaggaatctccacggtgtttttccacagtggttgtactaatttacattcctaccagcagggtagaagtgttgttcccttttcaccatatccacaccaacatctattattcgttgattttttttattatggccattcttgccagagtaaggtgctaatgtgttgtgttttgatttgcatttccctgatcattagtgatgagcattttttcatatgtttgttggccatgtgtgtatcttcttttgagaattctctattcatgtccttagcccactttttgatgggattgtttggtttttcttactgatttgtttgagtttgttgtagattctggatattaatcctttgtcagatgtgtggattgtgaagattttctcccactctgtgagttgtctgtttactctactgactgttccttttgctgtgcaaaagctctttagtttaattaagtcccaactatttatctttctttttattgaatttgcttttgtgttcttggtcattaaatccttgcctgagccaatagcaagaagaatttttccaatgttatcttctagagtttttatggtttcaggtcttagacttaagtccttgatccatcttgagttgtttttgtataaggtgagagatgaggatctagtttcattctcctacacatggcttgccaattatcgcagcatcatttgttgaatagggtgtcctttgcccactttatgtttttgtttgcattgtcgaagatcaattggctgtaagtatttgggtttatttctgggttctctattctattccattggtctatgtgcttatttttgtaccagtactatgctgttttggtgactatggccttatagtatagtttgaaatcaggtaatgtgatgcctccagatttgttctttctgcttagtcttgctttggctatgcaggctcttttttggttccatacgaattttaggattttgttttctaatttgatgaagaatgatggtggtattttgatgggaattgtgttgaatttgtagattgctttcagcagtatggttgttttcacaatattgactctacccatccatgtgcatgggttgtgtcccatttgtttgtgttgtctgtggtttttttcagcagtgttttgtagttttccttgtagaggtctttcatctccttggttaggtatatttctaagtattttatttttttcagctattgtagaaggggttgagttcttgatttgattctcagcttggttgctgttggcgtatagaagagctactgatttctgtacattaattttgtatccagaaatttttctgaattatttgatcagttctaggagctttctggaggagtctttagggttttctaggtaaacaatcatatcattagcaaacagcaacagtttgacttcctcttcgccgatttggatgccctttatttcttttgtctgattcctctggctaggatttcgagtactatgttgaagaggagtggtgagagtaggcatccttgtcttgttcccattctcagagggaatgctttcaacttttccccattcagaattatgttggctgtgggtttgtcatagatggcttttaatacattgagctatttcccttgtatgccaattttgctgagttttgatcataaaaggatgctggatctttttgaatgctttttatgcatctatcgagacgatcatgtgatttctgcttttgattctgcttacatggtgtatcacatttattgacttgtgtatgttaagccatccctgcatccctggtatgaaacccacctgatcatggtggattatctttttgatatgcattggatttggttagctagtattttgttaaggattttagcatctatgttcatcagggttattggtccgtagttttcttttttggttatgtcctcttctggttttactattagggtgatactggccttacagaatgatttaggaagggttgcctgtttctctatcttgtggagtagtgtcaataggattggtaacaattcttctttgaatgtctggcagaattcttctgtgaatctgtctggttcttgactttttttgttggtaatttttatattaccatttcaatcttactgcttgttattgttcagggtgtctaattcttcctgacttaagctaggagggttatatctttccaggaatttatccatctctaggtttcccagttgatgtgcataaagctgttcatagtagccatgaatgatcttttgtatttcagtggtgtcagttgtaatatctcccattttgcttctaattgagcttatttggattttctcttcttttcttggttaaccttgctaatggtctatcaattttatttatcttttcaaagaaccaggtttttgtttcatttatcttttgtattttttttgttgttgtttcaatttcatttagttctgctctgatcttggttatttcctttcttctgctgggtttgggtttggtttgttcttgtttctctaattccttaaggtgtaaccttagattgtcagtttgtgctctttcagattttttatgtaggcatttagggctatgaactttcctcttagcaccgcctttgctgtatcctagaggtttcgataggttgtgtcattattgtcattcagttcaaagaatttttttttttttgagatggagtttcgctcttgttgcccaggctggagtgtagtggcacaatctcggctgattgcaacctctgcctcctgggttcaagtgattctcctccctcaggatcccgagtagctgggattataggcatccaccaccatgcccagctaatcttttgtatttttagtagagattgggtttcaccatgttggccagactggtcttgaattcctggtctcaggtgatccaccagctcagcctcccaaagcgctgggattacaggcatgagccactgtgcctggccccgaagaattttttaatttccatcttgatttcatttttaacccagtgtcattcaggagcagattatttaatttccatgtatttgcatgattttgaaggttccttttggagttgatttccagttttatttcactgtggtctgagagagtgcttgatataatttcaattttcttaaatttattgaggcttattttgagacctatcatatggtctatctcagagaaagctccatgtgctgttgaatagaatgtgtattctgcagttgttgggtagaatgttctgtaaatacctgttaagtccatttgttccagggtatagtttaaatccacagtttctttgttgactttctgtcttgatgacctgtctagtgctgtcagtggagtgttgcagtcccccactattactgtgttgctgtctatctcatttctcagttctgttagtaattgttttataaatttgggaactccagtgttaggtgcacatttatttaggattgtgatattttcctgttggacaaggccttttatcattatataatgaccctctttgtcttttttaaccactgttgctttaaagtttattttgtctgatataagaatagctacactgctcgcttttggtgtccatttgcatggaatgccttcttctacccctttaccttaagtttatgtgagtccttatgtgttaggcatgtctcttgaaggcagcagatggttggtgaattcttatgcattctgcaattctgtatcttttaggtggagcatttagaccatttacattcaatgttagtactgagatgtgaggtatcattccattcattgtgctatttgttgcctgtaccccttgggtttttgtgattttgctggtttttttaattgtatttttgttgtataggtcctgtgagatttatgctttaaagaggttgtgttttgatgtgtttccaggatttgtttcaagatttagagctccttttagcagttcttgtagtgctgccttggtaggggtgaattttctcatcatttgtttgtctgggaaagattgttatctttccttcatttatgaagcttagctttgctggataccacatttttggtggataattgttttgtctgaggaggctgaagatgggtcccaatcccttctagcttgtagggtttctgctgagaaatctgctgttaatctgataggtttttactttataggttacctggtgtttttgtttcacagctcttaagattcttttcatcatcttaactttaggtaacctgatgacaatgtgcctgggcaatgatcttttagcaatgaattctccaggtgttctttgagcctcttgtatttggtgtctaggtctccagcaaggccagggaggttttcctcgattattccccaaaataaactttccaaacttttagatttctcttcttcctcaggaatgctaattattcctaggtttggtcattagacataatcccagacatcttggaggctatcttcatattttcttattcttttttctttgtctttgttggattgggttaatctgaagaccttgtctttgagctctgaagttttcttttgcttgtttgattctattgctgagactttccagtacattttgaatttctctgagtgtgtccaatgtttcctgaagttttgattgttttttatttgtgatatctatttccttgaatatttctcccttcacttcttgtatcatttttctgatttccttacattgggctttgcctttctctggtgccttcctgattagcttaataattaaccttctgaattctttttcaggtaaatcagggatttctccttggtttggatccattgccagtgagctagtgtgattttagggggtgttaaagagccttattttgttatattaccagagttggttttctggttccttctcatttgggtagtctctgtcagagggaaggtctagggctctagcctgttgttcagattctttcgccccagggggtgttccctggacgtgattagtactctccctgtttcctagggatgtggcttcctgagagctaaggtgtagttattgttatctctcttctggatctagccaccaagttcaaattgttacaaagttcagctggcagtttccttctccctgtggccttttacaggtgcctctggcagccctcctgaaggacccctgtgaggcaaggtggaaatggcttcctaggggacccagagatcccacagggcttttctggctgcttcctctactcttgtattccactcggctctctaaatggactcagctccgggtaaagtcagaatcttctcccgtaatctagaccttcaggttccgcagtgggggtgcatgttcagggtggacgatctctcccacttcctcagtttgggcactcacagtatttggggtgtctcccgagtcctgcaggagccatccgctttcttcagagggtctgcggtttctcttggctttcctaatgtattcctgccgtcgttctggagcaaaagttcacgacgtgaacctccacacactgctctgtttgtccaagtgagagctgaaacctagtcctgcctcttgtccgccatgatccgtcacaaaaaatcctcctcatgttggaattttaataggtactcccaaatttctctgcagcaatgagatggcgaattgtattttctaattgattatttttcagcaacaattaatcttacataattcctattattttccaatgcggtaaagaagaaaatcttgaattttacattattggctttaaaacctgtatctgtgtctcttttgttgacctaaagcaagaagctgaggcacaaaatacattttaaagagtttacttgagccaaaatgagaatagctgcccggaatacttagatccaaataactttggacgtgagctttgttagatctttgctgcaaacaggtttcaaaggcgaaaaaggtggacaaggagtgagccttggtccttcactctatatgattgcttggcttttcattttgtttacggtgccattattcataaatttaggtcgattttcgtcaattttttttcttctctatgacatctacattgttatcttactgagcaggtcttccttatctggtatatataataatatatatataaatatatttttctatattttattttaaacatattaaaaactgggcttgatatacaactttgttttattctgactctattttgtgtagataaaatactgctttagtgagtaacatttaaaaaagccatggtgagagcagcatctgcctctgttcctagataaagggcatgattctgatgtttttcctcacatactgtgtctactaggaatttctgctagacaacttcagttagaaatttgaaaatcttatttgtaatttcccaagaattttaatgaggcttgtgggttccagctttactcaataccttcccagcatcggcagaggaggccacagggcttccacttcacttcattattgtgtgagctacactggtagatttccaacgcagtgccatatttacatggcctgcatgatggtgatgcaggttttcatttattcttggattgaatttgctaatattttatttgaaatgttgcctctctcttcataagcagagttgtgctacagtgctcttttccgatgctgcacctatttgggtgttacaaacacaccagcatctgacagtggtcaggggttgcccattcttttactatgctcaggattaccttgtctaaaatcaaatttgggctttttgttttgaataactggtagagcttatttgtgactctggtcctgataacctctggggtggcagatctttggttatgggctcagttctgggtgcagttagtctattcgagcccataagtctttcctgttctttattttctattaccttcctattacactttttcatctacttcacatttctcaccctcttatgctgaaagcgagttgagttacgttcactgtgtcgtgctttttgacaagtgtagttaagactatgtattttcctgtgacccccccccacaaattttgatacatggtccttacattgatgttaattcaaaataggttttaattcaaataagaatttcttacattaaacttgagcacccacatgtaagtgtaatttcacataaatgtaaaacttaaactgtgcctgactctcccgacacgagtctcttcctctccctccctcatttgctagactctcctcctgctcactcccatgttctccactcatgcccctgcccccaaaccaatcatttgactcccaaatgttgatatttgaagtgtgtgtaggggaaagggggcatgataaatgaaactagaatagtaagaagctggtgtagacagcatagtgggctcaaagggattcactgggcaccccgttttaatcagcatgcccttgctatgatctcagcactcatggcatgcccttcccatgatcctgatgttcatggtgtgcccttcccatgatcctgatgctcatggtgtgcccttcccatgatctgaaagttcatagcacatgcccttcccatgatctgaatgttcatagcacatgcccttcccatgatctgaatgttcatagcatacccatcccattctttgagtgctcatagtatgttcttcctgtgatctgagtgctgatatcatgcccttcccatgatgcaaatgctcacagcatgcacttcctgtgatctgaacgctcatagagtgctcttcctgtgatccaaatgctcatggcatgccctttccatgacgtgaatgctcatggcgtgcccctcctgtgttctgaatgcttatagagtgcccttcacatgatctgagtgctcatggtgtgtcctttctgtgatccaaatactcatgctatgtccttcccttgatccaaatgctcatggtgtgtccttctgatgatctgagtgctcatagtgtgctcttcccacgatatgagtggtcacggtgtgccctttccatgatatgaatgctcacttggctacacctaaagaagtcatgcacaagcatattctcttgaatgttgttaacaaaaacaagactatgctgagtacacgttctgtatcttggattctcactcagtagtgatgtgtcctgggaatccccccagtggagcgccaagccatccctgcttacggctggactgttccacactccgggtcacagccatgggtgtgcccttccgtgttacagcctctgccacagcgtggatcaccagaagtgacactgccaggttggaaggcagctttagcactgctatgctggtactactgtctaaaaattctgtgaccctcacagcaacgactgagtgtaccccttactcacattcgccatccacactggcaacagccttgtttttttctcatttttttctgcttgtttggcggcaaaaaaaaaaaaaaaaaaaaaaaaggagagagagagatatttcgttgttacattagttgctttccctgaatattagtgaattttaaagttgtcctttatttatctttttttggcaatttgtatttgttcaacgaatgatctgttcatagcctttgtccatttttctactatttgactgttaattgattttaattgctcctttccactctagatgttaactctctatctctcacttttcttacaaatgtttttctacagccccatcaatacagaactgtcagcatgaagcactttcatattttataaggccaggtctacttatgtgttgatggcttctaggctcagttttggttcaggaatctcctttgctcgaagtcgacagtgacctcctgggtggtattacagcacgggtttccattcattttgcacagtggacagtctgggtgcgttttattcccattcagatggaaaaccagctggttctgccctccttctccccacaggcctagatagcactttgtcacagaagaactggggtctggttctgggctctctgtcttcttttattaacagattcatctgttcttgttgacaataccgtgtggacttggtcatagcggccttatagtatatcctattatctgtcaagtcaataccgcatcaccattcttttccctagtttattaaggaataaataaataatggaatttgtatcttcatataaactttaaaattaatttatctatttcaaaatgaaaaagtactatcattattattgtaaatgaaattgcatttaatttatacattcatttagagagaaatgatcttttcccaaattttttgtatatttaatgatgttttatgattttctttttgtagatcatgtgattattttgttaaatttacacacctgattttgatcaacttttttgtcattatgaaagggatttttttttctccattaccattcatggtactttgctaaagaacaaaacaaaaaagaaagaaggaaaagaacagttttatacttatcctcagatcgaagacattttttaaagaaatgttatcaattttttagaatttttagatgttgtagacatctaacatagcattaagaaaaaataattttattatgttttaaatcttattttctcttacagtagctttaccagctcttattttattttctagactttggtctaactgagatagtactaagtaccaacaatgatagcgggagtttctgctagtccttaattttaaattaaattgttccattgtttcactgctcgagataatatttgttattgtttctacattatattttagcaattccaatctattctatttctatttaaccaggaatggtaagtaatagtaaattgtgttattgcattttaagtacctatgatattaatttttcttctttaatttgctgacaccctggaaaatacaactctattctccaacacggaaccattctgtgaatagattctatttgactatggtaattgctgttttgatttgctgccctatcttttattattttatttagaagggatattgatctgtatgccctgtccttgtcctgttttcatcagaggccaatacaaaagtttcgctgactctgtagagtgcactggggcccttttcatcttttccatggctgaaatagtttaagcaaccttggagttacctatcctttcgagatttgatagaagtccaccgtcaatgccatctgacctctggatttctgatcaccttgtctatctcttccatcctcattgtccattggagttttacatttcttcttggaaaagctgtggttatttctattttgttagggagtcatcgatctgttcttcattttccaatgtgctgccatgaaaccgcatatacagtcgctcctggttcttctcatctctcctgcatgcctgagccctgctcctttctcatggcaaatcctgcctcactcggtgctctttctttgttttccacactgggttgtgaagcagggcttcatgttttcttcccaccaggtcttttattcatagttaattattttaacttctgcatgcattaatttaactttctcatttatttgtgctttagctctttgttacttaactaaattcttaaaatagctacttaatttcttggtttttgttgttttgatgaaagcaatttaaagagcacagattttcttctgaggaaggctttgctggtgtgcttgaattttcttaacaagtgagttaacttttcattgatttctggagacactttcagctcttcttaagagtctctttgaatcagtgagtaggagaatttgcagctccttgttatttatttgtaattttattattatttgtgctcttcaatttaattcctctatttcctcccattcttggggcctctgggcctgtatattctgaagggcgtgcactgaagttccggctgtcacggttttcttggctttcctactcttttgctgaatttcagctcctccctgggttccctgctggccccaagtactcacctcgtctactctaagcctcgcaggcctccctgaggctctcagtggaagcgctttttttttttcttttttcttttttttgagacggaatctcgctctgtcacccaggcaggagtacagtggcccaatctcggctcactgcaagctccgcctcccaggttcacgccattctcctgcctcagcctcccgagtagctgggactacaggtgcccgccaccgcgcccggctaattttttgtattttaagtagagacggggtttcactgtgttagccaggatggtctcgatctcctgacctcgtgatccgcccacctcggcctcccaaattgctgggcgcccacctcagcctcccaaagtgctgggattacaggcgtgagcccccgcgcccggccggaagcgcttgtttaatgcacgatcttttttaacgtggaccctgtgctggctctgagccaaggctggggcctcgttgctgccccgacccccagctggccttgggctgcacagctgccaggcctgggcgctgcccagaggggttctgacagcatctgctttgctgcttcaccacaaggccgactccctctcacctacattctttctgctgcacctcctgtgcctgggtccatcaggagctcggcctgtctccctgcaccgcacggcaccgagcggccaacccctgagcggctgctggctcgctggccgcatttccctaatgcagcccaggtcttccgttccttcctactcctcagtgcccaggctgcactttgccccgagaggagctttccccttattttcactggtaataataatgtcctattacgagaagaccgtgatcttcaggaagagtctctttcggaatctgtccaaccccggtgatcttgtgattctggatgagcgatttaacctcctaaatctgataacgcccagggtaggccctgaccccgtgacacctcaccagggaggaagagctgacagggaaagggcacatgctctctgcagcccacagagctcgactcttcccaggaaacctgtaaatctggaaaaaatattttagatctccatgttacagatgagaagatggaagctggccacagccagagttggaatcccacccaaggtctcctcactcccctcaagctgcctttacactaaacagtgatgcccacaaaactcggagactgtttactcattgtgctcctaaaccaagtccatggcactggaaaggaagaagtcagctcttccgaaagtcagaaaataaaccagaccggggattccatgagcagctagagcaggtctgagcaggagcgagactggctcaggccaagagcgtctgagctttggggagatgtggactcctaggatgtggggtccatcctctgggttcaacctcttccaggcaagagaccaccagtgagcaggctgaggggaggtgcggggctggctggaccgacccctgcagcctcttccaggcaagagaccaccggtgagcaggccaggggggaggtggggggctggctggaccaacccctgcagcctcttccaggcaagagaccaccggtaagcaggccggggggggaggtgaggggactggctggactgacccctacagaggactggaggggcagagaaacgtgcggcgctgcggggtcgtcgccggcctcgaacttccagagtcttacaaagggtgcacgggggccctgggtgaccttgaactcccctttgcctgcagctcccggaggaggcccggccggccgcgggcaccgcctgtctgcccttctaccgctcttcggccgcctgcggcaccggggaccaaggcgcgctctttgggaacctgtccacggccaacccgcggcagcagatgaacgggttgacctcgttcctggacgcgtccaccgtgtatggcagctccccggccctagagaggcagctgcggaactggaccagtgccgaagggctgctccgcgtccacgcgcgcctccgggactccggccgcgcctacctgcccttcgtgccgccacgcgcgcctgcggcctgtgcgcccgagcccggcatccccggagagacccgcgggccctgcttcctggccggagacggccgcgccagcgaggtcccctccctgacggcactgcacacgctgtggctgcgcgagcacaaccgcctggccgcggcgctcaaggccctcaatgcgcactggagcgcggacgccgtgtaccaggaggcgcgcaaggtcgtgggcgctctgcaccaggtgcgcggggtggtcctgggcgccctgggtggctgcgggcaaagcggggggcgcctcgtgtgggtgcgcagcatcgtggcttctctctcccaggtacttgcacagccatcatgggcgcccacatgggtgagctccaggtcgtggggccctgtgtgggtgcgcagtcctgctgggcgccctgcatgggcgtgtggagggtcatcgtgagctcctgtgcaggggccgaagggtaactccggagctggcggccctccggggcccctctgtcccacctgcttaccctccagccggctggtgattatcccaccaagacccaacaaccacagccccacaacagtggcagccagaccacccaggtttcccggtgcgcacagccaagctacgtgctttacagatttcaactcatttaataattcccagaacaacccttggaggtgggtggaccaggggtgctggtgtttttgtatttcagagacagtgcagtgaatgaagaaccgactctgtgtgaggattctgaactaacaagttagagtctatttgaaacctttcttcattttatgactttcttaagtatcacatgagagggtcttgaatggagagtcaagttggccttttattaattgtgtgatggagaaaagcacttatgcacctggaaatgcggtccctgactctaggggtctcacaggttgttaggaagaaggatgggctgtttgatatgcgagtcaccgtgtgtgtctgttgcaccaggccctgtggcggcctgggcatcgtgtctgcagtcctagccgggagcctgcagggaggtgcgcgtcagtcctgttctaaaggaggcactggagccttgtccgaggaggcacaggggctgtgtgtggcaccggctgcccccgggcaccatgcgcccctgccgctttctggccttcactgcactggggtccaggccccaaaggtcagagcagagggtctgggaagcctccatgcgctgggtgttaacccttagttcctgggtggcgaggggacctggagcttcctggaacaggggctggcagcagcaggccctcacacttctccggcaagcacggcagacgggctcactgtcctaacacgcatccacacagcaaacacagcagacgagctcactgtcctaacgcacatccacacagcaaacacggcagacgagttcactgtcctaacgcacacatccacacaggaaacacggcagacgggctcactgtcctaacacgcatccacacagcaaacacagaagacgagctcactgtcctaacgcacatccacacagcaaacacggcagacgagttcactgtcctaacacacacatccacacagtagcgcttggtggggagcatcagccggacggaggaggcttatgtgggtgagaagatcgagttagaaatgaaaacaggaaccttgtcactatgtgaagtaaaaatcatcaggcacccacgtcgctttcaagcagcgactcagacactttcctgcttccccgtgcaaacgggaatataaacccaggagctgctgagcggtggaatccaggtcctcgtctccatgagtctggacttccggccacacgcgtggggaggcaggtcccagacggctgccttctcccctctgctcaacccctgaggccttcggcgctcctgtctgcttccttgcttctgtgccccttccctgactgcgacctccacgggcagatgttcatccatttaattcttgtttctcaggacccacaatttgccaggttgcttcataaatatatgtagagtttgtgaatgaagtagaatctcaaaaataattctggaagtcctgccccttctgtctcctcaggagcaggatttggtttgaaccttctttgagtgagaacctcatccagcccagggagctgtgagaagagcagctgcctctgatccctggagcccgttcacagagcgggaaacgcccaattgtcacgcaccctgttgtctttcttctccatggagttctgggattatttagaggcgtgaattattaccaggcccagtcattgtagattagagacagtttaattccaagttactgagaatcctactgacctagaaataatgacatttggttgctgcggctgtggctgctgctgctcctccttgtcctcctcctcgtcctcctcctcctcttcttcttctccttcttcttctttttttttgagacagtctcactctgtcacccaggctggagtatagtggtgagaccttggctcactgcaaccaccacctcccaggttcaagcgattctcctgcctcagcctctcaagtagctgagaccacagacatgtgccaccactcccagctgatttttatatttttaatagacatggggttttgccatgttggctaggatggtcttgaactcctttcctcaagtgatccgcctgcctcaggctcccaaagtgctgggattacaggcctgagccactgcgcccagctgccttttcttattattaatgaaataataacaacagcaaccaataggaaaagtgttcttctctgtttcatatttaccttcctcaattcattttctgtgtgttctgctttttaaaaaactgtgaacattcttttcttcttggttttacatttcacttttgaatttccttttgtatttttttcagttaataggtcctctttggtgctttttgcaaaaacctttgatacattaaaataataagttgtgtttaacgtgtcgatagagccactgctgcgacttctagccgtatttgaaagatccacggtggcctgggcctggaagcctcatttttctctccctggttctaccgactcgtagtttggtaactttgtaatctgaatctctcttcttctgaaaaacattagataatgaaaagagatgccagggcaaccttatgaaagagaaatagcatccccccctctatcacccctcaaaccccctacacacacacacacacacacacacacacacacacacacacacacacgagccagccagggccaggctaatgcacacatcagcaagagacaggaaaggtcatctcagagccgggagtcacagctttctcctccatctgtccacaccacctccctcctccttcatccgtccaaaccatgtttctcctgctgcatccgtccacaccacctccctcctcctgcatccgtccacaccaccttcctcctgctgcatccgtccacaccacgtccctgctgctgcgtctgtcctcaccatacccactctaatttgtcagggcccaaccacagccgcccccactctgaggatcttggctcctctaatttcttttgtcgaaagctgagagctatcccctccctcagccctgggccacaggacttctgctgtgggcatgtttgggagggatctgcagggccgccctctgtgctggttcctgggatccggcatctctcgggggactcgcacgtaggaagggctgataaagttgctcttgctggcttgagatcccacaggaccctggatccataagccctgcttcccaccaggaggaactgaagctcttgctcttcaatcccagaaaaccctagctgctttaggtgtgtcataagacaagaactcacaatcagttgctcactttggtgataacttttgtgttctacagacaagaaaagaatgagaaaggaaacccttcccagcacaggtgtgagggaggcagagaggaggtagccatcctcggggagtctgggtgtgccatccaggcagcatggagtttgggttccacagggtgaaaagataaagacatcccaaatatctggcgtggatgttttctatgccccggccatcagatagcagacctatttctggagcacagccttgatttccccagatatccagggacccacagaagctttgctttggatgtgtgtggaggtagaaccagaccccggagggactgcagatctccctggacatccccatcccgggcaggcagatccatgtctcggggcaggggctgcatccctgggccactcggctgctgacctttgctgtagctgagtactttttcagattggttgctcttccagagcaaaggagcagatggataaagtcatgcttccaaggctggaaagaaagagaaagggccgttcctgcagtgggtgctgttgctgccccacccaggcccctttatctgcagggccccatcccccagtggcctccaatgttggctgacaaagtctcctggtcgttcctctccaggggtagctgtggaggctgttccctgccctgcagggacagccaggcccctacctcaaggctggaccaagcccaggtgcgccatgctgcagggcttcctgcggaggagcacaagccaggcctggctgtgtcacgtccttggggagctgggtgcctgctcagcctcctccctggagcaccctcagcaagcatatgggagcctcttattggactaatagggcatgtttgagaaaatgctgagtgatgttctgcgtagagcagggtaggtgactttgaaagcagtcgagagtcagaaagttcagaggagcctgtgccaggggctacgcggctgtttcccaccgtcggtgacaaggatcgcatctccaggtctcttcgtcctggtctccccgtgtgctggggtcctggcttcccgtcaccttcacgcccatcattttcccaagtgtggacctttcagtcattcccactggtgagttgtgaaggcaaagaaatggagagtggccacaagtcagcacctggtggctttggcagaggctgtggggaaccaggaggctggggtgagagcagacgtggaggagcagcttgaagcagcctgggaagatgaggcctctacatggcaccgccagcagaggaagaagacatggcccacctgggaggtgagcaggaggggcacctgacagcgacgatgccccggtctcacagtatggcgtctgcccaggtccaatagttcagagtaaccatttcccccatgcgaccaggtaaagaaataccagaagcatttccagaagaattgccatgaaaattccagagagctgtttacaaggttcaagtgttttctttttctctttttgagaaagcatctcctctatcacctaggcggaagtgcggtggtacaatcatagctcactgcagcctcaacctcctgggctcaagcaatcctccacctcagccacccaagtagctgggactacaggtgtacaccaccacacctggctaatttttaattttttaaatttttttgtagaaacagagtctgactgtgttgcccaggctggtcttgatcttgggctcaagcaatcctcccactttggcctcccaaagtgctgggattacaggcgcaagccactgcgcctgactcaagattcaagttttaaggccccattggtcagaacaatgggtgcttctgcccaacctcgacggctcccaggggaggctgcagtatctgagccaatcacttaccagggatgtttcagatcagatgaggaggcagtggggaagaggagagacacactgttcagagctctggcaagatcagacactgaggaagtacagtgtctgtgaggctctgatgaagggcgcaggtttcctctctgttaacagctagccgggcacaggtggagctgctgaacctgaggctcaggcctcagttctctgcctgtgcttgctgcatcccctggctcacaagtcaaacttcaggcaggcaagaaggggaagaggtgtcttccttaaaatagcttgcacttgaatttgaaattgtctcagtccctgggctaaaaagagagaggccttttcctttctattgtagtgagaagaaaccaaagaatgttccagggaacagaaggtgctgcctgagttctgaatgtgggaagcacacggaccttctcacgcggttaggaggagccccttggacacctgtgtggttcagaaacgttgccacataaattgcacctgaggtggagaggctgtttgcacgatgaagtcgtgcaactgctctctgggatgctgacccatagcacagtgcttggcaccaatggatgaactagcacagggacggaaaccccactgggaaacatttggatgctgccttttcctccttgtctgtccaggtctccgaggtggagcgggacagcgagggcaggtgcaccttcagtgaaggcccaggccacacaagactcacggctctccctggtctccctgaagggccaaattacgtgcttaggaaatgcattctggcacatggaagaaacatattacaagtgtgtaaataatattggttatttttaaacaatccacttgccttcctaaactggtaagctaaaagagaagattcatattctagaattattcctattatgcttcatttggatgcagtttattgaccaaaatattccccttaaataccaaaacaacttgacactgatttttctgtctgaaagaaacactgttaaacctgaaagtagaatcttggtacataattctcctgggaccatgtatcaaatcgtaatttccaggccctgtgattgcaactgtaattttccatcgacagagctctctgccatacaacatgctttgatttaatcctcacaaaggctctgggaattaggtattattgttgctttgtagaaaaaggaactgctccccactgtcaatcatccagccaggagtctagctgcccagcctggcccggtggccattgttggctcgacagaggtgctgtctcttgccactgccagccccatcaccatcctgggaaggaggctctctagtcagccctataaacgcacctcctgaatatccatgaaaaaatcagcaagaaggcatttctgggaagttcagctgaggcccttattacaagacgagaagggtccagttccctggggctgtcaaggaagatgctcttccacactgccgctcgaggcgaccctcctctggtatcctgggcctcactgagatgcttttcctatctgcacagatcatcaccctgagggattacatccccaggatcctgggacccgaggccttccagcagtacgtgggtccctatgaaggctatgactccaccgccaaccccactgtgtccaacgtgttctccacagccgccttccgcttcggccatgccacgatccacccgctggtgaggaggctggacgccagcttccaggagcaccccgacctgcccgggctgtggctgcaccaggctttcttcagcccatggacattactccgtggaggtgagtgagtgcggtccctgcagctggtccccatgaactcttccttctttttttaatttttttaaattatattttaagttctagggtacatgtgcacaacgtgcaggtttgttacgtagggtatacatgtgccatgttggtttgctgtacccattaactcgtaatttacattaggtatttctcctaatgctatccctccccctgacccccaccccacgacagacgggatatgatgatccccgccctgtgtccatgtgttctcattgttcaattcccacctatgagtgagaacatgcggtgtttggttttctgtccttgcgatagtttgctcagaatgatggtttccagctgcatccatgtccctgaaaaggacatgaactcatcgtttttttatggctgcatagtattccttggtgtatatgtgccacattttcttaatccagtctagcactgatggacatttgggttggttccaagtctttgctattttaaatagtgctgcaataaacatacgtgtgcatgtgtctttatagcagcatgatttatagtcccttgggtatatgccaagtaattggatcgctgggtcaaatggtatttctagttctagatgcttgaggaatcgccacactgtcttccacaatggttgaactactttacagtcccaccaacagtgtaaaagcattccttttctccacatcctctccagcatctattgttttcctgactttttaatgatcgccattctaactggtgtgagatggtatctcattgtggttttgatttgcatttctctgatggccagtgatgatgaacattttttcatgtgtctgttggctgcataaatgtcttctttgggaagtgtctgttcatatccttcgcccactttttgatggggttgtttgttttttccttgtaaattggtttgcattttttgtagattctggatattagccctttgtcagatgggtagattgcaaaaattttctcccattttgtaggttgcttgttcactctgatagtggtttctattgctgtgcagaaactctttaattagatctcatttgtcaattttggcttttgttgccattgcttttggtgttttagtcatgaagtccttgcccatgcctatgtcctgaatggtattgcctaagttttcttctagggtttttacggttttaggtctaacatttaagtctttaatccatcttgaattaatttttgcataaggattttcgcatcgatgtttatcaggtctcacttctttcttatgactcatcgcagccgtgcagaccttccgtatgggcacacttgctgatcctacacaaggtttttaatatctgtggggaaaataaatgtgtttaaagcattttaaaaggctaaactgggctcaggcacggtggcttacacctgtaatcccagcactttgggaggctgaggcaggcggatcacttgaggtcgggagtttgagaccagcctggccaacatggtgaaaccccatctctactaaaaatacaaaataaacaaacaaaaaacattagccgtgtgtggtggcagatgcctgtagtcagctactcaggaggctgtggcaggagaatcgcttgaacctgggaggcagagggtgcaggtgagccgagatctcaccattgcattccagactgggcaacagagtgaaactccatttgaaaataaaataaaataaaataaaaataaaaggctaaactgttctatagttatgatcagcaccatcatctttagaatgttaatgatgggttacctttggaagttaattatttggaagaaaatgatcctattcccccaattagttttttggaagggttatttttaagcttccccattttttctttatattcctttcccagtagtctgtaagtccttctgggagcttctaacctgtctcaaaagttgaccggctccaggcgtagtggggagtggggagggcaggggtgctgcagtgcgtccggcgatacctgcttagatgagagctgagtcatgcacagtgcaccagaggggcaagggccagcctggccctcagcaggtgcccggcatttgaagacacccaggtcatcccacacaggacgatgcatgtcgtgatttctaagtcttccttttgggcatcctaaggccaaaccgatcctttaaagactctggtggcatgcagtggtgggttcacacgccactgagatagaccgaccctgacaggccgtggggcctgctttccatgcggggcctttggagatgacaggaacagtggtccccaggcaccctggccactccctcagctaagctgagtcttcctttcactgttctggatgttagaattcagcaaacgcttcttttttttgtaatctttctgttgctgagaaataaaacaaaaagctttaaaaactggtgggctccttctccaggcccctttctttctgagggtccatcccccatgagccacattgtcagtgccagcccagtggttcacctgccaacaagggcagtgtcctgaggacattcaggaaactctggaatcacacaagctgaattcatgaacttacacgaaggtttgctgaggataagattgagctattgggctgggcgcggtggctcacgcctgtaatcccagcactttgggaggccgaggcaggcagatcaccaggtcaggagattgagaccatcctggctaacacggtgaaaccccatctctactaaaaatgcaaaaagaaattagccaagcatggtagcgggcgcctgtagtcccaattactcgggaggctgaggcaggagcatggcgtgaacccgggaggcagagcttgcagtgagctgagatcgccactgcactccagcctgggcaacagaaagaatgagactccgtctcaaaaaaaaaaaaaattgagatattgttgtttctctagaactgagccaagagctgtccttgccttgtgcatggtattttccaggtggtttggacccactaatacgaggccttcttgcaagaccagccaaactgcaggtgcaggatcagctgatgaacgaggagctgacggaaaggctctttgtgctgtccaattccagcaccttggatctggcgtccatcaacctgcagaggggccgggaccacgggctgccaggtctgccagttccttcccttgcacacctcatgcagctgctgcgggatttgccgagctagcaacctgctgctagagagactgatttagaggaaaacaatcacaaatctgaggccttctaagcaacggctcttaaagggctccagttcattcagctaaagtggccacttccagcttttcttagagatagaaatggcacgaagagggtggttctgaacctcccaggaacgtatgagctgggaccttgagaaacagccgcttctagtagagggaggagggagtgcgcgggcagacaatggcaggtctgtatctggtatcccgggaagctcctgggatggctagagtgcccccctccccttctcctccccaccacaaggtcccagagcctgcaaagatcattccgtcacatcaggactgctgttaactaactggtccaagctggcccctggcaggagtggctgctcctctcaggccagcagccccctgtgctccccacaccccacccggctcctgcctttcccaggccccacccggcagcctcctccctgacctgcccagtttccaactccctgacctcaggcccacctcagccttccctcctctgggctcctaggtggttcggttgtctggtcaacctgcagcacctgtctaggcccgatcccctgacacctcctattctgtgtgcagctctgttctctccacgtaccctgggagcttgggaggtgccctcctgttgtgtgtgggtgacatgtgagatggacagtgctggcaagtcctgccctgccccgtccctgggccttcctctgtcccctggcccttcccccatccctgtcttcctcaccagtggcatctggaagggctgggatcagcagccacacaggctgtgaatatctggggactaaatgtgagttgggaggatgcagaaggggcccctatgtgtgtcaggataacgcacactgtccccctcactccctgcacccaaacacagctgctttcttgttgccagagctcagggagcacagcctacacatgccttcacatgcccggcacatacccagcacacacccgcacatgcccggcacatgcccagcacatacctgcacatgcctgcacacacctacacatgaccagcacatgcccacacatgaccagcacatgcccagcacatacccagcacacacctgcacacgcctgcacatacccatcacatgcccagcacatgcccagcacacgcctgcacatgcccagcacatgcctagcacatacccagcacacacccacacatgcccagcacacacccacacatgcccagcacacacccacacatgcccagcacacaccttgcctctggctgggaccccctttgctgctggccctgctcaggccccacagcttgatctcctcatgttcccactgctgacttccccaagctaactgtgccacagagtgggggaccccctcccggctctcacaacccccaccttcctctgcttcacttttcaccaactgaaatatggccaaaggcaaaaacccatgttcccactggcctgtgggtccccccatagatcgtaagcccaggaggaagggctgtgtttcagggctgtgatcactagcacccagaaccgtcgactggcacagaacaggcacttagggaaccctcactgaatgaatgaatgaatgaatgaatgaatgaatgtttgggcaaataaacgctgacaaggacagaagggcctagcgggaagggaacaggagtaagaccagcgcacagcccgacttgtgttcagaagacctgggattggacctgaggagttcaattttggatgaatctcttaattaacctgtggggttcccagttcctcccctgagcgcccaggacagtagagtcaacctcacgtttgagcgttggggacgcaaacacgagagtgcttggtgtgagcacacaggaggagtcacgacagagcagtgtaagagccgccacgtgggtcccacacagggggagtcacgacacagcagtgtaagagccgccacgagggtcccacacagggggagtcgcgacacagcagtgtaagagccgccacgagggtcccacacagggggagtcacgacacagcagtgtaagagccgccacgagggtcccacacagggggagtcacgacacagcagtgtaagagccgccacgtgggtcccacacagggggagtcacgacacagcagtgtaagagccgccacgagggtcccacacagggggagtcacgacacagcagtgtaagagctgccacgtgggtcccacacagggggagtcacgacacagcagtgtaagagccgccacgagggtcccacacagggggagtcacgacacagcagtgtaagagccgccacgtgggtcccacacagggggagtcacgacacagcagtgtaagagccgccacgagggtcccacacagggggagtcacgacacagcagtgtaagagccgccacgagggtcccacacagggggagtcacgacacagcagtgtaagagctgccacacatgggtccctgcggcctgcagttcgaagcccactgcatgtgttagcactctataccccagccaccgtagaaggccggactgcgatcactttctaaaagatggatcgagagactgaagcacagacagtttaggcaacttccccaggtctgaattccagcaactggaggcatcgatgcaccagaaaggccacaaacctggcagaggcttcattagatctgatcagttcgatctgaggataaatcagataaaagagaaacgctcatgtctcagcaagctgagctgtgatgatgatttccactacgccctgaaatcttttgttgtactttacggggaatataaaatgtacaaccttccccaaaacacttttttgctgctgggcacagtggctcacgcctgtaatccctgcactttgggaggccgaggcgggcagatcacgagttcaggagttcaagaccagcctggccagatggtgaaaccctgtctctactaaaaatataaaaaatcagctgggcgtggtggcagacacctgtaatcccagctacttgagaggctgaggcaggagaattgcttgaacccaggaggcagaagttgcagtgagctgagatcatgcctctgcactccagcctgggtgacagagcgagactcagtcaaaaaaaaaaccaaaaaaacacttttttttgcattcccgtttctgcagtgtctcccacaggcagggacatctaaagtgatgttctttcttcccagctctgcggcctctgaagctgtgatgagcttcagcctccatgtctttacctcctgcacaggccttgcatattttccctctagagttggaaaaagatgcaaatgtgtttcctcttagagcaataagaaaggaaattacccttctaacttcgttgttttttctttttgaaattaagatttccatctctcacaggtattagaaatgttttaattattttggactacttaaaacagtttgacaatggtctaaattgactatacagaaactttctctcctcatttgagaactttaatttgctcattattttggtttctcactagtctgaaaataactgcattcttttagtaaatatttaatgaaataactgctgtgtcccccaagccctgtggcaagcaatgggcgtctgttttctatataaaccaagtgtctacaggttacctattcctggagctgagaaatttgtggggtatgtttgggatggtctaggctacagtagattgggtgataaagatgaaattttgttggaggtgctgagatggagagacacagagcctcttgacggggcaaagcacttcccggtggctttgatgagagggctgggatggcccatctggagacagaaaacgagagtggtttctgcagatcacagggcggcagagcccactgtggacagcaggagtcaggctgaggcagcgcagcttctcacgggggctcgggggaacccttgccagatgtggaagcaccagggctacggggccagccaaggcaggtgactctaggagcacaagagtcagacacacacttgttcctcctgagggtgaaccagggagccacctgctaagaaatggactcaatggcacctgacagcagttttctaaaagctcaggattttttttgttttttgtttttttgagacgaagtctcactcttgtcacccaggctggagagcaatggggtgatctcggctcacggcaacctccgtctcccaggttcaagcaattctcctgccccagcctcccgagtagctgggataacaggcacccgccatcacgcccagctaatttttgtatttttagtagagatggagtttcaccatgttggccaggctggtcttaaactcctgacctcaggcaatccgcccgcctcggcctccaaaagtgctgggattacaggcatgagccaccgcacctggcctctagaagcgcagattttgaatctcactcatgccttcctctttcactttgtccattcttccaatccctcttcttccaagttgttcccacccctttgctccatgagtctgtttaccacatgggcatccccttcccagaccaactggaggatgcctggctatttctcccagttctgtttggtctaaacatgagacaccaagaggcccaaccttctgtcccatgaaagcctcactgtccctggggggaaccagcccagtgctcacatgttgctgtgcgtgtgcttgtccaggacttctgctgggagcctgtggtgggcagggcgctgagagtagaaccagacagtcttagctaaagcaccacacagggcgggtggatgagtagagacagtagcagaggccctgggcggcgctctgatcagaacccgtgggagtgagggtcgcccatccttgaggagggagcacttctggaggaggtgacagctgaaccaagaggagtggatgagggacgaaggcagatgtgaggagtggggcacagggaggggcacgagtgtcaggcaaaggcgcagccacagagtcagaccatggacgggggcctgggcagggagcagctgaggcgtgggtcagtgagcaggaggaggagtgagaagagaggccagggattcaccagggctcccaggaagaaaagatctccagtcttcaatatggagatgagtggccagacagataaagatatttgtgtgtgtgtgtgtgagtgggtgggggggggggtgctggcttctgtgtgtgctcctgatgtcattgtgggaggcaaactctgaagaggatgcagagctgtgtcagttgccctgtagaggcaagaactaagtgcaggctgggcaataacaggaatgcacttagatgtcacggactcagcattcttgctgtctccagctcctttatgaacaaacctgcaaaaagagctctggcgtccgagctggaacattctagcctggcaaactgccgggcagtgtcacagggtgggacaggactctgcccggcatctgagctggaatatcctagcctggcaaactgctgggcagtgtcacagggtgggacaggactctgcccggcatccgagctggaatatcctagcctggcaaactgccgggcagtgtcacagggtgggacaggactctgccgggcgtcggagctggaatatcctagcctggcaaactgccaggcagtgtcacagggtgggacaggactctgccctgctgcgcttccagtctcggggaccatggcatgagtgagatgggctgaacaaaagttcagttctgtgagagaaaccctgcagcctctcccctgtgcaggttacaatgagtggagggagttctgcggcctgcctcgcctggagacccccgctgacctgagcacagccatcgccagcaggagcgtggccgacaagatcctggacttgtacaagcatcctgacaacatcgatgtctggctgggaggcttagctgaaaacttcctccccagggctcggacagggcccctgtttgcctgtctcattgggaagcagatgaaggctctgcgggacggtgactggtacgttcctatccagagcgtcttccttcacgttctgcacagaggcaggtggtctgcgttggttctgaagccagccagacctgcattcacattccggctccaccattcaactcttacgtaagcctggtcaggttgtttctcccacccacagcttctttaacctagaacagtgtttttataacaatgaagcaactacgaagcacgtagcacttagaatgggagctagcactgatttttcctagatccaaccacacgagcaagcaggcacctaactaaacaaattgtgacacaatcgtgacagcccggagactgcatcccatccctcacgtcccatgacaatgcccgggaaagcgcagaggtggacagtgactcaggcgcagacacaggccatgcccggtgctcatggatgcctctaggctggacaggacttcccggccccccagaccccacctacagatagcagatggttgccggtagcagaaagctgaggtcccgctttgcctgcctcatgcatgtctgctccctcctcaagttcaacctagaatttggaggtttgtactggagggagtcagaggcagatcctgttcccatctgactctgagtgcatgccccccgtagaagcaggtgcgcaggataccagtgttaggattttggaacaacacagacaaaagcaataggaaaatgttttcttttgcttttaaatacatccctacctatccaattctctctctatttttggtagtcactgtgccgaggtcagatttttgttgtaaaggatctgtgttcttcccagagagtgcacctgccacacgctggggctcctgtcctttccccagtgtgacttttatctctaatttctgagatgcagcctttcaaagagctacgaacacctgggtagaaatcaccaggagaacttgtctcccttatagctgtgtcttcagcaaacgtgcggtttggaattctctgggacatgggaagccactcgctcagaagggggaagatttcaccagcttgccccatacgtgtgtctcccatgcgtgttttatgccacctgtggctgaagcgccatctgaaatcagtgcagaggcagctggcaggttcctagggtggtgcccccaatttctcatcctatgtatttatgaccacatatctccccaatgcaaaaatgggatcaattaacttacgtatagtggggcctctttttcatgttctaagaggaattcatccctgtgatgggaagcagaagagttttacgtggcaggggagatgcacatgggagatgcatgctttacggcattcaggccaggagctattggggctttggcaactattttcatattttgagaggaaagtgggacttcatttcttcacattgcaatttttctgattaatcatggcctggaggaagaagctgaaggtagagagactgtgcagggcacgttgacttcagaataggagcaccctctaaaatagctggatttgctgtcatcattcttgtttttaacacagcaatacaccccagataacagcaatgcagcaaaatagatgctcatagtcaacaagcaaagtggctctgagcccctcttctgaggccgctcgttcagacagccaggtgcacgctgtgctgcccctccacatctccttcgggtcctcagtacctgcacctgagtggtcccgggtgctcaggggtctgggcagacgccacagggtctccttcaggtcctcagtgcctgcacctgagtggtcccgggtgctgggggtctgggcagacgccacagggtctccttcaggtcctcagcgcctgcacctgtgtggccccgggtgctgggggtctgggcagacgccgcaggagaggctggcagcacacagctgtgggcagctggtcttgagtgcctgccctgggggttctccatgcactgtgaccttactcactgtctccttctctggaggttttggtgggagaacagccacgtcttcacggatgcacagaggcgtgagctggagaagcactccctgtctcgggtcatctgtgacaacactggcctcaccagggtgcccatggatgccttccaagtcggcaaattccccgaagactttgagtcttgtgacagcatcactggcatgaacctggaggcctggagggaaacctttcctcaaggtgaagttcggtctcctctcacaccacgttacagcacgtgcatctcatcaaacaaagcttatcttccccaggagctgattttaacttttcactgtttagaaaatagtgtcaacgccctgccttacaccctcagggcagctcctggggcggggcggggcggggcggggcccttctctagtgagaaaggaactggaggcctagagaaagggagcccgcggggcccgatctgggaagaggccgtgtgtgctgcgtgggtgctcagtgagtgaccacagcagggctccccggccctggcaccagcccctccagggcacaagcgcacccgtgacagggacgttggtgtgtggttttcttttctcgtagtttgactacatgtcaacctgtccacatttcatagacgacaagtgtggcttcccagagagcgtggagaatggggactttgtgcactgtgaggagtctgggaggcgcgtgctggtgtattcctgccggcacgggtatgagctccaaggccgggagcagctcacttgcacccaggaaggatgggatttccagcctcccctctgcaaaggtcagtcctttcttcaatgacaattacaaaacatctgaatgtttccgatataagttaacaatgcaatgtcattgaaaatttcttcgccaaaaggtgcttctgaaactgttatcttcccaggagcaatctggggatagaaagcaagggctctccccttggctggccatgttcccagctggcctttttctaggtagtgaggcctcaggacaggcacgtggaatcgtgaccaatggggtcaccggtgagggaagagagaggggagtccgtgagttccaggcaaagttgtggtgaactcgcaggggcgctttctcaaagggaacacagcagcaaacgtctccactccaggaacccatagagtaaggctcgcctccacctccacctcctacaggtggctgattcccaagcccatgcctggtcctcctccagccactgggttccactcccagcctcccgcatgtttaggtgtggacaagtgtggcttcctggcggtaatttgagagcaggatggggaggcacctttcaggccgcaaggcaagacagccgtgggccacttccacctgctcctcccatgtgctggcttgagcgggtgtcagcccagggcacctgggagcaggtgtgctggacaacagagcctcccggggggagagccgtgtactggggttcctctgcggggaacagcagaatgagagtccccatctgactgttctgaggcagagccctctgggtgcgactcctgaggctggggcttcctgtcagagcagcttgcgtcctccaactacttcagaactgccctgccacaaaacctggaccgctggttctggtctcatgggacagtggcgtcagggcaggcaggagcaggaatggctgctgttctgggaggaaggctgctcagatgacactcaccagcaatctttagaaggccaaccagctgccttcagggactgcattttaggagaggaaagttggcatcagactcacagtctcctgtgagctacgtgctatgagctgcacttacctagaccgcagaagaaagagatggtctcgtgcaagaatctggctggtttgcaagcagaaatacaagcaaagtccacagttttcagttttctcagagttttcagaagatgaaagagtcctggagccagtgctttgggagacccaggtgagagaatcctctgaggccaggagttcaagaccagcctgagaaaaatagtgaaaccccatctaccaaaaaaaaaaaaaaaaaaaaagtggctgggagggggatggtgtgataagttgcacaaggtcagtgtgctcaatgccagtgaactgtacatttaaaaatggcagaggtggtaaagtttacattatgtataattcagcacaataacaaaatttccatttcaattttgaaagtccaaaatgtttctccttgaagggttgcagtggtcaactgcttccagaccctcagtcataaagggagaggctgagaccctgtgtgcaccagagacccaccaggactcagtgctgtggcaggggtcaggtaggggtgcggctcccgccaagtctgtggtctcaggtgccctcccgggagccaccttcccattagaagaggagagaagggatgaggagaggaagaaacaaagctggcctggggaacggtgcctcggaaataactttcaaactcactaacggcacaaggagctgcctgggcatggatagggcagaggcctgctacataggtgagggggtgtcatcactggaaaccagcagcctgggctggaaaccctctgtttaaactgttaattgcacaatgccagatttgcagacgtgctcccctgctgcattttgggattggtcatgaatgacagtgtacaaggagatcacccagagattacagtgccccagagaacagcagaccaggatgtttctcccagagaactttccagaagcctcggtgatagaaacacaactactctgtcgggtgatgacatctgtgtaaactcgtggttgctgttaacactattgcatgactcctgaccataggctctgccactgacacttcagtgacaaaagggtcacgaatcgcaaggttttcctgttcccttggcttagagactgcacaaacttgaaacggccacttcactcacgattcctggttttccgtgttggcattacagttaaggaattgatggcaggtgcttcagggtatagcatgttgcgtgttctacgttaacaagccttcctatggtgcacttcactgtacacctgcgtctctccttgcccaaatacccagacgtttcacgtgtccattttagcttcattttaagtatgaatgaccccaaagtgctactcacaggcatcttcaaggtgcaaataaaagatgggtgagaccttagagtggatcaggaagggagactgctggagtcctacaacctgcctgtgtggagctgccccctgtgcgcgtgccctctgaccttccgcctgccctctgaccttccacctgccctctgaccttccgcctgggacgttgctcatctgtctcctaagtgaggaatgctccttcagcctcctgtagaccatcctatgccatcaaaatcactcttctgttcttgaaattttttcatttatcttccttgatttttagtccaacaattaacagctgtctgaagttaagatccattgtaagaaggactatttctgaaccagtctgggtgctccccagggtgcaggggcctgtctcggcatggtgcgtgcacagcagccagtgctcctggtgggctccctggctgcagcaacatcaccaaggagcttatcacacctgcggcgtctggggccaccacaatccctgagtcagggctgcagcaacaacatcaccaaggagcttattacacctgtggtgtctggggcaccacaatccctgcgtcagaatccacactcttcacaagaccccatgagactgtgtatatgaaggtctgagacacccatcggccaaccctaactcatcctgtcttctctctctagttcactaacttgggcccaacttcatgttctcctgccacagacatttccgtagccatttaatctgtctcccaaattgctgagcctctgtgtgcctccacggtttcaaatgtgaaatgaggacaggaataaggcattgatttaaattagttataaatgcacagtacaaagagcggggtgcaggcctgttgatattaacactgtgagtgctcaggagccgtgttctgaatgctgggacagccacacccagaacaattacactacacagttagcagggcgtctgttgacttggaagagtgttggtgacatgtcactcaataagcatgtaagctacacagcaatgtgtacattgggaatctgttcgggttttttttaaagcagtgggccacaggcacacacatcactttgatgagtgtcctcccgaatgtgaggggagcgctaggctctgctccagaacctgttaatactggagacctcggcagcctgagatggggacaggtaggagagattgctaaccttcatcaatacaactcttttttttgtttgttttatcatatctgtaattaaaatatatcttagagataaatgacaaaactccaaaatctggtacaaatgcgtgtgcacagatatttttactacagctgttccctgcactagaagtttcaaaatcgagaatcacaagggaaaaaactcaagtataacagacaggaaactttacgtttatggtaaattgataagaatataagcactcaaggagatcctcagtgaaacctcatcaacacatctgcggctacagaaaggaaggctacgggcttaactgaatatttgatacagaaaaacaaatagtattcgctgctctcttctctattcaaattctacttattcactcaaactcattcacataaaaacttgatattaaggccgggcgtggtggtttatgcctgtaatcccagcactttgggaggccgaggcaggtggatcatgaagtcaggagttcaacaccagcctggccaagatggtgaaaccccgtctctactaaaaatacaaagaagaaaaattagccgggcatggtggtaggcgcctgtaatcccagctacccaggaggctgaggcaagagaattgcttgaacccgggagatggaggtttcagtgagccgagattgcaccactgcactccagcctgggcaacagagtgagactccctctcaaaaaaaaaaaaaaaaactggcaaatgcattgcagtgagtctcctctgagtgcctggatgctgcaaatttcaaatagataaaaagctgtgagtcagtggctttttccatgagttattgtcaggaggttatgcagtaaacgaatatacataaatgctttgtgcatattatggaaaatacagttcgcaaccagtactaatttacttagagaaatggaaacatctgtgcactcactgcatgtggagactggacaccacagccatctgcgcactcactgcgcgtggagatgtgtggacaccacggccactcttcttgaaactcaaggcgaagcagtcggagagcagagcctcggcctccatgcaggtcaccctggtatctggggacactgcggctgaggctggtttcctcctctgtcgggagcgctgctcttcagacaaggccgatttgtccccctccttcctgtccatcctgggaaggagacctacacagcgctggcccctgactcggccttctgcttagaagaaactgaccgtgggtggagcgttgtgggccaaactgtgcccccaaaaagctatgctcaagttctagccccgtgtacctctgcatgtggcctgatgaagaagcaaggcctttgcaggtgccgtcgagttaaagtgaggctgtcgggtgcatcctgctccaatgtgcagtgccctcataggaagcagagacaagacacagacgggaccctgtgaagacccaggatggaaataaagcttctgccaggcatgggccccccaggacccaccaggagccagggcatgcaggaaggacgccccccgactcccgagagcctgctgaaggagcaccacccggccgacaccctgatttcagacctgtgacctctagaactcttggaggatgcatttctgttgcttggagccatccactttgtgatgatttttcccagcagccacagggaactcataaggatgagtctgaactgcagggatggggtgaggagagggggcagaagctgctccaagggaactccccgagagggatgcagggatgtgttggcagctgccattcccattctgaggaccccattgcacatcccaggggatggagagaaaatgggcttgtagcgttcatgggtgatgactttgatttttcacacgatcatgatggaaacactccctaccccagaggcggctgcagatgccttcacacagctctggtgctccacagctctgcataacgggatgcaggaggggctggttccaggggcagctttagccaagaaagaccttctaggtttaacagccttgacatggttacctgtacatgaaacactttaatagctgctgctagatagagacaattaacagccgatagtcaatagctccaatcccttgaaatttcttgacccttttcttatacttctttttatttttttgagacagagtctcactctgtcacccaggctggagtgcagtgccgcaatctctgctcactgcaacctccgcttcctgagctcaagtgattctcctgcctcagcctcctgagtagctgggattacaggcacccaccactgcacccagctcatttttgtatttttagtggagatgggatttcaccatgttggccaggctgggctcaaactcctgacctcaggtgatctacccacctcagcctcccaaagtgctgggattacaggcatgagccaccggacccgacttcttatactcttatagaatggttgtcattatcaataatggcattattaaagaccgtactgtttagaaagcctgagatatccctgacaccctgctagttgtcataagcatcgtctttgattccacgcccatttttcacagctgacataatgatacccattctgtaactgagaaaaccagcatgggccaagcctcccccggggttaggagtgggcagtcccatccaatgcagcccctcaccctggggagcaggtggccagccgaccaccccagctggccttcgaggcctcacgggtctccggcactgggtcgcctgagcactgcccaggttcgcacattctcatcgtcctggggtggccgagtcggggaccaagaccctgtggcctatgtggaccccggctcctccactcagcggtgagactggggagggtccctccacctctcccagtgcttttgctctgtctagggatgtcgtcagcaccagggccccaggagtgcagggaggttgctgcctccagcctggccctcggcggaggctgcacccaggccagctctgttccctccagacagagcagctcctggaagagctcgtgttccccacactgacagcacctgctccatttagagaatgcgcactgggcatgtagagaagacctgtgacacgctacagcttcttttctaaaactggccagaaaaggaacattatttgaacaaaatgtacagcaggttatctggaaacatacgcctaggggatgagatactaggttgtaggattcttgtgcagggggagcaggagcaggaggggaccccacatcctcactggcggtggcaggtggccccagtccttgctctcagaggacctgccggccagctgggagcatctgcctgggcgaagcagaccctgccccaccctcaccctggccccttcctgcccccgtgtcctgcacttggccaaattccacattcccaggcagaccctgatttcctccaggaagtctcctgtgactcgggcctgagtgagccccagtgtgtggactccctgcaggctcagagcccgtggccagcgcacatctgtctgctcctcatcaccttttcggatgtgccgggagcagggggcggccggttccccctagaccaggtgggatggcaggcaaagggctgacctccccagagagaagcacctcccagaacgggggtcgctcgcgggagatgggggtgcagccgcttcctctcacgtgtgtggccttgtgtgtctggcagatgtgaacgagtgtgcagacggtgcccaccccccctgccacgcctctgcgaggtgcagaaacaccaaaggcggcttccagtgtctctgcgcggacccctacgagttaggagacgatgggagaacctgcgtaggtgaggctgttcccctctctctctgtccgtccatttgcgagtttttgtaaaatgaagaaaagtgtgttcaagttaggcaactgtcaatcaccatcttgattgggaagggcggagatgaataagacaccaagcccacggtgcccgaggggcgtctgcgctgtgctgggggcagaggatgcacttcgtgtgcctgctgtctgcagagaccctcgaagcacactgaggctggggacggcagccagaatgcattgccagacaaggcccacaggtgtatacccagcctagatcacaccccagacaaaaaacctatgaaacaggcaggattcattacagacccatccatcacctctcctcctcctgggacccctccaaatgcacccgactgcaccctgaccagggccagcagcacagctgcctgcctgttctcccacctccacctccggatgtccccgcccggcatggggcctgggtgctcaacatctgcctcggatggccttgtccagtcccccagctctgcactcagctcagggacagcgtcttcctcaccgctgcctccaagccaggtgccagctacgcccaaacttttgacgaatttactcccctgaaaattgtggctcttaggtaagcactatctttaatcttcattttatagaagaggatactagtgataagagagggcgagagacgctcctggtcacacagccactccgtagctggccgggaatttgtgttaatagtctggcttccagctcttatagaaaaataattatttaccagactcaagttacagacagacttcctttgagctactgtcataggggagagaggtctccagaaagaaccaagtgcaaggctcaaatgcagcaaaggtagctgggacgtccagccagggcggagaggggtcagtgcaaaacgcttcatgactcaactgcattgaggagcttctgctaaactggaataataggattcttgctgaaactcagctcctcagcgaagggcacaagggccagggtcaaggccagttatcaagcaagtgagtctgaaaagagatggccaggacgcggctgcccggggccttcagaggctggggaggctctttctggggctctcaagctacatccgcttgactggcacgtcccccactcctgtgtcaggcatacacccccttcctgtgtcaggcgcaccccctcctgtgtcaggcgcaccccactatcctatatcaggcacatcccactctcctgagtcaggcacaccccaccagcttgtgtcaggcacacacccccacccccgtgtcaggcacaccccaccagcctgtgtcaggcacactgccccatcctgtgtcacgcacaccctcccacccccatgtcaggtgcacccctcttcctgtgtcaggcgcatcccccccaccccgtgtcaggcacacccccaccaccatcctgtgtcaagcacaacccccctcctgtgtcaggtacagcccccaacccccatgtcaggcacacccccactccttttgttgttgttgttgtttgtttttatttcttctaaaaaaaaagtgataaatgatgtgaagaacatgcaggtttgttacataggtatacgtgtgccatggtggtttgctgcacctattgacccatcctctaagttcctcccctcatcctccacccctcaacaggccccagtgtgtgctgttctcctttctgtgtccatgcaaaggaaccatttgtttacttaggggttgcggagaaattcttgtggctttctttttggcagtttttttttttttagttttattattattatactttaagttttagggtacatgtgcacaacgtgcaggtttgttacatatgtatacatgtgccatgttggtgtgctgcacccattaactcgtcatttaacatttggtatatctcctaatttaacatttggtatatctcctaatgctatccttcccccctcccccaaccccacaacaggccctggtgtgtgatgttccccttcctgtgtccatgtgttctcattgttcaattctcacctatgagtgagaacatgcggtgtttggttttttgtccttgggatagtttgctgagaatgatggtttccagtttcatccatgtccctacaaaggacatgaactcatcatttatggctgcatagtattctatggtatatatgtgccacattttcttaatccagtctatcattgttggacatttgggttggttccaagtctttgctattgtgaatagtgctgcaataaacatatgtgtgcatgtgtctttatagcagcatgatttatagtcctttgggtgtatacccagtaatgggattgctgggtcaaatggtatttctagttctagatccctgaggaatcgccacactgccttccacaatggttgaactagtttacagtcccaccaacagtgtaaaagtgttcctatttcttcacatcctctccagcacctgttgtttcctgactttttaatgattgtcattccaactggtgtgagatggtatctcattgtggttttgatttgcatttctctgatggccagtgatggtgagcattttttcatgtgttttttggctgcataaatgtcttcttttgagaagtgtctgttcatatccttcacccgctttttgatggggttgtttgtttttttcttgtaaatttgtttgagttcattgtagattctggatattagccctttgtcaaatgagtaggttgcaaaaattttctcccattctgtaggttgcctgttcagtctgatagtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatgtaagtctttaatccatcttgaattaatttttgtataaggtgtaaggaagggatccagtttcagctttctacatatggctagccagttttcccagcaccatttattaaatagggaatcatttccccattgttgtttttgtcaggtttgtcaaagatcagatagttgtagatatgtggcattattactgagggctctgttctgttccattggtctatatctctgttttggtaccagtaccatgctgttttggttactgtagccttgtagtatagtttgaagtcaggtagtgtggtgcctcccactttgttcttttggcttaggattgacttggcaatgtgggctcttttttggttccatatgaactttaaagtagttttttccaattctgtgaagaaagtcattggtagcttgatggggatggcattgaatctataaattaccttgggcagtatggtcattttcaccatattgattcttcctacccatgagcatggaatgttcttccatttgtttgtatcctcttttatttcattgagcagtggtttgtagttctccttcaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagatgatggggttttctagatatacaatcatgtcatctgcaaacagggacaatttgacttcctcttttcctaattgaataccctttatttctttctcctgcctgattgccctggccagaacttccaacactatgttgaataggagtggtgagagaaggcatccctgttttgtgccagttttcaaagggaatgcttccagtttttgcccattcagtatgatgttggctgtgggtttgtcatagatagctcttattattttgagatacttcccatcaatacctaatttattgagagtttttagcatgaagggttgttgaattttgtcaaaggccttttctgcatctattgagataatcatgtggtttttgtctttgattctgtttatatgctggattacatttatcgatttgcgtatgttgaaccagccttgcatcccagggatgaagcccacttgatcatggtggataagctttttcatttgctgctggattcggtttgccagtattttattgaggatttttgcatcaatgttcatcaaggatattggtctaaaattctcttttttggttgtgtctctgcccggctttggtatcaggatgatgctggcctcataaaatgagttagggaggattcccgctttttgtattgattggaatagtttcagaaggaatggtaccagctcctccttgtacctctggtagaattcggctgtgaatccatctggtcctggactttttttggttggtaagctattgattattgcctcaatttcagagcctgttattggtctattcagagattcaacttcttcctggtttagtcttgggaagaagtatgtgtcgaggaatttatccatttcttctagattttctagtttatttgcgtagaggtgtttatagtattctctgatggtagtttgtatttctttgggatcagtggtgatatcccctttatcattttttgttgcgtctatttgattcttctctcttttcttctttattagtcttgctagcggtctatcaattttgttgatcttttcaaaaaaccagctcctggattcattaattttttgaagggttttatgtatctctatttccttcagttctgctctgatcttcgttatttcttgccttctgctagcttttgaatgtgtttgctcttgcttttctagttcttttaattgtgatgttaggatgtcaattttagatctttcctgctttctcttgtgggcatttagtgctataaatttccctctacacactgctttgaatgtgtcccagagattgtggtatgttgtgtctttgttctcgttcgtttcaaagaacatctttatttctgccttcattttgttatgtatccagtagtcattcaggagcaggttgttcagtttccatgtagttgagcggttttgagtgagtttctgaatcctgagttctagtttgattgcactgtggtcggagagacggtttgttatttctgttcttttacatctgctgaggagaggcacacccccactcctgtgtcaggcacacccgccctcttctttcagggacaccacaccctcttgtatcgggcacaggataccctcttctttcagggacagcacagcctcttgtttcagggacaccacaccctcttgtttcagggacaccacatcctcctgtttcaggcacaggataccctcttgtttgagggacaccccaccctcttgtttctgggaaaccacaacctcttgtttcaggcacaggataccctcttgtttcagggacaccccaccctcttctttcggggataccccatcctcttgtttcaggcacaggataccctcctgtgtcaggcacaccccaccctcttctttcaggcacaccccaccctcttgtttagggcaaaccacactctctggtttcaggcacaccccccttcttctgtcaggcacagcccaccctcttgtttcagggacaccccacccccttctttcagggacaccctacccttttgtttcagggacaccgcacctcttatttcaggaacaggacaccctcttgtttcaggcacacacaccctcttgcttcaggcacaccccactctcttgtttctgggaaaccacaccctcttgtttcagggacaccccaccctgttgtttcaggcacaccccccctcttctttcaggcacaggataccctctcgtttcagggacaccacaccctcttgtttcaggtgtcctctctctgcacagcatttccccctcacactcattgttttatcagcctctggttttattcatgttttttctccatatgaaatagtatcctctcttcctttcaaaccagagcactctcaatcatggaaaattagaaacagcagctcttgcattcagatttttaaataaaatgtttaaatcaatggttcagatgtgaattgcaaaggtagccaggtagcgaagctgccacattcacagagaggagctcagctgctttccgcattattattacaaacctaagaaagcggattcagaaccctgctcaggtgaaggcagtggggcatttacgtcaagactgcagttttgctggactacagcccagaagcacttgctgtatttttgataatatctaaccctgtcagatggctccatggggccccaggaaacacttctactgctgtactccagctgaagccaccaccctccatccctcccaatgttttcttctggactcacccacagaaagaaggagaaaggagtcccagtggaggtcaggaacagccctgggagagcacccagagatgaattcgtgcctaagagggctcacccactacgtctcttcctcctcccggagagcacccaaagatgtgttggtgcctaagagaacttgcccactacctctcttcctcctgggccccctttgaatgcctgcaccgtgaccggggccaggagcacatgagcctaagaccattctgtgcaccagggcccatgtctgagagattaatacacaggtgcccagggcttctcctgtctccgtggtgatttacagacttagatttagatacagatattgattatggatagagacagtttagatataggcacagatgcagatatatagatatagatataaatttacatataggtataaaagaatagatttagatttcggtacaactctccctatataagtttagacgtagatacacatatagattcaggcatcgatataaaagaatagatttagatttcggtacagctctccctacataagtttagatgtagatacacatatagattcaggcgctgatataattatagagggagctctgcttttgcagtgttttgttcctaacgttgcggttaaaggaactgtattcatttcctgggggtgccacagcacagccctgcagactgggggtgccacagcacagccctgcagactgggggtgccacagcaaagccctgcagactgggggtgccacagcgcagccctgcagactgggggtgccacagcgcagccctgcagactgggggtgccacagcgcagccctgcagactgggggtgccacagcgcagccctgcagactgggggtgccacagcgcagccctgcagactgggggtgccacagcgcagccctgcagactgggggtgccacagcgcagccctgcagactgggggtgccacagcgcagccctgcagactgggggtgccacagcgcagccctgcagactgggggtgccacagcgcagccctgcagactgggcacttgaacaagagatttctctctcagcaagtcctggaggctggagtccaagatcaaggggagggcacggttggctccccctgaggactcaccccttggctgcagataccaccttctccccatgtcctcccagggcagtccctctgtgtgtccatggcctcatctcctcatctcataaggacatagctgccttgggccacggcccacagtgacatccccatgccactgcaattacctcctcaaatgctccatccccaaatcagccacattctgaggcccagggtgttggggattcagcatgagaatctgggagacccggttcagcccacgacagccaattggtccatagtgccatcttttaatcttcagaataaaactttagaagaagtgtatacaacaggagcatgagttgcataaactaatttccaatattttgtttcaaacgtcttgttttagtttttgtcctgagaacaattacaacatacatttatctatttcctgcatcttttttttttttgagacggagtctcgctctgtcgcctagactggagtgcagtggcgcgatctcagcccactgcaagctccacctcccgggttcacgccattctcctgcctcagcctcccgagtagctgggactacaggcgcccgccaccacgcccggctaatttttgtttttgtatttttagtagagacggggtttcaccatgttagccaggatgtatttcctacatcttaaggactcttttctataaacgctgaagccaaatgtgtctctagagttgagacgttccctcccagtgctacctctttgctaaggaatcctcctgcctggacactgtccatctgcctctccagatcctgcccccgccaagggcgtccgagagagcccctgagcccggcccggaccagcgcccgtgctcagggcagctgtgcgctccgcgctgccttctggttctgtgtgatggatgtgatgcttgcatggtgctgtccctgccccgctccgcccctgctgggctcctggctgccgaacctgaagtcagggtccgccgcagaacacgtcttcccgctgagccctgcagcccctcaagcagctggctgcctccgaggagcttcctctccgacagctgccgtgtacctccctgacctccctggctgtgactcaggccctccggaggcactgggccaggccgccggtggagcctgatggtggacgatggtggacagtgaccttctccttctaaggaagggactgagggagggaaagtgcccccagagcatctcaggagctgggaggtgaacagctggggatgctggcttcagtgcttcccccaccaccagcacccttatgattatactgctgcccctgcaaaaatgaccatggaaaattaggatgctgggcatgacctttctgcatccctgacgcacaagcctaactgttgttgcacggaggccacacacgtccctgatgaaagagccctgctcccgtgcaagcagccgtcagtgccctctccgtacagatggcgcagccatcagtgccctctctgtacagacggagcaggccagcaggacccagcactgtccctggatgcaccagctctgtcactgctggctggaacacccaaaagggtgatggacatggctgtccctcagttttcagaatgacagcgtgaaacccaagcctgcctgcatgaggaagggtggacacagacagcagcagaggcctcggctgagtggacatgcgctcaggtgctgagggctgagagtgacccaggagcaacagctgagccatatttacagcccctcctacgagccctggctggaggccagaggttccagggaaggtgggcaccagggcccatgtctgagagattcataaacaggtgccacggcttctccttccgtcctcacagtgactcacagacaaggatgccaaggcctggaagatgaggcatggctgtgagaggagctcacactcccctggcctgcgagagctctggccccggccagcccgtgtgctgatcgtattagacggagtctccagagaaacaggagcaatcagagatgcagatgtatgtatagaaatagttatagattagagacatccatagagacacagtttgtagatgtagttacgtagatttagatatagatatcgatttaaatatggatatatgtagatatactatatatagatttacatagattgaacatagatatagataacaaatatgtagacatagatatagttatactgatttagatatagatactgattgtgggtatatatagttttaggtacagatgcagatataaaaatatagatataaatttacacataggtatagaatagatttaggtgtagctatacctatgtaagtttagatatagacacaatatagattttggtatagatgtaaatatagaggtagttacccatacatagacatagttttacatgtgcttctagctctatgtaccgatatgtgaaagcatctctattctgcagaattggtcatgaaattagagaggctgaggagtcccaggatctgctgtctgcaaactggagccccaggggagctggcggggcagttccagtctgagggcaggtgaagctgcaatgagatgtcccagctcaagcagagagtcaggaaaagagaagtgaagccctttttcctccacttcctgctctactggggccctggaaggatgggacagggcccacccatgttggggagagccgtctgcttttctcagaccacagattccaatgctgatcccttccaggacccaactcaaaaacacagtgggaataatgtctaatctgggcgcctgtgctccagtcaagcggacacataaaattaaccatcccagtcatgttattctgacctgaattctccaaaatcccagtgccctctgtctgcccagggcctgcccaaacccgatgccgtttctttccaaaggccctcgttggccttcacccagcctcagggactcccccttgcccagccccaccagaggggcacccacgcccacagcagagaactccagggctccccggggtggcactgaagaggtcggaaagccactccggcagcagccgtgacctttgtgatgcccccgtaggacatgcaggggcttcaggacctgtctcagctgggtatctcccagaagcacacagccttcaatctggttccaagcggatttactggctcttgaaattgaaaatgccaagaaacaaaaatttggagcaaagaataaaggaaagtttctgctgtgcggcatctggccttccccctgcccaggctcgtttcacacttttgggtaaacatggagctgcttacgtccctgctgtgggtctgccgtttgctggtgtgaggtgggcttcaatcagatgctcgccacggcccaggacgtggctcctcctctcactcaaggctctgatgtcagatgcctggctttgctggtttttgaagttccacaggtggcccctccagcccaagtttctcagaaccaaatccagccggaaatgtcaaacaccaattccagaatgaatttccacggctgccctgtcctgactgccctgacctggcctgtgcttacctggaattcccacccaggcctcgatcagctcagccttccccgcacccccagccccaggcacacaggcggagcccccacctctagcagccatgggggtgagagcgagtagcagcagatggaaacaagaacccagcctctttctggatgcaggaggagcggcatcccagggccagcaagcagctctgctccccatgggcttttagcaagaggctggtgtgctcaggttgccctgcagactcccctgcgtctgtgaaaggtggcaggaaggagatcctggaggcgggaggatggttagaggagcccaggaggaaaagtcatgaggtgcaaaggctaagaggacaggatcgttttggagaaacagtcaggatgcgcatttagggtttattcattcattcttgtatccaacaaatgcttgctgagtgtccaagacccatgcgaggaagacagccacggacaccacctgtgtctgggctgggaaagacccatgataggaagacagccatggacacgacctgtgtccgggctgcaaatgagacacacctgcaaatcatgcccaggtgctaagtggcacagggaaccgcagtcacccacagacgcattcatcaccgactttaaaaaatccagtgtgagaaatagaaccaaaccaagcacccattcccccagccgctgcctctgtctggtacctgaatgtgctctcttagccccagagcctatcttcaaccacacgtgatgatgtttatccagggcgacccatgtttgtttaaaaaaaaaacgctgattggtagtatttaaattcttatttaaaagtcagttttcgtttcatcttggatttctcctcggccacctcgaatgggtatccaaacagaaaagtcggtaataaaactgtggtcaaaggagctctgagttcagagccgcagtggccccaggctggcagctccttgcagaaagcacagaagccaagggctggagcccaggagccgttactcagtccccggctttttcagatgaagacacaggtccaggtgggaggcacttcctcaggcccctcaccagatgctctggggccggctcctgggctgcctctctcctctgtcccatcaggcctgcacttctctgtctgattcccaccaaccttgttcggtttctttctggaattggctgatgagacccaggatgagctccaaaatctgctgccatcccgtgcccccgtccccccagggctccagctctgcaaggtgctgtccaccttccttcaaccacggtttcacctccaggaggcttctgggaaagataaaatgcagccaagggcaaaacctcacagcgttataccgcgtcccttacagcccaccttgcgaacctttcccgccccggtccgaggcctccagggctccctgggtcctgtggtccactccgagggcactgagagccctccctggtttgggcagcaaggtgtgctttctgtcctgcaggacgcgtccatgccgaacccacagtgaggttccatagagagagctaacttctctgccctgtgtcccctgctggctctccccacacacgtcacattcggatctggacttagtggtctaaatggcttttctgggcagataaatgtccctccctccctgcgtcatgctgtggggtgaaggccactggcccaggacagggtatggcccagactcaggcaggacaacctggcttgcccaggccctggaaggttcttctaaccaggcctctttctgtgccccagactccgggaggctccctcgggtgacttggatctccatgtcgctggctgctctgctgatcggaggcttcgcaggtctcacctcgacggtgatttgcaggtggtaagtccttcactttttgactgttacttagacacaaagcaatctcctttcctctggacatggctgcaatgaagctgctttattttcccgaagctaacacaggttactggtatctcaaaggcattgatctcagagctattttgtacaacgtaatagactctccggatctttcattatgctttaaataatgaaagtggagtgatcatttgtacaccttaggtggtgtcaggtatctgtggacgaacattcagcaatatggaacacttttctaacactaaatgattgcattgaagtagtctcttgttaggagtaaagattcttacaaaggtttctcagagaaaaaaggtcatccatgaataaaaagttttattcttcagttttattccctcccttgagggcagaaattggaagttgaactttcatgttaaaaatggcgctgctgttgaaagactcagacccgcacctgagaggccctgccctgtgagagtgctctctgcagaaagagcccctcgaggcttcctcaggtgcggcagctggtccatgtccctagccctgaggaaccggctctgttccttgctgctgcctctcaccttgctgctgcctctcaccttgctgctgcctctcaccttgctgctgcctctcaccttgctgctgcctctcaccttgctgctgcctctcaccttgctgctgcctctcaccttgctgctgcctctcaccttgctgctgcctctcaccttgctgctgcctctcaccttgctgctcttgagcaccaaactccttgagcatcccttccatttttaatgcacaattgttcattttatatagacagtattaaaaataacagcaaacactataagaagtcattgcaggcccaggctgggcccccagggccatgcccaggatacctgcagatagaggccacagtttctcggcttctgctctccctgagtgccaggctcccccccccaatatgccctgtgcacactcctgctgcagccagccctgccctctgccaggatgacccctgcagtcaccttcgccctccaccccggccttcagagctcctcactggcggagcccccagcaccaccccataccacacatgtatggattatccaagcctcccagcctcacccgataccacatatctatggattatccaggactttcccactctaaggccatcttccagggtgtttctcatcttcccaataatagaaactcaacattctagcaaacttcatttttctagcaacttctcagtacactgaggaacatctgccccttgaacaggaaatctttttcttacagtctttgcacctcctacaggaactggtttttaaaaacttgaaagcttagcaaccagatgttacccatgatctttatcgtttccaaagggccttgtcaagaatccacagttaatggactcttttctgttgtttttatttttgtgatcacttgtaagggaagactctgtacctgccatctgctctgcatcctgtctctctggggctgagatatggtagtaaagccagttccccatttcagttattctgcaaggcctctgacaactgctgtggttgacccagatgcctgcatttgatgcatgagcttatgatctatccggcatatgatatttcagtgacgtatttctgagtagcttcatagcttctaacaaaactaacatacaccataattcagacaactgtgagaaattccttccagtagagaggtgatagtaatggctaaagccatgtgtcagatgtaatgctaagtcatccttagccactgtctcctctgattttctgatcaatcatctgactcaggtgcttgccatggcttgaactgtgcattgcccagaacatatgtttatatcctgacctttaggacctcagaacgtaaccttatttggaactaaggtctctgcaggtgtaattagttaaaatgagactgtcctggagtagaggggcccctaattcagtatagctggtgttcctctagaaagaagagtttggacagagtcatgctgagcaggcgaaggccatcttgacgggaaggcagagatcagggtggggtttctctaagctggggcctgggaagatcgccagcagccacaggaactgggagggaggccgggggagccgcctgcaggcaccttgatgtggactcctgcctccagagctctaggtcataaactgctgtttaagcagccaagtctgtggtcctctgtgactgcagccccagaaaacttaatgaagtgctatgattgtgtccattttcagtgtagcatgtggaggtggagcgagagcctgttacttgctcaaagctggtaggcccagagcagatccttgaacccaagacctgtctggtgctggaggtcgtgccacagctgccctgcttctcctcgcgagaagattatattccacatgccagggctgttgtttcaaataatcattaccagtgaagattgaataatcacctactctctctacaagacactatactgatctgttttggaaagagagtactttaacctttaaatggtgtctctagttttagatggggtggtggcaggaaatattccctatgttttatgaatcatttggtctttaaaccttaaaaactttaataactaataattaaaaccctcagctaaccatgaaatagactaagcaataaaaattgaataggctgtaagcaaataacttcaaattagctggttctgtaattagaactatgaaatgtataattgtaacaaaaactgatacgactataatttcctattcataaacaattttgtatttgcaaacatccctataaacatctatcacattatcattataataaatattagtgtctgtagcccacactcacaagaaaaatagcaattttctttaagattgacagccatagatgaaatgaatacctttccaagggaacttgggagagaaatatttggctatagttgattttagactctggagttctaaaaatacgctaccaagcaccaatttagtttgcaaaatgccacttagctgaaagatatgaaaaagtggatgttaatgtgccatcacacgcttgagaacacaggcagttacagagtcagagaccataacagggaagaccctggggctccagggcagaaacatcctggaccaaaaccacagcacccccagacctgtgattaggtgagctcagaaggtcaagtcactcattaggaaatgtcttcccaccacctaccctgagacccctattctgctcccagcaaatgggctcaacacaatcccagcctcgcctccctgtgtcttattcttcagcttttaaaaacatgatcttatttccaccttagggcattattgtgcggtgaggagtagggaggagaacagagagggataggaagaaagagagacagagacagcagagagagacacgggaggggagagaacccagcacggtgtggcacacagcaggtgctcagcaaacacgtttcctctcctagtgagacaaaggtgtttgcttctctactctcctcgttttctacccaccctgctgtctggggtctcacactgtatgttttggtgtgattgttattaatgtgacaaattgttgatatattttcactgcaaatctacgattcggagttaactccatgaaaccaactcctccatcaactttcttgacactgcatttaaaatacctccacggtattatgcttgttttattgcattgaaattgttttcaccaagttgaattctttctgtgcaaacttttacactaaaaattcattcctcaaatcagttctttggtccatgtcagttttgccaattagacctttcgccatggaggtgttttcctttgtgttatgatttcttcagatccggctttcttagctcagcattttaaacttaaatttcatgaagactttgtctgtctgttgattcttactgtccagggaagatgctaaatgtgcagttccagtcctttctccattcgctcttgtttttattatttttaccaattctacttttccaccatcacttagttctgcaatttctgaaatacaatttttcaggttttccttgtcgttgataaacggtgccctatacctttttgctgttttcagttgtattttgtattgatattcctacctatggtatgcattataaattcaagaaagtttgaatcatttgcattaatttccagcaaatccatgggaaagccgcgaggtccttccctaggatgcagccaggtttgtcctccgtccaggacgtctaaccctttgttccctcctgcaccttcccacgctgtgagctgacgggtgctgtttctctaggcacgtcacggggggttcctgccatctctcctctctttatcattagattcataagcgtgctggagggaggccagctgggactaggccgaggcagccatggggcagtgggccacgggatccctgtaagccatgggtgaccgggtgccctcttcccccaggaccctcctccccagggaccctcctcccccagggccctctttccccagactcttggggtagagacggcctgagtctcttgagatggagtctgaagcttctggtcatctgaactgcatgttgatgacaggaattgtcttcaggacgtcattagggaagtccgagagaactggccctttgctgggggacagacgtagagtggccagcctgggctacacagcatgggggatccgaacctgttgtagtggaatccttcagagtcagtacggcgtctgtgaggcactcaggccccagaggacctggggaaggacctgcgctccttagagacccacgtctgccctggaaatgagcagggggagctgttcccagcctggtcacacatgaaccacagcaaggacagcctcccaccccagtccccccgtgggttcagctaaacgcattgtccagtttccagcccagaacccaagcctggctgccaggctcatctgctttctctgggcagctcccagcccctccctctgtggccccactttcttcacccacttctgagcaagtataggtgggaaatgtgccttcctccctctcctgaccccaggctgtctactccacaccggccctgccaccgtgccctggcagtctctctacccgacaccggccctgccaccgtgcccttacagtctctaccccacactggccctgctaccatgccctggcagtctctctaccccacaccggcccgccaccgtgccctcacagtctctctaccccacacctgcccgccaccgtgccctcacagtctctctaccccacaccggccctgccaccttgccctcacagtctctctaccccacacctgcctgccaccgtgccctcacagactctctaccccacaccggcccgccaccgtgccctcacagtctctctaccccacacctgcctgccaccgtgccctcgcagtctctcttccccacacctgcctgccaccgtgccctcacagactctctaccccacaccggcccgccaccgtgccctcacagtctctctgatctgtctccctctcctgcccccagaccatctacctcacacaggccctgccaccgtgtgatgcccagccattcccacttcttggcttttattcaagcctcaatctctccatagaatactccctccttatcatctcaacctggcttcgaatgttcaagtctgacacatcgcaaaggctacacccaaacaccacccactgtctgcaacctccccaaacccccactgtatgcaaggtcctcaaatccccccactgtgtgcaacctcctcaaatcccaccactgtgtgcaaccccccaaatctcccccactgtgagcaaaaccccaaatccccccactgggtgcaacctcctcaaatcccaccactgtgtgaaacctcctcaaatccccccactgtgtgcaacttcctcaaatcccctccactctgtgtaacctccccaaattccccccactgtgtgcaacctcctcagatccctcccacgctgtgcaaactccccagatccccccaactctgtgcaacctccccaaatctccccaactgtgtgcaacctcaccaaatcccgacactgtgtgcaacctccccaaatcctgcgcactctgtgcaacctccccaaatccgccccaccctgtgcatcctcccaaaatcccccacactgtgtgcaacctcctcaaatccccccaactgtttgcaacctcccaaatccccccactttgagcaacctccccaaatccccccactgtgtaaaacctccccaaatccccccactgtgagcaacctccccaaatccccccactgtgagcaacctccccaaatccccccactgtgtgcaacttccctaaatccccccactgtgttcaacctccccaaatacctcccattgtgtgcaaacaccccaaatccctcccactctgtgcaacctccccaaattacccccactgtgtgcaacctcctcagttccctcccactctatgcaaactccccaaatccccccgactctatgcaacctccccaaatcccccccactctgagcaacctccccaaatccccaccactctgtgcaacctccccaaatcccccacactgtgtgcaaactcctcaaatccccctactgtgagcaacctcctcaaatcaccccccactgtgttcaacctcctcgaatcaccccactgtgtgcagcctccccaaatcccccccactgtgtgcaacctcctcaggtcccccactgtgtgcaacccccccaaataccgccactgtgtgcaacctcttctaatcccctcactgtgtgcaacctccccaaatccccccactgtgagcaaactcctcaaatccccccaactgtgtgtgagctccccaaatccccccagtgtgtacaacttgcttaaatccccccaactgtaatcaacctccccaaatcccccctactgtgtgcaaccttcccaaatccccccactctgtgcaacttccccaaatcccccctactctctgcaaactcaccaaatcccccccactctgtgcaaccttcccaaatcccccccattgtgggcaacaacaccaaatcctgccactgtgtgcaacctcaccaaattccccccactccgtgcaacctccccaaatacccccaactctgtgcaacctcccaaaatcccccaaactgtgtgcaacctcctcaaatccccatcctgtgtgcaacctcctcaaatccaccccactgtgtgcaacctcctcaaatccccccactgtgtgcaacctcctcaaatctcctcacagtgagcaacctcctcaaatccccacactgtgtgcaaccaccccaaatccccctactgtaagcaacctccccaaatccctccactctgttcaacctccccaaatcccccccactctgtgcaacctccaactttccctcccattgtgtgcaacccccccaaatccccccactgtgtgcaaccccccaaatcccacccactgtgtgcaacctcctcaaatcctcccactgtgtgcagcctccccaaatcccacccactgtgtgcaacctcaggtcccccactgtgtgcaacccccccaatccccctactgtgtgtaacctcctcaaatccgctcactgtgtgcaacctcctcaaatccccctactgcctgcaacctcctcaaatccccccactgtgggcaacctccccaaatccccccactgtgtgcaaactccccacattccccccagtgtgtgcaacctttacaactctactcactgtgagcaacctccccaaatcgccccactatgagcagcctcctcaaatcccccaactgtgtgccacttccccaaatccccacattctgagcaacctccccaaatccccccactgtgatgtaacctcctcaaattgcccgcactgtacaacctcctcaaatctcccccgctgtgtgcaacctcctcaaatcccgactctgtgcaacctccccaaatccccccagtgtgtgcaacctccccaaatccacccaactctgagcaacctcgccaaatcccccaactctgtgcaacctccccctatccctcccactgtgtgcaacccccccaaatccccctactgtgtgcaacctgctcaaatccccaaactgtgtgcaacctccccaaatcaccctcactgtgtgcaacctcctcaagtcccccactgtgtgcaatccgcccaagtccccccactgtgcaacctgctcaaatcccctcactgtgtgcaacctccccaaatccctcacactgggtgcaacctcctcaaatcccctactctgtggaacctcctcaaatcccccccactgtgtgcctcctcaaatcccctcactatgtgcaactccaccaaatctcccccactgtgagcaaaaccacaaatccccccaatgtgtgcaacttcctcaaatccccccactgtgtgcaacctccccaaaaccccccactgtttgcaacacccccaaatttcccccactgtgagcaaacccccaaaacccccactgggtacaacctcctcaaatccccccactgtgtgtaacctcccaaaatccccccactgtgtgcaaaccccccaaatctccctatgaccaaaaccacaaatccccccactgtgtgcaacctcctcaaatccccccaatgtgtgcaagccccaaaatcccacccactatgtgcaacctcccccaaatccccccgactctgtgcaaactccccaaatcacccccactctgcaaactccccaaatctcaccccactgtgggcaaccacactaaatcccgccactgtgtgcaacctcaccaaatttccccgtgtgcaacctacccaaatgccccccactctgtgcaacctcccaaaatcccccacaatgtgtgcaaactcctcaaatcccaatactgtgtgcaacctcctcaaatccccccactgtgcgcaacctcctcatatcccccgactgtttacaaccttcccaaatctccccactgtgagcaacctccccaaatcccccactgtgtgcaacctccccaaatccgcccactgtgtgcaacctccccaaatccccccactgtgcgcaacctccccaaatcctcccactgtgcgcaacctccccaaatccccccgactctgtgcaacctcccccatccctccatgtgcaaacctccaaatccccccactgtgtgcaacctcctcaaatccccccactgtgtgcaacctcctcaaatccccccgatgtgtgcaacacccccaagtcccccccactgtgagcaaccaccccagtccccccacagtgtgcaaacaccccacatctcccccactgtgagcaaaaccacaaatccccccagtgtgtgcaacctcaattccccccactgtgtgcaaccccccaaatgccccccaatgtgagcaacccccccaaatcaacatgctgtgtgaaacctcaaatcccccaactgtgtgcaacctccccaaatcccctccactgtgtgcaacctcaagtccgccactgtgtgcaacccccgcaaatcctcccagtgttcgcaacctcctcaaatcctctcactgtgtgcaaccttctcaaatcccacgccactgtgagcaacctccacaaatccccccaactctgtgcaacctccccaaatctccccagtgtgtgcaacttccctaaatcccccaaactgtgttcatcctccccaaatcccccccccactgtatgcaacctccccaaatcccacctaatgtgtgcaacatcctcaaatccccaccactctgtgcaacctccccaaatcccccccaatctatgcaacctccccaaatcccccccaatctatgcaacctccccaaatcctccccactctgtgcaacctccccaaatcccctgctttgtgggcaatgtcacaaaatcccccggtgtgtgcaacctccccaaatcccctccactctgtgcaacctccacaaatcccccacactctgtgcaacctactcaaatccccacactgtgtgcaacctcctcaaatcccccccactgtgtgcaacctcctcaaatccccccactgtgagcaacctcctcaaatcccctcactgtgtgccacctccccaaatccccccactttctgcaacctccgcaaatacccccactgtgtgcaacctcctcaaatccccccactctgtgcaacctcccctatccctcccactgtgtgcaaccgccccaaatcccccaactatatgcaacctactcaaatccccccactgtgtgcaacctccccaaaacccccactgtgagcaacctccccaaatcccctcactgtgtaacctccccaaatcccctcactgtgtaacctcccaaaataccccccgtgagcaacctccccaaatccccgcactgtgtgcaaccaccccaaatcccccccactgtgtgcaacctcctcaaatcctccgccactgtgagcaacctcctcaaataccccactgtgtgcaacctcctcaaatccccccatctgtgtgcgacctccccaaatcctcccagtgtgtgcaacttccctaaatccctccaactgtgttcagcttccccaaataccaactgtgtgcaacctcctcacatccccaccactctgtgcaacctctccaagtcacccctactctctgcagactccccaaatccccccccaatctgtgcaacctccccaaatcccacccaattgtgggcaaccacacaaaatcccgccactgtgtgcaacctcaccaaatttctcccactctgggcaacctccccaaatcccccccactctgtgcaacctcccaaaatcccacacactgtatgcaacctcctcaaatccccatactgtgtgcaacctcctcaaatcccccccactgtgttcaacctcctcaaatccccccactgcgtgcaacctcctcaaatccccccaatgtgagcaacctcctcaaatccccccactgcgtgcaacctcctcaaataccccactgcgtgcaacctcctcaaatccccccaatgtgaggaacctcctcaaatcctcccactatgtgcaacctcctcaaatctccccactgtgtgcaacccccccagatctcccccactgtgagcaaaagcacaaatcccccactgtgtgcaacattcctcaaatccccgcactgtgtgcaacccaaccaaatctcacccactgtgagcaaacccccacatccccccactgtgtgcaacctcctccaatccccccactgtgtgaaacctccccaaatccccccaatgtaggcaaccccccaaatctcccccacagtgagcaaaaacacaaattcccccactgtgtgcaacctccacaaatcctcccaagtctgcaaccccccaagtccccccattgtgagcaaccaccccaaatcccgccactgtgtgcaacctcctcaaatcacccggtgtgcaacctgctcaaatccccccactgtgtgcaacctcctcaaatctctcaactgtgtgcaacctcctcaaatccccccttctgtgcaatttccccaaattccaactgtgtacaacctcctcaaatccctcccactctttgcaaactccccaaatcgccccactctgtgcaaccgccccaaatctaccccagtctgtgaaacctccccaaatcccccccactgtgtgcaacctcaccacatccaccactgtgtgcaacctccccaaatcccccctaccttgtgcaacctccccaaatcccacccactctgtgcaacctccccaaatcccccacactgtgtgcagcctcctcaaatccccccactgtgtgcaacctcctccaatccccccactgtgagcaacctccccaaatcctcctactgtgtgcaacctcctcaaatcccccactgtgtgcaacctccccaaatcctctccactgtgtgcaacctcctcacgtcccccactgtgtgcaacccccacaaatcctcccagtgtgcgcatcctcctaaaatccccccactgtgagtaacctcctaaaatccccccactgtgagtaacctcctcaaatcccaactctgtgcaacctccccaaatctccccagtgtgtgcaacttccctaaatccccccaactgtgtttaacctctccaaatccccccactgtgtgcaacctccccgaatccccccactgtgtgcaacctccctgaatccccccactgtgtgcagcctctccaaatcccccccactctgtgcaacctcctcaaatcccccccactgtgtgcaaccgtgctaaatccccccactctgtgcaacctcctcaaatccccccactgtgtgcaacctccccaaatccccccactgtgtgcaacgtccccaaattcccccactgtgtgcaacctccccaaatccccccactatgtgcaacgtccccaaatccccccactgtctgcaacatccccaaatgcccccactgtgagcaaccttcccaaatccccccactgtgtgcaatctccccatatccccccactgtgagcaacctccccaaatcccacttgttgcaacctccccaaatccccccactgtgagcaatctccccaaatgccccaccgtgtgcaacctcctcaaatcccccaccactcagagcaaccttctcaaatccccccaatgtgagcaacctcctcaaatccccgtactgtgtgcaacctcctatcacccccactgtgtgcaacctcctcaaatccccccactgcgtgcaacctcctcaaatccccccactgtgagcaatctcctcaaatccccccactgtgtgcaacctcctctaatccccccactgtgagcaacctccccaaatccctcccattgtgtgcagcctccccaaatccccccgacgctgtgcaacctcccaaaattgcccccactgtgtgcaacctcctcaaatccctcccactctgtgcaaactccccaaaccccccccttgcagcctccccatatccccccaactctgtgcaacctcccgaaaacacccctcactgtgtgcaacctcgcccaatcacgacactgtgtgcaacctccccaaatcacccccactctctgcaacctccccaagtctcccacactctgtgcaacctcctcaaatccccccactgtttgcaacctcccaaaatctccctatgcgcaacctcgcaaaatctcccccactatgtgcaacctcctcaaatccccccactgtgtccaacctccccaaatccctcccactgtgtgcaacctcctctagtcccccactgtgtgcaccccccaaaaatccccccactgtgtgcaacctcctcaaatcccccgccagtgtgagcaacctcctaaaatccccacactgtgagaaacctcctcaaatccccccaagtgtgtgcaacgtccccaaatatccccagtgtgtgcaacttccctaaatcccctaaactgtattcaacctctccaaatccccaccactgtgtgcaacctcccgaaatcccatcaactgtgtgcaacatcctcaaatccccctcactctgtgcaacctccccaaatctcccccactctgtgcaacccccccaaatcccccccattgtgggcaacgtcacaaaatcccacgatgtgtgcaacctccccaaatcccccacactctgtgcaacctccccaactccccgactctctgcaacctccccaaatcccccacactgtgtgcaaccttctcaaatccccctactgtgtgcaacctcctcaaatcccccccactgtgtgcaacctcctcaaatcccccccactgtgtgcaacctcctcaaatccccccatggggggcaacgtcctcaaatcccccgactgtgtgcaacctcctgaaatcccttcactgcgtgcaacctccccaaatacccccactgtgtgcaacctccgcaaatccccccactgtgtgcaacctccccaaatcccccccactctgtgcgacctccccaaatccccccactatgtgcgacctcctcaaatccccccagtatgtgcaacctcctcaaatccctccactctgtgcaacctcaccctatctttcccactgtgtgcaacccccccaaatacccccactatgtgcaacctcctcaaatccccccactgtgtgcaacctccccaaatccccccactgtgtgcaacctccccaaaaccccccactgtgtgcaacctccccaaatcccccccactgtgagcaacctccccaaatccccacactgtctgcaaccaccccaaatcgcccccactgtgtgcaaccgcctcatattccccccactgtgtggacccttctcaaatcccccctaatgtcagcaacttccctaaatcccccaactgtgttcaacctccccaaatccctcccactgtgtgcagcctccccaaatcctcccgactctgtgcaacctcccaaaattgcccccactgtgttcaacctccccaaatccctcccactgtgagcaacctccccaaatccctcccactgtgtgcagcctccccaaatcctcccgactctgtgcaacctcccaaaattgcccccactgtgtgcaacctcctcaaatccctcccactctgtgcaaactccccaaacccccacactctgtgcaaccgccccatatcccccccactctgtgcaacctccccaaaacacccctcaatgtgtgcaacctcgcccaatcacgacactgtgtgcaatctccccaaatcccgcccactctttgcaacctcgccaaatcccccccactctctgcaacctccccaaatcacccccactctctgtaacctccccaaatcacccccactctctgcaacctccccaaatcacccccactctctgcaacctccccaaatcacccccactctctgcaacctccccaaatccctcacactgtgtgcaacctcctcaaatcaccctactgtgtgcaacctcctcaaatcacccccactgtgtgcaacctcctcaaatccccccactgcgagcaacctcctcaaatctccccactgtgtgcaacctcccaaaatctcccctattgtgtgcaacgtcctcaaatcccctcactgtgtgcaacctccccaaataccccccactgtgtgcaccttcctcaagtcccccactgtgtgcaacccccacaaatccccccactgtgcgcaacctcctctaatcccctcactgtgtgcaacctacacaaatgccccccacagtgcgcaacctcctcaaatcccccaccactgtgagcaacctcctcaaatccccccactgcctgcaacctcctcaaatccccccactgtgtgcaacctcctcaagtcccccactgtgtgcaacccccacaaaactcccactgtgcgcaacctcctctaatcccctgtgtgcaacctccacaaataccccccacagtgcgcaacctcctcaaatcccccaccactgtgagcaacctccccaaatccccccactgtgagtaacctcctgcaattgccccgcactgtgcaacctcctcaaatcccccccacagtgcaaaacctcctcaaaacccccgccactctgagcaacctcctcaaataccccactgtcagcaacctcctcaaatccccccaactgtgtgcgacctccccaaatcccccccacagtgtgcaatctccacaaatccccccccactctgtacaacctccccaaacccccccaactgtgtacaacttcctcacaaccacccactctgtgcaacctccccaaatcccccactgtgagcaaccttcccaaatccccccactgtgtgcaatctccccatatccccccactgtgagcaacctccccaaatcccccacactatgtgcaacctcctcaaatccccccactctgcacaatctccccaaatcccccccactctgcgcaacctcctcaaatacccccagtttgcaacctcccaaaatctccctatgtgcaacctcgcaaaatctcccccactatgtgcaacctcctcaaatccccccactgtgtccagcctccccaaatccctcccactgtgtgcaacctcctctagtcccccactgtgtgcaccccccaaaaatccccccactgtgtgcaacctcctcaaatccccctactgcgagcaacctcctcaaatctctccactgtgtgcaacctccccaaatcccccactgtgtgcaacgtccccaaatccccccactgtgagcaaccttcccaaatccccccactgtgtgcaatctccccatatccccccatatccccccactgtgagcaacctccccaaatcccccacactatgtgcaacctcctcaaatccccccactctgcacaatctccccaaatcccccccactctgcgcaacctcctcaaatccccccactgtgtgcaaccttcccaaatccccccactgtgtgcaacctcctcaaatccccacactgtttgcaacctcctcaaatccccccaaatgtgtgcaacctcccgaaatcgcccccactgtgtgcaacctccccaaatccccccaactgtttggaacctcctcaaatccccccactgtgtgcaacctcccgaaatccccccaactttgtgcaacctccccaaatgcccactgtgtgcaacgtcccgaaatcccccccactctgtgcaacctccccaaatccccgccactctgtgaaacctcccccatcccttccagtttgtgcacccccccaaatccccccactatgtgacacctcctcaaatccccccactgtgagcaacctcctgaaatccctctcactgcgtgcaacttcctcaaattcctcccccactctgagtagcctcctcaaatcccccccagtgtgtgcaacgtccccaaatcgccccactgtgtgcattctcctcaaatgcccctagctttgtgaaacctccccaaatcccccccactctgtgtgcaacctccccagatctcctttctgtgcaacctccataaatccaaccaaatgtatgcaacctcctcaaatccccaccactctgtgcaacctccccaaatccccatcactctgtgtaatctccccaaatcccccccaatctgtgcaacctccccaaatcccaccactgtgttcaacctccccgaatacccaccactctgtgcaacctccccaaaacgcccccactctgtgcaacctccccaaatccccccaactgtttgcaacctcccaaatcccccccaatgcgagcaacctcccaaatcccccgtgtgcaaccccccaatctcccccactgtgtgcaacctcctcaaatcccccatcactcagagcaaccttctcaaatccccccaatatgagcaacctcctcacatccccctcgctgtgcgcaacctcatcaaattttcccactgtgtgcaacttccctaagtcgtccaactgtgttcaacctccccaaatccctccaactgtgtgcaacctccccaaatccgcccccaccctgtgcagcctcacaaaattacccccagtgcaatctcaaatccctcccactctgtgcaaactccccaaaccccccacgcagtgtgcaacttccccaaatccctcccactctgtgcaacctccccaaatccctaccactctgtgcaacttccccaaatccgcccacactgtgcaaccgcaccaaatcgcgccactgtgtgcaacctccacaaatcccgcccactctgtgcaatgtccccaaataccccccccactctgtgcaacttccaaaaatcccccacacagtgtgcaacctcctcaattccctctagtgtgtgcaacctcctcaaatctcccccactgtgtgcaacctcctcaaatatccccactgtgggtaacctccccaaatcccccccactgtgtgcaacctcaagtcccccactgtgtgtaacccccccaaatcccaccactgtgcacaacctcctctaatctgttcactgtgtgcaacctccccaaatccctccccaatgtgtgcagtctcctcaaatcctccgccactgtgagcaacctcctcaaatccccccagtgtgtgcaatttccctaaatcgccgcaagtgtgtacaacctccccaaatcccccccactgtgtgcaacctccccaaatctcccccactctgtgcaccttccccaaatctacctaactctgtgtaacctcctcacatccccccactctgtgcaacctccccaaatcccccccccccccattgtgggcaaccacaccaaatcccgccacttgtgcaacctcatcaatttccccccattctgtgcaacctccccaaatccaccccactctgtgcaacctcccaaaatcccccatactgtatgcaacctcctcaaatccctgtactgtgtgcaacctcctcaaatcccccccactgtatgcaacctactcaaatccccccactgtgtgcaacctcctcaaatctccccactgtgagcaacctccccaaatccccctactgtgtgcaacctccccaaatcccccccactctgtgcaacctccccaaatcagccccactccgtgcaacctccgcctatccctcccactgggtgcaacctccccaaatccccgtgtgccacttccccaaatcaccacattgtgagcaacctccccaaatccccccactgcgaagacctcctcaaattgccccgcagtgtacaacctcctcaaatcctccctcgctgtgtgcaacctcctcaaatccccccactctgtgcaacctccccacatgcccccagtgtgtgcaacctcccgaaatccacccagtgtgtgcaacctccccaaatccccccactctgtgcaacctcccgaaatccccccaactctgtgcaacctccgccatccctcccactgtgtgcaacctgctcaaatccccaaactgtgtgcaacctccccgaatccccccaactttgtgcaacctcaagtccccgaatgtgtgcaacccccccaaatcccgtgtgcaacctccccaaatcccccacactatgtgcaacctcctcaaatccccccactctgcacaatctccccaaatcccccccactctgcgcaacctcctcaaatccccccactgtgtgcaacctcctcaaatccccccactgtgtgcaaccttcccaaatccccccactgtgtgcaaccttcccaaatccccccattatgtgcaacctccccaaatcccccaatctatgcaacctccccgttccccccaatgtgttcaagccccccaaatccccccactgtgtgcaacctcccgaaatcgcccccactgtgtgcaacctccccaaatccccccaactgtttggaacctcctcaaatccccccactgtgtgcaacctcccgaaatccccccaactttgtgcaacctccccaaatgcccactgtgtgcaacgtcccgaaatcccccccactctgtgcaacctccccaaatccccgccactctgtgaaacctcccccatcccttccagtttgtgcacccccccaaatccccccactatgtgacacctcctcaaatccccccactgtgagcaacctcctgaaatccctctcactgcgtgcaacttcctcaaattcctcccccactctgagtagcctcctcaaatcccccccagtgtgtgcaacgtccccaaatcgccccactgtgtgcattctcctcaaatgcccctagctttgtgaaacctccccaaatccccccccccactgtgtgcaacctccccagatctcctttctgtgcaacctccataaatccaaccaaatgtatgcaacctcctcaaatccccaccactctgtgcaacctccccaaatccccatcactctgtgtaatctccccaaatcccccgcaatctgtgcaacctccccaaatcccccccactgtgtgcaacctccccaaatcccgccactgtgttcaacctccccgaatacccaccactctgtgcaacctccccaaatcccaactgtttgcaacctcccaaatcccccccaatgtgagcaacctctcaaatccccctgtgtgcaaccccccaatctcccccactgtgtgcaacctcaaatccccccactgtgtgcaacgtcctcaaatacccccactgtgtgcaacctccccaaatccctgccactgtgtgcaacctcaccaaatccgtccactgtgtgcaacctccctagatcccccctatgtgcaacctccgcaaatacccccactctgtgcaagtgccccctatttccccaactgtgtagcaacctccccaaatccccccactgtgtgccacctccccaaatcccccaactgtttcgaaccacctcaaatccccccactgtgtgcaacctccccaaatcccccccaccctctgcaacgtccccaaacctactctgtccaacctccccaaatcctccactctgttcgacctccgcctatcgccctactgtgtgcaactccctcaaatccccccactgtgagcaacctccccaaaccctcccattgtgtgcaaactcccaaatctccccactgtgtgcaacctcctcaaattcttccactctgtgcagcctccccaaatccccccaactctgtgcaacctccgcctatcccccccagtgtgcaacctcctgaaatcccccaactgtgttcaacacccccaaatccccccattgtgtgcaaactcctcaaatcaccccgctgtgtgcaacatccccagatcccccccaatgtgtgcaacctccgcaaatccccctactctgtggaacctcctcaaatcccaactgtgagcgacctccccaaatcccccaactgtctgcaaactccccacatctccctcactgagtacaacctccccaaatccccccattgtgagcaatgtccccaaatccccccactgtgagcaacctcctcaaatccccccactgtgtgcaatctcaaatcccccccactgtgtgcaacctcctcaaatccccaccactctgtgcaacctgcccaatttcccccactctgcaacctcccgaaatcccccgtagtgtgtgcaaccttctcaaatccccccactctgtgcaacccccccaaatccctctactgtgtgccacctcaagtccccccactgtgtgcaacctcctcaaatcccccacactgtgtgcagcctcctcaaatcctccccactgtgtgcaacctcctcaaatccccgcactgtgttcaaccttctcaaataccccatactgtgtacaacctcctcaaatcccccctgcagggagtggcttctccctgtgaatctctcctcccttctttgcccagaagcatgtctcaattagtaagagtgcagttaatatttctcatcttaaggtggtgctccgacctgatacaaaggaaagcgggttgaattcagaggcacgggcataccctgtccttgtttctaaagtgttcatgaagaagatcgaattcaaatggtgaaatatccatatatgcaattgtatagaaaagtcaggattatttgacaaggattgtttttgatgcttttatgcaattcagaacctcaatgaatatagaaaataatttaaaaagacataagagctctctagattgaaataagcatggtgcttataaaacaatggtgaacagtgaatgccaattattttaatttaaatttctattatgcagcaaattcataaaatggggaaagtcttttttcaacatttccaagacatgctctgttaagacatggttgcttcaggtggcttttacttgggatattgagaggtaaggcagagtggtgatggttcaggctgaggagggcgagggctgccataacaaagaaccacacgtttggtggcttaaagcaacagacgttgatgttctcacagttctggagaccagaagagcaagtcacggtgttggcagggctttgctccccccgaaggttggaaggacgaatgcgccttgcacatccagcctttggtgccctgctggtgttcactggcattgcttggcctacagactcctcacgccaacctctccctctgtctttacccggccttctcccctgcgtgtctgtattcaaatgcccctattcctataagggcaccagtcctgctggattccaggttccaccctaccccagtatagactcaccctaactaattacatctgaaaaaaaccttacttccaggcaaggtaacattcccaagttctgggtggatgtgactttgaaatgattatcaagtagatccagttccgtttacagtaatgagcagacagtgaatgagaaattaatgtgctttcacatcgcacgaacacctgaccttcactgaattttaatagaagctggcattggtgctaactccttacagactttatgtcagtgtattctcactgaaggaagttgctattttatcccactttacgaatgagaaaactgagatgcggagaggtcaccaagtcaaactcaagcgacaccccagcccccctcggtgatcaggctgaagcgatgactaaatgccatttgctcctaatgacaccgtcacaagcactgaagccaccaaggaccgttgggcctgtacagaggagaggcagactcaggccctccccactgacaggagggctgtcttccatgtacacctaggtcggagtccgcaagggtggggcggtgacggtgcactggactttgctggcggtgctggaatggctatgcggagggcgctgtggtgcggggactgcgctccccaggaggacctcgggagttgtttgtttgtaggtattacagtattgtctaacgttgccgcgttgacacagggtcacgggaagccacctccagggcctgtggtcctcttcaggcaggcggggcggggaatgctcaggaccggtgatgatggtgccatgcagagttcagggatgaatgaccaccaaggcaagggaaggagtccagcagctcagtatttggggaatgggggcgggggcaggtaaaaacgcagaatcaagggaaacaaacagctggaaaatatagtagctgttaagttctgatggaaaagctgttttgtacttacagttaaatcccacagtatttgtgatgtatttccgggtaacttgctcttccctcctcaaaaggtcccagcctcaccagagcttcccttcctgcaccggccccagctctccacgcctcccagagaccagggggcctccacccttgctcctctgggacggcgcttcctccccctcatctccaggtcggggctggggtcttcaggctcaggttgaagatgctgttgggccctttgcctgtacagggatggcgcccgacccaggaaaagcctaacgttgtctgtcatttggatgcgtctcttggcagtgactggggggaaatcctcactgcagcccgcgtcccttgcatgattgttgtaagaaagccccagctcagctgcgtggagacagggtcctcttggctgcaaattctaaaatcatttttcctatgaagagagcagtgctaattttttccaaaatatatcagattatgatcgacttgactgaagtgtgaaatgaaagtgggttggagtgttcctgccaaagacaagcacggctgccttgccgtcgctcgtgccgtgctctctaccctccacagtcacggtgccggaccctctcccgataactggacacgtgtctcccacaggacacgcactggcactaaatccacactgcccatctcggagacaggcggaggaactcccgagctgagatgcggaaagcaccaggccgtagggacctcaccgcagcgggccgcagctcaggactcggagcaggtgggccacaccatgccgcatgtttccagctgccaccgcagtggttggacaggatctgggtgtcggagcagctctgctggggctccctgcatatttctgtttactccgtgtttcctagtccgttctgcaccttcctccgggaggttttatttacaagctaatgacagtgagccagaatgtgagcctgcttagtgagaggaatgaagatgccttccatttgtacaaaccggttccaaaactaagggctcactttcaggcgtttgcttccacttaatctgaggatcggctggaagcacaggagaggaaggagaagctgaagcaaaaccctgacttttaaattctgatttttaagtggaatagttataatcagtgtggaaaaatgtgtatgtttatgttttacccccttaccttgtatgcagaaccccaagggaggccatatcaaaaactcacttgtgtaagtctgacttttgaactgagagaagcagagagcagaacagtggcctccagaggggagtggggaggtgctggtcacaggcacaaagtctcaggcaggaggagggcgcctcaggtctgctgcacggcatggggcgcacgcttcctcataatgatcgcatgtttcaaaattgctaaaacaataggtttttttttttttgagatagagtcttgctctgtcgcccagactggagtgcagtggcacaaacatagctcactgcagcttcgaccctcctgctcaagcaatcctcttgcctcagcctcttgcgtggctgggtctacaggcgctcaccaccatgcctggctaatttttaaattttttacagagatgcagcctcgctatgctgcccaggctggtgttgagcccttaggcccaagagatcctccagtctgaaactcccaaagtgctgggaccacagccacccactaaaataatagattttaaatgttctaactgccaaaaaaagatgtgaggtgatatgttaattaatttgatataatctctccacaatgtaaaggtatcaaaaccatgtttaaaacataaatatatgcagttagtatttgtcaactaaaaatacaaattttaatttaaacaaagtcacttacttgcatacaggaggggggcattgccaacatgatcggtctcccttctgaaattcagtgtgagattagatcctgtcctcggagataagcagagcccagggtcgttctgctgagagcacattcgtctttgcacctggctcccacgcatggaaccaaaaggacctggcctggaagtgaggctctttgtgaatttaaatagcttttccagccacagcaagggcagtgccagcaagtcccctgggcccctaattagtctgactgacaccaggggcaaggccaggcgttctgttcatctgtggtcgcagggacctgtgtgctcagcacggcttcttcctgaaggaccctgcctgcggattgcagatcccactctgtgagtaggaacctttgccacgtggatcctctgtggcctcctgcaaacaagcatttgtccggaagccagaaacttccctccagcatgacaagcaagaaggatggctcatctcgccagcggtcctttgtgaaaagagctcctgtccaggcccttctgtcttgtatcaagtgtgtgctgttactggagcagtcagaattcagacgttattaatgtttgttctgcatttttgcaggagagtgctgggatggaaggccgggatactcacaggctgccgagagccctctgagggcaaagtggcaggacactgcagaacagcttcatgttcccaaaatcaccgtacgactcttttccaaacacaggcaaatccgaaatcagcaggacgactgttttcccaacacgggtaaatctagtaccatgtcgtagttactctcaggcatggatgaataaatgttatagctgcatttgtctggccttttcttgtaaacattgcctgatttgttccttctggggctttgccattaaaatgtatttacagattacacatctttattttgtgaaccctggaaacaccactcttgcaatcctcctgtctccaccttctggcatctctgatgccgtgctcgtctgcactctgccccggcggtccctccagcactggtttttccacaccccctgcccatcaccaggtgtccacagggcctacatctggcttccctcttctcctgggaagagcactcctggcttcctgcagggccggtgggaggaggaaagtgattctgagggagaggctggagccttaaggaccaacaaggcaaagtgacttgtctcatcctccagagattcaccaacacatgagcctcagaccccaggcttctgcctccagcagccgccctgccgcacactgctcttactcctccttataccctcactcacggggaacacagcccagtgatcccggaggaaactcactccctccctgactcaacaaggcagtctcgggggcaccgttagccacgcgaccctgtaaagctgccgtcctcatttcacatgtgaagcagctgaattccagagtgctgggtcccagcccaggcagccctcagcctcacgcaaggcaatagttaggagtccttcggcattgaaagcaaactcagacacatctgacctggagttctacctgcactaagagaagagagtggtaactaattcatggataaaacagaccatcgaggcagcactgaatgatctcacccacgaatgacaacagtggcacaggagggctatgaacattttgcttcaggatgttttatttcgctctactgttatgtagagaaagcatggtttgctttttataacttttgtgacccaaaaataccagactgttgttttccctaggtgccaggccatcctgttctgtgtgttcccaaactcttagttttgttcatgtaaaactcatgatttcataattaaaacaatattaaaataaaactcatgaatgatttcataattaaaacaatattaaaaatatcctggcaaatttcacaaattgcccttatcacaccggtaagcagcccgttctcacactgccataaagaaccactgagactgggtcatttagaaagaaaagagttttaactggctctgggttgcgcaggtggtgcaggacgcatggtgctgccatctgctcggcttctggggaggcctctggaaacacagtcatggtggaaggggcagggtaggaggcccatcacaggctgggagccaggagccgggaggcagaggggcagccacacatggagaccaccagatggcaggggactcactgcacaggaccaagaggggtggtgctggacccttcctgagaacccaccctgtgatcccaccgcctcccaacaggcccctcctccaacactgggagtgacaattccacatgagactgggtgggacacagaccaaaccatatcaacacccagggaagggacaggacccagcttctgcagaggagctgctgagagttcccatcagcaggtgaggagagacgcagggaatcgcagcaacgcacaacacatcagcacccgctctgggcagtgaagggaggtggccgcccaacctcaggatcatttccacgaagggaacacaggcctcctacttccagctgctgccctgccatgcactggaacacactgactggggagcggtcttcccttccacctcggagcctcttgctgacaccaaaacaaggaaccctggcttgatgcggtgcctgcatgacctctgccctctgggattagccagaaggagtagtgccatatagtgatggttaacaccaggcctcaacctggctggctggagggaggcccagctggccggtgagatcttgtctcagcctcagctagatggatggataagaggatgagctgttttggaggagactgggctgtgagtcagcagactgagggggaagacctgcctgaatgcagggtaggcaccatccaatcccggatagaactaaaaggtagctgtgtctgtctcctagagctgggacacccttcttctcctgcccttggacatcagcactctagcctcttggccttcagactctgggcttgcactagcactccctgccctgggctctcaggccttcagccttggactgagtcatgccattgtcttccctggctctgaggccttgcaactcgggtcctgagtcacatgaccggcatcccagagtgtccagctctaagacagcctgtcctgggacttctcacctccaccatcacatgagccagtgctcctattgaatatcctctttccatccacctagttagctatctgtttgtctatctatctatctatctatctatctactctaagacaggctgtcctgggacttctcacctccaccatcacatgagcccattctcctactgaatatcctctttccatccatctagctagctatctgtttatctattattatctatctatctatcacctgtctatctatatagctacctacctatgtagcctattggttctgtctcactgcagagccctgactatagtgatacacatattttaagagtccctggatgattacacactgatggctcacaaccttgacaatccccgatgatgggatcagccttaattcgtctgcagcatcttcacagtgctacaatcctgacactccttggggtcaaagagttttagagtattagttacttaatgggtataatgatcttggttgatatgctgccaggatttgtaacaattttgccaaatctcaatcgatttaaagatctaactgagaagattgtgcctggctaagtatccagggagttggtcagcttccttcccaggtctttctgtgtctgtcacaccatccactcactttgattatttctgttgggccactcacaggagaatttcaggcaaactggccgcggctttggcctcttactgggataattggtaccgtgttagccctggagaacaccccaaggtcactctgtacagccccttgattttggagaggaaatagctgagtcccaggcattggaagtgaattgcttagagtcacgtaacaaatttaagttcaggaagagatgacaacacacttcaccatcagcacttggtaagactgcctcacccctgccacggcgctaacagcccacatctctaccaaattgtgtttgctatttgggtggctgctgcttccatattaaacattctgctattcgtgaatgactctggccaaattaatgaaagccatacagcctgctgggcttgtaacacccattccttatgaatattacacatgttggaccacgttcacccagcagtcccccaggagcgggggttctgagtgtatggggccctacaagtcataggtatctcactaaggatgtaatttctgagtgaattgacctttccttcgtgaaaaagaaagagggaaattgtatcctagcaaatgcgggtttccatgagcagacacccccacctgctgggtgacttgggaaacagcagaatcaccatttttcctgacctgcatcttccttccgctcaaagagcacacgtgtctgtttcgttccagggcgctggatacatgcgttgcacatggaaaccttattattgtactttttgggtttttcatgcttatagttaaacatcaccactttctcactcagctgtgaatgtcaagagccttgtgccctgtgggcttactgagctctggaataagggagagaacctcatgacatccatgtcagcaatagctttgcagatgccttcgcaaaagccacagaccccagacatgctaaggacaggaactgctcattgcttacggacttacttacccgagcatccacttagggccgacagacggtaagattgacgagaaggccaggaaaggacaaaggctggaaggtgcatgtcctccgcacctgcaggcagctgctgagttcaaacagtgaagggcgtcgggcccagagagagcccagagcctctgtgaacctggagctttcctaataaagtgtgctccctgggcagtgagagtttctacagaatgcgtggtgtggcctcggactcaggggtgtgcgtcctccctgtggacagatggatgaagcggaaactccagacagacggaagcacggtctatgaagaaagcctacccaggacacagcacacgtggagatgtcagcacatgcggggtttgggagaggctcacggtctcttcgctcatgacttcctgcaaccaagaatgcaatctgcagttagggcaccggactgggggtcgtggaggaacactatccctagggttagggggagcactatccctgggagtcaaggagggagcactgttcttggggttgggggcagctccaggcctggggaaagtgggagcacgacccctggtggagcggggagggagcacttgacctggggctgggagagacaagtaggtcttgggtttggggttcagaccctgcaggtttccgtctctgcctgtgttggtttcccggggttgcgtcatggactcccacacacagggtggccccacacagggaatggacactgtccccgtggcagagtccagcactcccaggtggaggtgtctgtggggccgcgctccctctggaggctcttcggggcccttccttgtctcttccaggttctgggggctccaggcaaacctgaccggggctgccccattccaattccgctgcctccacgtctcctttccctctgtctgtggaaaacccctccacttccctttggaatgggcctgggttgtggcactcaggctcccccaggtggtccaggcagctctcctgttctccagacccttaatcttttccctctaaagatcctttttctttctccacgtaaggtctcgttcacaggttccagggactcggatatctttcaggcaatcagtttccagccttccacatcgccatgaactttctggaataaaacctcaaatcctaactaactctgcatttgcacaatttaaataatcaatatttactgtcaagaagagacacctctcaaaaactgaaatcctgtgatcagtgaaataagtacgtcatgtgagtatatcgataagcattacacaaagaaagacagaaacacacactgcacacacacccaaaacccctcacaccacccaccacacacacacacagccacaaatcactcacaccacccaccgcacacacacacccaaaaatcactcacaccacccaccacacacacacacccaaaaatcactcacaccacccaccacacacacacacacacacagctaaacatcactcacaccacccaccacacacacacacacccccaaaaccactcacaccacccaccatacacacacaccacatacacgtccccacagtcaaaaatcactcacacttcctaccacacacacaccacacctgcacacacaccacacagacacaccacataccacacctgcacacacagacatcacaccaccactcctgtttaggagtatggaagggctttctttcacccgatcagtgaaggggaatcaacccttaagaactaccgggcgcggtggctcacgcctgtaatcccagcactttgggaggccgaggcgggcggatcacgggtcaggagaccgagaccatcttggctaacacggtgaaaccccgtctctactaaaaaaatataaaaaaaattagccgggcgtgctggcgggcacctgtagtctcagctactcaggaggctaaggcaggagaatggcacgaacccagtaggtggagatcgcaccactgcactccagcgtgggtgacagagtgagactccatctaaaaaaaaaaaaaaaaaaaaaaaactctaccaacaaaaaaatgacacttcattggtcagtgacagactatttaaggataaatatttttagtcagtgtttaacttatgtacataaaaactcaatgaaatcataagacagcattaaatagcttgtttaaaataaaccgagggaactcgcctcttgggaatctttaaagaaaaatctttaaagaatgaaacagtggtcagagcctctttgctttaccattaaaaaaaaatgtaatgcacttttcatgactgccatttttgcaggcaatttcagatgcattttctacctcccccatcggggttcaaaacgcagtaccccaaatgcagcaccttggtgaatggcctgctttgagctgagggagatctggaagtcaacagaagcaagaagtcctctctggccttcacccttcttcccactacaaaggccataatggaaactagggctcttctccctgaaagcaagccgtaaaacctgggagggtagctctctgcctccccgcttctcccggaaggttgagtgtctgtgtcctgctgggcacccaggggacgatcccagcacagacccaggaaggattctgccaaggggcctggccaggctcccggctcaccagctccagggcacgcctttctgtccactcccagaaccccctggttcctgcttccttcctcaggcttagcagaagaattccgtttcccggggccttgggtcctcatgtgtggcggaaggctttggctaaacacatgtgccatgccctcctgtcagtgtgactttgggtgcaggggtgtccaccacgagccttgcaatgggtaaggagaaggaaactgtctccgggatggactggccccacacccctccctcctgccctcacccacccttggtctctacaggagcgagtttcatcccaggctgagcccagtccccggggccagcacctgtctgcagagtacctccagtcctcagtcctggtaagtaactggatcccggagcagctgcagccagtggctgtgcaagtctgcccttctgcctggcagctcttttcctagagcagtgattcatacttaacaggcgctccagggagagcataaaagtgaccaccccaaggagaaaagcagaggggccaagctttgatggctcccattgagaagtttcatgagataatccaaggagaaagatgagtacagtgcctgccagtaacagttactcagtggcttctaggtccctccagtcacagttactcagtggcttctaggtccctctctcggaaaccagactgacattcctgaggctgcagggcaggtaagccttggcccagagggaggcagagaacaggcatatggtgcagaacaggcatagtgcagaggtggatgcacattttccagattggttcgaatttttcaggacatccattttgtgctgtggccccaccccagccacgtaaatagggacaagttccacctgccataggacaccgcccgccccctctccagacacctgcctcttctcttctgcagctgacagcagggcttctcctgctgggtctgcaggcctccatcaggccctggctttgggggctcaccccagcccatctcatgcagcactgttggtgcaaaggtgtccctgctccagggctgggctcctgtagaccagcagaggctgactgagctggacccgtgggctgggggactttgacctggttctgttgagtcaactgacctgcctgagggtactgctactgctgtcacccagagtgcaatcaatcacaggccctgtgcccgcatttcacagctaaggaatggcagatcctgtgcggggagggaaggaaggaagggagaaatggagggagggaggcagggaggaaagtgtacagggagagacagagcgcagggctgctggatggagagacctggaccgggccaggcttggccgtgtgaggagcgcctgtccttctagggaccttggagatcagggagcaggctgctgacaaacgacttatttctcctccctctgaactcccaaattcccagaaatctgcctcgaaagtggggagagcagagaggctgtgaggttggaccgagggggcccacggcctcaccctccttcccacgtgggccacccctggacgcttcgttcgcaagcctgatattgtcctaagatgtggtttgatttttaagggcggagagatgggctcagctgctggtggaatccagcccctccgtctttgcgggatgtggggtctctgcctcctgcagtgacagcaccggcatgacccagcctggcttcccgctcccaagcgcgggcacctgcggccgaagacgcggctccgcagcgccacctagtggccgcccagcctctccccaaagcggagccttaggacgaagctccctttccccgaggtccctgcaggtttctgtggagcctgggagtctgaattactgtctcccgggtgattcctaaccctggaaactcgctgctgctccctggggctggtggtcgtgccagttgctgcgtcagagcagttgggcgcccacaggctgaggacgccggggccagggtgagggtgaggctccacctcagggctccagagaccgagttttgcacttgacacttccttaaccttcgaaagcctgattccttcttatcgccctgagggcctgaggtcccctatctgcatgatggaggggttggataccatggtcttgaagaccttccattcctagggtgacaagattctaaccacattgcacatggaacacttctcggtgcaatgaccccaaacaacatcccagcctgtgcagttcccactcccagagatccgaaagtcggtgggtgacgacccacgtgtgaaaggggctctagagagctgcctacagtctcatgtccccccacccaccgccctccgtgtgctcagcacctgaacgtcttcacagagacagggcagagtctgtttaaaaggaagctccgacagtctccctacgaagagatggccgccacctcaggcacgtgggatatttctggggatggaattgtcgcaataatgaggaaatcccctgtggtttaatgggcagagtcccaaaggtgcttgacatcctgaccagcacaaggcagcccacctcctgcagaaactgtgaaaaaaaggcaagaaaagtatacccataactaatttgagtggttgtaatgtacactgaaacaaaaaagtcttttcaatttttttttctttttgagatggagtctcactctgtcgcccagactggagtacagtggcacgatctcggctcactgcaacctctgcctcccaggttcaagctattctcctgcctcagcctccctagtagctgggattacaggtgtctgtcaccataccagctaatttttgtatttttagtaagatgaggtttcaccatgttggccaagctggtctctaactcctggcctcaggtgatctgcccacctcggcctcccaatgtgctgggattacaggtgtgagccactgcacctgacccttttcccgattttaattgcactaaacttccatagaatgctgacagcgcataaacatgataatgtgtctttgcaattttcaagcttaaatacttagaatccaaaaatatgatgaagtgtggagtttatttgaacacgaagttggaggatagtcacataggaaacacagactctcaaaatggaaagttaaagtctcatttacatagtcagaggcagaggtttaacaggttgcagcattttccaacaagatcaagacataggttatagcgatttgacttgattggtcacagctcgctacactaaggaagcttgttttaacatcccataaggaagggtaatggtcttgaggcggtctcacctctggtaccattcagtctttcctaatcattacaggacaagaatgaggaagagatttgacccagaataaagaagcagaaggtgcagcttcacaccatgcgacgcaggccccacagccacgttcctctcaaggctcaaaatcaggtacggttccaacagctttcagtttggattaatttcacatctccccttttcaacatcaacatgatccttttgaagaaagcttagtagctgaatgcagatggtttgggaatctctgtatgtttaggggcttagccccagatacttaggaaggttcactcctaggacgttg

SEQ ID NO: 1196 - DNA, 22034 bp, Homo sapiens
tccaccttatcttatcaagtgccgatttactgagcatgagacaaatacataactgactattcccctacctgttccttgtctcttgcaacatgtggattctgtgatgtgactggaccttccctctttccagcctgcttttcccctttagatattgaagcccacaaaatcatctttggagaaaggcacagatcgcagactgtttctgtggtttctatattcccttcttctggcgtgtgccttacattggcttctaaactttacaaacttctaaattgactgagacttgtgtcagacatattttggttgacaaattggcatccaacagaagggactctgagtggaggtggtcctgactgttgagaaatctgactttggtgcttggtaccagcccgggctacttttattgctcaaactgttacaggaaaggggtctggagccagaccacagagtgagttcttggatctctgacaggaaagaattctgggccagtcacagagcacagtgaaaaaagcaagtttattaaagactactctattacagagtagggcatcctcagaactaacaacaagaggaggccaggcaccgtagctcacacctataatcccagcactttggaagatgaggtgtgacaactgcttgagaccaggtgttcaagaccagcctggacaacataatgagactccatctctactaaaaataaaaaaaatttgccctgcatggtagcatacctgcagtcccaactgctagagagactaggcagtaggatctcatgagtctgggatgtcaacgctgcagtgagccattattgtgccactgcactcctgcctgggtgacagataaggcttgtcttgaaagaaaaaaaaaaggaaaagaaaaaaaaaagcaagagtaggactctgaacacaaataaaatgctatataataagggagctggccaggcatggtggctcacacctgtaatcccaacactttgggaggccagggaggctggatcacttgaggtcaggagttcaaggccagcctggccaacacggtgaaaccctgtctccatcaaaaatataaaatattagccaggtgtggtggcgtgcacccataatcccagctactaaggaggctgaggcagaagaatcatttgaacctgggaggcagaggttgcagtgaacagagatcatgccactgcactacagcctgggtaacaaagcgagactctgtctcaaaaaaaaaaaaaaaaaaaaaaaacaagaagaagaaagcaagctaagaataataatgaacttatgtgctttattataaaggcttgtgaccagcttgtgacaggctgatgttatcctcttgtgtaactattgagttcagcaggaatttagggatatactattacctattagtataagaaacctattatctattaatataagaagcctattcttagactaagaatactttttggtcttgagatatcaggacttcaagactttctgttaagttctgggtcttgtttacttatcattaactcattctctcaaccataaaggtcctgtgaaggagagtgcctagcttcctgggaatggaatccagcaggtttcacttcatttggccttattcaagacggagtcactctggtttggacacctctgatatattttcctcctcccttttataaggggatccttaattctaaggggtacagagggacagaggtccatcttcataaatgtcttcaaggtgaacaggagcaatgatattcctccctaaccactgggatcccttgtatttagattggagaggagttcactcagcaagtgttggcgtggtgaggaccaatcattattgtgactttcaacaaaaggtgaaatctggaaaattagtaagtgttcaatttaaagaagctatttaataggtttaccttgttttcttttcttttctttttttttttttttttttttttttgacggcattttgctcttgttgcacaggctggagtgcaatggcatgatctcggctcactgcaacctccgcctcccaggttcaagcgagtctcctgcctcagcctcttgagtagctgggattacagctgtgtcccactatgccctgctaattttgtatttttagtagagatggagtttcactacgttggccaggctggtcttaaaactcctgacctcaggtgatccgcttgcctcggcttcccaaagtgctgggattactggtgtgagccactgtgcctggctaggtttaccttgttttcttgcacaaaaattacaacagcaatacattccacagcaacaaaacagaatctgttccaagcatctgaacaaaaaggttttccatgaaccagacaattgctggaaccaccctgatatggggtcaactgacagtgtgttaatggcagagatatgggtgtctaagtccttcatggcctgagtaatattatgttaatattatggaatatacaaacaacattccattttgatgatagcacaagatctcccttgagccgctgttaaaatgtccaaagccatgcagtttcgtaaggctacctgtctaatttgagaagtctcttcagttagtaggataatggcatgctgtgtagtattgaaagctgtagctgtatgttggaatacagattcaacttgccacttgacatccattacagccacctctgacagtaatatagccctcgagaaaaaccaccaagtagggtcaggcgcggtggctcacgtccataatcctagcactttgggaggccaaggtgggtggatcatctgaggtcaggcatttgagaccagcccggccaacatggcaaaaccccatctctactaaaaatacaaaaaaattagctgggcgtggtggcaggtgcctgtaatcccagctactctggaggctgaggcaggagaattgcttgaacccagggggcggaggatgcagtgagcggagatcatgccactttactccagcctggatgtaagagcgaaactccgtcctggaaaaaagaaagaaagaaaaaaaaagagacctctttggtcacctgtggcgagatttcccaactttccagttagacgggagagagtctaatttagtgaggatatgtcctgggagataaggatgaccccatgtacatcttccaatccaattacaagataaatacagccagccatgagacccacatgcccatagccagccccaaggagaaagacaagcaaccagtggctaggacttattctgccattccatgcacatttggtcacttacaagggtgtgattacattgttggggtggtaaccttcccatattacaggtctcagtctcttcataactgttactatgtctttcaaagcatagggacactatgcttgatacctgcacttggacagctgtcatccacccaagtccatcatgcacagcataacagggcagggtggaatttagctgtttcttcattaaacaaaaaagacgcttccttgtttcattgtgagaaatgaaagggctggaccctttgtttttatagtacatgggaaaacgtgatggatattcactccaatcataatgatgatcccataaactcatattggctggcaggatgtatcatggcagcaccacggtggaggagagctgtagttctccacacacccggcaatccattttgttgtgtagggaggctgaagtttgtgcccagccagcaaagagattgcctcttagctaataccaatatgtgtccagaattgggatattaatccagatttttatgttatttatctttcttgtttcttctaagcaggagccagatatcactggttggttcacaggaataagtggaatcagtctcttgtgttccagcagcctgtgggacttcataagaaacagacttaattcaagatcaatgagcccagctgcttcttccttgaagtgtaactgcggttgaggcactaaggagtacttacttagtagggtcctttccactgtgggaaagttgatctgctagggaccattttttcaagtcattaacaggatcccatttcctggctggattacaataggatttttttccttagtgagggaaggaagtctctcatttctgtattcaagaagagctttttgcacctgacctaagttggcaacataattctgtaatttgaaagtatctccatctactaggaaatcagcaattctttcagaaaggctttccgtacattatttcaaaagggctgagccttccactggggcagcccaaacttgcagcgaggccacaggcgatagacggagccaggtttctgatgtttcctgtcagagcttagcaagggtcctgtctaaaatttgattggtcctttctacttttcctgaagactgtggcctccatgcggaatgaagaccatattgaattcctagagcggatgctatgtcttggttattgttgctgtaaagatgggccattatcactctacaagcttttaggcaacctgaatctgggaatcatatccttgaatgaaaatttagaaaccttgattgacttttcaggccagataggaaaagcttcaatccaacatgtaaagaaaggtatcaaccaacactgataaatattggaatcctttacatgggggcatttgggtatagtgtgtttgccaatcttcttctgggtacgaccccctatgctgaacaggctttactaatggaggaggtaaagtttggttgtttgaggtttttttgggcacacaattcacaggcccaagtcacttgttttactgttctaagaaagtcttttcggccaggcacggtggctcacgcctgtaatcccagcactttgggaggctgaggtgggtggatcacgaggtcaggagttcaagaccagcctggccaacatggtgaaaccctgtctttactaaaaatacaaaaattagctgggcatggtggcagatgcctgcaatcccagctactcgggaggctgaggcagagaattgcttgaacccaggaggcagaggttgcagtgagctgagatcacaccactgcactccagcctgggtgacagagcgagactccgtctcaaaaaaaaaaagaaagtctttccctataaacagatgagccatattaattgaaatgagaaatctcttcccaaatgagtagagccatgccaatacttaactattttccattgatcagctcttggtacatatcatctgtcattttcatcaattagccatctggaagtgcttatagttaacccatgggtcttagcccatttttgttcttttctagtattaaccatgctctagttttatcgtcaccaaggcagtgggcaccaacatgcctaccagattaactggttccctcaaatgaagctgcctcagctgtagcatctgcaaaagaatgcccttttattattttggagttttctttctttcttttcttttcttttttttctttttttttttttttttgagtcagagccttgctcaagttgcccaggctggagtgcaatggcacgatctcaggctcactgcaacctctgctgcccaggttcaagcaattctcctgccttagcctcccaggtagctgggattacaggcacgagccaccacgcccaactaatttttgtatttttagtagagatggggtttcaccctgttggcaagcctggtctcgaactcctgacctcatgatccgcccgccttagcccctcaaagtgctgggattacaggtgtgagccacagtgcctggcatattttggagttttctttttgatgtcccttgcagtgaatcacagcaacttccttaggcagcaaggaagcatctagtagatttaaaattcccaaataatgttctataggggagcccttagaagttaaagagtccccattatttccaaatagcagcatgagcatgaagcaccagaaagccatacttggagtttgtgtacatgttaattcttttttaaaattattatccttttttgagacagagtctcgctctgtctctagcctggagtgcagtggcatgaccttggcttactgcaagctctgcctcctgggttcaagtgattctcctccctcagcctcctgagtaattgggactacaggtgtgcaccaccacgcccaggtaatttttgtatttttagtacaaatggggtttcaccatgttggccaggctgttctggaactcctgacctcaagtaatccgcctgcctcagcctcccaaagtactgggattacaggtgtgagccaccacacccagccctagtggcccgtcttttaaatcctgccagctggaataaatttgttccatagcttgtgtacatgaatgatctagggtgcctttggatccaagtagatacgtagctaggattaaggtcttctgttatactttaagagttatatcaagagtatctagcaataaagcctgataatttaataactatcccctactcatctattggtgccctttagcttctagggcctctgttatttggtgtggggtcaaaacctccagatgttgtcccaaagttaatttattgtcttcatctatgagaagagcagttgttgcaactgccctgaaacatctgagtcatcctgaagccacatggtcaattggttagaaaaatatgccatgggtcaagggatgtatccctgtttctagacaagaacatttagggctgtcccttgtttctcagccacataaaggaagaaagtaaagcctgtccctaaacccacggggaagaattgtccaagttaacacagaaaccaaaagattattaggtaatcaaaagtaaagaccacaataggggactcagcaaaagaaatgtttcactagagaagggaaatgacaaagttctagaaaggaatgtccaagttcaggccagtagcggcaagcaggacaagatttacatggccttgccatttgtaaccaaaaagtaaaagtcattccattagcaaggagatgaaaaagaactgctgaaaagcaatctccagttttccatcctggagcagttcacctaggggggactggtataattgctgccaggcttaatctttcacattggaccttttcatttaaaacttgtaaatgcgaaattccaagtaagctttgcaaaaaaggagagacaataaacaattcatttaagtggtctagatctagggaaagtaaatattacagagccatttgtccccaatgtcttctagcaacatgccagaacaacaggcaaatggcccataacccaaaggcaaacaagaaaaaggaaagttaaaaacctcaggaccagttcaacaagatctctctcataaagtagcagtaaagcatagaaagcaatcaggaaactggcaagtggcagcctttggaaagctcttacagagagcacaaggaggacgaatccacagtgaataatggttaacatcccattgtgctaaacccattttcagctgtgaggggcctttaatcctcccaagtaggcctcaaacccaatcttagataagtgtccttgtccttcatcggtataaaaatgtattccccttcttacccaaagtcagtcagttggtcctgcgcagtctatttcttttgggttgaaggtctcacctcaataaagtccttgggagttgccacaggaaatgttacttaaaaggaattttgttccagacccaaaaaacaggttcttggatctcagacaggaaagaatttagggccagtcacagagcacagtgaaagaagcaagtttattaaagactactctattacagagtagggtgttctcagaaggcgagaggaggaccccacaccaaaaattatgtagctagctaagaataatggtctcatgtgctttagtacaacagcttgtgatccacttgtgacagagtattagtagtgttattctctgtgtaactattgatttcagcaaacatttatgaaaatactattatctttaaagagaaacctattcttaaactaataatgctttctgttctcaagatatcaggacatcttcttaagttctgggtcttgtttagtgagtaagaatcattagctcgttcagccaaaaggtcttgttatgggtagagggtgtccaggttcgtgacatcttgaacaaagaattggacaaaatgtacaaaccaaggaaagaatgaagcaacaaaatcagatttattgaaaatgaaagtacactccccaggatgggagcagcccctgtctaggggctcaacagctgggttacagaatcttctggggtccaaatacccactagaggtttcttactggtcacttggtgttcaccccatgcaaatgaagtagtggcctgcaatcagaggctgaagtaaagttacaaagttgcactcctatgcaaacgtctgattgaggccattatttcatttgcatggagtgcacaccaagtggccaatgggaaacctctagtgggtatttggattgattggtggctttctgcaaccaatcagaggtactttcaattttccttctgccctgcagaaaagcaggtttgcaaagggagtaacctctggtccttctgttacttaggcatagatagttggttttttccttttgatttagttctacgaagtcagtgtgaatcagccttaggttccctgcctccagaccctattttcctgcctcagtcttattatggagagtacttaactttctgggaatgtaacccagcaggttttgctttattcagcctttattcaagatggagtcactctggtttggactcctctgacagcgggagtgaagtagaagtgatagggtttctttacagttcttatatccaactatttgatttagtctatatggaattcccctttgtcttctttaggaatatcaaagcatttcaacaggtatttagtacctgtgagctagccaacttgttactttgtatctttttaagtatctactctttactagttattgtctaagacactataatgtctctactcactatagcaatcttctgaagattagattccattttataagtgaagattccaattttgaggggtgatacgatttactggaactcagatccttctgactttcaaatagttgtttcttggaccaaaggacaatgaaacagtgatgactatatctgcatgaaaagggaaaaagggagctgtatctgactcttcactttcagaaaataaggtggctgctgatgctaacctgagagcagcattaggctatgggaaagctttctccaaattcagatcatcattttgttacaggaaaggggtcccaatgcagactacaacatggggttcttggatctcatgcaagaaagaattcagggcaagtccgcagtgcaaagtgaaagcaagtttattaagaaagtaaaggaataaaagaatggctattccatagacagagcagccatgagggctgctggttgcccatttttatggttatttccagatgatatgctaaacgaggggtggattattcatgcctcccctttttagaccatatagggtaacttcctgacgttgccatggcatttgtaaactgtcatggcgctggtgggagtgtagcagtgagcaccaccagaggtcactctcgtggccattttagttttggtggattttggccgctccttcactgcaacctgttttatcagcaaggtctttttgacctgtattttatgctgacttcctatctcatctggcgacttagagtgccttaaccgtctaggaatgcagcccagtaggtttcagcctcattttacccagctcctatttaagatggagttgctctggttcatgcgcctctgacaatttcatgttaatttttctctttgaattcatgagcagcactgaagagagtgcatgaggtttctggaaaatagcaatttgaagtcttttagtccataagattccctgttataaatgtcttcctaggctgaaaaaaaagtaatggttgaccataaaaaagatggcggccgcagcttctccacagcaacggcaacgccattctcaagcaagcgcatcaatatatttagttccggcctctttgcacgtcatttccggcaccggcatggccgggtgagctgcaggctaccttatttaagaccgggaatttagtcagcctggtgagccgactctgaggagatggagtatcgctgaggtgatgagagagaatgtggttgttagcaacatggagagagaaagtgggaagcccgtggctgttgtcgcagttgtgactgagccttggtttacccagcgatacagagaatatctccagaggcagaaactctttgatacacagcaccgtgtggaaaagatgccggatggctcggtggcgctaccggtgctgggagagacgcttccagagcagcacctgcaggagctgaggaatcgtgttgccccaggcagtccctgtatgctcacgcagctcccggatcctgttccttcgaagagggcccagggttgttcacctgcccaaaaattgtgtcttgaggtgagtcgctgggtggagggtcggggagtcaagtggtcagccgagttggaggctgatttgccccgatcatggcaacggcatggtaatctcttgttgctgagtgaagactgtttccaagccaagcagtggaaaaatctgggaccggaactctgggagaccgttgccttggcacttggcgtccagcgtttggcaaaacgagggcgggtatcaccggatggtactcgaactccagcagtgacactgctgctgggtgaccatggctgggtagagcatgtggataatggtatccgttataagtttgacgtgacccagtgtatgttctcctttggaaacatcactgagaagcttcgagtggcatcgttgtcctgtgctggagaagtgctggtggatctctatgcagggattggttattttacattgcctttcctagttcatgctggtgctgccttcgtccatgcttgtgagtggaatccccatgctgtagttgctctgagaaataaccttgagatcaatggagtagcagatcggtgccaaatacactttggagataacagaaaactgaagctctcaaatattgcagatagggtgatcctggggctgattcccagctctgaagaaggctggcccattgcctgccaagtgttaaggcaggatgctggaggcattttgcatatccaccaaaatgtggaatctttcccagggaagaatcttcaggctcttggagtcagcaaagtagagaaagagcattggctgtatcctcagcaaattaccaccaaccaatggaaaaatggagctaccagggattctaggggaaaaatgctgtcaccagccaccaagccagagtggcaaaggtgggcagaatctgcagaaactcgaatcgccactcttcttcagcaggtgcatgggaaaccatggaagacacaaattctgcacatccaaccagtgaaatcctatgctccccatgtggatcacatagtcctggatctggaatgctgcccctgtccttcagttggctagaggaggtagatcctgggacacatgggatccacgtgcgagtggcccttaaatgtatcagttcagtccaggttgtcatcccttttgtcccctggtgatcagtttttttcatattttatagccctgaaagcaggctctagatcaattcaaattatttcatttgtctttcattgataacagaaaatgaaatacctgtttgggagaagcagcatggcccattgaaatgaggctcatctgtgcaattatgaattccaaattctgacctcagttctggaattgaagtttcagtatgttttggcctcgggtttcgttatttgcaaaatgagagtttctttgaactgtctcacgtgactattaagcaactatacacaggacatcggttattttagagtgaaagacacagtgctttttccaaattgctctggctaccatatagaaaattgactgaaggagggccaagatggaaacagagagaccagtgaggaggcttctgtggttgtccaggtctgaggtgatggtaacttggactcggatggtggtaatgggaggtagattgatatgataaataaaattgacagaccaagcaatggaatcagaattaagtccttaacatgaagctgctttgttattatgactgactaaattagagagagaagggaacaaaaattattttagtgtatttccattcccttactgtggcattcctaaatgattgtgaggggttgtcttataaatttggtttgttgtggtagaaatatggttaagaatcaccagtctatttttttttttaaagctcatctgctgaggacgaatcactgttctaaatcatagggaatctagatttctagcctcaagcttgtgcaatagctgccaattaatacttattagtttaaagttcctattaaaatcttagattcgtataggcctcatactccctcttcatcttcctaccgtggctgagaacaggagggacaacctaagaagctatagggaatgtgagatattctgcagagcatttccagcctcaccttattttatggctgtctgccataaaagatggtttgccactggagtgaataattgtttgttgttttgtttgtttgcttttttgtttttttgagacagagtcttgctctgtcacccaggctggagtgcagtggcaccatcttggctcactgcaacctctgcctcccaggctcaagcgattctcaagcctcagactctcaagtagctgggattacaggtgtgcagcaccatgcccaggtaatttttgtatttttagtagagatggggtttcaccatgttggccaagctgttttggaactcctgacctcaagtgatctgcccacctcgacctcccaaagtgctgggattacaggtgttagccaccacgcatgacccaagatgactaattgttgattaccactcagagctttgttctggtgtattttgaagctatctaggctggtttgctaggtgaaggaaatatagaaaagtgtggccttgtatgattgtacctgacatttggctggctggatttgggcatggctactcatccttctcttgcaacagtagcagtaaggacaggttggtgctgtttgtgttatccaacaaatattaagtgcctattatatacaaaagccacaggaaacataacgatccattagatagagttcctgtctctgagaaacccacaatctagcagcagaaataacacaagtactcaaagaaagacttggaatgcagtaagatgagtgccatgtgagtgatagcacgttgtaggaatgaaaaggtgggaaaggagttctcagaactgaatagtgaagtcttcagaggtagtgtttgaattggctcatgaaaactgggtaagattttgatgggtaggttgcgggtagaaacaggcactagtagaagagaataacagatgcaaaagtttgaatcctcagaaaatggtatgttgttattagataagtttggaacagaggaagcagtgagagatgtgttgaagatgggggttgttgtaaggattaaaaaagcactgtgtcttgtacacagtaatcccctagggagatgttagccagcatgtgatcccaccacaaaaacaaacagcctgcttatttccattcccatctcacagagcggtcttcctgtgttaccttaatcatctcctcctttttttttttttttttgtttgagatagagtctcactctgtcacccaggctggagtgcagtggcacaatctcggctcactgaaacctctgcctcctgggttcaagcgattctcctgcctgagcctcccaagtagctgggactacaggtgtgtgtcaccacgcctggctaattttttgtatttttagtagagacgggtttcaccgaattagccaggattgtctcaatctcctgaccttgtgatctgcccgcctcatcctcccaaagtgctgagattacaggcatgagccaccatgcccagccagtcatctcctcttttacatagtgggtttttcctcacttgtgtgtccatggcttgctgtcctcaaactataaagataccaacctggaggttgagccaatatgggaagggaacaaggagaaacaatgaggaagaggagccagagagtcagtctggggactgaggatttgcctttttgccacaagctctggatagacagctgatgtcaggtgtggccagttgaactcattcgaccaacagttgttggactcctgcatgcttgcactctccctctctcatatatatattatatatatattcatataatatatatatcatatataatatatatatattcatatataatatatattcatatataatatatatattcatatataatatatatattcatatataaatatataaataaataaatatatacatatatatatgggccctgtgtgtgcagtgatgtaagactgacatggctctgccttcatataatttatttgtttttattttttggagatggagtctcgctctgtcgcccaggctggagtgcagtggagcgatctcagctcactgcaacctccgcctcccaggttcaagcaattctcctgtctcagcctcctgagtagctgggattacaggcatctgccaccatgcccggctaatttttgtatttttggtagagagggtttcaccatgttggccaggctggtcttgaactcctgacatcaagggatccacccgcctcggcctcccaaatgcctcttagaatttagattccactcattcaactcctgactcctctactttctgggtgacctcaggcaagttatgaatctctcaagatttagtttccttatctgtacattagggttaacaattgtacatatcctgtagggtagttcttaggtttaaatgaatatatgttaagctgtcatcatcgtgactcactgagtggtgaatacttttgtaaaataaaaagtatctgagacaggtctcaatcagtttagaggcttattttgccaaggttgaggacacacatgggaaaaagacacaagtcacagtaggatctgtggcccacacatttttccaaagaggattttgagggcttcagtatttaaaggggaaagtgagggtaggaggagtaggggtagaggaaaaaaacaaaaaggagtgtaggtagtgagttaagtggtcacattcttgtgaggctttgattagtgctcactgaatccacatgttacatgtgaagtggggtagaggaacagtcaattaagcatttgtcaggactcagtaaatatgcatatgtctgaggtgggcagagggatggtttctagtcttgactttgtgctgtatctgtgaagataagctgtttacattgtcaaggtaagggaggccaactgaggagatatggaatcttctatcttgcggctgtgtttaggcaaaaggaaaggcagtttttttgcatgactgagtttccaggcttcacttttccctttggcatagtaagtttggggtctgacttgtttgtttgtttgtttgtttgtttgagatggagtttcgctcttgttgcccaggctggagtgcaatggcacgatctcagctcaccacaacctccgcctcccaggttcaagcgattctcctgcctcagcctcccgattagctgggattgtaggcatgtgccaccacgcccggctaatttttgtatttttagtagagacagggtttctccatagtcaggctggtctcgaactcccgacctcaggtgatccacccacctcagcctcccaaagtgctaggattacaggtgtgagccactgcgcccggcctggggtctgacattttattttcctttcacacttcattctatcagtcagtctttgtatatgatgaaccaccactttccaatttggctgtgaggggttgctgtatgtctggcctacttgaggcagaatgtcattattttgaaaagccattcactgattaattaggagatactgtgtactctctccattaagcgctgtgcttggagccagtgacatagagatgaataaaactgagtcctgcccacaatgggatcactatctggtgacacagatacagagaaaacaatgtcagtgctgtttactgagtgcttagatagaaataagggtttttatgggcacacataggagaggcagccaccctcatttgaggatgtgggttgaggattgaacagggtgactaggaaggtaggagcagggatgcctaagggagtgttaaagaatgagcaggagttaatgtgtggatggaagaacagaagcctcccttaagctttttctctacttaagcatgttcatttacattttagttttctttgaggacttgctggattgccctggttgggaagaggcatcttatggaaccaatgaaaaaagactgaagggttcgggaggctcatggggtccttgtcatctcagtccagcaatttgtataagctctaaaggcttcccatgcaagcttcagtattagttgccagtcaatgcagccacctgatagagatattgtgatttttaaaaaatagtaatttttaaaaactccctcaaacttgagctgctttattaactttgtaatttaaaaaattatatgagtgcagtaatatatgagtacaatatgtgcctttgaaatacacaaataggccaggtgcggtggcttatgcctgtgatcccagcactttgggaggctgtggcaggtggatcacctgaggtcaggagtttgagactagcctgtccaacatggcaaaaccctgtctctactagaaatacaaaaataagccaggtgtggtggtgggcttctataattccagctacttgggaggctgaggcaggagaatctcttgaactcaggaagtggaggttgcagtaagccgagattgtgccactgcactccagcctgggcaacagagcaagactctgtctcaaaaacagaaaaaccatacacgaacagaaattaaaaatagtaagaaacaaatagaatttaaatttcattttctcctaccctgggcatacatgtgacaaaatccaatatatatcactctgaacagcctcagggtacagccactttatattgcacaagctgtaaaagtagtcattttcaaactcaactattatttaaaatgattacaagcatttaaaatgtttaaaataaagatccaaccctgttcacttgggaaacagttgtggcagttccttaaagtgttgaacatagggttagcatattacccagcagtgaattaaccaaataaataagacatatgtgatagaggtatatatacccaagagaatgcaaacatatgtccacacaaaggcttgtgcgtgaatatttgtagcagcattattcatagacaaaatgtggaaacaacccaaagtccatcaactgatgagtggttaaacaaaatgtcatatatatacaatggaatctgtaaaaaggaatgcagtactgatacatggtttctggatgaaccttgaaaacattatgctgagtgaaagaatccagttgcaaaaggtcatttattgtatggtcccatttatatgaaatggccagaataggcaaatctatagaaacagaaagtaagttcccaggtgctggggggagtggagaatggagaatgactgctaataggtactgggttgattttgtgggaagatgaaaatgttctgaaaatagatggtggtgatgattgcacaactctataatatatgaaccagccatttaattgtatatttttaaagggtgaatttccctacttgcttcagcaacatatatactaaaagggtgaattttatagtatgtgaattatatctcaataaagctgttaaaaaaaaaaaagcaaagaacttggaaacacttcctacaggaaggaacaccagagctgcattttattatttttagggtcttgctttgttgcccaggctggaatgcagtggcgcaatcaaggttcactgcaggctgggtgcagtggctcacacctgtaatcccagctcacgcctgtaaactttgggaggctgaggtgggcaaatcacacctgaggtcagcagtttgagaccagcctggccaacatggtgaaatcctgtctctaataaaagtacaaaaattggccaggtgcggtggctcatgcctgtaatcccagcactttgggaggctgaggcgggtggatcataaggtcaggagttccagaccagcctggccaagatggtgaaaccccatctctactaaaaatacaaaacttagccaggggtggtggtgggcacctgtagtcccagctactcgggaggctgcggcaagagaatcgcttgaacccaggaggcagagattgcagtgagccagtatcacaccactgcactccagcctgggtgacagagcaagactccgtcccccaaaaaaaaaaaacatacgaaaattagtgagacatggtggcaaacacctgtaatcccagctactcaggaggctgaggcaggagaatcgcttgaacccgggaggcggaggttgcagtaagcggagatcacaccactgcattgtagcctgggtgacagagtgagactctgtcccccaccaaacaaacaaacaaacaaacaaaagacttacttgcagctttgacctcctgaactgcaatcctcctgccccagcctcctgagtagcaacctcccacacacccacccccccaagttcaagtgattctcctgcctcaccctcccgagtagctgggattacaggtgtgcaccaccatgcctagccaatttttgtttttagtggagacagggtttcaccatgttggccaggctggtcttgaactcctgacctcaagagatccacccacctcagcctcccaaagtgctgggaatacaggtgtgagccactgtgcccacccataatttttaattttttttatagatagagggtctcactatgttgcccaggctggtctcgaactctagggctcaagtgatcctctaacctcagcctcccaaagtgctgggatcacaggcatgagccatggtgcctgtcctagagctgaattttgaatagaatcaactatgtaaaggcagaggaagtgagggccccttaacctcttctccaagataagctatttgtctcattgaaactttcttttgaatcttacagttaccattgtgtgtttcctataggcccttctccagattctccaagttgttcccaagaaccttttcactggggcccagaattgactcacagtatccatcccaattcccctttctcttaaaaaggagaagctggaaaactcaagtactaaatttcccagcctctcttgcacagatagtgaccatgtgaaccagttctggcaaggagctgcaggcagaggtccccggggagggctttgggtctctgaccctggagatgtagcagccatctctccaagcatgctaagactggcagagcagcattgtaggactgatttcttaaggggatctttgatcagctacacagccctgaaatgtctatctctgcacttgtcatgtgaaaaaataaaaaaataaaataacctgcaatcccacccccaagtctatttaagtcactgtgcgaatttttttttaacttacaggcaagaaatatttctacctgatattctgagtactagattaaccaaataaattagacatatataatagaagtgagtaaataaaaactgagtgggaatgctcacagagctcataccacccaaaacagggcatcttgaaatcagttctttttttcaggtgtttcatcggttaatgcttccatccagtgaaataaaaacttcattcagccttgaaattaatttatccatgactccaaggactgcgtttggtcttttttttttttttttaatcaaagtgatagatactcaataatgggattcgttccctgaacaggaatctaactcaggctgtagccataaaagcacagaagcttagttactagaccacaggctggagtgttgttttgtctcttttcccttctgtctcttcttgccctttcataaatgtttttgggccccaatcatgtgccagacactgtggcaaccactgggagtaaaatagccaacaaaacaagactcaatcccagactccatggaccttatactctaatgagagggataggcatttatccaataatcacacaccacatacaacatttcatgtaacaacttgcattctagtaaatgctgtgaggagaggttctcggggtgcaattggaacctatgacgggttggcctggtcagaaaggtcagggcagtcttccctgagaatttgatgacttagctgcgagctgaatggtgagtaggaattaatgagtggctaaaatggggaacagctttccaggctctgacagtgtgtgcaagtgccatgtggaggaatttgaggggccaaaatgaagggtagggtggatggagaggaaagagtaaggggtgaaggaatgttaattaggctgcagagttaagtgatggtcagatcaggcagggggcaatgtaggctatattaagaacaccatcccagcagcaatgggatgtcattgaagggtctaagcaaaaatgtgacatggttaaatatgtgatgtcttgcaaattcagtttatcaaaatcctagtattctaaaacatttaaaaatatactcaacacatacactaacccctaatattccttcatctgcccaccctcatttccaacaactgtggtgacatgggattgtacaaggagttggctttgtatacataattcatagtcaataaatttttcgtttacgttcatgggaaaaatgctggctcatagaattagttgactcagttgggatgcattcttccattttctggaaaagtttatgtacaattattattacttccttaatgtttgttagaaatccccaatgaagctatttggacctggatttttttctttatgggaagatttgtaactacaaattcagtttctctgaaagagttttttagggtatctatttcttggctgagctttagtagtttgcatcttcaaggaatttttctgttttatctaatttgccaaatatactgatacaaagtgttcaaaatgttccttttaacaactgtaaaatctgtagtgttatcacctctcattactgatactgataatttgtcctctcttttcctgatcagtcggcctagagctttatcaaacttagcttctcaaagaattagcttttggtttcattgatttttctctattgtatttctactttttctttctttcttttttttctttttgagatggagtcttgttctggcgcccaggctggagtacagtggcgcgatctcagctcactgcaacctccgcttcctgggttcaagtgattctcctgcctcagcctcccgagtagctggaattacaggtacccacccccaagcccagctaattttttgtatttttagtagagacggggtttcaccatcttggctaggctggtcttgaactcctgacctcgtgatccactctcctctgcctcccagagtgctgggattacagccatgagccaccgtgcccggcccaccttttgatttctgctctatttcttttttttctacttactttggactagaccaccaccattttttgctccccactcttctccttcaaggactgcaattatacacatgcatttggctgcctgaagttgtcccaccctttactgatgctctatttattttggtaggaggtgtgtgtctcattttattcttttttctctctgtttcagggaggttctactgctgcatcttcaagttcactgatctttctttctgcaatatctaatctgccattaatctcatctaacatatttttcatctcagacattggagttttcatctctagaagtttgatacgggtctttttataccttcattgtctgtaatatcttcagtctttcctctggtttcttgaatacatggaatataattataataactgttttaatgtccttgtctaataatcttcatcatctgtaatttctgagtcagttttgacagaatgttttattttttgtttgttttgagatggagtcttgctctgttgcccaggctggagtgcattggcacaat

SEQ ID NO: 1197 - DNA, 35501 bp, Homo sapiens
gtttaaacatataaagaataagagaatgttaatggcatgagaaagacagactcttcctgtaaaatataaataggctcatgagacttcctgcatccccctcagcacccgcccacttaccggacattcatccactaaattgttaccaaacattaaggaaggtgcggcaaggcattcctttcataggcatgagaggtcctcccacctgaccctggggctagaaactgaaaaagaattgaaaattctgaagccaagtagattttagctttttatttttatgttctcctttttcctctaaagcagccagaaaagctgaatttttaccttttaaacagattttagtttgtggattaatcttttgtttaaatttaattactgaatagtgatttcaccagttgtttcgaggttggttacctttactaaaaatgctggatgaaggccaatgggtcacacactgagcctttctttaacttacaactacgatgtcagaagaatcgtcactctaatccaaaatattctcctcctcctattgtgcccatttgctctgacctttcccaaaggatgaaataagaaaacaattcatttacagtgctttttttaaaaaaaggtttttgccttcttccaagttatatataggccaagtgtggtggctcatgcctataatcctagcactttaggaggctgaggcaggaggatcccttgaggccaggagttcaagaccaaactgggcagcatagcaagaccctgtctctaaaaaaaaagaaaattcaaagttatacatgtacatgagttaaaggtttcaacatatcttcctatcctccaaggcaaccattttcaacttttgactgattctttggtatttaccttcacatgtctaaataacatgtttaggccaggcatggtggctcacacccataatcccagcactttgggtggctggggtgggtggatcacttaagctcaggagttcgagaacagcctgggcaacacagtgaaacactgtctttacaaaaacgacaccaaaaaattagccgggtatagtggagtgggcctgtagttccagctatgcagaaggctgtggtgggaggatcatttgagcatcggaggttgaggctgcagtaagccgtgattgtaccactgcactccaggatgggcgacagagaccctgtcttaaacaaaacaaaacaaaacaaaacaaaacaaaacaaaacaactatgtttatatttcttcttcttgattttttagttaccattttgtcgatttcccaatacagaagatgaggatttagctttcttttgtacactcctttgcatctccaccaatcatgtacactttcagttctttaattctcctgaaacttataatttgctcatcctgcacaatcaagaggacgtaattgatgtagtagatcaatgtgatgcaggatgtccagaaggtccagatcttttcaggctattttatgatagagggcaggaatactgttaatatagccctggaaccaaaccgtaaatgtgtacttttttttaataaaaaagaaatagactttgggcagcctagacgggcagatcacaaggtcaggagatcgagaccatcctggctaacatggtgaaacctcatctctactaaaaatacaaaaaattagccaggtgtggtggcaggcacctgtagtcccagctacttgggaggctgaggcagaagaatggtgtgaacccgggaggcggagcttgcagtgagccgagattgcgccactgcactccagcctgggcgacagagtgagactccgtctcaaaaaaataaataaataaaaagaaatagggtctagctttgtcacccaggctggagtgcagtggtacaattgtagctgactgtagcctcaaattcctggactcaagcgatcctaccacttcagcctcctgagtagctgggagatgctcaccactacgtccagctaattaattttttttttaacgtaaagataggatctcactctgttgcccacactggtcttgaactcctggcttcaagcaattctcctgccttggcctcccaaaatgctgggattacaggcatgagcaaccacatccagccaatgtgcacttttgtctgtttcatggaatgccactgtttctgatcctttcttacgattggaatagaaaagaatgcattcactaaaatcagtggtgcataccaaatatctgaggatgtattaatcaactctagcaaatacaccacatctgtcatgacagctgcgatcaggcctactaatgggttgtacttgcagtaatctactgtcatccttcagagtccatctatttttgccgggccatatggtgaattaaacagagatatgatgggaatcagcacctctgtttcctttaaaatcttaagagtgacacgaattcctgccatcttctcttgagatataatattgtttgatttcctgtatgtgtttcctatgtgtccccccaaaattcatatgttgaagccctaacccgcagtatgatagtatttggaggtagggtctctgggagataactaggtttagattatatcttagtccatttgggctgctataacagaataccatagactgtgtggcttataaacaacagaaatttatttctaatagttctagaggctaggaagtctaagattgaggcactgacagattctgtatgtggtgaagtcttcctggttcaaagataggtgtcttcttgttgcatctcagcctggggaaagtgtgagggcactctctggggtctctttaactgatatcattccttaatcatctcccaaacacctcacctccaaataccatcatgccgggcattaggtttcaacatgaattttagggaacacagaaggtcatgagggtaaagcccccaccatgggattagtatccttatagtaagaggaagaattcagaattcagaattccctctctacacactcacactgagaaagggccatgtgaggacacagcaaaaaggtggttgtctgcaggctagaaagagctctcaccagaaactgaatctgctgggactttgatcttggactctccagcctccaatactatgagaagtaaatgtctgttgtctaaatttcccagtatatagtattttgttatagcagactgagctgactaagagactgtgccatgtttctctggagctgggaagcagtttcaaaggctttcacttggccttccccaccattatagcttttaccccataggcaaaagtcctaatgcatttgcatcaattgccaaaaatgacaactccattatacatttgaagagtggggaaatgataattagttgtggtcacagatccagtagtaaactcactctgagccggaccttgccatgactccatttattaactggcttctttatgcccccattataacagaaggccacgatgatgcttgtggtctgtggataacaagttaaattcataccctctgtctcacaatccttggcatgtttgggtatgtccatttccccagggtacaattacccaagtaaatgactaaagatccctttggggaaggactgaggaaaccattaccatttatacttgttgaggtatagcaaagtccttcctcctggcctcttcagtcaatgggttccaggtctaaaaatgctctggtctggaaactaaggaattgactattgggtgactatccttagcatcctggtcatctatccttaacttttttttccccactggtacaaaataatagagcttagttggttgtctatctattttgcccctaaagacgccaccatctagtaaccatttctataactctctgagggtcaagtccccttggtaggtcattataattgcgacctcctggcttctagtaattaagcactgccagttggccagtattgttttggggtctatcatctccattgctatcagtgagtcaaagtctgggaggcctctgctaccatcagtcctggcttgcagagagccaccactgaggtttttagtgatgtttatgtcctttgcaccagtgcattccctaatggccttggtaaatggtgtgtcctctgggccttccctcagaacataatgatcataaccttccaggcgtacgtaatatatccactccagcagacccatttctgtcaaccttttaatccctttttgagccacctgcctgccctagcactcctagcatttcgttttcttttcccatgcttttaggagccattgtagtagttagtgaatgttcacgtcaattcttgggggtccttggcagaatattaaatcctgtatttgggagaatactccaaattcaatataactttcccattcaattttatgttctagctccccttgcttaagcatcatctgaatccagccccatgtactcttctgaagctcctgttggtacgtgcttgtctaggtcttacatcttctttggggaacagtcatttacctctacccatcaggtacagcaccttcccaactaggttatgctatgatttaaccctaattatagatctactggctagaaggctagatgacaggtgtgagtgctggcggaagggagaacatgcctttcaagtagaagcctctgcaatgtcttctagtacaggaaagtgatagctctgagtagggaggaggggccacactgcaggcttcagaggagcctggggaatcaaaattttcatgatcactacccagatggaccctccatgtgtcagggtgctagattttctcaaccatgaccctgactttgacacaacagacctattttaggcatttaaccatcttttaagtttgaccactctaaagtagtcttgatgctcagctttctccacccttcccctgcagatgagagctgttttttatgcaacgaacaggtgctctggctttcacaccagaccttcaattgcttattacctacccttagctgttttttatttttctgtaaccaatggagtttagcaatagccatccaattctattattcttatagctacaacttccaccatatatgttaactgccagatatatcacacctgcaagtgcattctcttccacctggtacatcatcctgattggaccattaccttgtgccaggagctgactatgcttcacctaccacctgctaggtagtctataattcagctcccaaacctcatctggttgtctactttctccaaccaatcctcgtactaattcttgcaggcagccttcttgaggagcaggtgcagagagagacaaagctggagcataagatgtgaaaggaagggagaggaagtaggactggtaagagaatgaagtcaaattccagtacaggtccaataaagctttggccagcctcgctaagagctctggagtgaatactgcccatcagaggtgtccagtggtggccataatggctgagcctttatagtccagccttgcttaatcacccagtttaggctgcagagagcatgactgtgggcaaggccattgtctgcgattgaagcagagtctgatggaactgacaactggaggtagtctttgcagcttgggagcaagtccctccttgaagggggatctgggcagctcatctccatatctaccacaagggcaaacagatacccagcatattctcttttcaaggaaccaaaagctgtacagtacttttccatttttcatcttttggggatatcttcaccagctggggatttttttttaacctggtaagggaggcatagcagagaatgctatttgtcctctaatatccattctatccttcttccttaatattataacccctgatttttagttgggtatatagccacccagaataatgttgtcaaatgactaagttctggccaatgggctataagtaggaatggtgtgtacagcttccaggaagtatccttaaagagaggggaccatggtcatctctgtccttttttctttcctgcataggactgtagacatgatggctggaatttaaacagctataaaggaccgaaaggtagaagccacatgttgagaatggaagaaattaattaggtccctgatggtcacagaaccaccatactaatctagactgcctacttctgcattatgtatacatgataaagacatgaatattaattttagctaaggacacttaaaaatattctgttacttataaacaaacctattcctatcggatgcagagtttggttcctataaatttgtgctacacataaccttaaaagaaatgtggtttttagtggaagcatttgggcagtgggtggtaaagactcagatactgcaagatggaaaactggtgacctttgttctccagttgccagacatttggtaaacctgttgccagctttagaagacagatcacacgccaatcaaaattgtggcacgaagggaaatggctggaaatatctataaacttggtatttgctggctttttcttgacactttaaaccaagttctatgagatatgaattcaggccagaagtaaccaatttgcatgtagaaatggaaaagaatacagttttgctaaaggagaaattctgctgtaatccaagtggattaaaagtctcataatttgggcgggacgtggtggttcatgcctgtaatctcagcactttgggaggccgaggcggatcacgaggtcaggagttcgagactagcctggccaacactgtgaaaccccgtctctattaaaaatacaaaaattagctgggcgtcgtggcaggcaccagtaatcccagctacttgggaggctgaggcaggagaattgcttgaacccaggaggtggaggttgcagtgagccaagatcatgccattgcactccagcctgggggacagagcaagactccatctcaaaaaaataaaaataaaagtttcataatttgaagatttaaagggcggaaaaaaaccacacttcttctatacctttagactgaagtacagttggccctccacattcatgggttccatatacatggattcaaccaaccacagatcaaaaaatcttatgaaaaaggtacacaaagttccaaaaagcaaaacttgaatttgccacgtgccaagtgttaaatactatgttaaatccatgtgaatgatgtgtaggcattgtattaggtaattaagtaatctagagatgatttaaagtataggtgggatgtgcataagttgtatgcaaatactatgccattttatatatgggacttgagcatcctcggattttgatatccataacggtcctggaaccaatcccccatggataccaagggatgactgtacacagaaacagtgcctgtgaaactttggaaggaaatatgcctggcatttacccacacaagactgacaaatataggattgagaatgctgtgaacctattaaatcccattgtttccaaagggattagctgtcattaagagtggggtaactggggagcacacagaaactgggaaaaaagtttcggggcttaaaaactcatctaggcaagaactgtggctagaatttctcccacaaacaactgactgaaagcaaaagaatgagaagcatattaaatttttacattaatcatattgccagagacacaccaaacttctgctattgctgttgacaagcacagttgtggaggtgtttgatttttctgaagcagcattagcagaaacctcagtgtctagccacttgtcctgtgggccttgacagacgggacgtaggatatgcatggcactggtgcagatcatagtgggtatagtgtggttctagggtcagcggtgcacgcagctttctgatggtggtttcctaggcatggcagcagcagtgtgattcagagacgtcatttcctgatcatagaagagtcattgcttccttggtggcctggttctgggaagactttgggactcattcctgaaaaactaatctagagcctatttaatcaaccctcccaagtattcaatatctttgtgtttatactagctaaaatggattctattttccgcaaatgaatcttaactgataccacacattgtgtacaggaagaatagtggctgcagacaataggatctcaggaatatgggaaagtagaattgcttatctgttctcgtagagtttgaaagtagcaataattatgctagtactagaaaatgagacactgccactctgtggtgcacaatggctaagactgacctatatacattttctaatcttgtccttgtgtatttcgtgatctgctggttcaacatctgtttgtacgttaaacacctcaatcttaatattctaagaacgatgatccttcccattgagcctactaagacccccattttagcaaggaccaacactgagttgctcaggttaaaaaaaaaatcgttactctttgtttttttttcttttttcgggtgggagggtggagggcagggcctcacactgttgcccaggctggagtgcagtggtgcatctcggctcactgcagccaggggatcctcctccctcatcctcccgagtggctgggactacaggcacgtgccaccacgcacggccaatttttggagttttttgtagcgatgggtcttgccatgttgcccaggctgatcttgaactcctgggttcaagcggtccaccggccctggctacccgacctgttttttcttacattatcatacagccaatccatcagtagagctcgttggctgtgctcaaaatatatcttgaaccctaccagttttcaacatcccaccatcttattccagactaccataatttattccttggcttattgaaccagcatcttggctgacctttccgctggtacttttctttttttgagacagagttttgctctggttgcccaggctggagtgcagtgaggcgatctcggctcaccgcaacctccgcctcctgggttcaagcgattctcctgcctcagcctccggagtagctgggattacaggcctgcgccaccacgcccggctaattttgtatttttagtagggacggggtttctccatgttggtcaggctggtctcgaattcccgacctcaagagatcagcccgccttggcctcccaacgtgctgggattacaagcgtgagccaccacgcccgaccctgcttgtactcttgaaggtcaacgtgtaatcccgccactccccagctcagaatcatctaacgactcccatctccttactcggcttacccagggtcctgcctttctcactcatctcatctcctcccatcttatttcccaaattgactgcgctctaagcgccctggcctccttgcttcttttcaaaacaccaaccacattaagcttcaggacgtttgtaacttgctgttctctctgcccgcaccattcttccctcagattcctccaagctttttcattcagctctgctcaaatgtcaactcaaagaggtctttccaggctatcgtatctatcacttatcttagcgtcacttgtatctccctctccagaatgtaatgctcctttatgacagggaatgcctttacatccctcgcgccttgaaaaatgcctggcacatagtaggcaccttaaaaatacttgattaaatggatttgggctgaacgtatcctgcttaactgcagcacttgagctgaggtcacctcaccaaagcaggcacacaaacacaaaaggaagcacacaaccagatgaggcctgcctgccgctcctgaaccctttgggagggctcgcgcgggaaccctgggaagctcccgcggccggagctgggcctgaaactgttctttcgtttcctcctgcggccgagaaagggaagaggtaaacaggcgaaaatgaggcgagcaggggctgaggaccgggcctcagctctacagcattcgcctgagcatgtattgttatccgtggcagcgccttgtctcattggatggccctaggcctagtgtggccgcgactccgaactgaaagcccaagcgcggcggcgtccagccgggcagccattttccgaagctgctctcttggtaaccccgcccgggcgcgtacgcacgaacggaggcggggcttaccgcgagggcctcgctccggaagccgcaccctccgcggcgtcccaccgtcgaggattaacaaaacgccaaacaagattttaacagtcggcagcgaaagcgcgcactcgagcgccaatgagagcggaaggaggggcaccgcgcctgaggaacactccgtatgtcgaacaatgattggctggagcccacctttcttcttttttgctattagatgggcttgctgctcccgcccatctaattggctttggtctaggtacttctgattggcttcccccgggcggtgggaggcgcggttttggggattgttcatcatggattggtgaatttgggctccttctcgaggtggtggcccatcccgtctgctctctgtcccgtctcccgacccgtacgcttttccctcaactcgcgcgcacgaatggttaaaaaaagggtgtgaggctcgagcccgccagccaggccgctagcacctcgcgcgcgccctcagcgaggacccgcacgagctgcccggctctgtgcctgcgttgtttgaaactgtggaacccgttaggcttttggggaactacagtcccagctggctccggagcccgtgcgtgccaggggcgagtggccgtcgcgagacggctcctgcctttcgtgtctctgcagcgtggagactggaaccggcaatttcaaaggacgccacgttcaatcgcagcgctggcgcgggcggaggctaaaacacgggggtcctgagactgaggaaaacgcgccaagttcccctcggtggcggagtgctaaagaccctagcggttcaggcgttcggcgagcggggccgctgcttgttgcgctcctggctctcccggggcgggcgcagatgggcgccgctcccgggatgtagttggtgttggtgcaagacgggagcgagcggcggtcggggttcccgctcttgggagcggatggtcactcccccgcggggagggcgagccgaccagattttcctggggccggggacccggcgggctcggggcagggactcacctgtcgcacccacactcattcgggttggacttgccggcgtcaccgccgcggacttcgctttgggccatgaccaggtaaggagggcctgggaggaggggccggctcccgggcgcgggggcaagttcggccggcgcgggagaggagctgccggggagaccccgggaccgtgttggcctcgcaccctggtcgacctgccagggggagccgtgtgtgcctcgggcgtggcgcctgtcttgccgccgccgggacgcgagaaggcaggtgcgggctgggcgtaaataggccaactccgcggcgagggcgcccggcgcgggggtgtgggccgaggacgccgccgccagcctcccccgaccgggcagcctggtcgctgctcgtccttccagctttctttccgttcccgagagcggtgaaggatggggagaaagaaacgtttccacgcaggttgccctgtgtcggtaattgcgaaattttaccgcgcattttctttcacttacactttttcaagaagtgtttagaacgccgcgtgtcttaaaccttggcgaagatgtccttgtagatttttgttgaaaaatcggaatcgagtcgtgtcatcttataaagaatttaaaactattgggactgagtgttcacgctgtcaacagataatggtcgattcgtcgtgctttctgcgaaagttgatttagttacaggagaaatattttggatgtaacagccccccagttacaaggaaagccaggagcaagaaatagcaaggaagatactgcacctggcaaaatgttacattctcggtgtgagctttgctttgaggggctaggaggtttggttttttgattaagctgacgatccgctatttcacctgcctaatcattcttcccttctgtgtagtctggttactctgtcggtttgagatccagtttctgtcatccattaaattggctctcgagaaaaaccttttatcagaatcattaatgcttggcgatccctgagaacttagcgcaggttggtttatcattcagaagacagcgcttcctcagaagcattaggtagacaggagagtaagtgaagttggagacagaatggagagatggatcagctttccagtgcttcctgatttgggtctcagaaatggtttcagtgtgctgagttcagtatgaattcctagatcagtgtcagccatgtgaaatgcttattaaggatgaaatttgagtgagtcttgtgtagttcattttattactctgcattttaaatttgaaactcgttgctgaagttttgggctttaagtaattttatggtaatactctagtcagataatttttcctcccatgtcctgaaaaataggcctgatgtagaaaatattaactcctacactcctacaaatgttgccattttttttcacgtgcaagttttactttaaaacagggtgggaaagttgcaaatggcaaaccaaatcatctttttttcctactcaaagcactatttttaaaatccaaagttttttaaaaagtttggaaaacgagtattgtggtttctagtgcattaagaattggatttacacaaagtgcatcgaacagttttttttatcacggtctcaactttgcttgtgttttatctttcacttacggttttaggtataacttaacaccatctctatgccttgaatgcaaattattctttaataagctttttaggtactttattttcatatatccatgttaataactagaaaaggcattggaagagaggactcatcgtccagcactactttgattttccattcatcctttcctaccttgtacttgagaattagaggtggtagtgctcagtcaatattttctgaatgaatcattataatgaaatattaagttgttttttttttgagactaagtcttgctctatggcccaggctggagtgcaatggcacgatctcggctcactgcagcctccgcctcccggattcaagggattctcctgtctcagcctcctgagtagctgggattacaggcgcccgccagcacgcccggctaatttttgtatttttagtagagatggggtttcaccatgttggtcaggctggtctcgaactcctgacctcgtgatccactcgcttcggcctcccaaagtgctgggattacaggcgtgagctatcgcttccggcccttgaaataataagtttttactacttatactattttactgtaggtctactaaataggatattttgtaatgcgacccttaatccatagcaggctgattttaaaaattcagtagcttctgttttttgttctttaagaacagtgtggtatgcttcttcatttaagcaataaatattgagtgcttattggcaggcattaggttttcaaatgttaatttctaatttgtaccattcccttggtaaatttgttttcaaaattgatgattttgttgccaaaactgataaccaaaaactaatgaaactttctctgtgattaacagatataattggtgattacaactttcctctataaattaactcttgacactccttgggatttgaagaaaaaaatgcctggtgtcatacctagtgaaagtaatggactttcaagaggtagcccttcaaagaaaaacagactttccttaaagttttttcagaaaaaggaaactaagagagctttggatttcacagattctcaagaaaatgaagaaaaagcttctgaatatagagcatctgaaatgtatgtatcttacatttctgtactttaaaaattctacagtaaagcagcagtgaacttggttgacaactccagtctgacttgatagtctgtagcggcacaaaaaagtacgcttcagtgtacttcttagtcaaatctagcagtttatagtaggaacagcaaaactggtggttccccgtaggaatcacatcgataatgtttaactcatgttaacactgtgctcagccatttagactaacttggagaaatatttgttgactaaaattgtctttctgagtttaaatttgattatttgtagtgcaaaacatctgtgtaggggtaaaaggttttatatatatatatatatatatttgtttggttcagaagacttgacagttataagacattttaaactctagtcatgtaactagtcatacctgttggaggcatatgattgcaaattataaaaataaactttaagtaatgcttttgatgcaaataaattatttagctacagaaaataaatcagaacaaagtggaatactttattccaccaccagcagctctagctggagtctgtactactccctgtttaacatataggcactctgctgggtgactaaggtggatttggtcccatgtgttaatttcctaatagctatcaataaccagttgaggagatttgtgagagtgaagcttttgtttatcagcattcatacttctgaatactttgaggtgctagagtaataatagctagcaatcgtaaaataaatgaaaatattggaaggacctagtggtttttttgttgttgttgttaaagaagtaaaagaatagtaaacttaaagcatttgtgttttgagatggggtctccttgtgttgcccaggctggtcttgaattcctgggctcgagcagtcctcccaagtagctggaattacatgtcaatgcccccacacccacattctgaacattttatttttaagtgagggatagctacatattttttttttttttaccagcaggaagtcatatataattctcttcacagactttctttcctctgaattcttattaatagaatcttacttagtgcagcctctcccaaatattgtcatggttagtttattcccaggtttctgttcagttaaactatttgattaaaatgtcaaagtagatgaaacaaatcatagtctctcagttcctcaattttctactctgtaaaataggattaacatccttttaagggaattgttctgtggcttgttatgtgtaataatgtttttaaatgcttttaaaacttttattctgggcatatagcaatttttgagcctgtatttcttaaaatgtcatctgaacaagattcacatacttttcagattatacaacttttgggaaaagactaaatctacagaagtaatattttcaccttgtttctttaagataactacttatcgttctcccttctatatttcatagtgatcaagttgttcctgcagcacagtcttcacctataaactgtgagaagagagaaaacttgttaccatttgtgggactgaataatctcggcaatacttgctatcttaatagtatacttcaggtaaattgacaattttgctatatcataaagctttagtaggcaaagattgatgtagcatttaatgtttttgagttattggaggactttaatgtccatactgtctttgcctttgattgttaataaaccagaataggctaaaataataagttacatgttattaaacttcctttggggtaagagaaaatgatagactaaataaaggtgggatagcaaaattgagtagaccttaagtggaaggtcaaacctttaatttctttctctgattcctggtgctacagtgtgatatatgtcttatcccttggaagtaacgttggcattgtgttgtgtgtccgttggcgctgtgttgtgtgtccttgtaaccttaaagtcttagcaatatctgcccaggtgcagtgctttgtgctaatgagggaagacactgggctactactgatgaagtggagaacaaattttgacacaaaacttaatctcagaattttagggtaatacatgttaaaagtgctctatagaaagcatgatgttgttttaatgattttacgtgtattgtttgttcagtaaacacttaagacaatctcactttttataggtattatatttttgtcccggttttaaatctggagtaaagcacttatttaatattatttcaaggaagaaagaagctctaaaggatgaagccaatcaaaaagacaaggtaagaaaaataaagaacagaaaataatgtaaaaagcaaaagtaaattaatggaaatttacttgcctggaaatgaagaggactgggggggtggatgacaaagattatttctctgttagcgagctattgtcaggcaattatttttcattctttcaaggtggctaactagataattcccttttacaatgtttgctcctgtaatctgtgtatcaaacttttgttacttgtatactatatattactgtatactataatcacaatatgttatacccatgtacaacttatttacccattgtgttttcaaattgagttaaaatttaaatacagtgtatttaaagaaatctttaacttccataattaaaaaaccattgtaattcacataaatagtaattcataattcctcttaaaattacaaaaaagaccagacgtggtggctcatgcctgtaatcccagcagtttgggaggtcaaggtgggtggtggattgcttgagcgcaagagtttgagaccagcctgggtaacatggcaagaccctgtctttactaaaaatacaaaaactagtagggcgtcatggtgtgagcctgtagttccagctaattgggaggctgaggtggaggattgcttgagcccaggaggttgaggctccagtgagccgcgatcaagccactgcactccagcctgggcgacagagaccctgtctcaaaataaaaaaataaaaaataaggcttatttgtacatcccttaaaattagtgctattatgcaacttagaaaatctagtattcttaagtgagacaaagacaaagggggaaggtacttaatttgttcataaaattattggtttgtgtgtttctttcttgacagggaaattgcaaagaagattctttggcaagttatgaattgatatgcagtttacagtccttaatcatttcggttgaacagctccaggctagttttctcttaaatccagagaaatatactgatgaacttgccactcagccaaggcgactgcttaacacactgaggtatagcctataatataattttagggtttcaatttagctacttgtttatatccttggaggagaatgacatgcgaagaaacaggaataaagggcaaggaaagtagaaactctaggtccacagtcctttatatcccagagactctgaatactggaaatttttttcataaatttggtgctaaattcgttagatctgaacatattatatgaggctttttatagtcattcatatttatctctaacgtgaatattcatacatgcttctatagaagtagtaatgtgtttagttatagagtactcccatatcaagtcggtgataaatattttacttatatgccatataatcattgaatctgaaaatgtctgaatttctaaatgcgtggtcctaaggatttcacattaagaattataggactatattcaaaatatgtgtaagaactgtaaattccaaatattctatttttatatgtgattagaggagaactgttggctaactggattagattgctttttggtattttcttaaaaatgaaactttacatataaaatagccttattcaaatacaattatagggcaagtctttaaaacaatcacttaagcatttagtttaaaaatagaactaggtgcaatatattgctataccttagttaagaggtattgtaggccggtcacagctcacacttgtaatcccagcactttgggaggtgaaggtaggtgggtcatttgaggtcaggagttcaagaccagtgtggccaacatggtgaaaccctgcccctactaaaaatacaaaaattagctgggtgtggtggtttgcacctgtagtcccacctactcgggagactgaggcaggagaatcgcttgaacccgggaggcggcggttgcagtgagccaagattgcgccattgcagtccagtctgggcaacagatcaagacccttgtctccaaaaaaaaaaaaaaaaaaaaggccattgtagcgtggtggccaagagcgggtttgaatactggcttttcatcctaagtagttctgtgaccttgggcaagttatttaacctgtctgtgccttagtgcttgtatctgtcagtaatggtgataatagtacctcatagggttattgtgaagataatgtatacataggagataaaaaacattttgactaaaacctggtgtatggtaagcattatctaagtattagttattaatatatttagaagaggatcaaagtattataatgaaaatagggtacaatttactcttacttttagttacagataagaaattccaaattagtgctgaataaatgtcttgacatttaaaaaatgaaataatttatgattttccttacatgaattaatttctatataggctttatgtactgtatcttcaaaactagaatagatgaaatggaaatttttatttatagggaactcaaccctatgtatgaaggatatctacagcatgatgcacaggaagtattacaatgtattttgggaaacattcaagaaacatgccaactcctaaaaaaagaagaagtaaaaaatgtggcagaattacctactaaggtagaagaaatacctcatccgaaagaggaaatgaatggtattaacagcatagagatggacagtatgaggcattctgaagactttaaagagaaactcccaaaaggaaatgggaaaagaaaaagtgacactgaatttggtaacatgaagaaaaaagttaaattatccaaggaacaccagtcattggaagagaaccagagacaaactagatcaaaaagaaaagctacaagtgatacattagagagtcctcctaaaataattcccaagtatatttctgaaaatgagagtccaagaccctcacaaaagaaatcaagagttaaaataaattggttaaagtctgcaactaagcaacccagcattctttctaaattttgtagtctgggaaaaataacaacaaaccaaggagtcaaaggacaatctaaagaaaatgaatgtgatcctgaagaggacttggggaagtgtgaaagtgataacacaactaatggttgtggacttgaatctccaggaaatactgttacacctgtaaatgttaatgaagttaaacccataaacaaaggttagtataattcttagactttgataggtagaagcattagcagctacagaattagaattttctcttcctagatacatgtacaatataatctctggctaaaattgtttcaagagaaggaaatttaacactgaatgtgaactatggtgttttaagtgctatgcttagattagtgtgtgtgtatatattgtatgcatatatatgtgtgtgtgtgtgtgtgtaatgtcattaaagtaattttaatttatagcttataaagtagggaagttcggccaggtatgttagctcgcacctgcaatcccagtactttgggaggcctaggcgggcagatcacctgcggtcaggagttcaagagcagcctggtcaacatggtgaaaccccgtctctactaaaaatgcaaaaattagccaggcatggtggcgcacgcctgtagtcccagctacttgagaggctgaggcaggagaatcgcctgaacccgggaggtggaggttgcagtgagccaatattatgccactgcactccagcctggggcgacagagcaagactccgtctcaaaaaaaaacaaataataataaagtagggaagttcagtatattttaatgtacatttaagagtacatttccctttatgcagtgtttgacataaactgatgaaggacattgcatttagtgaaattttaaaagtaaagactaagtacagtcatgtgttgcttaacaacagggatatgttctgagaaatgtgctgtttcattgtgtgaatttcacggtgtacttacacaactagatgctagagcgtactacacaactagcctatatggtatagaccagggtatctaatcttttggcttccttgggccacactggaagaagtgtcttgggccacaccacacagaatacactaatgatagctgatgagccaaaaaaaaaaaaatcaaaaaagtctcataatgttttaagaaagtttatgaatttgttacgggctacaggcaagctttgcatggcctattgctcctaggcaacaaacctgtatagcatataactactgaatactgtaggcaactgtagcacaatggtatttgtgtatctaagacgtatctaagcatagatatgtaaacataggtacagtaaaaataatcatagactactgtcacatgcggtccattgttaaataattgaaacgttggtaggtggtgcataactgtaagttacacgatacttgaactagatttttacctagttttgtccagatctacagatatcagggaaaatgtgtaatattgatatagtgaatagttttaccaaaaatgtcatccttattctgggtttattctatggggaggtgtctgtaggaagggagttacaatacaactgacttttttttattttttattttttttatttttttggagacagagttttgctcttgttgcccaggctagagtgcaatggcatgatcttggctcactgcaacctccacctcccgggttcaagcgatcctcctgcctcagcctcccgagtagctgtgattacaggcatgcaccaccacacccggctaattttgtatttttactggagacagggtttctccatgttggtcaggctggtcttgaactccgacctcaggtgatctgcccgcctcagcctcccaaagtcttgggattacaggcttaagccactgtgcccggcctacaactgacttcttttaaagacagtaatttcatagtcagttttatctttacagggaccttaaatttcattaatagggtacctctaataagctaataatgctaataagctgatctatgaaaatggaactgttattcatgatatactttatttaaatggaaaattggttatttggactataatgagaaactaatctgtatagacttacattttcctattttcattttaggtgaagaacaaattggttttgagctagtggagaaattatttcaaggtcagctggtattaaggacgcgttgcttggaatgtgaaagtttaacagaaagaagagaagattttcaagacatcagtgtgccagtacaagaagatgagctttccaaagtagaggagagttctgaaagtaagcaaaattggagtcttgtgtggaccatgatggaatatttataattctttaacaacacaaagtttaatagtagctggtgtaattagggaggggaaaaaagctagcttttagtgtctaatgtaacctttctgcttatctggcttcacttataaatggttagcatttgggaaattgtgacatcttgattttgatgtagagtgtgttagaatggaaaactgaaatgctttaataagtgtacttttgggaacctgagtctttcagagctactgagggttttttttaatttttttgagatggagtcttgctcggttgcccaggctggagtgcagtggcgtgatctcggctcactgcaagctccgccttctgggttcatgccattctcctgcctcagcctcctgagtagctgggactgcaggtgcccaccaccacgcccggctaattttttgtatttttagtagagacggggtttcaccatgttagccaggatggtctcaatctcctgacctcgtgatccgcccgccttggcctcccaaagtgctgggattacaggcgtgagccaccgcgcctggcctactgaggttgtttttaacacaataattgagccactgttgtgtctagagcataccacaaaatatggaaataccataggaaataatcatgagacaggtttacctatcacatattgaaagttggcaattaaatgtaaacagactaggcttattttgtttttgctgtctatcatattttttggccgatcaaatatatttaaaaggtatgtatactgttgaggatgcacttatgaaagtagtttctgaaagtaaaaatctctttagttatttaggaatgggtcggtcaattgaaattaaatgctaattttgaacctgaaactttgtggtttattttttgaatgcctgagagaagtatttgagtgaaaggattctcttttttagtttctccagagccaaaaacagaaatgaagaccctgagatgggcaatttcacaatttgcttcagtagaaaggattgtaggagaagataaatatttctgtgaaaactgccatcattatactgaagctgaacgaagtcttttgtttgacaaaatgcctgaagttataactattcatttgaagtgctttgctgctagtggtttggagtaagtattgtaaataagaactatatgaagaaaatgagctgctgtagaagataagtcttgttcaaaatgctgtaatagtaggaatataaagtactgaaatgaagtagattgtaaagattgcttcagtaaagttttgttcttattaacagtttccctgtaaaaatgaaacaacttaaatccttttgatatgaatacatattctattaagtatgatttcttctccttttttttttgaaacagggtctcattccagttgtccaggctggagtgtagtggcacagcctcagctcactgcagtcttgacctcccaggctcaggtggttctcccacctcagccttctgagtagctgggactacaggtgcatgccaccatgcccagctaattttttgtatttttagtagagacaggatttcaccatgttgcccagtctgatcttgaacttctggactcaagcaatccacctgccttagcctcacaaagtgctgggattacaggcgtgagccaccatgcccggccagtttctttattcatcttttcatattcattccctcttagatgttagtagcagaattcagtagaactgactaaagcagggaacaaattttgtatacatcaagatttttttgaaggggcgggaaaggctaaattcttcctagttttaaggtaagccaggaaatcaaactagtctttcaacagtttgaaaaaaaatgctgattgttttggatagtctgtttttttctgacatgtgtaatgtcattgtatgtgtgactcctttgtacattagttgcttgtttgaaattaccacgagggcttcacagtagctctctcacacttgattatgtcaaaagataacatatagccccttattcagtggaccttccctttgctaatagtataaaatactattttatttactttcccaaattttggtagagaaaaacttcacactaaaaatgactaaaatgggctgggcgtgggtggctcacacctgtaatcctagcactttgggaggctgagatggatggcttgcacccaggagttcaagaccagcctgggcaacatgacaaaaccctatctctacaaaaaatacacaaactagtttggcgtggtggcgggcacttgtggtcccaactactcaggaggctgaggaggaggagcctgaggtgggaggatcacttgagtccagaaggagccatgattgcaccactgcagtcagcctgggtgacagaccctgccttaaaaaaaaaaaaacccaaaacgtaacatttttggttccggttcagtctatttaaaataccatttattttcttaactgcacaaaattaggaaaataaaggaaaaaatacaattatttcttccacagaaatgcctgaatattagcagttatttatttttttgtttctgcatatattataaatattattcaaagttggggtcttgttttgattctgcttttctgatatatgaacactggatattaagggttcattcagatttttacttggtttcagattggggtataacattttgaatttaaaatagaactgcaggaaaccttttctttttttcctcccaaaggtttgattgttatggtggtggactttccaagatcaacactcctttattgacacctcttaaattgtcactagaagaatggagcacaaagccaactaacgacagctatggattatttgcggttgtgatgcatagtggcattacaattagtagtgggcattacactgcttctgttaaagtcactgaccttaacagtttagaactagataaaggaaattttgtggttgaccaaatgtgtgaaataggtaagccagaaccattgaatgaggaggaagcaaggggtgtggttgagaattataatgatgaagaagtgtcaattagagttggtggaaatacacagccaagtaaagttttgaacaaaaaaaatgtagaagctattggacttcttggaggacaaaagagcaaagcagattatgagctatacaacaaagcctctaatcctgataaggttgctagtacagcgtttgctgaaaatagaaattctgagactagtgatactactgggacccatgaatctgatagaaacaaggaatccagtgaccaaacaggcattaatattagtggatttgagaacaaaatttcatacgtagtgcaaagcttaaaggagtatgaggggaagtggttgctttttgatgattctgaagtcaaagttactgaagagaaggactttctgaattctctttccccttctacatctcctacttctactccttacttgctattttataagaaattatagagtgagtgtattttccttgtgtatatattaaacacacccatacaaacattggtaaagttgattacatcaaagaatctttagcttatcttttgaagctactggatattattggtctctctaggtttttatataaatagtgaaatttgaattactgaaaaccatgttaatttttagaactcattttcctcagtagagactagtgatgcattagcttctgggaacaaacttgtatcggttcttaattaaattatccaaaacggaggcatttaaacacttggatttacaccagtcttttgtgtttgctttttaaaataaagtgctcgtatttgtattctccatattttggagtaattatctacatgatgtttatagttcctgtggtttttcacccaagaagcagaatctcattcagtacatttagttttataagagtcatgaagctaaatccttgggctatgtcagaggcacaaagtctagaatgtgtgtattcacaatggtgtatgtacattttgtgccttgattcacttagaagtgtctcagaaaacctggacagttcgcttctacacaagaattttatatgtatttatgaagatgattctgtaccctagtatatctttttgggcatggactaatttgtatctgtttaactcatattctgcacgatctgtatatagtacatcaaacttagaggtgtgaccttaaatttaactttttttaaaaactgggaggtcaataaaatttaaactgcttaactatgtatatgaatatttgaattttttacttgtatatttttataaatacagctgagttttcttaaagcgaataagtgtgtgtatatatatatgtatatatatgagagaataagcatgcataattacctttattactgaatactttctgacagtgcaggagtttttcaaagaggagaaattgtgcttagtccagccaagctgtcatacttaaaagaggtttataatgaaatctgttgcatctaattgtcctttaaagtagacatgatttaatggaatccaaaactggaaaagttaagatgatgctttgggcacacataaaaacttggttaaaatttcattttaaactagtatactgaagtggtaagtgatgaatgatttcatgacttgttaatggacattcttggtactaagtttttcctagaaatgattctaaatatgtaaatgctattggggtaacactttaataccccatttcaacaaggagtaccttctcaattaaaaaaaaatcgcagtaggctgggcgcggtggctcacgcctgtaatcccagcacattgggaggctgaggctggtggatcacgaggtcaggagatcgagatcatcctggctaacacatgaaatcccgtctctactaaaaatacaaaaaattagccgggcgtggtggcaggcatctgtagtcccagctactcaggaggcggaggcaggagaatggcatgaacccaggaggcggagcttgcagtgagccgagattgcgccactgcactccagcctgggcaacagagtgagactccgtctcaaaaaaaaaaaaacacagttacataatgtcttatattctttcataggatgatgagatggtaataaagtcatggttctccccacctttcagaatcactaatggaaatccttaaacagtcctgagcgctacctgtaagttttgaatggaatgggtctaagatagacactgggcctcttaatactcgagagacagccagttctaagaactaacacaaattcctgatgtgagaaagttccattttaagaaaaatgaagtttgtaagaggtttgtatcatacgaatgtttaagaggaagcctctgttctgaaggatgtcagaaaataattggttttgcataattatataaatcataaagtccttgatattactgagatttctgagatttttgtccaaactgttatataaatgtaacctaatgagaagtgacccttcagtggttccttattctctcccttatgtttatacccaccactgacccccaaagaagaagggaaaatgtcactttttttggaggggagggatttccattcttgactccttacctttccttattgttcatttggctcctcaaatagagttttgaggttatgcccttctgactcagatttggtctaacaatgtagactcatctgaaaaatgtttttgtgattcagtctttgaattgatatagataagaggaatttgagatgatactgcccattaaagtacatggagtgtgggatatcaaccatcacttaggctctcagaagtagatattttttagtatattttgaatatttactacattgactatagaatgaaggcaatacgttaaatctgaccagtttttgttttttttttttgaaacggagtctagctctgtcacccaggctggagtgcagtggcgtgatctcagctcactgcaagctccgcctcccgggttcacgccattctcctgcctcagcctcccgagtagctgggactacaggctcctgccccctcgcctggctaattttttgtatttttagtagagacggggtttgactgttagccaggatggtctcaatctcctgacctcgtgatctgtctgcctcggcctcccaaagtgctggtttttgtttttgacttaagagtcttgctctgtcgcccaggctgaagtgcagtggcgccattttggctcgctgcaacctccactttccaggttccagtgattctcatgcctcagccacccaagtagttcggattacaggcacgggctactacacctggctgatttttgtgtttttggtagagatggggtttcaccatattgaccaggctgttcttgaactcctggcctcatgatccgcctgcccctgcctcccagagtgctgggattataggcctgagccactgcacccagccaatctgatcagttcttttatatatatgtgtgtgtatgtatgtatgtgtgtgtgcgtgtgtgtacagatgatagttttttttttttttttttttttgagacggagtctctgtcgcccaggctagagttgcagtggctccatctctgctcactccaacctctgctgcccgggttcaagcgattctcctgcttcagtctcccaagtagctgggattacaggctcctgccactgtgcctggctaattaatttctgtatttttagtagagacgggttttcaccatcttggccaggctggtcttgaactcctgacttcgtgatccacccgcctcggcctcccaaagtgttgggattacagatgtgagccaccgcacccagatctggttagttcttaagtgattcatgtaactggtcagtagaagaaaaggattataaatgatgccattctgtaaactgcactactacccaaaaaccattgttctaaactgttctggaaatcattactatgcatcgttttggaaaaacttgccaagaattaaaatgttacttctcaaattttttttctgtatgacttgcatataattttagatgaattaaagcacctaattttactttttatatgcttctaaactttacaagtgtcagaaaataggtaatttctcaaactccagctgtgttaccttcatggtgctacaagatagctttaagtagattctaatttactggtttacatcgtcaaaaactgatggctggttttaatttgaaacagagaaatcattcattttagttgctaagaatcatgaagttcttactactatcattggtgtaataagatttaatcaagttaaggtgttgtcactggtattagttatccccgtatttaaattattttacacaaaggttttactaagtaaagttctgcaattctaaattcctgttttgggtatgtaaatggaaaataactttgaaacagttaccaaactcattaatttggggctatctatgatttttattctgctaggtttggaactagttcttgagtcaaccctttaattgttctctgccattgtcaataataaaaattttgaagtcccactcggtaaaattagtgtaaacattcacatatttaatagtacctttaaaataagcattactacatttaaaatggttccaaaatgaatctataaatggtaatataaattaaaaaatacgaacttaaagtgaataaatttttaaccttagctatggtataaataatggtaaatgtatagtgtacctttgagtcattaaaatgtcttaaaagataacagcttgttaccagaacattagaaaccatagccatgattctcaagcgttaacaatctacatttgatattttcttggccactgcattcttcaatgaataataatttccagaattccattccatgttgttttccaatagatcttttcacactcgatgttgaatacatggctctttgcagatgaataaaacaagtgcattcagtttagagatccattttgcgaaggctcattcgactgaaggaatctctgggaaaaaaatgagaggacatagttagttaaagagaacaatttttgcatatacctttaaatgtcttacatggttttttctgccagttaccttaaagttttgccaccatttcttactaacttccaagttggatgctcatcctacctactctgccttatattttggcttatagatttagctatagaagtgtattacagtcaccacttactggtcttttgtattcgtttgtctgactgatgctgcagatattgtaataaacaagacaaggacttaagggataatgggagagattttaggaaaagatttggggttttttacacggcaaaaggcaggtgtttattaaattttaagtcttaaaccagttctcaaactttgtctcaggtcccttttacactcttaaaaattattgagaaccccaggaatcttttatgtgggctatatatggatgtttatcatatcagaaattaaaactaagaacatcttaagttactataaaataacccattacatgttactataaatagcattgcttattaaaaatgatctgcaagaagctttaggagagtggtactcatgtaggagtgtggcttaatgcctatgttctcacatgtgcttctatagtcaatcttttccaatgtcacatctcaacctgtagaaatctccactgtaccctcacaagaaaataagtgagaaaaggccaatatttggcattaatatgaaattagttttgacttagggaaattcctgaaagggtcttagggactcccctctcatgggtccaggatccctactgcaaatattcctgatttcataaaccagcaaaattaaaaattcaaatgctaaagaagaattttaaacttaaattctaaaaaagagtgaagggaacgatactcctggaatactcttaacatattttccattatcagttggtttcttttacttatccttcgtgccattaaggttaagccatgaggcttaatatctccaggaaaggaaaaggccaagtacaaagagatcacattggcttcaaatctcaaagcttgctttgaagggaaacagcagtcttgaaaactagatactgttcatcaagaaaaagtttttcaaaactgcctacatatgttaaaaactaaagcttggaggattggccaaaaagtagatcatagaggacggcaaaaactcggatgttgtaaggcaaaattttggtcaggaagaatacagcctttccatggaaaggagtttccatggagatctgaaggaactgagatgaggattaggcctatctcagggacccagcaccctggctctctgggatctctgacctggtgggtataagactgggagagggggagtggaagcagcaagaaggaaaaactttcaaaaagattgaaggggaaaccaaaagtggaggggactagtatgtttcccattgggaattttgagaggaaaccatcttcaatacttgtatgtaaattcgatttcaaaatgcaagaaagtttactttctgcagttattgtgtcctttccagaattccggtactataaagtgaaatgtcaggcactgtcctaagaacttcacatctgtaatgtcatttaatctccacaaaaacctctttaagttctatctcattatacagaggagaaatctaaaaaaattatctgcttaaataatagaactaggatttcgttgtagaaaattccaagttaatgacaagactttgtgtggtgtcccggttaatgagtaccaactttttgattctcaagttatttaccttgtagaatgattatagatgatacaggttgaacatccctaatccaaaattctgaaatgttccaatatcagagactttttaagcgctgacatgatgctcaaaggaaatgctcactggaccatttcagatttttggattagggatactcaaccagtaagtgtaacacgaatattccaaaatctgaaaccccaaacacttctggtcctaagcttttcggatgacagatgctcgagctgtaaaaagacttctactagtttaacatgttaggtttcagaggaaagaatatctaaaaccacttaaaaataagcatacctgtggcaggtgacaggcaatactgccttgtataactgagggatctttctgttgatcagtggctgtagggcctctttaaggcgatgatagtttctctccagttccctttgatactccttttgatccggcccaattaagctcttattttttcttaaggcatcttcacacctaggaaaaacaggatgttatcaagatattacttctggcatagtttgtgggtttaatgccatacacacgcaaaatacatatacatatatatgtgggcttaatgacacacaacacagactatatatgtgggcctaatcacacacacatacacacaaaaatataggccaggcatggtggctcatggctgtaatcccagcactttgggaggtcaaggcaggtggaccacttgagcccaggagttctgagaccagtctggacaacatggcaaaacctcgtctctacaaaaaaatgcaaaaattagccaggcatggtggtgcactcctgtagccccagctattcatgaggctgaagtgggaggatgcttcagcccaggaagtggagaatgcagtgagctgagattgtaccactgcaatccagccagggcaacagagtgggactgtctcaaacgtgggtgtgtgtgtgtgtgtgtgtgtgtgtgtacgcgcgcgctgagattgcatcactgcactccagcctgggcaaccgagtgggactatctgaaacaaatgtgtgtgtattcaccatgatgaggacatttagtttttcagctgaatgttaaataatcatcttttgttttaggtttaaggcagggaacagataatcaactgagttcctgtaaaatctactatttacttccagtgtcattaaattgaaaattatctgaaggcatttttttcacatcaccacttgactagaagctctttcagggatgtaatcatgctcatttatgtggcaccaatgtcatctggcacagtgtctgcctgtgttcaaatatttcttaataggttttgtttttttttttttttgagatggagtctcactctgtagcgcaggctggagtgcagtggcgcgatctcggctcactgcaacctctgcctcccaggttcaagcgattctcctacctcaacctcctgggtagctgggattacaggcgcctgccaccacgcccagctaattttccttatttttagtagagacgggtttcaccatcttagccaggctggtctcgaactcctgacctcgtgatccacccgccttggcctccctaagtgctgggattacaggcgtgagccaccgtgcccggctaaatgaatagattttgatgacagtcctttatccaagttaattcaagtatttgagaaaagtatctggaccctgacagacaatgaaggaaaggatatttacaaataatatatatatctctacatatttgtggaatgccactaaagtgatgcttagtagaaaacacatagcatcaaatgcttatattagaaggctaaaactgaagagttaagcaacttaaagtattagaaaggaaataagattttaaaatagagtatcaaaaattgcaaaagttggttctttgaaaaaactaaaaaaacaaactaagctctggcaagattaaatgaaagaggtcaaatatcccctaccagaaatttaaaatggaacataaagttaaatacagcagaagttttaaaaggcagagaggatataatgtactttttttttttttttttgagacagtgttgctctgtcacccatgctggagtgcagtggcatgatctctgctcactccaacctccgcctcctgggttcaagtgattctcgtatttagccacctgagtagctgggactacaggctcacatcgccacacctggctagtttttgtatttttagtagacatggagtttctccatgttggccaggctggtcttgaacttctggcctcaagtgatctgcctacctcagccatcgaaagtgttgggattgtacaatttacaaaactgtacaatttcatacaaaaaaaccctctgaatttatattcattgatattaatagattaatgtagattttttgctaaattattaataatctgttaatctagattaatataatttagcaaaacagactcaatgaagaaaaaaatggcaataatcctaaaataatccaataggttgaaacaactgtcacaaatctatctacaaagaaaacactaacttctactaaacatcctagggaccaatacccgaatgtaatgcaattattctagagtatataaaaaaatgcttccaggccgggtgcagtggctcatgtctgtaatcccagcactttgggaggccaaggcgggcggatcatgaggtcaggagatcgaggccattctggctaacagtgaaaccccatctctactaagaaaaaatacaaaaaattagccaggtgtggtggtgggtgcctgtagtcccagctactgggaggctgaggcaggagaatggcatgaacctgggaggcggagcttgcagtgagcagagatttcgccactacactccagcctgggtgacagagcaagactcgtctcaaaaaaaaaaaaaaaaaaaaaaaaagattccagagtataggggaaaagaactattcttgaggggagttcccaactcatatttcaaggctgggataccaaaacctaatggagactataagaaaaaaattataatccaagctcacccataaaaataattgtaaaacttccaaacaaaacacagttggccctccctatctgtgggttctgcatgcatgaattagaccaaccatggattgaaataataattaaaaaaactgtgttgaacatgtacagacttttttcttgtcattatttcctaaacaatacaatattaacaactatttacattatatattaggtattttaagtagtctaaaatgatttaaagtatacaggaggatgtacataggttatatacaaatactacaccattttatataacatattaaacttgtcttcagattttggtatccacagaaggcacactgatggacaattttagcagaaaacttgtgccaatgtattgaacacacacacacacacacacacacacacacacacaccctccaagtatttttctttttttcttttttttttgagacagggtcttgctcttttgcccaggctgaagtgcagtggcacgatctcagctcactgcagctttgatctcctgggctcaagggatccttccaccttagcctcccaattagctgggactacaggcgtgcaccatcatgcccggctaatttttgtagttttagcagagataatgttttgccatgttgcccaggctggtctcaaacttctgagctcaagcggtctgcctgcctcagcctcccaaagtgctgggatttacaggcataaggtaccacactggccaagtttattaattcctggaataaatgaaaagttgggttataaaatcactaagtttttagattaaaagattaaaggagatgcagaataaaagcacttgataacaaacttttaaaacctgtcatattaaaaactctttgcataactacaaataggtgggtagtcctttaaccataattaaaaatctacaaaaaacctgtagcaaacatacttagtggtgaaaacccttttagagaaggaacaagaaaatgatgtcctctctattcctagtcaacagagtactggacgtcctaaatatcattataagacaagaaaaagattctacagataaattattagaattaataagtctattaagataataattctaataagataaattattagaattaataagtaagtctggtaaaattctcatgtaaaagtaatatataaagttaactgcagctgggcacagaggctcacacctgcaatcccagcactttggcaggctgagaccagaggactgctggagcccaggagtgagagaccagcctgggcaacatagtgagactctgtcactataaaattaggtatagtggtgaacacctgtggtcccagctacttgggaggctgaggcaggaggatcgcttgaatccagcaggtcaaggctgcagtgagccatgatcacaccactgcactcactccagcctgggtgacacagtgagaccccatctcaaaaaataaataaaataaaataaaataaaataaaataaaataaaataaaataaaataaaagtcaactgatttttggtagagcaggaaacagaaaacacaattttgaaagataacattaaggccgagcacagtgg

SEQ ID NO: 1198 - DNA, 26263 bp, Homo sapiens
tatacaattaataaagtgtgatgagtagttaccatagaagtattctcagggatagaggtcttctgcctgcacttgaacaagagcagcgctatattgattataatttgggactccaggtaagattttgtttgtaaacctggcttcactaccatataaaagtttgaatactgccatttatttatctgaatttcatcctaacagcctattatgtaaatgaatggccattgcgtatatagttataactatataagctttttttttttaaattgagacagagtcttcctctgtcacccaggccggaatgcagtggttcaatcacggctcattgcagccttgacctcccaggctcaagtcatcctcccatctcaacttcccaagtagatggggacacaggtgcacgccaccacgtccagctaatttttaaactttttgtggagacggggtctctctgttttgcccaagctggtctcgaacttgtgtgctcaagaaatcctcctcccttagtctcccaaagtgttgggattataggtgtcagccaccatgcccagccttataagccttatcctcattttatagttgagaaaatacagttaacagagttaaagaacagagttaaagtaacccttttttttttttgagatggagtctcgctctgtcgcccaggctggagtgcagtggcctgatctcggctcactgcaagctccgcctcctgggttcatgccattctcctggctcagcctcccggtagctgggactacaggagcccaccaccacacccggctaattttttgtatgtttagtagggacggggtttcaccgtgttagccaggatggtctcgatctcctgacctcgtgatctgcccccctcggcctcccaaagtgctaggattacaggcgtgagccaccgcaccccgccgctaaagtcttacgacaattaaattgcaaagcctcattccaaatctctgctctctatatcacaccacagtgcccacacccaaaatggaataaatcttatttccccagaagagagatctctagttaagaagtacaaagctctgccttagccttatccaatatccatttttttttatgaaagagatatatagcatgctgataaaaaacaaaaaacacaccatcatctcaatcaacatggaaaaagcatttgaaaaactcctttataaggccgggcgctttggctcatgtctgtaatcctagcactttgggaggccgaggcaggcagatcacctgaggtcaggagttcaagaccagcctggcagacagggtgaaaccccgtctctacaaaaaatgcaaaaattagctgagcatggtggcctgcgtctgtggtcccagttaccgggtggctgaggcaggagaatcacttgaacccaggaggggaggcagagattgcagtgagccgagatcacaccactgccctccagcctgggtgacagagggagactccgtctcaaaacaaaaatcaaaaaacaactcccttttgagaaaaaccgtcaacgccagaagggaacttcctcaacctgacaagggcatctgtgaaaaatctgcagcttaacctcatatttaatggagaaagacagccgggcgcgtggctcacgcctgtattcccagcactttgggagtccgaggcgtgtggatcacgaggtcaggagttcaagaccagcctggccaacatggtgaaagcccgtctctactaaaaatacaaaaaattagctgggcgtggtggcgggcgcctgtaatcccagctactccggaggctgaggcagagaattgcttaaaacctggaggggcggagcttgcagtgagccgagatcgcgccactcgactccggcctgggcgacagaggaagactctgtcgcaaaaaaaaaaaaaaaaggagaaagacattgattttccccctaaaggcagaacgagacaaggatgtctgctggtaacactgtcttttttttattttgagacggagtcttgctctgtcgcccaggctggagtgcagtggcgcgatctcagctcactgcaagccctgcctcctgagttcacgccactctcctgcctcagcctcccgagtagctgggactacaggcacccgccaccatgcccgactaatttttttgtatttttagtagagacggggtttcaccatgttagccaggatggtctcgatttcctgaccttgtgatccgcccgcctcggcctcccaaagtgctaggattacagccgtgagccaccgcgccccgccaacactcttactcaatattgtactggaggctgagcacggtggctcacgcctgtaatcttagcactttgggaggccgagcgggctggatcacctgaggtcaggagctcgaagccagcctggccaacatggtgaaactccatctctactaaaagtacaaaattagccgagcgtggtgctgcatgcctgtaatcccagctacccggatggctgaggtaggagaatcgcttgaacccaggaggtggaggttgcagtaagccaaaatcatgtcactgcactctagcctgggtgacagagtgagactctgtctcaaaaacaaaacaaaacaaacaaacaaaaaaacttactgccacaggctggaatgattcactgaataaacagtgaaataaacataaataaaataaataaatatatttttaaaaattttggtcttactttgaccccccaggctggagtgaagtggtataatcttggctcatttgcaatctcgacctccggggttcaagagatcctcctgcttcagcccccaaaatagttgggactacaggtgcccgccaccactccggctaatttttgtattttttgtacagctggggtttcaccacgttgcctaagctattttcgaactcctgggctcaagccatctgcccaccccggcctctgaaagtgctggggttatctgcgtgaatcaccgcacccggccaaacaagatatttaaatctataattaacgtttttaggttttatttattttttgagacggaatcttgttcttgttgcccaggctggagtgcaatggcaggatctcggctcattgtaacctccgcctcccgggttcaagcgattctcccgcctcagcctccaagtagccgggactacaagcgtgcgccaccatgcctagctaattttgtattgttagtagagacgggtttcaccagtcaggctggtctggagctcctgacctcaagtgatccacctgccttggcctcccaagttgctgggattacaggcttgagccaccacgccagccaaacaggatatttaaattaaagccaaaatggccggcgcggtggctcacgcctgtaatcccagcaccttgggaggctgaggcaggtggatcacctgaggtcaggagttcaagaccaacctggccaacatggcgaaacccggtctctactaaaaatacaaaatcagccgggcgtggtagcacatgcctgtaatcccagctactcaggacgctgaggcaggagaatcaattgaacccgggaggcggaggttgcggtgagccgagatcatgccattgcactccagcctgggcaacaagagtgaaactcggtctccaaaaaaaaaaaaaaaaaaagcaaaaattaatgtgtttagattttaagtccaactggagtttgtttattgtttccccacaagtaatcccagcactttggggaggctggggcaggaggatcgcttgagcccgggagatggaagatgcagtaagctatgatcgtaccactgtactccagcctgggcaacagattgagacactgtctaaaaaaaaaaaagtctaggactcagtgaatggctagactaaggcagaaatcttgcagggatttgtcttttgattctgcatggtttctaatctttatcaggagttaaacatccttctacaggataactgcatctagaggcaggactatatataagcaaaggaaaagttcttcgaagaggaaacacgaatcgctcgttttaggaagtcagtgccttgaaaagcgccttggggttgggggctcggggctgggggagggatagcattaggagaaatacctaatgtaaatgacgagttgatgggtgcagcaaaccaacatggcacaagtatacctatgtatcaaacttgcacgttgtgcacatgtactctagaacttaaggtataataaaaataaataaataagtaaaaatgccttcagcagcctgaagttctaagagctttccaagtttgggaaggtgtccgggttttctgcgattacttctctgagcatgaacggaagtcaccctttgtgccttatgcggtgattttaatgataggtgtcatatataggacggagtaatctgtttacattctgttcttctcgatgcactcacaagcgggtaactaggtgacaagaaaacaaagatcttattcaaaagaggtcttacagcaacccaacgtctcatcttcccatagtaaagatgacggcgccttgaggtaagctacaggcaacaccacttccgcgtttctcttgcgccctggtccaagatggcggatgaagccacgcgacgtgttgtgtctgagatcccggtgctgaagactaacgccggaccccgagatcgtgagttgtgggtgcagcgactgaaggaggaatatcagtcccttatccgggttagttgtgtttctacagtctaacgcgtagcataagggttgggagaaatcaggtgtcctcaataataggctccgtgtggaagccgcttccggtttttaagtttaacgcccaaattcatagaaatgggactattgtggggctcggggactaaggagggatggtggggagagggcaaaaaagactcgggtgaggtgcacagtggggccagaccttgcggctaaaagcagcagttattttagggatacgcttccccagaaggtgacgtgtctccctggctacaggtgtttgttcacctggatgtgaacaaaaatcctcagggcgccaactcccagtccgcatctctctgcccccttcttcactcttcactgttttgtttgtttgtttgacggagtctcgctctgttgctaggctggagtgcagtggcgcgatctcggctcactgcaacctccgactcccgggttcaagcgagtctcctgcctcagcctcctgagtagctgggactacaggcgcgcgccaccacacccagctaatttttgtattttcagtagagacggggtttcaccgtgttggccaggatggtctcgatcccctgacctcgtgatcctgatccacccgcctcggcctcccaaagtgctgagattacaggcgtgagccaccgcgcctggcctcactcttcactctttcaagccacattagggctgaaaattcaagtaggtgttaactacagagagttggggagtttagctcatagttagaaacgggctgtcttctcagttatctctactgtggaaggtgagaaaagtttgtcttccttgtagtttctgcctgcttcaaagaccagcagttctagttctcctacctcatgtattcattcactaaaaaaaaaaaattactgtgcatatagaacctagggaggagataccaagccgaataaggaggaacttactgaggtagacaaaaccagatcattataatacagtgtttaagtggagagagactgagacagatatggacagatataaagcgagaaatggctaggatgttttgagagcataagaggagacatccagtttgcattcggtcacggaaggtttcctggaagaggtaatgcttgagctgaaacttaaagagtaaacataagctagcctgataaaacataagagtagaaggacattcaagccaaaagggacagcatgagcaaaggcatagaatctagaaacggcacaggcaccagcatgatgtgtttgaagaaacaaagtagctcagagttgttagagcatcaaatgtgaggcagggaatggtagacaaagctaggagacatatttgagcacttgaattttctcttggaggctttgggataccgttaaaagttattaagctgaggaattacatggccgatttgggtttagatcagtcacattggcaataaggggaaaatacaattgacagggacaagactgaaggtaagagacaagttaggctgtcattaatctcagcgaaacaaaaggcaatctaaactaggcagttgtgaggatagagaggagaggtagatttgtagaatattcagaaggtaaaattagcataacatggattagtgtagtaagggatagggagggtcaaagatgattcccaggtttttgccttgggtgaatgctcatactgccacctgaaattgataattcaggaggataattcaggaagtgtatccaaaggaatataaaaaattccagatggaaatgctgagtttgaagtacctgtgaaatgaaggtcaaaacgtcaacatacagttggatactaaaggctgaagttctgaggaaagatctggaccaaagatgaaaatctgggagtcattagcctgtgggtgttagttgaaaccaggactatatgaggctagaagggagttacccagggaaggagtctatcattaaatgagttgtgggctgagggcagacactatcagagaagtgagaggagaatccagatggtatcttcaggtcttttgtgcttgctaaattgagtggagcccattctattctctgttctgggcagacccccacttaccagtatagccttgtcttcagctttgctaatgttagaaaaattaggtaaacatattaagaaaaagtaggctgggcgtggtggctcacgcctctaatcccagcactttgggaggccaaggtgggcggatcacgaggtcaggagatcgagaccatcctggctaatatggtgaaaccccatctctactaaaaaaaaaaaaaatacaaaaaattagccgggcatggtggcgggcacctgtagttccagctacttgagaggctgaggcaggagaatggcgtgaacccaggcaatggagcttgcagtgagccgagattgcgccactgcactccagtctgggtgacagagcgagactgtctcaaaaaaaaaaaaaaaaaaaaaccggctgggtgtagtggctcacgcctgtaatcctagcactttgggaggccaaggcaggttgatcacctggggtcaggagttcgagaccagcctggccaacatggcaaaaccccgtctctactaaaaatacaaaaattatccgggcatggtggtgcacgcctgtaatcccagctactcaggagactgaggaaggagaatcgcttgaacctgggaggtggaagttgcagtgaacccagattgcgccactgcactccagcctgtgcgacgggagcgagattccatctcaataaaaataaaaaataaaaaaaataaccacatacttttcttttgaggagagggggactgcccttggccccaactactctctcaaagacctcattctctgctttcagtatgtggagaacaacaagaatgctgacaacgattggttccgactggagtccaacaaggaaggaactcggtaggtagaccctcttgggaggtgtggggtgggagtcttatatgagttaggcaatttggtatcctagcgcccactaccaaagctgccctgtcacatgttagctgtctccactcccacagcgccagagttccccagttcccatcctatgagtctcccaggctggtggcctaagccaagatatcatttgagtactggaagaataggcaaattggactgaggtttggtctttgttacaggtggtttggaaaatgctggtatatccatgacctcctgaaatatgagtttgacatcgagtttgacgtgagtgtgatagagtgggaaatatgaaggttagtagaaggggagggattagatgatgggtaacaagctatcctttcttgaagggaccaaagaaaactttaaaaatgggagagaaaagctgaggtttgaggcaagcataagttatatttactcatctccacatccagaatcctggtatggatgtgctccttggggagttttacttaacatttcagtttaaccaagaaatatgtatgtctgattatattagttcctttctatcctgattctgttttattaaggttttataatttctccagattcctatcacatatcctactactgccccagaaattgcagttcctgagctggatggaaagacagcaaagatgtacaggtaggactgaataggagatggcaaagagtcaaagaaagccttaaggaagaacttcgtggcgggagggagagcatcaggaagaatagctaatggatgcttggcttgatgtctgggtgatgggatgatctatgtgtaaatcaccatggcacgtttacctatgtaacaaacctatacatcctgcatgtgtacctctgaacttaaaagatgtaaggaaaaaaaaaaaaaggaagaactttggaggcagagattttcccagggtctgctggcctagtggggtgccaggccctcctttgctgagcctaagcaaagtacttagctgaacttgttctcaattctgatcactagtagtcttcctatgcccccaagaggctgctgtgctttatggtaaactttgcatgtcaacaccttcttcatgtccctctcataggggtggcaaaatatgcctgacggatcatttcaaacctttgtgggccaggaatgtgcccaaatttggactagctcatctcatggctctgggggtaagttttgtgtatttggcataaaaggagaaagagggacttaggccctgagcagtacaagaaaagcagctaagaataaaaggaataacagtgatgtcccttaagcatgttcccccagaatctgtctccaggaaggagcttctaatggaacaagaagcattgactggtagtaatctcacaggattttccttgtattgcagctgggtccatggctggcagtggaaatccctgatctgattcagaagggcgtcatccaacacaaagagaaatgcaaccaatgaagaatcaagccactgaggcagggcagagggacctttgataggctacgatactattttcctgtgcatcacacttaactcatctaactgcttccccggacaccctccacctctagttgttactaagtagctgcagtaggcattgctggggaagaaacaaacacacaccaaacagtactgctacttagtttctaaggctgcacagggaagggaaagactgggctttggacaatctagaggtaatttatatccgcccccaggtggagcaacatgcgattctggaggcacgggggtaactgaaagtgagtacatatagtctttctggtttctggagataacccatcaataaaagctgcttcctctggtagcctgtggttctcattgggagctgttaacagagggcaagtgggctgaaacctgaggcacatgaacagctacgccgggttgggttgggaaagagtcggaaataggggatgctctggtcaggagtgggaatgaaatgttgactgttccccctgctgctcagatctacctttgtcctttagtggtgagccatgctttgccctaccgtgttagcctgcaagaagtggttttgccggaccagcacttcccgccctccagggatcttcccagccctctgtgaagtgctagatgcttctccactggtctgcgggctggacccaggcctgcagtttgccatacttgcgcccctgctgtttgggaaggatctgtgctgtaagcctcgcggccatactacgactgtcagatctccatccctatgggctataggatggggcgacggcaccctatacctcagggacttgctttggagtcatggattaaagacctctctgggcagcgttgagaaccagcgaccctaaacttggctgcgtttccatggtgtcgatcgcggagccgtgggggcgggctcacgcaagcgccaagggaccggtgggaggagttcgggtgtggatgcgcaggcgctttgagagacggtgaagccggtggccggtggccgggcgggaccaacaaagatggcggcggcccctgcggcgggagcgatctgggcaacggctgcggctaaagctgcagccgggcccacgggggggctgcacgggggtagtagggggtggccctgaactggggcctggccctggctggcctctcccgccgcctcactgggggacaggtacgggccggggcgttatggcatggcggggtgtgggggggcgcagagggaagactgctccagacccgagaggacactctccacaaaggcgcgtggggcccggcggggcctgggagaactgggctggagggacagcatccctggaccgcggggaatacgccgccggattccgtagccaatcagcggtctcggcctttctgccctcgaggggggcggacccggctaaagccctgctgtggtgggagaagtgcagagattaagggtcaaggagttgttcgtcctccatccccgactactgctttctgaacctcgacaccatgtcggaggtcggaggtgggggagggaatggatcgtaagtcacccatatagtctgcttcatttgcagcccagagaggcagggattcgaggatggagggctgtcttttgggctgttattcttgcatctacactaccatttggctagggtcttaagtgacccgaggcacatcctactttactagccgggtatggggtcccatgttacgttagagccgagataggagttatcactggcttttcagtaaagatgtgttctgcagggaggggtcgggagtatagaaagggtcaaagccatgggctgcttatctttcattcatttgtttacccaatagatactaagtatttactttgtaccaaacacgatgccaggtactggggatacgatggctgattcgatagatctggttcctgccctcagtgcgtatactgctccccactttcgttgatgtggtagtggtgatgactgagccaaccacctaatgtggaaatgagaggacagcaagattgtgggtatggaatggggcaaagcaataagggaaaattagtgtggcagggttcagtacagcagcctgggttcccatttccccccatattcaaatgctgacactctcttctcctcccaggtccagcctgtggtgtccacaatgccccaggcctctgagcaccgcctgggccgtacccgagagccacctgttaatatccagccccgagtgggatccaagctaccatttgcccccagggcccgcagcaaggagcgcagaaacccagcctctgggccaaaccccatgttacgacctctgcctccccggccaggtctgcctgatgaacggctcaagaaactggagctgggacggggacggacctcaggccctcgtcccagaggcccccttcgagcagatcatggggttcccctgcctggctcaccacccccaacagtggctttgcctctcccatctcggaccaacttagcccgttccaagtctgtgagcagtggggacttgcgtccaatggggattgccttgggagggcaccgtggcaccggagagcttggggctgcactgagccgcttggccctccggcctgagccacccactttgagacgtagcacttctctccgccgcctagggggctttcctggaccccctaccctgttcagcatacggacagagccccctgcttcccatggctccttccacatgatatccgcccggtcctctgagcctttctactctgatgacaagatggtgaggacttgccacacacatggccttcatgcccatgttcctctgtgctttcctgccatcctctgccttttctgtcccccatttccctgaagttcctttctcagcccttcattacagcagtttggacatgcctctcccttgcttaaatacccttgagcctcctagacccttttttgggttgttggtgactcttcagcatggtgtgccatttcggtccccaggggattaccccaactatttagaattcttctttgggtccccaggcccttcctttcccttgcttgcaccttctctactgggactctgcctaggcctaattaatctctggagctaaagagaggcaggcacagaacatcttagcaaacgtggttgcacattttctgagctaagtaagctaggctgattgcaattggagccagcaggagaagggcaagaaggggccacgggggcaggagggggttttgggggcagaaaggtgggagtggtgagcagctgggcaaccatgccggtgctgggggagttgccccaggagctgcaacgtcagctagctgagcagaggagtaagtgggcaacaggtgggacagccatggctgagtccgtggtacattcagctgtgatgggcttactgctcatgaccagtgaggtagggagactagaatacctagtgaggggaatagggtagagtttggggatgaaacatgcatgggatgggggaggcagtgggcagcatgctgttgaaaggttaaagtgccaggtaggatatataggaacttgccgattgtactctgaccttccaggctcatcacacactccttctgggctctggtcatgttggccttcgaaacctgggaaacacggtgagagctattctcctatctttcctctctaaaaggaatgtgaaatggtgctgggggtggggaaaacccacgagcttggggaaggcatgtggaaggagagctctgaagctcttctaaggcttcctgggcagtggtctggagagataacagcagtgtccctactgctccccagtgcttcctgaatgctgtgctgcagtgtctgagcagcactcgacctcttcgggacttctgtctgagaagggacttccggcaagaggtgcctggaggaggccgagcccaagagctcactgaaggtggggcaacaactcctgctccctctgttcaagtccctttttccccaaccacttgcaggtccatctgccactggtggtggcccccaacccttaaatctggcagttgtatctacttttcccagtgcctactttcctaaaggttattttctaccctctgagccaccttttgcttgcctcttccagacattaacctttgtttgccttccccactcccatcccaacagcctttgcagatgtgattggtgccctctggcaccctgactcctgcgaagctgtgaatcctactcgattccgagctgtcttccagaaatatgttccctccttctctggatacaggtgggagagctggaggctatgggatttctctctggccatgtctgggggtagggccaagcaagggccctggcagcattgttctgagccttgagatgttcttcatccaggaagtggggaccaatatctgggcagggaatagtgtctgtggactaggagaggagtcagttgcccatactctttgtctggctgtagccagcaggatgcccaagagttcctgaagctcctcatggagcggctacaccttgaaatcaaccgccgaggccgccgggctccaccgatacttgccaatggtccagttccctctccaccccgccgaggaggggctctgctagaagaacctgagttaaggtaagggtcgttccctctacctcctttccccgtagtttatcagcatcattcacacttcatagaactaaactagtaaagattgaagatgtagggtccagggaaaccctttagtatagaaaatagtatgagaagcaacatagaagtagaaggaaggaaggaagagggggagtctaagggagcagatggaggcagaagatcatgctagggatgtcaccaaattgaagaaggggataattcatttacaggtagaggaagacagcatattcttcccttatgtacattcctttcttttcctctcacctcggatttccctagaaagttcattgaggcattattcttttgacttttccttgaaatttagggaaggagcaggggtgtggatggggagtagggctctgtaggttgtttcagtgggtgttgggggtgcccagtgttcctgctgtctcatgggtgctccccacttcctttgatctgtggtagtgatgatgaccgagccaacctaatgtggaaacgttacctggagcgagaggacagcaagattgtgggtatggaatggggcaaagcaatgagggaaaattagtgtgtgaggggggtacaggcttggggggaaaaatcgatactatcaaggggtatgggaacaagactggatgatgcaaatgtgaagctgtgtgaagagttgattaggagtgttggtagtgggaaaggaagggtcaagcaaaggggcaggaagagatggaaatccaagaaatcatctcataacatccaacaatgaccttttctcctgtccctgtgcttctgtctagacctgtttgtgggccagttgaaaagttgtctcaagtgccaggcctgtgggtatcgctccacgaccttcgaggttttttgtgacctgtccctgcccatccccaaggtgggattccagaggattccggggtggacaggacaggggctctgtgacccaagcctacccacccccagagtgtgggcgggaaccctgtgggtttctggagcagaactgaagcctggattgattgagaagagttggaaaaggaaattcagaacatgttgacctttcttccccttttcccccagaaaggatttgctgggggcaaggtgtctctgcgggattgtttcaaccttttcactaaggaagaagagctagagtcggagaatgccccagtatgtggaggttcacaagggatacagtaagggtgggagacctggggggactccatgtggataaaagggattgcatgatgtcttcatatggggaataatatttatgtatctgggtttgtgttggagtctcagatctgttctagtactcctagagcaaaggggagaagccaagaggatccagctgtaatgaagagcatactaaatttgtatgtggatcggggtgtcagaaaagccaattgaggttaggagcatattaacctaacactgtttgccatttattcaggtgtgtgaccgatgtcggcagaaaactcgaagtaccaaaaagttgacagtacaaagattccctcgaatcctcgtgctccatatcctaatcttcagattcttacttctcttaggatacctcccatacattctctttcctccatgtttccagagaattgaattttccttaggaaaagtctgccacccacttttccacaagatgctcccagtgtgtcgggagtggggagaggacagctttcaggatagaagaagttcccctcagaggcccactgcctcccaaatgctccttaaccagggcttagatctgaatcgattttctgcctcccgaggctccatcaaaaaaagttcagtaggtgtagactttccactgcagcgactgagcctaggggactttgccagtgacaaagccggtgagtctggtggggaaagtcctaaggagccaaaggagtgggggcacagctctgattatagaacttgatcatctccaaccccgcaggaagtcctgtataccagctgtatgccctttgcaaccactcaggcagcgtccactatggccactacacagccctgtgccggtgccagactggttggcatgtctacaatgactctcggtgagaatagcctcctatttacatcctgccccattcccactcagccctgacaccctccccttctatgaagctccaggagagcagagtgccaggtgaaaggagaggtggaggtcttgcctgatcatttcctggatgctctgaggttcggtcttgtagggagaagggagtaaacaggaatgaccacaaccctttcccgatctccttttttcctagtgtctcccctgtcagtgaaaaccaggtggcatccagcgagggctacgtgctgttctaccaactgatgcaggagccaccccggtgcctgtgacacctctaagctctggcacctgtgaagccctttaaacacccttaagccccaggctccccgtttacctcagagacgtctatttttgtgtctttttaatcggggaggggggagggggtggttgtagctccattattttttttattaaaaaatacccttccacctggaggctcccttgtctcccagccccatgtacaaagctcaccaagcccctgcccatgtacagcccccagaccctctgcaatatcactttttgtgaataaatttattaagaaaaaatgatgtgcttatttgtatttttgcttagggggtgatagagaactgagccaaattggagtcttcttgggacccaagttccctctctaacaggtgggggcgctctcagagccgagggggaaggtttcggggatggtgctggacccggacctgtgtcccccagcagtgaaggttatgtactgggaggaaaagaggaaaggcatacttgagtgaggctgcgtgcaggctctggggcgactggtttggtcggcgatgggggagtgccactgttgacaaacactgggtacgttgccgggcggccctagctcccgtaggcccggtctgttgctaacatcaaggagctgtttatggagccgcctccccgtggactggccttaagtgtccctatctattctccctacgaccaaagctcctgcggccttccctctagggttgtcaccctagctggacctggtaagcttgtgctggggaacgctaactccagcattaagcgctcgccgcctcggtcctgaggagggcagtgacgggtacggccgctcactcccagctcggcgctaacacggttaacctccagctcttacagctgccgtcgctccgcctctgccagttcaatgttttattggtgaacgtgatccggggccttccaagtcccgccaatccagatgtaggagaggtagggttaggcgcgtgccgcgagaacagagtggacggagcgtaggagagaccgaaaaggctgggggtgggagtagcggatttgaagcacttgttggcctacagaggtgtggcaagcagagcacctcagaactcaggcgtactgcccgccgcccgagccctgcgagggccgatagcgagggtgtggcccttatctgcacccagcagagcgccggcggggtacggtcttaggacctcgatctccttctccctcattttctctcatccctacctattgtgggtgagtcctggcccctggacggggacctcgctgttccaccagcccatccgtgcacacttagtttcccctaaagcagtgagtggccgggatagaactcaaaaccggcggggcttctggagcgcaggttgtccccggtctgcctgtccatatcgccccctttcccccaggtttccgcatgggccggaccgtggtcgtgctgggcggaggcatcagcggcttggccgccagttaccacctgagccgggccccctgcccccctaaggtgagtgctccacttgtgccagagggagcttcatttaatgctcttcccatttccatcaaaagctagatggatcctggccctctgaatatgcctcttcccctcccctcctgacctctcgccggcggctacaggcggtgctgcagtgtctctccctcttgtcgccaggtggtcctagtggagagcagtgagcgtctgggaggctggattcgctccgttcgaggccctaatggtgctatctttgagcttggacctcggggaattaggccagcgggagccctaggggcccggaccttgctcctggtgagaggcttgtgggatgtctaggagaggttgtggagggggcttccattggggaatagagtttaggggaggaagtatgtttggtgggtcagatcttcccttagtttctcctcttctgagggcatgtggagagcaggtttctgagcttggcttggattcagaagtgctgcctgtccggggagaccacccagctgcccagaacaggttcctctacgtgggcggtgccctgcatgccctacccactggcctcaggtaacaccagcacctccgctccttttactgtgccctcatcctcatatgccttccatttctttcttcttttctttttttttttttttttttttttttttgagacggagtatcgctctcgcccaggatggagtgcaatggcgcgatcttggctcactgcaacttccgcctttcgggttcaagcgattctcctgcctcagcctcccgagtagctgggactacaggtgcctaccaccacgtctggctagtttttgtatttttagtagagatggggtttcaccatattggccaggctggtcttgaactcctgaccttgtgatccgcccgcctcggcctgccaaagtgctgggattacaggcgtgagccaccacgcccgacctgccttccatttcttcatctccctgtcagccttcccagcaaaaggaagccaaatgagtggaaatgaccccagcgcctggagctggggaggtatgtcaggagcttccccctcactatgcctttctccatgcagggggctactccgcccttcaccccccttctccaaacctctgttttgggctgggctgagggagctgaccaagccccggggcaaagagcctgatgagactgtgcacagttttgcccagcgccgccttggacctgaggtgacacttgcccagaggccccaaacctcttccctcctaaaccagctgcagagctccctgttcaaatctaccacctaggggctcttctgtatcatttggggatgccctcttctcttcataccccaccccctcataattcccaaaactcattattgggagtgaaggccttcatttccatccgtcacagtgggaatgtcccccaacccaaaccctatcccaccctcattccctaccaaataggggctgtggaaatcagtcagtgtagattattttttcgctccttagtcctagtctcacccttaaggtggcgtctctagccatggacagtctctgccgtggagtgtttgcaggcaacagccgtgagctcagcatcaggtcctgctttcccagtctcttccaagctgagcaaacccatcgttccatattactgggcctgctgctgggggcaggtgaggggggattgattcagagggtgaaaatattaagtactgccaaagtgagggagtggggacaaggggtgctattcaatgattctttttttcttttttgagacggagtcttgctctgctgcctaggctggagtgcagtggtgcaatctcagatcggctcgctgcaacctccgcctcccagattcaagcaattctcctgcctcagcctcttaagtagctgggattacaaacatgtgccaccactcccagctaatctttgtatttttttgtagagatgcagtttcactatgttggccaggctggtctcaaactcctgacctcaagtgatccacccgcctcggcctcctaaagtgctgggattacaggtgtgagccactgcatccagcctcaatgattcttctttgcttcctctgcagggcggaccccacagccagactcagcactcattcgccaggccttggctgagcgctggagccagtggtcacttcgtggaggtctagagatgttgcctcaggcccttgaaacccacctgactagtaggggggtcagtgttctcagaggccagccggtctgtgggctcagcctccaggcagaagggcgctggaaggtaggggaacccctggagtgtaatgaacctgtcagtgtttccatctttatccaagtggcttaactaggccagggccgataggactggagttcctcattgtttttgtgccttagaagctacttagacatgggctaccccagaatcctaggccctatttgtgaaccttcctcaaagagcctatgcaagtctgtggatagaagtagtacttataagtggcttagagataggggaaagaacccagcttcactgaacatttcagaacagccacactggcctgtctggtccacttcctggagtacacagaggaatgattttttgtgaagtctacatagtcacccaatctcttcatcctgggtcagtacacagtctccccggccacatgggtgcctgggaaactgagagtgaggcaccagaagtctcttttcactcatcaaattctcattttctgggtctctcaaatgttttcatgctctcaggtatctctaagggacagcagtctggaggctgaccacgttattagtgccattccagcttcaggtaatggaatagccaccttccccttccccaacccctaccagtgagaagcaaaagctataccttcctgggtcagcaggaccacaccatgcccctgaactggtcatctctatgggagtctaatcccaaagaggactgacaactgtaatgggaatgccttctgagtcaggcctctgcctgatctctagtgctcagtgagctgctccctgctgaggctgcccctctggctcgtgccctgagtgccatcactgcagtgtctgtagctgtggtgaatctgcagtaccaaggagcccatctgcctgtccaggtatgataaagggacggagaggctgggcatggtggctcacacctgtaatcccagcattttgggaggccgaggtgggcagataacaaggtcaggagttcgagaccagcctggccaacatggtgaaaccccatctctacgaaaaatacaaaaattagccaggtgtggtggcttgcacctgtaatctcagctactcgggaggctaaggcaggagaatcgcttgaacccaggaggtggaggttgcagtgagctgagatctcgccattacactccagcctgggtgacagagtgagactctgtcccccccacccccccaaaaaaatgggaaggagagacagcctcagctagagccctttccttctgacgcatgaatgtccttctctccagggatttggacatttggtgccatcttcagaagatccaggagtcctgggaatcgtgtatgactcagttgctttccctgagcaggacgggagcccccctggcctcagagtgactgtgaggaggaggaaactttgcctagtggcatttccagagggctcctctgtgctccattgtaggcaaggccagactgatcagtgctatattccctccttaggtgatgctgggaggttcctggttacagacactggaggctagtggctgtgtcttatctcaggagctgtttcaacagcgggcccaggaagcagctgctacacaattaggactgaaggagatgccgagccactgcttggtccatctacacaaggtaagttgggataaacttccctcagctctccactgaaggccttgaagacagagactggaacatttgtcactgtatgtcagccaaggcctaggacatcaataataaacttttccctgcatcctctcctctcttctcagaactgcattccccagtatacactaggtcactggcaaaaactaggtaagttgggaaaacagctgggctgaggagggccaaggacatcagacccccagctaaaacattcctttcatcctttccttccagagtcagctaggcaattcctgactgctcacaggttgcccctgactctggctggagcctcctatgagggagttgctgttaatgactgtatagagagtgggcgccaggcagcagtcagtgtcctgggcacagaacctaacagctgatccccaactctcattcatgaaaataaaaattgctggagcttggcttggtctggctgttctatcacctataggcataagaatgcggggcagcaaagaggcaaagtgtgcctgggatgcagaaagcaggagcagatgcgagacaaagtcctttattagaaaatatatcaaaatcccagccccctgagccaggaccagaagagggagctattccagcataggcagaaaatgcccagggaggggcttccttcaccaaacaacttcccgggaaccataaatagaataaatattcacagaggtccgaggagaagccagatcactcttctctccatggaagagggaggggcttggggtccagccctgctcctactctaggggcagggactcctaggaatcgtcacataaaatcatgacatcaaggattcacagtcataagccctacaggagaccctagagagagggacccctcaggtctacaggagcccagctccagtccagcagtgagggagaggcccctaccccctagcacggcaccagagttcagttccctcacatccctctgagaacagtgaggagctgagggtggggagaatacaaccccatgaattcggtttcatgattaaggtagacaggaaggaggagtcagtgtgaacctcggagggctgtgtggttggcagtagatagaggcccaggcctggctgggggccggcgttgcagcatctcttgacggaaggcttgggaggaaccaggtgggtaacgtggcccagaaggagcccgaggaccccgagggtcagtcccaatgtctgctgtgatgttggtataaagaggccccagctctcgagccagcaactggtatgtcagtgagttcatcccatcttgcgtccaggaattctgggtacggaccaggaggtcaaatctgagggttagaggttggagactaagacccagaaaggaacagccagaaatctagggacctttaggattttcctggctaggggtacagaaccctgaggatccagtaacaattcccaggcagtccttccttcttcctacctgtggggattttcctcattgcccttatctcctcggtgcttcaccatcttatagtgtcctacagatgtggggggccgagagatcttcatcccagccaggcgcaccctatgggaaaagtgagggtatcatgggggatccagagtagagaaaagcaaggaagggattaaatgtttctgtacacacaaaaaaacaactattacttagtaggcaaaagaaaaaaaaagcccaggacagaagtcaaacagaaagaaggaaatggctgaagagaatataaaagctggatgtatccaaatcctcagggcccagtgccagtcaccctagggcctttaaacagttggcaacctattcccttggcttcctaaagggctcctaggagctgcccttgcagtctaggaaggacgcagagagaggccattctgtcaaaagaataagagaagactgggagttgctgagaatcttagaatagtgactgagctaccccagcttctctcccacatcccccatgttaagaaaaaggtaggccaggtgcagtggctcacacctgcaatcctagcacttttggatgccaaggcagaaggatcacttgaggccaggagttcaagaccagcctgggaaaataatgggaccttgtctctagagaaaaagaaaaaaaaaaaaaacgaaagaaagaaaagaaaagggtagaaccaggtaatcaggaccttaaaagaaacaaactccacttctgacacacagaagcatggagtgcagatggcctgggaaggaactagaagaatacttatgtatatttacaattcactgggtatttcacacacatacagaggatgagaattcacagagatgtcatcacagaggacacagggggaatggaggcaattggtcctgcataccaagcccaaatattcataccacagacatgaaattgggtcagctgaggctgaaggtcagaatgtttcacatgctaaaaatgagttggccctgtgccaatggcacaggccttttacaaagcgattctgggaacatggagcagagcccctctctcctaaccccataggaagtggcctggctggaaccccagcagaaggcaagactaagctgtctctgggcccctttccagttctggaatccgacgatactatttcctattgatcttatgtcctctcccaagaacaaactaaccaggagactgaaggatgacacaatgggcagtagcatgcaagcctgacctgggtatcctaaaaagactaagggaaaggaatgggctcagtgcaggaccagggagctaaaggttagtgttgaagggctatggtcaaaggtggtcttagaggacagggatccagactggggtcaggagggaggaagtggcaggaagtctgacctggtagcaatgtcgtcatcctcaccaccccagccccagtattcattggggaagccattcatcttcaggtactggtcaggagtaagtgctgagactcctccgaagtactgggggtacgggaggctagggagagaaagatccttgcataccccgagtcttctggggacacatccccaaccacaatccgcttggctctcctccttccacaggatagtaggcttccctgtttcccagtacccttccatgccctctacctgtatccaaacttgttcatagcaacggcaacatggcggggtccccgggggtcacacacatacagattgtggtcattttctggcaagaggtccacatcgtgcaagaacaggcagtcccactcttcatcacgcagggcctctcgcaccccaacgttcaacagttttgccctgttaaatgttccatttccagcctggaagataatggaggggaaccagactatgtctgtaggtggcacggagaaaagggggctaaagaataaaagtgaaggccgggcgcggtggcttacgcctgtaatcccagtactttgggaggccaaggcaggcagatcacaaggtcaggagattgagaccaccctggctaacacggtaaaaccccatctctactaaaaatacaaaaaattagctgggcatggtggtacacgcctgtagtcccagctactcaggaggctgaggcaggagaatggcgtaaaacccgggaggtggagcttgcagtcagccgagatcgtgccactgcactccagcctgggggacagagtgagatctcaaaaaaaaaaaaaaagaaaaaaaagaataaaagtgaaaagagggaaatcaaagtggggtggagggcaaggagaatgaaaaagaaagactatctttttcatttttccacttagtcatttgacaaatcttgcttgtgtattggtatggacctgatacttaagatgctgctgtctaacatttaatcctgacaattggcaaccaacaatggtgtggtgtggaacagatggtatattagttatcttatgctctttcctcatgttagatgtttaagtatcttgctcagagtcatacatgtaacaagtgacggaactagaattttagccctattgtgtccaattccaactctgcacaagccattcaataaagaaaaaatcacaggagagtgtaggacagtgggaataacctaagcagattaaggaaaagtatgggactaacaaagttggaagagcagtgccgggtgcttctccacactctaacagtctggccttcttaaaattattctagggacccatttagatgaaagtgaagtggcatgtgcttgaggcttccttagaagaaagtcagtcaaaatgaggtggagattgggggtacctggtggatgacatagatgccataagcaagctgctggcgctgcaagaaggggtgcaggtggtagagcagcaggcgcaggtggtgctcccgggcacgatgaggcacaatgatggctgttcgggagcggggctcacaacctgcagggcggtaccggccccctggttctacccggggattccgctccacaatctctgccagtgatggcactgggctaaaggacaccgacacaggacccactgttgggaaggaatggcaagtagagggatcagaggggcaaagagaaaagaatcaaactagggtttgggaatacctctgacactggcagtctggttctggggcttagttctcagggctcactcagaaatctcgcatgccttggattacctatcactgggacagctctacaaaggctggaaggtgcaggatccttacctagccttctcttcttattttagggttgcctaactttctcctgtcttacagggttggaagctatagttgaaggctggagagacttgcaactaattaaaccagggctcatctacaaggaaaacaattcctagcctggggcaggaagagcccataaagggacaagcagtagaaagtggaaacccaatagtctaatctaaactcccaattcagagtctactctatctcaacctcagccctctatctcaacctcagcctacctgcagcctcagcctacctatcctcttctaagttccacttctgcc

SEQ ID NO: 1199 - DNA, 101225 bp, Homo sapiens
ttctgtgggttaagaagaaaaattttaaaaattaaaaaaaatccttgatacatctcaaagaaaagcaagaagaataaatataaaataagcaggacaaatatccaagaaagttaagatagtaccaaaaaaccaaatacattagtgattatattaaatgtaaataaaccaggcattccagttaagcctcgtgatgatcatgtagacaccgttatccacattttacaggtgtgaagaatttgagctgttgagtaatccgcccaagattgtccagctagcaagattcgaaccccgcagcctgctcctggaccctgagcacggtgcctttccaagcgtctccctgttctccagccacccagcactgctttcggtcagcccttccgcacactctacccagactcctgcaaccagctccgaaccggctctctcatgacacatcttgtcatggtgaccatgcgaaggtgcaaactggatctcctctcccctaaattaaaatctcttcctggattttcatttactacaggacaaatggagcagttcataaaaggtccccctagatgggatctcccgcccccttcatccaacgcttcttgccttcctgccctacattccaggaagactggactcagggtttccagagagtgcaagcagtttcccctgcctggaaagtgtgagttatggcccactgccccctcctctgaccccaggagggtcggcccctcctcctcatcactattgttatcattacaaatggctccattcagccagcgctttctctgtgccaggcactgtgctgaaggctttataggcatcattcccatctaactctcaccactctatgatgcaagtaccagtatcctccatcttctggatagaaagactcaggcagattactaattcagctagtatgtatttactaagtaactgctataagcttggcaccctcttagatgctgagaaaaagagcagtgaatagaacaggcaaacctccccgctctcatgtaagctcacccatcagctcacatatgacctatggtagttgtgataagtgatatgcagaaaataaaatagggagtacggacagcgtgtgaagcaggttgcagtgttctaaaaaggtagtaagggaaggcctcaataaggtgatatgtgagtaaagatgtggaggagatgagggaatgagccaggctggcatctcggagaagagcattctagggacgatgccttgagaaagagcagggaataagtggcaaacttgctgaaacgttatctgttggccaacctgacctcctgactggcaggtgagcccctccaagtgtggtcataaccccagcagctgggcacacagaagacattactaaatgaaggaacctggactccgattctgagtgaaacagtaaaggggcaccttcctcaccacaacttttgtggacttggaaccctgaggctggtgccattcatcctcagtccccagtgcacaatccccacacactgtccactccagactctcggagaggaaagacgtattacacccttttccctgtgtctctggaactggatctgtgcactgtgggcctctctggagtcctcctaaacaaagggaaggcacaggggtggtgtgctggaatgcaagatccctgagaccccaccgggggcagggaggcctgattccaactaggcactgcagtctcatttgcaccatcttctcacgtttcacaagaaaaatggagctgttaagacatccaaagagcaagtcaaactgatatcaaatccctgaaagctctaagaaacgagtgcaaggccattgggttatatggcatgcaaaaatgcaccaccaagggagaggacagccctgtcctctgtgtatagcaggtgttggcagagggtgaaaaacgtagctaagaccagaccaaaccaagaccgaattccagaggggtttgcagaaggtagacccaacccacccagcaaggtgaaatctaccagatgaccctcgtggagaagcctgagaaaggaacagggtcgcagagaggaaacctgaagcatccatctgggagaacccaggaaggagtgaagagcaatggaaagtgaatgtattagtaaatcgaagtgattaaccgttcaacgttatgttagatgatgtacacagaattagaacatatgacacagaacccagctgggagaaaggggatactggggtgggggaggacctcaagctacatcccacggagtcagagtggcctagaatcacccacggggcagtttaacacacaggaacatgcagctctgggcaaggggtgttatcacacctttgctttcttcaggaagatttacagggacccgaaaagtattcagagagacgttgaccattcaagtattgaaagataatcttccaaatcctaaggagacaggcaaaatgatccttaaatatctgcataactattaaatctacatattttatgacatgtgaacactttgtggcataatgaagcctcttgaataatcagcgtactacatggttaaactctctaacagaacctaagcgaaatcttaccatttcaaattagagagcttcagaagtgctgtacctagcacggcatgtggttcacacttgtcaggaacatcaactccccccaccccaaccctaaaccataatgctgtgctttagggaaacaagatctgtcctgatctgtactcaacactttccgggaacaaatgatggctggtggcactcccctaaacagaaacccctgttcactgataccgtattccccaactcatactgaataaacatttccacactcagaggctaaccacctgcaggctggacttctaaaatgcataagagatctttagtgcccccacgtggccataggtgatgtgacatcctcagtagggagttctgtcctgaagggtgggaaagacagctggaaaaatgttgtttgtatcaaaaatattaaatatctagggtatgagacagcgcaggaagaatggccccttttatactgctatttcttcccatcataaaagtttggtaagagggggaaaataatgcgaaatgttgaaaatctgttggattgaaccagaatgtgagtttttgtccagttccatggcccaggacaaactgtctctaatccgtcatggaggaaatgggaagaaccatccctgattgtgaaaattatacaagcatggatgtgattttttgttttaaacttttacacagaaaacatatgtatacatctttctgtaacttgtgttttaaacactgcaattttaaggcattttgtaaagactgatgcagtacaattattattatagtcaacaccaaaaagatatcagttggcaagggggagaaaggagaaatgtggcttgaagaggacatcttgtaataaatttattgtattttgttacattttccacttttctcttaattccaactgtatactatataatcaacgctgtttcagaaataaaacgtttcaaacgtaaaaatataaattctgcttcttaaaagtgcatacactttgaataataaaacatacaaataaataacagaaatcagtgacacatctcatgcacttgttctaaaataaatttaaaatgtacgatacacttttcttccagcctctaggaaagacatcctgccttccatattactgtacaactgaaaatgaaaacgacacagaaatcactatccacggtgcatgagtaataccaaagcactttgtgtacagtgatgtgacatgcagctttcaagacaactacagaaattccagtgtaaaaactgaagagttcaatcaagaaacgacttatgtcaatgaggcttaaattcaattttaaccagtggtgagaggcacagttggtgagcagacctctatggaatgcaaacacgtatttgaaaggcctacaaagagaactccaacttcggaaatactgtaactgcttttgcatttggtatgacaccacaccgtttataatagcacctaggaaatttcatattgcatttggacgactgcaacagatatcattattctggatggcctttctaaagaaacatttccaacttgcatgtctacttgtatcttcattccttaaaatgttgaaaacaccaggtaaattgtggtgttttgtaggcagcatgaggctcgacagaatgaaaccatcagattacttcgaaggtgttgtagtgcattcagctcaccacagattaaaactaaattttatttgcctccacagttaacacagagtgccaaattctgggatgtgtattacttaatggtaaaacaaacaaaaaacaaaacaaaacaaaaacacgaaaaaatagcaataagggttttttttttttaaaaaaaagacaccaaagaaaatgtttcacattcattttcaaactaaaaaaaagaattcctgaaaccacattctggataagaactatcctagagaatgagcaaaagtaggaaattcagcggcagcctggggtttgctactgtaattcctacaaaaaggcaataattctatcaaaagcagggacaggctttccaaggctaggaaggttgtttcttttcttcttcgacaatttctagctcagagtgacttccctattcccccacgggcctggggaaaaggttctggggacagatgcaaaccccgcggggacactcagcctgctccagcaactaagaccaccaatttccaccagactggcgagtgctaggccattcacaacatggtccaagctccccaactgggccttgaatcagaagggcccttgtatttcaaatgggagtttgatatcagtatctctcaattctttttattcttattttttctgcttctcctacacaactgaggaatcagtcactcctgagtaattcaaatggcagtgattctcgccataattctcagtaaagggatgacgtatcatagtggttctcaatctgtctgcaaattagaaacacccagaagcttttaaaatacatggtaattcctggatcccacccctacatgaattagatcaaaagctagggactgggacccaggcactgtattttttaaagttccccagctgattctagttaatgtgggtcttcactatctcagacaagtcattcagaagaggcttaaaagaatcttgaggaaaatacatgtgtgagattcaaaaaagtctctcaaatttgctgtgcaccccttctcccaaaaattgggaaacactaaacaaatgtaagatggatctagaaccgaatccactgcacaacactcccagaaattccatgggcttagtctaattgtgatcagtggctgggaagccccaaagcttttcaaaatagctctaagtctctataaaagcatcttttaattcttagcactattagaagccacattctttccttgtgaccaaaatagaacccttgaagatataaaaaattaaaatctatagaaaatggcaggttatttttagaacaaaacactttaggaaagtcttcaggctaaatacagtatgtacaccaatgatgtgtgttcaacatatccaattccacttctgcttgcaaaatactttacaatctcgccaatgatcagaaaaacagcagagaaatatatgcagagcaaaacaagaaatcgcattcatgctcttctacacaatgatgagtaagccatattttgaaaatcacaaatttaaaaatagagctccataattgttgccttttttttttaagacttaacatttcatgtctatatgttttattgtttgcttgcataggtagtaagagcatgctttctgagttatatggaggccacgcacaattgtttttacttggggaaaaaaatggtcatgctcaaaatgcatctgcaaaatactttgaaagttgatcaaaaggcagtgtgagagtgttcatttaaataaaaccactggatttctccccaaaccatgtagtagagtttaacaataatgtaccctttatgaaatgaaagttaaagacagcctgcacagtaacagctactttttgtgttcgtttgtgataggtactggtttgtcagcaaagtttgcctttctcaactacaaataatacaaagttccacgcacctccagaatacgtgttttattgaaactgtgcttatgacttgcatactatttcaaaaatccaacccagaaacactagttaaatctttgtatccaataattataataacctacattggaaacaatcacttcggctgttcagtaatttgtccgaatgaaatgtaacgtctgatgcccctctatgtgaaataaagcacgcttatttcaaataaatgagctttgttcacagctcttctctgctccattttccctaaaggctgccactcttggtccctttacatactgttgctatttttttcatgatagttattttaagggaatgacaatgttcccctcaaatcccacatccgtctcatacaaacataagatgacccaatgttaacgtaaagtgactgtgtaatggattttcaacccctaaatagtagagacagctcagtctgaaaaggtggatggaagagtaaaatgtctctaaagatgaagggcacttttggtttccagaaggaacagacttgctcaagagaaccacaagccttagccgatttgaccggaatccacgtgatctcttttcccaggagaactgtcactccatttaggacaccatcacatcccttgcttgatgggctgtgctcccagggctcctcagctacagcaaatccctgaagctttcagttttgcctctgtgctcaaagaaggccctccataaacgtttgcagaatgaatgatgaaaacaagattgcaaaagcgtgtcaggcagcctcacagataattacagtattttagcacaccacaaatactcccacatccgttcccactggtccagcatattattacttactttcagttcagctgctttcaggacgagaaaatacaaaacggatgggaaatggtctaagatgactggagcctaacggtttgagtttccacattatctaagggattaccaaggcaagatgtagggctgtcttaaggaatgatacggcctcagtgcaatggatgtttacaagaaatcaagaataaaactttaaaaagcaaacaaacattacagatacaacattactgttggtgattattttgtgcctaccaggagatgactgctctaatcaggcccatctagatgtcaacgagaaacccaggcctatcatccctagcagataatttttaaccccaaagcacatacacgctcattgtgctaaatattgctgggaaaattaaaaaaaaaaaaaaaaagaaaagaaagaaagaaaccaacaccaagtccccaaccctaccaatgaactaaattgaatcaagtaactactttcccacaagatacttcccacctcaaggagcacctccaaactttcgggccaaataacctttcctgtggcctaaagttgtacctagtagttggagataatgaaattttcactgtttaccaactatggaaataaaatagcttcatgatgtctagacaatgccatgatacttcctgattttttctattaaacctgaaacaaggactaaactccatgacatacagtttatagacactgacattttattccagatcccatggaaaaccaaagggatttgtagaaacgtttttcctttttttttttaagtcactagacatcgtggaaaatccattcctagataactcaagaataaaaatatttaccactgtgaaaattaaactagtttctattaatgcttgactacagcaaaaaagaagtgttattaaaaacctttgtctaatcaaactataattgtttcagagattcagataggagacttcaaatgagatctacctattaaacaaaaatgagaggtttgagttagacattcaattcctgatatagatgatctcttatttggtgcatctttttcaggagataaaagcgatacagaaaaacgagagcggtggctacacactgatggggctgtgatgtgctgggctgaacgcaatgacagcatcgaaggcagccagttgccgcagatgtactgagcagatgagagtggtactgctttgagaacccaccaaaatctgaacagtaaaaccaggacagcgagtgaagaagtgagtacagggctgagtgcaatggacaacaggctcacagtcaatgaatcacatggagcactgtggtaactttcacaaggctaaatgtctaaatcttaaatactgccaagggtctaaaattccagctaccctcaacagtaagtggtctccagacttgcaagttaccggctaatgcgcaaattagcagcaaaataaagttaagtaacgtactaaaaacttttcccaagagatattcttggggggaaaaaagaaaaaaaaagtagtgcagaattcacagctatgcatgcatatgtgttgtagttaattcacacacagcaatactgaaaagggaggttatatatggatctgtgcaccaagggttcaagaagaacttgaagagtctgacgaaaaacgctaatatttaaaagcacataaacttagcatgctgtatttactggcaaagtgacaaatgctattcagagagaatcaagaccttcactctcttgacatttaaaaaaaaaagaaaagctaaaaattgagcaggaaagtattgccaggagaccttgaaaaagcttgcaaaactatatactttgcttatctgtgaggttttttttggtgaggttctcctttgtaagaaatgcaatttgcactgacacggccagatggaacacactccaaaacctgcttgtgagttctgggcatgagatgaaatcttaagaacaaagaagaaataataaatgagttactgaaaggcagccctaacagagactgacagacaggatctgaagtgcatatgtaacacttgatcacacaacgcttcaacataccaccattggcttttggcagaaggcaacttctttcctctccaagctacaagatgagggaacatgagcccacagacacagggcatcgtggagcttcccacctctaacggaaaaatgcaacacctgacaaggaaaatgatgtccagtctttcacccagtttagaatctagaagttttttccaggaatctgtcaaaggtgttaactgctctactacagtgcaaaattccaagagccttagctagtaatttcagaaggaaaaaaaattaaacgagtgactggctttctggctatccaatctgccacttcctaggacctatcccaagagtcaagacaggttttggtgcacatgtcaccacagataggaaggtggtgaaaggcttcatttctacctcgaaaatgtctatctgtggcagtaggagaaatgacacagtcacccacatggcaccttcctctttaatccatttactggtgtgcaaccatcctagactagctgagtatatacctgagaaacattagtgttaaaatattgccctttacaaagactggtagatggggcgaaagtgcagaaagcaagagtttttccctcgatttgtttcgttgttagagtcacagtttttagagctcctggtgccacccacaatccacagtaaggacaagtcctgctcagaagaaacacgagtcagctccttcctccttctacgcactaatggtagcttttctggttcacaggtttcaaaaccctcatatccaaagaaagtcattagagttctctagaaagaaatatgtacaattgctaaagggaccgtcctgggtatcgtctacaattattccagttagcttggtgtcaatgttttgcctatggctgttatttggttcaatggcagaataaggcgacgctttgaacaatttgcaattgaattagacacacacacgcatacactcacacacacacacacagtcgggcacgtgactcaaaaaagtacaaaacaaaagcacaggaggctttggtgggagggcaggggttctaaataaataaacatctttacagataaaacactttgattgcagaaatatcactgaggtttttgagaaggccgtgcagaggtttgcatgctagaagataacttttttgaggatttctctgcagactgcctgccacccggagacgagggaactccagagtctagttgggaagacttggatttgcgagcggacagcagggaatgtttggcagaagcagggtccttggtgacaagctgctcttttcccgttgtatttgcatttggctgctgggaagctggaggctggtggcctctctctgcctcgtcgtccccggtgttcttacagacagacttaacagagctcccaccagcctttttagagagcaaggctgtcttgccaagatccgtcgagcgccgggtttccttctgtctcaaggctgatttgaagaaggacagccccttgtcctcagacttgctgtccctcttcaaaccagacttgatgcttgtgctgggggagcgcaggctggccatggaggagctccgcacgtgcttcccggcccccctgccctcccctgctcgggcctggctcacccgaggggaattgggtttggaggtggaggtggcgctggctctgtcagaacccaagctttgtctggagccctctctactcaagctgtggtctgaagtcctgctcttcccaggtgggaaagggctccttgtggcagggcccgaggcctttttggcagatgtggaggaagcagtgtaggtgagggccgaggctgacttctgcttctgtggcgaaggagatgacacggagtcctgagatttcggggatgactcctttttgggttgggcaggggcaggggatgaatgccgtccactgcccctggaagaagaatctgctttgctgcgggagcgggagggctttagagagacttttacaggaagaggagaagaaggggatgtacttgaaagggatgactcctggcttgccaaggctggtctccccttccgcaagcttttctctggctcagaagtgcctttggaactgggggatctcttagttgtgctctctggtttctttgcgagtgagcctgggtggctgggggctttcacctctttgactggagagctgtctacggagtcgctctgatccacataagcgatctgattattgttatcaaatggaccagagagcgggggcaggcggtccccttgtgctgaatgtttgctctgtgtatctacgacactggagttcaatctgcgggtgtccgattcgtctttgaacacgccttccatgacagccagaggggcccggcccacagccttgtgctcacggcgactatgactgtcgcttggttcctggtaactgctagaaaggttccgcaagctaccaaagcaagagatggagaccttgtcatctgctgcctccccaatcttctccaaggtggaagcagagctgtgaattggcgaatcccctgaaaatcgggatggagaattggagcgcatctgcagcttagcagacagggaccatgaaggtctcatgcaattttcattgacggccaaggggctggtgacagaagatctggatgacaaactctgacgctggacacttctcacaaatggtcgagttgaaaagcctcctgaacacagtaaagagaatactgttaagttaagccaatgaagacattctaacaacactgtaagacactgaaggtgaaacgaaggtaagcctcatgggatgaaaggagcatgaccttcagagccagcccatctgggatcaaggagtccctgtgtggctttgacttttctgagcccagtttccttatgtataaaatagggacattctaactcaggatcattctaacacagcaaacttctattcgcctccttgccctacatcagggctcggtataacttttcctgtgaaggcctagacagcagatgttaggctttgcaggccaaacattcaactctgtcactgctgcatgaaagcagccacaggtgacacgtaagaaaacgtgtctgactgcgttccaaaaatgtttacaaagaaaggcagtgggctgtatttggcctatggggctacagtttgctgacctctggtctaactcacagggcaagtgtgacgattaaatacaaccttacaagtcctgtgcccaacagagcacctggcattccatagatgctgtgaggtattgacccagcttcattaccttcctgaaggtgatctggggctcacagaaatgaagtccttgaccaagattacacaactcattaaaggaagagctaataccagaacccagaaccccttcccgcaccactcaattccacatgtaagctggcctgtcattgttgactacagatgtggatcaacgcaaagagctaaaaagacttggatatcatatactcctaaatccagtaacttaaaacttccaaaaaaatattcataatcagaggccaggcgtggtggctcatgcctgtaatcccagcactttgggaggctgaggtgggcagatcacgatgtcaggagatcgagaccattctggctaacatggtgaaaccccgtctctactaaaaatacaaaaaaattagccaggtgtggtggcaggtgcctgtagtcccagctgctggggaggctgaggcaggagaatggcgtgaacctggtaggcggagcttgcagtgagccgagatcgcgccactacactccagccgggagacagagacagactccgtttaaaaaaaaaaaaaaatactcataatcagaaccacatactcctatttggtgtggctcaaaacgtcctaagaaaatattctaaattaaattttctacacaatgatactacagttgtgatatttacaaaattctgtctttatagagcctaagaaacaggctctattctgtgggcaccacccagcaccattatacaatgatgatgcttaaaaggatactgatttcaccaactgcactgcttaaaaatagactgaggcaaaccttattgaggcttatcgttaaaatgacagtgaattctaagtttaaaggcagtactgaaaataacctctgcctaaacaagcaaaggttcaccagtcagttttccataagatgtgaggagccggaaggagcttaggaattgcagtccaatgtttttattttacaaataaagaggaagaggcaacaagccagaagaggtggcagagctagagctatggtgcagctctcttcacctggcattcttcttccagcctattgcaattttaactcaatttcattttctcagaattatccatcaccactagaagcagattacagtgatcgaaatgctggctgcagactgagacttgttggcagattgagtcactatgctcattatagaagctgcactcactccttccagctcccagtactgtggctgcccggtccttcccacaccacctgggtccctgtcgaaactaaggtctatcctgccattacccaagcagaaagtgaaagtttaaaaagaaaaaaaaaaaaaaagagttcaatttttatcggactttttactatctctatgcaaaggcaacaacagcttttgttttagatgcttctgtactaaaaagaacattccacagcttcctccctggggagcagcatgttggaaggtgaggctctcctggggccaagagagccaggggcctccatgccaagcctggagccgactccccaccacgtggcctgggcaaagcacaatctctctgagcctcttccagctatcctgctttttaaaacactttgggaaaaaaaaaaaaaagtatacattggtatataaagctccagcctccacaagagaccttacaagtggaaaataatgaagtggaaggagaaagtactgggacacaggaaaagcaaatgactctgttaatacaaaatgctttttaggatcataactcacagctacacagctccactccctgtagctccctttgggttctcctaccatctccttgggacttagctcctaggaaaaacacgagggactctgctgtgtctgtgagttaccattctggaaatttgtcaccaaaacccacacccaccatcatcttcactcctttctccagtcatctccacggactcagagagcgacgccagggaggtgcgtctggaggaagctgcagaggtcacgctggctggcttgctgcccgggagccggctcacccagtgttcacacagggaagaacttgtggagcctgcagagaagaaaacaggcatagaggtcaggctggggtccctcggccagccctgagccacacacaccctcatgaaggtgttacgagctgagctggggggcgttgatgtcctcaccccgaggtcagcatcaattcccagaccctgtgtcatgtcgtgcctgtccgaatatccccagttaagatgaaaagatgtaaggcagacttcctgacgcatgaaatttgtagtaataaaatgcaaggatagggatgaatactttataatgtaagtctgagtctaaagaattggcaagagaatggaatagacaagcactcatacattcattctacaaatatttatgaagcatctacatgccaggcactgttctaagcaattgcagtaatatttcttacacaaagagaagagaggatgcggcagtatactctttttctctcagcctgttttaaggaaatttgtcaccattttcataatattaataatacacacacacagctatatgtcaatctgccctgtctgttccagggacgcccttaaatatttattagggcaagagaaattgctcttgaaacagagtacatgaagcagcatgactgtctcaagtagacctcaagaaggtgtcatttctgagcacatctgagactggtggaagagcactggagttcccgctgtgttaactgagtgagtggctgtacactgggtgggcttggcccccagcagggcgtcattctgcttgagagatgccttgttttcactgctttgaactcaccccctgcaagcttcaagagaagcaaggattcatagcccctaacctgattgcacatcaccacattccaatcctctgtcacgctctcttgaagtcaaactctgcattcagaaacgtgtgtccacttgtttggattatgtgtggctgcattcatattgtgtgtgggtactggtccctgcatttattaaacacaacaggctggatgtcatccggctaaacccaagccacctaatattatcacagccatcaatccttctcctaacagaatagtccaatcttctcactggaaaagcagactatttctaatggtcctttaccctttacaaaatgttttaacacacatttatctaactggatgcttacgatgaccccatgaggtaggcattattattacacctgtattatagatgattgctatgtggcccagatgggacaggctccaggataaccccaggacagcgggtagtatgccacgctgcttttcagctcacccatgcatttatccacaagaacacatcatgagctttctttgcgccaggtccaacccactgtccccagtgaactccactgggccacaggtgctgtcacattcctccccaacttccttgactgcagtcattttagtttccagattaaatggaaacgtaaggattcatctgatcaaactgacagagtcatgagagcctccagagaggtcctctagaccattcattacaatcttttgctctggaaaaaactgcccaagaacaagagtggacctcacctgccaccgagctgttggctgaccatgacgggatggctgtccgcctctggtagaagaggatgtatgctgtctgcgtgcagacctcatcttctgacagctgctgcacatcgctgtcatcgaagcagtaccagaggccgtccacagagttcttacagtacgctgccaaagagagcccgccatcagcaccaggggaggctgcaccagccacttcatgcgacccacagacaccatctctttggctcatctaattaactcaagaacgttttaaggctgcgtatagcaacacagaaagagattaaaaaaaaattctaaattctgtatcacactcgagcaaaatatcttgagaaattccaaaccattccaagtagatgcagttccagttcatcttagaaaacacatacttatttaaaccaatgggtctcaaccagggaactgtgtctgtggcggggggagtgggatttggcaatgaatggagatgtttttgattgtcacaactcaagggagaggtgctactggcatctagtgggtagaggccacggatgctgctaaacattctataatgcacaggacagccccctgcaagacaaaactgtccgaccaaaatggtgccagggtgaagaaaccctgagttcagtgtgttgcaacattttagtgtctattagaaatagcaaataatatgaatagaaataacaatataatgatatgatagcagataaatataatatgtaacacttattatgtgccaagcatctcatttaatcctcagatttgttctcttattactcccaatttccagaggttgaaaaagattaatctgcttgcccaaggtcgtgcagctggtgaaaggcaggagcccagctcatttcaggcttatcaagtccttggcttgcacttgaagccctatcctgccctgcttccctcagggaggagcacaaaccaggctccatggaagttccctggcagactgagaacacatgagctcatgaacgcaggaggacttctttcagtccaaattctaagcctgagctagaaataaagaacattcaagtagcagcaaaaacagacgaaaacttaagagttcacaaacccagtcatcctgcaaggatatatcaaagggtgttataagcttgatccagaaaagtacattatgatcacattttctaaaaatatgcatttatttggggtgagaataaacgagtgctagaatatttagctgaatgctggaacagactcaggatggccccagggatggggcagataaggtcctgagaggcaccaggagtgactccttcaatgggccataaccatttccgcaagtatggagacttaagggataaaagagacgcgggtgagaaagggctacaccagacaagtcccccaaaatgagagcagaataaggacctatgaacggaggcagggaagttatttgcagctgagaacttgccggaaccagaagggaaagaacttaaaatgtaagcagcaaatggagctctaaggaaacagcaattggccagtggcgtcaggtcaggcttgatgcacacatgacccagctggggagtagctgctcttctggagtggtgagtgggagcagagctgtgagggacatgcccaagagaaggagacagaacagccttgcctcctttcagcctgctcctcttcagaatggcctcttctcagtcacagtgtggaaactgagacagcacagcaaactcattaattacaaaataattctacttgcttttcttcctagaactactttctgaagtattctctaggccagtgctactagaattatggctcacggactgacacgagcccacacgagagaagcaccaaaaaggagaaaagcatttaaaaaacttttatagcaatctgatactgccgtgatatttttattgtattcttacaaatgcactagttgataaaggattggaaattttaaagtagaaaaaaccaagttcttcatcacagatggtgtgagaggcactgttctagaatccttacacaatcgattatatcattataccatcgattatagctagaaacagtgcaaaataaagattacatcaaaataaacattccaggccggccatggtggcttatgcctacaatcccaacactttgtgaggctgaggcagaggactgcttgagatatggagttcgagaccagtctggacaacatagtataggccctgactctacaaaaaaatttaaaaattaggcaagtgtggtggcgcacacctgtagtcccagctacttgggaagctgaggtaggaggatcttgagcccgggaggctggggctgcagtgagccacgatcacacactgcactccagcctgggtgacaaagtgagaccctgtctcaaaacataaaataaacattccaaatgaaaacttaaaaatggggatgaggggtgagagagcatcaggaagaatagcttaatgcatgctgggcttaatacctaggtgatgggatgatctgtgcggcaaaccatcatggcacatgtttacctaagtaaccaacctgcacatcctgaacacgtacacctgaacttaaaagttgatgttaaaaaaaaaaaaaaaagaaaaaacttaaaaacagagtatctttcattcaacaatgcgaagaatatttaaaatgttctctaaactaagactctaaacatctcatatactagaaaagtggtggtagggtctcagcatgagaaaggggaaataatacagaaaacatctgagcacatcctgggtaatgggttccttgaggtcagcatgacctcttcctggctcactaacatggtagccaaattagtgaacagctacctgccccaggacacagagctagaaagatgtgtctggcttctaacccaagctccttccaccaaactgtactgcctctaaggtagttggaggtttccaggcattttccaagatctattctatatataaagagcaacacgatgctaaagtctagccctgtcttattcttcccaacaatttcttcccagaaactatgtaacaagccagtccatattttcttgagaaatagtgttataaatggaaaacacattctttaccaaagctgagctggtgaacgccaatcaaggatgctggcaaaggtgttacaacaccgggtgagttgtgaagttaaatgacctccacatccctttccattctaccagtccacaagtatagaattccatcactcagtaccaaagaacacagacatgactggtaatgccacaaaagcaaaaatccaacaagacacaatatttgtatacatggcccccataaaatagaaacctaaaatatgtaagataccaaatatactattatcatcattgaaatatggtttaaaccaaagtacaaggcaaaatatatctaaacatttaattcacattaacttttgtcttctatgaagtgagagcatctttcaaacttctctagcttctttctctccttgaaagcgcttcctacagcaggcagaggcaatccaagccattccatcacaagatgcgctcaaagttgggatcattcctctcacaaacaattgctgcctgcagcatttaaatatttaaagaacttcaggcagtaaaatgagtttgaaaaaaagaaaaatatctatttaaagaacttgaactaaaagggtttcaagaataaaagattattgtgtccagtaatcttccccaaccccggccctcctggaagggaacagagcagactgaaacagtgagtatgaaaggtagcaaggccaacggactcctctgccttggctgatggggagggaggttcacggctaaatactagagaaaagagtcccagagatttaatagtacccaggattggccagaccccacccctcctccatctctccctacctttataaatcaatggtcagcactagcactcggggtcttgttgcagaaaccactgaattaataaagaaagtccctgagaagtatacatatataacacactgagtgtgaaggatgcagaaatccaaatcctagacactcacacggataatcaaattaatcacatcaaccctcacatcaacgaataaagccctgaaatctgcctggctcccaaaaggctcaagcaggcccttagcccaatgattccatttccaagactcaatctcaaggaaatacagaattaaaattcaaaaaaagtgaaagagcataaagatattcaacaatgttacacgaaaagttaaaaaccagaaacaatatagatgttcagcaatggggaagggttagataacattagagatctatcaacagaacattctgtggtcattaaaaagtatttataggccgggcgcagtggctcatgcctgtaatcccagcactttgggaggccaaggagggcagatcaccaggtcaggagatcgagaccatcctggccaacatggtgaaaccccgtctctattaaaaatacaaaaattagctgggtgtggtggtgtgtgcctgtagtcccagctactcgggaggctgaggcaggagaattgcttgaacccgggaggcggaggttacagtgagcctagatcacgccaccacactccagcctggtgagagagcgagactccgtcgcaaaaaaaaaaaaaaaaaaaaagtatttataaaaaattaagtgtccacatcaagctacttctgttacaatactaggcgtgaagatgaggatgcagaaggcatgcgccactcacccctcactgtgctgctgtgcttctgaatttgtgacctgtctatccaccccactctagcccatgaggtgaggcggcaggctcctttccccgacagctgaccctccccctccagcacgctctggccactctctcctctggctctgatctctgcccactgctcacacctccaccacagaacccatgatgtgggactcctttttaaaccatatctgtacccacatctccctctacttgattacactctcagaagacagaggctggggacctactgatctctgctgtgatagagcccagggcaagcaggatgtgaggggctcaataaatgttcacttgaacaacaacaacaaaatgccagtaaaatcccaacagtggaaaataatggcaaaaacttaagagaaaaacacgtcaagtatatactacataccaaaatattacctacatacagtggaacattactcagccctaaagaggcaggaaattctgatacctgccacaacatggatgaaccttacagacattatgctacatgaaataaccagtcacaaaagaacaaatattgaatgattccatttaaaagaggtaccaagagtagtcaaattcacagagacagaaagtatggtgcttgtcatggctgaagggagagaaaatgggaattagtgtttattaggtacagagtttaagtctgggaagattaaaaaacttgtagagatggatagtgataatggttgcacaacaatgtgagtgtacttaatgtcactgaactgtacacttaaaaatggttaaaatggtacattttcttatgtatattttatcgcaattaaaaaaaatgttaccagtggttatctcagtgataagcccatggatgatggtattctttccacctctagactctaaatttcatgatgaacatagttgcttttataaatgacaaggtcaatttaaccttaaaacaaaaagaaaaacccttctaagtcactttaaagacactataaaagtgtcatgcacttgtatcccagctactctggagaataaggcaggagacttgcttgagcccagaagttcaaggctgtagtgtgtgataatcacatctgtgaatagctactgtactccagcctgggcaacacagcaacagctcatctttaattaaaaaaaaaaaaagtagttcacaatcatttaaaatgagagagaagatagaactcaaggaactctatctagcaaaaccgtaaatggggagcgcaggttaggtaaacaaagagcaaatcctcagttgaccagacaatgccatctgcacataccactccccaatcagtcagctacctactggacgacccaactcaggaaaaggaggaagaatgttcgtttatttgctcttgggcagagatccagaggatggaaactgccctcacagttggcacactgcctaccggaggggaaatgaggctctaaagtcaagtcaccctgccacaagcaaacccgtctgaaggactcgccagcacagacacgcagcctctcacactgcagacctgtgtagtgccccccttgcatggtgccatggtgattgcacacagcatacaggtcatagatgtagtcctcagggtccctcccgagtccatagggccgtctccacggggaccaatgcgatggcaaactccagctgctctggctcctcttaaccacgtgaggtgtcatgtccaggccagtcaaggggaatttgaccatgttctgaagtttcatgcgcctgtctccttcctgttgcaagaagaaaaacaagttctggtgatattttaatgcaagcagatggcagatcactttagaggggaatgtggatcctatcagacaaagcggtgtgagttacctatctgatgtttcccaagacatacaaatcagggaaacagatgatagttttagctatctagaggaacaggttttaatatcagctaaggtggaaccagtaaggatccatatagagggggtaaatgagcctctctgagtcttcctttccttatctgttaaagggctttaaagcatttgacttaaaaaaaaatgacagtatcaggtggctcttcctgatacctctgtcaaagagacatgaaaactaatgatgtgatggctccatgaagggcaaaccacagcgcctggtgcagaagagcctcttgataagcagtgcctgttcccctccacatcctccaacaggcacatcacaaggcaacactgtcttagcttaatatatccactcagtggcaatctttagtaatctgtattttccattaaacctatagggaaatgctttgaaatccaaccatcagttgaagagataatgactgaatgtttcctgtgtctatgggaactttaaaaaattaaccaggcatagatatgtccaccctaaggagctacgtataggtctgtgaagggaagaaaaatgttcatgagagaaagggatgatgggtcctgggtggtcaggaaggccagcctgaagaatctggagtgtatcctctgtggcttttatggaaaaggtgatgtcaccagagttgtgggtcaagaactgtgtaagcagtgcacagaacatgttagaaataggagtaatggaggtgaaaaatcaattaaaatcattgcaacagtgaccagctgaaaagcaacaaaatgtctgaaccagcacgctgtctgacagcaagaatggggaggggacacacaggagtcgatgaagaggcatggccatgcctagatgagagggacaagaaagaagagtcaaagaggacactgcaggtttgcctctggattgctggaagggtggtgacatgccttcaaaagaaaacagaaagcccaggaaattactctgtgtctggggaaggagaaacagcaggctgggatccaaaccctcagccagctttccacctgcagatcccaacggaatacacagtgggtgccaaatgcccactcttcactcccataggagctgaacctcaaacctctgtgtgaaagccccagacctggggaccatctgtgtgttgcccctgatacctccgcctcctcagacagtcctcaacatctctccgtctctactgccacaacctatcccatctactagcagcccaccctggatgaaggcaagggcctccttcaggtctccccatcttcattcttgtagcctctaatctgttatctacacaatatccagaataatattttcaaaatacagatttagtaaggttgcttctctgcttataacccttcatcggaatcctactccgcccccaaagggttccttggacaaccagcatccacccacgtcttccatcaactcccgccactgcccacccctctggactgcctgcccacctggcctgctcccagcctctcgtgcaggctgtgctttctccactgtcgggctttgcacacactgctctctctgcccccgtgtgggagatccctgcttccacctcacctagtaaaagcttgctcatctttcagatacaaactaagagccaggccttgtggagtccgctaatgtttacttcccatttacctcttacaatgagactgtctagacaatcctaacctcagggaatagacagcctttttggaaaaactgactcacaaagcaatacaattcaaagcagattttctttgtatttatttatgactcatctccccaaccatacaacagcttctcaggagcagaacacccatattacattaggtagaaacagaattctacctcccccagaaaggatctctacttagttctttttaaatcccagagtacacttaacaaaatttaggcacgacatttacaagtcaagtaaaatatctgcaatctgaactaaaatcaaattttgccttgggaaagaacaaaacattaccctaaacacaggggcaaaagtgtgtctataacatacacagacaggactcactggatcaaacaggtataccaaagaaccctcacagagcccatcagcagggggcataagaaacttgtcacaacttgtttgttcctgaggataaaggatttccatacctgccgaaatctctttagatgtataataagcacatcaggcagagtccagaggcttaacgtaatgcttccctgctgcagctgcttacagtgtgggcaacgccaggcatcatcgggggcaagctgaaaacagaagcatgactcccgttaagtgccacttaatgcaagactgtgttacagctggactaatgccttagccagggcatggtgcaactcaaaatctctctgtaaaccgcagatgctgggcatcaatggaataacacaatcaaaagtagccagagctggcacccaaactctaaacagattctggtttgttgaatagattatccctcaaagaggaacgactaaatcggtaaatactgtataaatgttaaatatgttactttctttctctctctttttttttttttttttgaaacagagtgtcactctatcacccaggctggagtacagtggtgtgatctcggctcactgcaacctccacccatcaggctcaagtgattctcccacctcagcctcttcagtagctgggaccacaggcatgcatcaccacacccagctaatttttgtatttttggtagagacggggttttgccatgctgcccaggtgctcttgaactcgtgaactcaggcgatccgtccacctcagcctcccaaagtgctgggattacaagcgtgagccactgcgcccggccagatgtcactttctatgtgccatgcactgctctggatactggaattatttagtgatcaagacagatggagtacctgctctcatggagcatatactgtctcaattctgtccctcacttcctgtcctccagccatactggcttcatttctgtttgacagtcttgccaaagggcttttgcttcctcctccaggaactttgcttcctttatttacttgttccactagactacaaacagcatgaaggcaaaaatgttgtttatgttggcccctgctacttcttcagtaccagtacgatacctaacatggtatgtactcaaaaaacacctactgaatgaatgagcccctgttaaaaggtatcctgctaccattctagatcagtgagatgtgttgtggaataccagtgctgccatctagtagatttgctcatccattatctttgtgccattatcaaacatctccaaagtcattaaaaaaaaaaaaaaaaagctaaacagggcaaggtgtcatagagaacctacagtcaaccaattccaaagccaactatttcataattgagtgcaaacctggcggggggggggggggggaaggggtgaaaaaaaaaacccatgtcttatgaaaaactattattaaagaaactagctaaaaacagtgtgggggagagaagactcgctggaaatacaaaagctattttcaaatattcgaacaacagacaaaaataatattaggacttctgagtcataatgaatttaagacagagaacaactgttggctatagtaaccagtggacatatttcaggttaacttcagtcaccatcagagccatccagagaaaacatggtctatctctgtcttaacgaggcaaactacctcataacaaaagatactcaaactcaggctaagcaatcacctatttgaaattaagcagaagaagaacccaaccaccagaataaaagagttttaaagtccccttcaatcctgaaattgcatgactccatttaagagtgaagagttacaactagtagtcaaaattatgatcctagatatcaatgcaaggttagatgactccaagtactctagtcaatgtttataaggtgcataaaaatcacacaggcctgggccccacccaaagaggcttatttatccatctctctgtccatccattcatttaaatacttactgggtccctactacctgcgaagccttgctgtctactttctggtctatatctacgctgttcaatatgggacccactagccaccatgtgtctgctgagcacttgaaacatgactaatgcaacgaaggaactgaattatttacttcacttaattttaattaattttttaaatttaattaatttaaatttaaataggtcctggcacttatgttcttagtaccaaaaagtcaagaatcactgtttaagttactaaggaaaagatcttaaaacttctaaattgagaaagaaaatcaccaaaacttgatcattaaccattaaaaagaactatgaaggttcatttccagagtacttcaattaatcacggttttctagaaacttacaacttcttgttaaagtcctaaaagcaagagcattaagatgctcattacatgtgcagacttacatatatgcaaaatcctgcggcgacttctggggcgtgatttgtttctccactatcaccttgccatgccccactccccactgccctgagcaaccaagaaatgctgcccagtctcttacccgctcctctttggtgtacagttggaaacactgggataaagtgcaggtttgaggctgatgatgacgctccctttgcagacgaacactttctgcatcaggaatatactcatcctcagtatttacaaataagctgcaattagggggaaaagcatctatcagggaatgtcttgcaaaacagaaggaaaaatacaattatggcttcatgaagtgactacaaactcataaccgaaggaaaaaaaaaatcaatgtgtaagaaaacaaaagtagtgacccaacttttctatattccaaaatgttcttgaaaagttctctgtatacaaagttatttccagaactaacttgatttttctgggtttggccatgaactgtactggttaaaccacatattcctgtcctttacatctaagaacatgcatctgacattgctttctagaattaatgggcctgtaataaaaatcaaagtaaattgaacctatatagtagctaatgagtatacagcttctctttcagcagtgaacaaatgttctaaggttctgggattgggaagagagaatgtataggaaaggaataataaactgcttaaataaagggttaacaacacacctggatacttagctaaagagaagagagatttgtgtttcagctcatttaacatatcaaaggtgtgctataaaaatgataattaaaacaatgtttctataaacactaactttaaaaatactcacaaatctcttgtctccttgtcccactcgactactaatttcacatgagcagtgccacctggtccacaagattttaatgccctatagaaccagggaagtggagagggaagccacatattattttctaaacaaatgattttacttaatgtgattatgtcctacccaaaatcataatttcaggtgattaatgaaaatcttcatcatagttccccatcagaaaaaagttttcagcaagaccactataaccactgatttaataactacatttcaactaaactgaaaaacccttaaattaaaaagcccaatacagtactaataataaagaggttggaagaaatttagtgtcataaggttgatgatcactctcagatagtcattatgaccttcccaatttcttgcccaatttttcacccacccaaacagacactggacggtagtcccctgggaacaaagtcgccccttgcacctttccacctctccaccaacatgccatgcctgctctagactgcacccttcttcctccttcctccaaagctacccccgtcccaagttcactggctccttgccatctcctgagaaacccagaactcagttaatattacctatctcatcttgtttgttatgcaatattttggattgttgtctactaactctcatctctaaacccaaacagtaagctttcaagcaggaccatattgtatgcttttttagaatcctgaaatataggcactacaatatttgttgaaaaaatcattataataatttttattataaaaaatttgagttttcacatgtatattatatattcatagatacatagtgtgtatatatgtatattattttattaatacaatagagtattataacagatttagacagcacagaggtagcagagtagagtgactaattctatggggcaggttgctgggggtgggaggaggaagagtataaaaaagggcttaaaggaaaggaattacggacggaggaaaccacacatgcaaagcacgcatataaaatagtatcgcctgttcaaacaatcatctgtactttaatgctgctgaaaggttgggatagtggggagaggaagagcaaagcctgacaaaagtaagcggaattcaaactgtgaagaacttcttacattgtggaacacgggctttattttttaggccacaagttgccatataagggttttaaggaagaatgtggcctgattagaacgttactttacaaaacttcattcctggtgaatatgaaagtgtaatttatctacagtcctaggacatacgttaatttgctttcctaacccaagtcctccagggcttttcttatttcaagaaagatcatcaaacatatacccaagcacaaatcaaaagtaaaataagtacttaatttcgaaataagcctaaagaaccctgcacacttatgtggaaattatataagacatcacttgaaatcacacatgaatatgtgtgagattctaaaaggtaatttaaaaaaaaattttttttacctttctactattgggtggcacaagggctgctcctcctggggcagcaaatatgttattccaacaacactgaccacacgcaagctgaatggacacacctgcatcagatgttagatgagaattaagccaaatttttcttcaagggcatctgtttcacagtggcatttccaaaacagattagagttacagtaaactgtttattctgcaaaatgcttcactataagattctataaggttgttgagccactctaatacactttaaatattatttacccaaatgcgatttacgtatcaaatatgttatgcaagacaagtaacacattgcctttactaaacatcagcttaatggtcttccacggataccttaacatagtaataatttttaacatatacagatagacattctactaaatcctttccaagctgatcatgtattgaacgttattagataaatattataaaggaatatgcagcagttcaaggaaaaccttgcagtggctagctctttcataaaatgagggataaattctcagtcctggaaatctaaacacaagaaactcaaatttcattgtaatgtttgtttcttcactgagtatatacccatgctatgctggaatatcaaaatgcttacaaacctgaatgcaaaccgtgggcctcaagaaatacttcatcttctccaagatttccttctgcagaaggtcccaagctattgtcttctctaagtgcagcacaaaaggcagtccaaatctaacacacatcaacaatgtaatcacctttaaagtacggtaattcctttaacactgttatctttttttctcgatctcttaaaacggaatcacaatataattggctttaggacagttctcaaaataaaagaaacaggaaatttaatggtaactcttcataaggagatgaacagcttggatttctaaatgaaatttaatagccaatacaccaaaatggcttctaggggagtatggtgctaggacagcaggtggcaacggggcaggatcagtgaagatggagagcacagggggtgggagtggacatgagcctggcaaacagcacaggtcgaactcataagaggttgggtgccagaggactagatagggctggaaggtctcacagacaggcagccacattcttgagtctctgacaacaagggaggcactggcaagcaagtgacagtgaaagtcagctccagagctatgtcccacagagtccaagcagtactgtggttcttggcctcagctgcacagaccgaagaccaaaatcacaagaggagctttagaaaataatgatgcccaagtccagcccccggagagattctgatgaaatcagtctggaatatgatctgagcactgagatgtttttagggcctctctgggtggttctaatatgcagccaatgttgaggaccactatcctagcctcaactctcatccacgcccagtcagtcaaacctgaattccctgaatgtgtcctactctcacacatccatgtctttttgtcagggaactccctctgcttaaaataccctccccacccttctgagtctaggctgtctcctactcactcatgtgaagacccagtggaggtattcttttccaggaggcaccctgttggcttgttccctgtgtatactgtgctataaacaatgcctgcttatttttctgcctccaccaataggctgtgagttatttgatagcaagcactgtgatttatttatcttagtagcgcaaacagacaatgtctagaaaatagatgaatgaatgaatgaacaaatgatctaacagattaactctgactcaggcccagagggaagtagaggtgctaagatcaccaagaaaccagtttccaacaactatcaaactgttcgctcacagtggtgcttaacagtgaaccaatctgcctaaaaactactgtgaggtgaaatgagttacaagtacatgtaaatcacccaaccatatttttttaaaataatgacttcactctttaagagactagcatcatgaagggaattccacaggttctttacttcattccttctgtgcctgacacacaccaagctcctcctagtcttgtgtgcatgtaccgggtgttccctctgcatgggatcctttccccccatgttcacacagcacactggggctcagcttggctgcggtctcttcagggacgtcttccctgacctcccttcctaatgttgtcttgccagcctcccaccatcacactctatcattctagtctgttttaatgccttcgacgtggtacggactgtctgaagttaaagacgtctgcttgttcatagtcggtctgtcctagctaggatggaagctccatgaggacacagaccttgcctgtcttgttccctgctgaatccccagtgtttagaaccatgcccaacacactgtaaacactaaaatacctgtcaatgaatagcataaatatgcatatcaacacattttacatttatgttatttactatgcagggaacttatttcaaagcaaaattttcaaaggctaacataaaggctattctaacaaatgttaagaaacactgagtcctttctccttgaaacatatctgtctcttgttaatactcaggttacattcctactgtgacagagttactttaaaagatagtctaaaacacccatacactcttacagagggcattagacaaatttgagagagatttctgactcccaaatttctgacttagaaacctgaatgaatgtgtggtgccatttgccaagatgggaaatactggagagccagttttaaaaggaaagaaaatttggacatacttcaattcaacttgggacataagacataagttcaatttgggacagaagactgagggacatgcaccatccaagtagacatgttaacaattaaaaaaataaaaataaaaaagctgtcaggaaagtagctggaaatgggtctagagccccaagaggagcctgaactgaaaatacacatatgaaatgggacttttaaaactagactcctggccagatgcagtggctcacgcctataatcccagcactttgggaggccaaggcgggcggatcgtctgaggtcaggagtttgagacctgcctgaccaacatggtgaaacctcatttctactaaaaatataaaaaatccgctgggtgtggtggctggcgcctataatcccagctactcggaaggctgagccaagagaatcgcttgaacctgggaggcagaggttgcagtgaaccgagatcgcgcaactacactccagcctgggcaacacagcgagactccatatcaaaaaacaaacaaacaaacaaacaacaacaacaacaacaaaaaaccccagattcctaattttactctcccccgaccaaccccccaaatcaggtcaacttgtacatgtattctttctaaatatcagaatcaaaaattaactactaaaagtaagaactttttgcccatgctttttaacatgtttgaaaatactgaactgttacagtctaggtacttactggaaaataatctggttctcaccttttcccttgttgcccagtgcaggctcggttacacaccaacaggacaatcttgtcgctgcctgctcttgatgtgggagaatccattttcccctgctttgctgctgtttgtgtaggagaagacagtctatgataatccaagccaaatttcaagtggtttaggttgttgtttaaatgaattcctgaaacagaataaaaacaactcattttatctcttcaaaattatttttattcactcgttatgaagaaatttacccaacagagaaaattttttttaaaaatgtcattatgtaaattaaactgcaatcaaaaaaagaaacatcctacttagattactcatctagccgttagagaatttctttagcatccattattatttcctttaaactagccttacctatcttaaaaactgaaaattaaaactgcacttcagtgaaggttagatacagttttagaagggcatgtgtgctgagatgattcaccaagaaaatttagtgaggtcatgcaaccagtaatcaaacaaatttttaaaaaataaagatgtggaatgttcttcaatattcaatagcagtttcttctccctgattaaagagccagacttataagaaataaaaggtaaattacacactacacctactagactcagagccatcaggagaatcttccaacttggaatacagtctactagactggatcaatccacattaaagttaacaaaaatatatatttgacaggcacagtactgatcctcccaaatgccccaaagcagagctccctgtcaatcaaagtacccagcaactcagcacccagcacaaccccaataaatgcctgactacctgttcattcctttaatcctttggaagcacagcctagggaaatgacatcccagctggaaaatagaagaaacccctcctgccaccaccattaataataataccaccagaaagagaataaaatacaaatggcctacacaaaagtatttatagcagaatgctggcaataacctcaatactcagcaatctaagactcactgaacctattaagatacctcaacattataacaatttaaaatgacaaagtacatagttaatgccaatataaattccagatagagtttaaaaaaacaacacatacaaactagaaataagaaaaaagctgaatctttgtcaagccactagagggaagaaaactttttaagcttaaacaccataaagaaatcacaaaaggaacaggagtagatcttacttcctaaccattttaaactctggtatgagaaaataaaaataatagatatctgaagttgagacaataaactcgtttcccaggttcttggcagaggtaagggtgggaagatctgttctcctagaatagatgtggactcctgacgagataaggggatgccacattgtcaactgcacagaaatcaagctctgtgttcaaactgtggacccatttactgccagctgtgtgagctgggagtggttacttcatctccaagtctcagcttcctcaccagtaatgtggggaaagcagtagcctcattatatattgaataaaacatctgttaaggccttaggatagaggctaacgcagactcaataaggcagtctctggctagaatacaataacctttggattcaccaaattcacttataaatagaagcttagtgttaaccctaagcaactggggtgggaacaggattttgagaaactttcagttgaacaaacattacctgggctcttgctgcatattaagaactatattgcactgctgggtataacaagataaagcaaaatgtggccccagctccagagaacttcacagtgtggtgggaaggacagagaagaaaacaaatcatttccacataacacgctggtgtgagagattaacagaagttaactgcccagaagagcaggagttcgccagccagcctgcaggtaaagggagtgaggaaaggctctctggacaagataatttaggtattttttactgtaatgcaataaaactagaaacaatccaaacaaaaacacatacagggaaacgtaacaactggaaaagaaacacaaacaagcacctgggtcaaagaagaataagtgaaataatagactatctagaaaatattgtaaatatgagtagaccagagaaaactgaattgtaagctggcattggagaaagctggccaacccaatatacaggatcaccgaaagaatcagaaactggaggtgccagaggcctctggaagtagagggtaaagtaaaagaggaattaaaataaggactttcaacaagagcaccaagaccattcaatgaggacagtacaatctcttcatcaaatggtgctgggacaagtaaatatttacttgtcccagaatggagtttggtccctacctcatacaatttataaaggttaacttaaaatgtatcaacaacctaaatgtaagagctaaaactacaaaactcagaagaaaacacaagagtaaatctttatgaccttggatgtggtgacggattcttagatatgacgacaaaattatgagcaacaaaagaaaaaacagacttcatcaaaatgaagaacttttgtacgtcaaagaacactatcaagaaagagaaaaaacccagagaatggaataaaatacttgcaagtcatatatcccataagggtctagtattatacatccttacaaagaattcttacaactcaacaaaaacaactcaacaaaaagataatgcaatttaaaatgggaaaaaggcttgaatagacatttctccaaagagaatatataaatggccaaacaagcacatggcaagatgttcatcatcatttactattagagaaatgcaagtcaaaacctcaatgaagtaacacttcacattcaccaggatggctaaaatcaaaaagatgaaaaataaatgttggcaaagatgtggagaaattagaactctcatctattgctggtggaaacgtaaaatgatccagctcctgtggaaaacagtttggcaattcccaagaagacaaccatagaattatgatatgatccatcaattccattcctaggtacatacccaaaagaactgaaaacaggtattcaaacaaatacttgtacacaaatgctcatagtaggactattcataatagacaaaaggtaggaaaaaaacaaatgcccatcaatagattagtggataaacaaaatgtggtacatgcatatgtatgtatggaatactgttcggccattaaaaaggaatgaagtggatccgttccaagatggccgaacaggaacagctctggtctgcagctcccagcatgatcgatgcagaagatgggtgatttctgcgtttccaactgaggtacctggttcatctcattgggacggttggacagtgggtactgcccacggagggtgagctgaagcagagtggggtgtcgcctcacccgggaagctcaaggggtcgggggatttccctttcctagccaagggaagctgtgacagactgtacctggaaaaacaggacacttctgcccaaatactgtgcttttcccaaggtctcagcaaccggcagacaaggagattctctcccatgcctggctcggtgggtcccatgcccacggagtcttgctcactgctagcgcagcagtctgagaacaaactgcgaggtggcagcctggctgggggaggggcatccaccattgctgaggcttgagtaggtaaacaaagcagccaggaagctcaaactgggcagagcccctcacagctcagcaaggcctgctgcctctatagactccacctctgtgggcagggcatagctgaacaaaaggcagcagacagcttctgcagacttaaaggtccttgtctgacagctttgaagagagcagtggttctcccagcatggcatttgagctctgagaatggacagactgcctcctcaagtgggtccctgactcccatgtagcctaactgggagacacctcccagtaggaaccgacagacacctcatacaggcgggtgcctgtctgggacgaagcttccagagaaaggatcaggcagcaatatttgctgttctgcagcctctactggtgatacccaggcaaacagggtctggagtggacctccagcaaactccaacagacctgtagctgagggacctgatcattagaaggaaaactaacaaaaagaaaggaatagcaccaacatcaacaaaaatgacatctacaccaaaaccccatctgtaggttaccaacatcaaagatcaaaggtagataaaaccacaaagatggggagaaaccagagcagaaaggctgaaaattctaaaaaccagagcacctcttctcctccaaggatcgcagttcctcgccagcaatggaacaaagctggatggagaatgactttgatgagttgacagaagtaggcttcagaaggttggttctctgagctaaaggagcatgttcaaacccatcgcaaggaagctaaaaaccttgaaaaaaaggttagacaaatggctaactagaataaacagtgaagagaagagcttaaatgacctgatggagctgcagaccatggcatgaggactttgtgatgcacgcacaagcttcaatagccaattcgatcaagtggaagaaagggtatcagtgactgaagctcaaattaatgaaataaagcaagaacacaaggttagagaaaaaagagtaaaaagaaatgaacaaagcttccaaaaaatatggggctacgtgaaaagaccaaatctatgtttgattgctgtacctgaaagtgatgggaagaatggaaccaagctggaaaacactcttcaaggatattaaccaggagaacttccccaacctagcaaggcaggccaacattcaaattcaggaaatatagagaacaccacaaagatactcctcgagaagaacaaccccaagacacataattgtcagattcaccaaggttgaaatgaaggaaaaaatgttaagggcagccagagtgaaaggtcaggttacccacaaagggaagcccatcagactaacagcagatcgctctgcagaaaccctacaagccagaagagaatggggccaatattcaatattcttaaagaaaagaattttcaacccaaaatttatatccagccaaactaagcttcataagtgaaggagaaataaaatcctttacagacaagcaaatgctgagagattttgtcaccaccaggcctgccttacaagagctcctgaaggaagcactaaacatggaaaggaacaaccggtaccagccattgcaaaaacatgccaaattgtaaagaccatcaatgctaggaaaaaactgcatcaattaacgggcagaataaccaaataacatcataataacaggatcaaattcacacataacaatattaaccttaaatgtaaatgggctaaatgccccaattaaaagacagactggcaaactggatagagtcaagacccatcagtgtgctgtattcaggagacccatctcatgtgcagagacacaagtaggctcaaaataaaaggatggaggaagatctaccaagcaaatgaaaagcaaaaaaaaagcaggggttgcaatcctagtctctcataaaacagaatttaaaccaacaaagatcaaaagagaaaaagaaggccattacataatggtatagggatcaaattcaataagaagagctaactatcctacatatatatgcacccaatacaggagcacccagattcataaagcaagtccttagagacctacaaagagacttagactcccacacaataatgggagactttaacatcccactgtcaacattagacagatcaacaagacaaaaggttaacaaggatatccaggacttgaactcagctctgcaccaagcagacctaatagacatctacagaactctccaccccaaatcaacagaatatacattcttctcagcaccacatcgcacttattctaaaattgaccacataaatggaagtaaagcactcctcagcaactgtaaaagaacagaaaccacaacaaacttgtctctcagaccacagtgcaatcaaattagaactcaggattaagaaactcactcaaaactgtacaactacatggaaactgaagaacctgctcctgaatgactactgggtaaataacaaaatgaaagcagaaataaagatgttctttgaaaccaatgagaacaaagacaacgtaccagaatctctgggacacatttaaagcagtgtgtagaaggaaatttatagcaccaaatgcccacaggaaaaagcaggaaagatttaaaatcaacaccttaacatcacaattaaaagaactagagaagcaagagcaaacacattcaaaagctagcagaaggcaagaaataactaagatcagaggagaactgaaagagatagagacacaaaaaacccttcaaaaaaataaatgaatctaggagctggttttttgaaaagatcaacaaaattgatagaccgctagcaagactaataaagaaaaaaagagagaagaatcaaatagacacaataaaaatgataaaggggatatcaccactgatcccacagaaatacaaactaccatcagagaatactataaacacctctacacaaataaactagaaaatctagaagaaatggataaattcctgaacacatacaccctcccaagactaaaccaggcagaagctgaatctctgaatagaccaataacaggctctgaaattgaggcaataataaagcctaccaaccaaaaagagtccaggaccagacggattcacagccaaattctaggagctggtaccattccttctgaaactattccaatcaacagaaaaagagggaatcctccctaactcattttatgaggccagcatcatcctgataccaaagcctggcagagacacaacaaataaaagaattttagaccagtatctctgatgaacatcgatgcaaaaatcctcaataaaatactggcaaaccaaatccagcagcacatcaaaaagcttatccactatgatcaagttggcttcatccctgggatgcaaggctggttcaacatatgcaaatcaataaatgtaatccatcacataaacagaaccaatgacaaaaaccatatgattatctcaatagatgcagaaaaggccttcaacaaaattcaacagcccttcatgctaaaaactcagtaaactaggcattgatggaacgtgtatcaaaataataagagctatttatgacaaactcacagccaatatcatactgaatgggcaaaaactggaagcattccctttgaaaactggcacaagacaaggatgccctctctcaccactcctattcaacatagtgttggaagttctggccagggcaatcaggcaagagaaagaaataaagggtattcaattaggaaaagaggaagtcaaattgtccctgtttgcagatgacatgattgtatatctagaaaaccccatcgtctcagcccaaaatctccttaaactgataagcaacttcagcaaagtctcaggatacaaaatcaatgtgcaaaaatcacaagcattcctatacaccaataacagacaaacagagagccaaatcatgagtgaactcccattcacaattgcttcaaagagaataaaatacctaggaatccaacttacaagggatgcaaaggacgtcttcaaggagaactacaaaccactgctcaatgaaataaaagaggacacaaacaaatggaagaacattccatgctcatggataggaagaatcaatatcgtgaaaatggccatactgcccagggtaatttacagtttcaatgccattcccatcaagctaccaatgactttcttcacagaattggaaaaaactacttcaaagttcatatggaaccaaaaaagcccgcatcaccaagacaatcctaagcaaaaagaacaaagctggaggcatcacgctacctaacttcaaactatactacaaggctacagtaaccaaaacagcatggtactggtaccaacacagagatatagaccaatggaacagaacagaggcctcagaagtaacaccacacatctacaaccatctgatctttgacaaacctgacaaaaacaagaaatggggaaaggattccctgtttaataaatggtgctgggaaaactggctagccatatgtagaaagctgaaactggatctcttccttacaccttatacaaaaattaatccaaggtggattaaagacttaaatcttagacctagaaccataaaaaccctagaagaaaacctaggcagtatctttagggacataggcatgagcaagggcttcatgactaaaacaccaaaagcaaaggcaacaaaagccaaaacagacaaatgggatctaattaaactaaagagcttctgcacggcaaaagaaactaccatcagagtgaacaggcaacctacagaatgggagaaaatttttgcaatctatccatctgacaaagggctaatatccagaatctataaagaactcaaacgaatttacaagaaaaaaacaaccccatcaaaaagtgggcaaagggtatgaacagacacttctcaaaagaagacatttatgcagccaaaaaacacatgaaaaaatgctcatcatcactggtcatcagagaaatgcaaatcaaaaccacaatgagataccatcgcacaccaattagaatggcaatcattaaaaagtcaggaaacaacagatgctggagaggatgtggagaaataggaatgcttttacactgttggtgggagtgtaaattagttcaaccattgtggaagacagtgttgcaattcctcaaggatctagaactagaattaccatttgacccagcaatcccattactgggtatatactcaaaggattatatatcatgctactaaaaagacacatgcacatgcacataaaaaattaactcaaaatagttcaaaaaactataatataagagctaaaactataaaactcttaaaagaaattatggggtaaatctttatgactttggatttgataaagtgtcagacatgacaacaaaagcacaaggaacaaaaaaaaatagataaactggacttcaataaaactaagaacttttgtgtttcaaaggacattatcaggtagttttgaccacccacagaatgggagaaaatatttgcaaatcatatatctgataagggtctagtattcagcatatgtgaaaattcctaaaactcaacaacaaaaagcaaacaatgcaattttaagatgggtaaaatatttgaatggacatttttccaaatatgatatacaaatggccaacaagcacaagaaaagatgctcaacatcatgtcagtgacaaacacaaatcaaaaccataatgagataccacttcatacccactacaatagctaaaattaaagagtcagataataatcaagtgttggcgaggacgtagagaaactggaaccctcaaacactgctgataaaaatgtaacacggtgcagccactttggaaaagtctgtaagtaccccaaatgattaaacataaagttaccacacaacccagcagttctattcccaggtatgaagagaaacgaaaacataagtccacacaaaaacttgtgtggaatgttcacaggagcattattcacattagccagaaggtggaaacaacccaaatgttcattaacaatgaataaacaaaatgtgatctattcaaacaataaaatattatttggccacaaaaaggaattaagtatgatatatgctacaacatgaatgaatcttgaaaacatcacactaagtaaagccagtcacaaaataccatgtattttattattccatttatatagaagtctagactagggaaatctgtagaaacacaaagcagaatagtgggccgggtgtggtggctcatgcctgtaatcccagcactttgggaggctgaggcagatggatcacttgaggtcaggagttcgagaccagcctggccaacatggtgaaaccctatctctactaaaaatataaaaattagccaggtgtggtggcatgcgcctgtgatcccagctactcgggaggctaaggttgcggtgagccaagatcatgccactgcactccagcctgagcgacagagcaagactctgtctcaaaaagaaaaaaagagagagagaaagtcgaataatgagtgcttagagcttggcaggatggggagactggaaggtaccttgggaaaacaaagcaggagctaacgagaatagaagctggagaagtgaatcctcagcacagcaaatggtaaggaacatggaaaagcacatggcatgtctgagaaacagagtaacctgaaagagaagaaccgaggaaggagagaaaatggagtagagagactggaaagaaaggcaaggaccaaatcatggcaggggaggagggggttatgctcctttcaaggtgtttagatttgatcttagaaaaggggaaccactggtaaatcaatagcatgtaacatgatcagaactgtgtattagaataagtctgtggagaaataactagacaggagaaagttcagtggtaaagataaaaacttactggaaaggctcagttgggactcgcctgaactacgtcagtggcagtagaataaaggggaaaaatgcagtgtgtgtcaacagctctatgagaattttgaaggagaagttatcaagcttggatccagtttgagtgaagaggaggatagtagtgccattatttctagaaaaaatgcaggagcaaccaatctaagaaagaaatgctaagggtaagatgcctgtaggatttctaagtagaaattccagtagggaggtggaagtcaaggaatggaactggaatcaaaagaaaagtggaggctagtgggggaattcagctcaaaaaatcaaggcgtggaaaatcctgataagagcggcagttctcacttagcttgcatcacgatcacctacctaaagggcttgtttaccagagtttctcctttactcggtgtggagtagggaccaagaatttgcatttctaaccagttcccaggtaatactgatgcattaataaccactggggtagagcaaaagaagaggagccctaagaggaaccctgaagaatgctgtggcgaggagcaaagtctgagttgcttggtaactcttaaaatcagaataaccctgtaactccaggcacagtggggagacaagctaagttccaaatcacagcccaaaccgcagtaagaggaaaaatactgtccagggctttacttcattttgctgcctatcaatgaagagttacatgcaaatttcttaaaagcaggtaccaagaaaacattctatagcaaaaatgttagaatcttaagagctgatagcaaaatttaaaaaaaaaaaaaaaaaaaaaaaaacctatggcatagtatatcttcctgaatgtcatgataagatgccaaaaaggctacttaaagaggtcacagtcagtcctaaatctcaataagaggttttcccaactaaactatggatatatctttgcctaaaacagtaagagctgccttcttctaggaaaatattactataagatttttaccattataccatcattaaaaaatcatgtgtattttaccacaatttaaaaaaaaatgtatatcattatataatagacaactaaaaaggtagactatagttaaacctgcaaacccaggtggcattatggaaacaggagctcccttacctctttgactgagaattccttcaggcctaaatatttcgggagtctcaaaggcaaaaatgcagtcgctttcatggactgtttccaggtcgtctgtatcacaaaaggaacgatggaacccatcatagtacatttctgttaacacaatctaaaaataggaaaaatgtaaacaggtgggtaactggaaattcgatactaattgatctcccaattctatgaacttctccagaccatcaggactggcagtggtctgagagacatctcgcagagcccactttatttgcctttaatgagagaatcctggaagcacagtaccctctgtaattatataacaatatacagtcacccctccatatctgtgggtgctacatctgtggattcaaccaactgcagatcaaaaatattcagaagaaaaaaaaaggatgattgaatgtatactgaacagagtctattttttcttgtcattattccctaaacaatatagcataacaactatttacataacatttacactgtattaaatattgtaagttatctggagatgatttaaagtatattggaagtacaattattatgtatccataaaataaaaagtaaaaataaataaagtatacaggatgatatgcttaggttctatgtaaatactgtgccatgttataaaagggattaaagcactgtggattttggtatcctagtgcaagggttcctacaaccaatcacatggacactgagggacacctgtactctgatgcagaactctatgactctaactccagagtttctctaagttttagtgtagaagagaaccaggagatcataatgtctaacctccgtttcactgaaagaagagaagccaagagacttgcctaaagttctacaacgattcagcctcatgtcaaggacagagtccacatctgactctgaggctttctcccatatcatttaattttctatttttcaagcctaaaccacggatatttgtattgaaaaaaaaaatcaactcaaatgtccaaaaatactaactagttaaatgtagtatagccttactggaattataaagctactaaaaagaataaactatatatatttgcactaacatgcaaaaatctaagtaaatacaaagcaaggtaaaaataatatgtgtaaatgattctacttatataaaataatgtatatatgcatggaaaaaatctaaatggatactatataacatagtattaaagtcagtaacccttcgcattaagatacctagtatgagatacttcctctttctgttatatttctgaaatggttattttacaataaaacagaaaaacaggacaggcatggtggctcaagccagtaatcccagcactttgggaggccaagacagaaggactgcttgaggccaggagttcaagaccagcctgggcaacatgccaaaacctcgtctctacgaaaaatacaaaaatcagctgggtgtggtggcatgcgcctacagtccccactacttgggaagctgaggtgggaggactgcttgagcccacaaggttgaggttgcagtgagccatgatcacaccaatgcactccagcctgggcaacagagtgagaccctgtctcaatcaatccatacatacatacatacaaacaaacaaacaaaacagaaaaacaaaagatggagaggagaacactggagacatttaaagacttcattatatgctcagccacgctgtctagtgaaaaagcactggattgggcatgcaggttctggtccggcctgtcatcaaccagccctgcaaacctgaacaagtcacatgccttttctgagcctctttcaaataagggagttggactagacctatgaggtcccctctaccagcactaacattctgcaaatctaccaggtaaaaggggtcggtggtatattccacaaatagtccagcaaaaatgttcctggcacattttccttctaatgaatttaatgaccatgttgtttttctgccggtgaacaagcaagtaaaattcactctcttcagcaaactgaggtcaacagcaaacttgtaattatttcaccaatttaaaccacatgcaaaaggagccagacagtgctggaagctctaaagatgcaaccagatttgccctggacaccaccgaagcctcgctccctccctttctgcctttccctcatcctgaagagaagaaagagccaatgggcttttcagagtaggaaagaatatgaacattttatcaacatgccagtacttggcctgcaaaaatatgagatatttgccatattagggcaacactgctggctgtatttgttttactgtggtaacttcccaaatgaggccacatgaggccaaagtacaaaacacctttattattccagggattacacagtagcttccagaagctactatctagggaaagcaatttagctacggagtcatctttccttaataaatcttaagtaaggaatgtttttccaaataaaataataatagtaaattgagtaaaagctatatgcaaaaacatgtcaagtccaaacaggtcaaaagtatttttggtcaatttcaacataactgcttatcaaacatttaccccaaaaagggatgcggcatgggcacaactttcctttctcttctctaaacaaggtaagagactctggtccagccgtaatgagaaaacaaaacgtattgagcatctattacgtacagaacattgtactagcaagatatccactcttatcatcacaatgggaaggggttttctagcgtcactgctcaagttttcaaagcctctttgactatctcaaacactgcgaggacgctccactgcccacatacacatccacaggaatgatttaagaagggttaagtaattataccttatgaacaaagctacaagaaggtcttggtgtaaagtcacagcttcttttaaaattatatacacaattaaatgaaacatgaaaagtttctatatacattttagtctttggggccttgatttttttccctaaactctaaatgcaactggttttaaatctctatccaaccatacttggcaaagaactgtaaaaaattctaagagaacagaaagcaatacttttgtggctcatgtgtaactggtcttagcagacttattacctgatcagtggggatctttgtttccatagacactgcttcccgaagtctggcgacagtcccagacagaggtacggccacaccaatcctcatgcagtgagaacatttgccttgatacactacagtgacatagagaggcctgtacagatcaaagtcagatcttctcattagtcacttatttcaactaaaatatagaagatgcaaaataaacctgagacgaaatcaacaaaaaactaaagctaacccacactgttactcggaagcccaaatggaaaaatttcacttggctctaagcagaactgtcaaacaatcatcaagatctttggaaaaggcaatcttcataaaatgaacattctatgaagcaaacaaaaatatatctacacttgattctgtgctttgtattttctttagaacagcataactcctggaaatgttgagaaattgttcaaaataaagcaacgaagaaacaagaaatgtaaagtaaggtctctagagaatcctgaagtcactcagcagcccccgtcccccaaccccgatactatgtgtggatgacgaactgggccagactacacagcccctgcttgcctcatgtgcctgctcaccctgcaaactcaggagggcatttattcttgtaaggttgtagcaatgactgtattcaatcccattattaatcccattacctgtctaaataagtaagaagacctaataggagcctacagaggcaaagggataccataagaaaatacagtcttcattttactaaatccattcttaccttgtgtggggcagaggaattggcaaagaaatgcaaaggaaaggatcaaaagtgttgctctgtttctgacaatgaggacacgtcaaagaagatcttcaaaacaaaaaggtaagacgcttgacattaaaatcacccagaacgatgtcaggtaaacaaaataagtggaaacatccgattttctcatacctgtattgcgcttgaaagagttcttgtacaaaagtgctacagacagggaaagatggtccctcaggcatcatatcagtctctgatggtggctaaaaaaaaaagaaagtacaacttcacagactagaaagaccaattcttggttgaagatgaagctagagaatcacatatgatcttgacttcctttacaagctatgcatcaagtgcagatacttcagtgacgggcacctgctaaaggagccagaacacagcagtaggatgtgggtcacgtggactcatcccctcacacagactctgccagcaatcgtctctgcacagcactcagccgggcagctccccttccccaggatgctccagttcccctccaattctcaaagcccccatcccaatctcctctaataagtaatccccaaccactttaaaagtactaatattggccaggcacaggggctcatgcctgtaatcccaacactttgagaggcaggggtgggcggatcacttgaggtcgggagttcgagaccagcctgaccaacatggagaaaccccatctctgctaaaaatacaaaattagccggctgtggtggcgcatgcctgtaatcccagctactcaggaggctgaggtaggagaatcacttgaacccaggaagcagaggttgtggtgagccgagactgtgccactgcacttcagcctgggcaacaagagcgaaagtccgtctcaaaaaaaaaaaaaaagtactaatgcttcccatgcctaaattccctagtacctattacctgtgctctgtatgttggtgcctaatcacactctacttcatgttgtatttaacttttcatgtccctccgcctaacaattagttactgagcacctgctaccacatgcagagagcactgtacagaacattaggatacaaagataataagacccagtgcctgaccttgaggatgtctcaatttggtgggagagtcagccacacgcatatagtcatatgacagaatagagtgttcaggcacaaaaggaccttgaatcagaataatttaaaacttaccaaacttagaaatttaaaatttgaagtacagagaagaattatcaaaaactttaaaagctgcccaagggaagcaactctttagtctaatttttttccattatataagtcattttacccatatttgtaagactacatgtataaaattaagaattaattgctatgtttctcaataagaacattctggggctactatggtcaaatccaatcccaacagcagagaaaatccatacgtttcctttatgattgtgtattcattccagtgaactacagagtatgtgtcttactagaatagaaagcaaacatattctgctttaaaaacagtttagtgaaatggaatcactttttttaatctgaagctcatcatacatgcaaatgtttcccctctcattagactataaattccttgcggacaacagctcttgtatcttacactgccagcacagtagtaaacaaaatgaaatgtcctttaagtagccactgaatcttatactcacccagagcttagtcaatttcattgtattaacgcaatgcaacaagtcctcagtagaagaatctacacactctcatggctggctgactgccctagggcagcatgcgtccttaccttcagaggaggctggccactctgcttcactgaatggttgaggtcttcatgaactcggtccaaaagccacagcagaaactcctgggcatcatgttgggaatttccccggtactgcagtgcattctttgacacaatagtctatgcaggtaaataaatcaccatgaacagctgtgagttcctggctttaaagaaaaactatttattcataatcgcaaaagggatgcaagatctcaagggtgttagagaatacttcccagaaggagtgcaaagtaaaaacagatgccagtgtaaaaacctcacccctagaaacatgtaccagaacccttaaaatacacttaatccagcaatcttacttttaggagtgtatctaaagacatcatcagaacagcctgtcaagacttctaagaaaatattaatcaaggtttataaaagcaaataattggtaataacttggacatcttaaaaaagagaattggttaagagtaggaggagatgaaacagtaaaaacagttaaattatgatacaactacatgacatccttaagaaatactatataagtgaaaaaaggttataaataagtagtgtgaaatgtgaatgtattcttgtaaaaatcatttaggggggtgtagacatatacatacaaagaaaaagttctaaacacatacctacatattaagtattatctctgggtgatagaataacaggtgctttttttccttctcacttttcatattttctacaatgaatacatgttacataacaaagcagttaaaagttttgtttcaaactttacaagattgatttacattgcttttgctaaaatgctaaacttttattatgtaagatacataacaacttcaagattcatcactcatcaacaaagacttaataagtgtctaagatactaacagcctagtgagggggacagggagaaagtccacgcttacagtgtagctaatgggatggtggtgatggatgccaagtttctcatagtcagagagggaagttacagataagcaaggagggaaggcaatgaatcagctgaagttggtataaactcctattttcttaacatagagatgaacagataaataattacagatatttatataaacttgggttcacatccatatatctgtacactgaaaggcgaagaagtagtgacaccccagtaacaacgtgcacatccagtgcccatatcttggtttctaataccattttccaatataaaactagggctccttggagaaatggccctttcgaggacactgggacacgggacatgtcaaagggacacaggaaccaatctaaaagaactcccaacagccaaagctggaacaatctgatcaacagaataaacaatattgagttataacccaaagtataaaaaagtataaattgatataattaaatgactgaatgaacaaatagggagaagaggcaaatcttccttacagaggaattccaaataatttatatcaataatcccccctccaggaggtagagcttaccacccctacaccttgaatgtggcttgtgatagtgacttacttccaaagacaggagaatggaaagaggagtagaaagtaacttatagttactaacaaagtaactaacactacttcagagagctgagcaaggttgacatcaccagtggtaagtcaggttgctagcatgtgcacttgatatgtgatgaaaagaacatttaacctctggtcttcctcccaaaaacccatggcctcagtctaatcataaggaaaacatcagacaaaacccaaactgagggacattctaccaaaaaaaaaaaaaaaaaaaatgtgactggtacttctcaaaactatcaaggtcaaggataagaaaagtctgagaaacaataacagaccagaagagactaagatgatgtgacgactaaatgcaatgtgttatcccatgggagcctggaacagaaaaaacgcacaagagactaactggggaaacctgaataaagtatcaaatttaatcaatagtaatgtaccaatgttagcttcttagttataacaaatgcactacagtgacataggatattaacaaaagggaaactgagttgggcttcgtggaaactctatgctacctttgccacttttctgtaaatctaaaactatcctaaaagtttatttaaatacgaatatatatatttacaaactttctataaatataaatatggcagttgtgtatatgtgtatcatgggaaaagaatagaggctaattaagaagaggacggtggtgttaactaacagacaagaaacccttccaggagatgtcatttgagctgggccttgaagattaagaggcagggattcaaggctgaggaagcaacatgcacaaacaaagatacaatatgacaccttcaaggaagaccaacaaggtagaaataggcctgaaattccaggtctattagacagaatgggaggagatcaaacagtaaacagattaggcagagtaggaggagatgaaacagtaaagtcagaggccagctcaggaaagattttaaaggccagtcaaacatggcacagggagccgtaaatgaactggtaaattaagatcacgggctctggaccatacagcctgagttcagatctctgttgccccacttcctatttgtgaggcctgggactactctcctccaaagtaaaatggataataatgactcagtgtgatgaatagattttgagaatgcatgccaaacatttcacttgtaaatgagatataaccagcactcaaattttagccatattatatatgggagtaaagagaaatcagggggccgggcgcagtggctcacacctgtaatcccagcactttgggagtccaaggagggtggatcacgaggtcaggagatcgagaccatcctagttaacatggtgaaaccccgtctctactaaaaatacaaaaaattagccaggcgtggtggtgggcgcctgtagtcctagtgacttgggaggctgaggcaggagaatggcgtgaacccgggaggcagcgcttgcagtgagccaagatcgtgccactgccctccagcctggacgacagagcgagactccgtctcaaaaataaataaataaataattaattaaataaaaataaaaaagacagaaagcaggggaggtaactgtacaatgggagagtagttaggaaacaaactaaagaggcaagaaataatgacagtctaagctaaagcagtgaggacagaatgggaaggcagatttgggagagatttaggaattcaagtggtagaatcaataggatttgtgacctaatgaatgtggagagggaggaaggaggcattaatgtcactcaggtgtcctacctagatgatgagcaactggtagtaccctgcatcaagacagaaaataaaaaaggaggaagtccaggaaagagttcgcggaatgagtcccccctttcgaatccattgtagctgaagttctacagaagctctgaatggaagttatctggtaaacaactgaaaaatacagatctgtgggctcactgcaggagtctatgctaaggacaaagatttggaattcaacagatggggggtggtggtagaaacctcaactaaggctgagagtgctcagacatcatctatgagagactgagccagaggacagaatgcagaggtaacctatatttaggtgggaggctcaaagaagcccaagaaaaaaaccatcaaagatgttgtgagaaaatcaggagaatggtgtccaagagtcaaatgaagagagcttcatgaagaaaagggtgatcaacagtgtgaaatgttgaagaatgataaaggaggccagagaactaaaaactgtctactatattccaattaagacaacgataacagaggtgaaaagaaggaacagatttgcgatttgcatcacaatctgatgatcagtttgatctgaatcaacaagaaaatattcatttatagatcttgagattcagattcgggaggaaaaaaacaaagggatatcacagagaatatggaggtgtcactgacacaacttactgaataaaatgaacaagggagaaggatcctgatagcaacaaagtttcaaatacctggaagggaccactggatgccatctcagaaacaggtacacaaggaggaacaggcatgatgggaagtcttcatcatggtacaaaacctccccactaaatcaccaaattcaagtgcttttttctcagtcttcatgtctatctccctttagcattatatatatataaacggcccggacatggtggctcacgcctgtaatcccagcacttagggaggctgagacaggtggatcacgtgaggtcaagagttcaaaaccagcctgaccaacatggtgaaactccgtctccactaacacaaaattagtcaggcgtggtgacacatgcctgtaatcccagctacttgggaggctgaggcaggagaaatgcttgaacccgggaggcagaggttgcagtgagctgagaacgcgccattgcactccagcttggacgagaagagtgaaactccatctcaataaaaggaataataatttaaaaaaaaaaatcttattccatcttgaaatggtttggcttatggccttatgttcccctcatttagaagaatcaaaaccaaaggcattagtatgtataatggaagaatgtgacctacagaagagaagatttcctaattttaaaaaaatgaataggcgggtgtggtggctcacacctgcgatcccagcactttgggaggttgaggtgggcggatcacctgaggtcgggagttcaagaccagcctgaccaacatggagaaatcccgtctctactaaaaacacaaaattagccgggcacggtggtgcatgtctgtagtcccagctactcgagaggctgaggcaggagaatcgcttgaacctgggaggtggaggttgcagtgagccgagatcatgccattgcactccagcctgggcaacaagagcgaaactccgtcccaaaaaaaaaaaagaattaataaaaaaaacatcattagcactaatgaaaccttggttgactcgggatggaagacaaacatgtaggtgtcactatactgacggatcgaaagaggaaagcagatgacaccaaggtctcccatttctgacttaggtagataatgaaccaggaatagaggaagagattaggggaccacagttttgaacaagttgcatttgaggtatcaacatgatcccaagtgaggttaaatctggtgctcaggaaagagatccgagctggaaatttgaatcagagcagcacacacctatcacatgagacagaacccagggaacatatggtgagaagaggaagcagctgggacagaatcttgaacactggaaaaggtcacggaaaagctgcccgtgaagaagcaaagaggtggcagccaggagagagagagtggcatcatacaagtgaggacagacaaacctccatggaggcggaagcaataatgaaaactaccgcagaaaaggcaagtcaggcaggctctgaggcagatcctccagaatagcaaattaagaggttgcttgctcatataatctcaatgaagcagaatatttatcagagagggttaaaagaaacaaggcaagggtttgaatgactgccagagatcattcttcatcaccaaggagctcagttataacagaatggaggaaagatgctgtgaccatctggaggggaccttcaggagcagagggacccacaggctaagggaagagctaacagaaaggagatatctgaataaagatgattcttcaggctgggtgcagtggctcacacctgtaatcccagcactctgggaggctgaggcgggtggatgacctgaggtcaggagttcaatatcagcctggccaacatggtgaaaccccatctctactaaaaatacagaagttagctaggcatggtggtaggcgcctgtaatcccagctatttaggcgactgaggcaggagagttgcttgaacctgggaggtggagattgcagtgagccaagatcgcatcactgcactccagcctaggcaacagagcaagacccttactcaaaaaaaaaaaaatggtgattctttggtaaggggaaaaggagagattgatttaaaagaggctgcagaggaactggccttaaacagaaggtcggtaggagagatggaagagaaggaggtaaagatagtcctgcatgcagataagccagagacaggaaggcagggaacctggttttttgagtttattttgtaaagaaagtagaggacaactgccaagaagagctcttaggtgtaacaggggtaatgacaatctcatggcatagagttgggccacacaaactgtcagaagtacagcaagcttctgtcctgaatcctctctcttaactgactcccaatggggaaaaaataggaaaaaaaaaaaaaaaaagaaagtttcaacatagacattccaaacaaattaactgaaatcaaactcttcattgtatttcaaagcagatattttatacacagcatccattcagatttcagggtggagactacgttcaattatcaagactgcattaaatttgtttacgcttctgtccacgatcacttcaactcatccacacttatccaccaactgctgtgttctaaggcagagtgccaaggctgctcaacaacatgtttgttgggcacgacccaacaggtaacagaacgtccacaatactcgtaactagggcaaaaaccattctgggtcaaccccaccctaaatcactatatcagaccctaaaggaaatttaaggaaaagaaaatcttaataacacaaacacaaaaggtcctctttctgcctctttttacccctcacaatggtaacttattcccactgcagatactccccagacaaaacaaaacatagaagaatctaacggccaatcctttagtatgtatcacagaaaaaagaaaagcagtaggagtcaagaatcctaagctcaagctccggctctgccacaaaccactggttatcaagaggcaactcactgaacctgtgattcgaatcctggttcatcaaatgagcagataagacccctgcatcccaaatcttcacccaagcccttctccaagagtcccggaaagtgatctggtatacgtttttggtcacatctgatgttgctttgatttgccttttacgattttttttcataattaaaccttagtttatttgatgtcctaaattaatctttctgtatgtttgcagttttgaaaaagttgattatcaatgtcctctgtaaatagaagcattgctacaatctgagaaattatttaagtatgtcatttctatagaaaatagaatgtgggccaggtgtgttggcttatgcctgtgatctcagcacgttgggaggccaaggcaggaggatggcttgagcccagttcaagaccaacctgggcaacatatcgagaccctgtctctatttaaaataaataaaaagaaaatagaaaagaaaagaaaaaatagaacatgcaccttcttaaaattaatcttacatatttgtgtctattttacagaatgtgggtatagtgtttctgtttggaaaaaaatattaaactgagtctcttggtctcctgacttaaatcctatacatcctactataaacacatttgacccctgctcctattatcccctcacttgggatgatccttagcatatagttactaaataataaagtaaaaggcaaaacacttaccgggttttcaagtttcacaaaatttctccttacccttcaaagagagaatgtttttatttttttcccttaaagaaaaaaaaaaaagagttggaaacatgggtcagaaaagagccataaaattagacatgagggtctttcttcctgtagagccctagtaaagaggtcgaagcatcccaggctccagggaaaagatactgactgatccaagacatccttcacctaaccccaggaagaagaagaaaaagcaatggtcggtcactggtgatttccacccatgggaaatggatgtggcaatactggtctgacatgaatgactggaagttgggctcctcttttgggaagaagggtagcttgcaagactcatcaaacccaatcattgcccactttctttgattctatgccagaagaaacacaaaatttgtttccagtgatcatggacaaaaacaaaaacaaacaaacaaaaaaaacagaagaactcaggaagacaatagtatttacatttttagaaaaagaaatagatgaaatgcaaacagctgggtggtatctaaaagtgaaatctggtttatgggctgctgctggaaataaaataataagcacttgtcttgagaaaagtttcatcttttgaattttactttcaggacgcctactaagttgatgaagaataattagctaaaacataagggataaaatttgtacaaatagatgaacactgtaaaaacagatacgactcatgaaaaaatggtaatatagtgtccatgcaatagtatgacatactaggacacagaataaatagggccttctgtgcccttcatccattcttcctccttatcttctcctctgaggggagaggagacaaataagactgagaggcccctaatatttgctggctggggcaaaaggcccttgaaagggaccctaaggcctctaggctttcatatgtacttcccctagggctggaatgccctccaccacacccttcaaaccactctccctcctcagaaagataagcaggggaccctggtgggagaggagaaagaaatgaggcacagggaaagggggcttccatccaggatggaaagacaacctgatgaggacaggagcaaatgccacacacattccttggactctgttcacatttggccacagagaaaagcatgttattcctggtacaggttgagtatcccttatgcaaaatgctcagaaccaaaggtatttcagagttcatatttttttcgatttctaattatttgtgttatacttaccagctgagtatcccaaatttgaaaattcaaaatccaaaatgctccaatgagcatttcttttgagcataatgtaagtactcagaaagtttcaaattttggagcatttcagatttcagattgtcagatttaggatactcaacctgtacagagctcctgatccttccaggcacaagggccaagcataggataactcaagtataggtgtccatcatatccatgttctcaggatccaaactcaggaaccaaacagatttgcatagcaaagaatatctgcactgctataagattagtgtcagattttaagcaaattcatatgtaccacaaagagctggtggcaaggattcattgctgaataacgactagtaaagtatgcattcctcacccaaaagaaaaggctgtaataaaggggttgaataatggttactgcatttcaagaaattataactgactcgtgaaaccacaaaactaagggttaaagtatggtcaagagccaggataaaagggagaaatagtgaaaggaatatcctataagtggattcagccagacaaacaaggagcaaaagttgtcccaacagattatacaagtagcaagagaagactccaagtaagtacttacacaatggtaaaaactttctgctagaaactatgcagtagaaaaagaaagactggattatgaataccagggttcaagttctcattctactacgtttgatttttttccttttctttttttttttgttgttgttgttgttcagatggagtctctctctgttcttgttgttgttgagatggagtctctctctgcccaggatggagcgcagtagtgcaatctcagctcactgcaacctccgcctcccgggttcaagcaattcttctgcctcagcctccaagtagctgggactacaggtgcacgccaccacgtcctgctaatttttgtatttttagtagagatggggtttcaccatgttggccaggctggtctcaaactcctgacttcaagtgatcctcccatttcagcctctcaaagtgctgggattacaggtgtcagtcactgcacccgaactttctaccattttttacttaacatgtgcttctctgagcctcagtcatcttttctgcaaaatgggaatggtgataggaatgcttttctaaaaggattactgtaaggctttaatgagatcataaaagcattttgtaaagtctaaaactctgtacagatgctattatgttagttttgaaaaatagaataaaaaaagaaaagaatcaccctatgatactacataatccttaaaaatgccaaagataaagaaaacgagaaaatatctaaagcattagttctcaatcctggctgcacattagaattgcctggggaaagttaaaaataaaaaccatgtcctggcagcagcccactgctaatttttttttcaagtgtgacttatttttaatgactatttctaatgtgaagccaagtctgagaacgaacacagccacactggaaaagctccggagtttcacttccaaaagcaccaaaacttatgggaggctcctttgtcataagtgcattatatgacttcttacattacgttttattcatatctctaggacataccatctcacatgtatcactagacagtgaacaggaataatgtcttactcaatattacttccccaatacctagcaaatacagtgcttggtgcaaagggtaacaataacagttaatacttattgagtgcttatactgtatcaggcattacgcttattgcttatagatgttattttctataaaattcacccttaatggctgggtgcagtggctcatgcctgtaatcccagctactctacaggctgaggcaggaggatcgcttgaacccaggaggcggaggttgcagtcaactgagatcgcaccactgcactccagcctgggtgacactgcaaggctctgtctcaaaaaaataataaaataaaataaataaattcacccttaggaaattccctatgctgtattcttatttatagatgaaaaaacttagcctcagagaaagaaagtaacttttcaaagttatcactcttctttttttctttttttttttttgagacagtctcgctttgtcccccaggctggagtgcagtggcacaatctcagctcactgcgacctccgcctcccgagttcaagcgattcttctgcctcagcctcccaagcagctgggattacaggcgcatatcaccatgcccagctaatttttgtattttttgtagagatgggtttcaccatgttggccaggctggtctcaaactcctgacctcaagtgagccgcctgcctcagcctcccacggtgctgggattataggcatgagccaccgtgcccggccaattaccactattgttcaacctcagctgattaaaaaagctttaaaatatttttgcccataatccttcttcaacaaagtaccttaaaatgatttgtccccatataggactcagcatcatacagggctcaggttcttcattctaaatgtcaattctcagttagacataaagcacgactgagctacagctgcaccaaccttgaggcttcagggaatttatctgctcttaaataactccttgtttagcagtttttgttttgttgcaatttgtatttcttcctatgactgaaatatggcccagaaacaaaaatgccgtttatctaattggcatgttatttgagaaataaggaggaatgcagatgatgtagaaagatcaagttgcagcatgtgaagaactatgtcctgcccaagtgtcccaggatgctagagaaagcaaacacaccagagacaaagatctggctttagggaactccatctgtctttcatcagtaatgtaaagggggtgttcttcaccttaaatgctcaagctgctcttctggtggagattaattccaccaatagtccatccttccccgcacaacttaagtggccaagacttgctgactccaagtttagagtcagctcaggtcaccaaaatgtatttaactacccaatcaactaactcaagtaactcaaatgtatcttctttttggactctttctcatttttccaacacaatctacaattcaaaactatagtaaaacaaaccctttttttaaggaggaaggggggaaattttgacttacaatcaacacaaaaaagcaaacgtccagtcccaatgcaagttggtcatcatacaggaagaatgataatctgaaagagttaaagttaaaactgaaaagccatctaaatatctaataaattattatatattcctgtcatgaaacattacaaatggttgagggtttaaaaagcatcaagttgtacactttaaatatacacaatttttatatgtcaatgatatctcaggctgtttaaaaacaagagacagacctatggagctttaaacgaaagttttccatttatagtaactctaaacccaaagcccaaaccaacctctggatcttaaccactggggaaagagacagcagccagcatcaaagaaaaattagagagagaaaaagaatgtatccctacagctacatccagcggccttttcaggccatcctggcttgccaggtggtgggagatgaatgcttaaacctaggaagagaaaaaaagaatggcagtggcagctttctgagcaagtaaaagaaggtagaggaggaacatacagacatacgaactcagcacaatgaccctgcccacagcacaagagccaatcaatgttcttcgctgagtggtgctcctctccgaagtggaagtaaagtgacctatacatcccaggaggcagaataaggtgggaaaggcaaggactagaggaaaaatgagataaggccttgaactacccctaagccaaagatccatatatttcttctataaacacacacagattatatatacacacacaagaggcaaaatcctcttgattttgaatacactgacattttattataagagacctaaaatgtttttaactgaacagccgattttataaggagatccaaaatattctggaaataaccttgcattgactcactattctgctattgcatttttataactgcaatatcacttagtagtaactaagggagattattcataagcagatccagcaagtttcactataaattatgcattcacatcgccataaacccagagtactcccagtaaattttaactgcctgagacgcttgcaagtcacagacctgctgtggcactctacacagccaaccctatggatacttgacaggcaagccaggctgactcttaggcctccaatcaatcacagcctccgcccattctttcaatcctggacacaagaatcagatctcctaaaaaccaacacagacacctccagctcatcctggctccagtcttctcctagcaaagtacaatttagaaccttcccagcctaggcctggcctggcccggcccaatctttaccaattctagtcagttcaggccttggtcatctgcctgtcttatgtggatgctaaatggatgagtgtgtgaatatacagacagcaaacaaagagaagagtgtgaaatcaaaatacggcaattccctagtatcaaaatgttactatcatatagtaacttcaaagaatagatcaagctgttctccctcactactaaccaaagaaatgcaaattaaaacaatgaaatgctattttctacttaacaacttaaagatttcttttttaattacaacagtggggtaccacacattcttaacaatgctagtggtaaaatccttctgtaaataaggtaataatatgatttaagagcctttgaaataggtaactactgaaaggaatttcctcgttttatatagcctcaagaaataatgaaaagtgaaagatttatgtacaaaatacattcattacaaccagaagccatctacatgtccaaaaataggttacagtaccttcatataatgatctgagaagtctttatgacgaaaattactcataagacaatacaaaataaagatcacatgatgaaaatctggatatatggtttgatatcaattatgttatgcacacacaggggaggggaaggcaagtaagtcaattttattatttcaacttgcatatattttccatgttttctacaaaactttagacactactcttacagaaatagatgttatctaatatcaaattttagcaaaagaacccagacacaaaagaatatatacttattgcaaaccaaaaccacaatgagataccacttcacgcctactcaaatggctataatgaaaaagacagacgttaacaagtgttgatgaggatatggaaaaactggaaccctcacacagtgctcgtgggaataaaatggtatagcaatgttggaaaagtgcctgacggctcctcaaacaattaaacacagttaccatatgacccagcaattccatctctaaaatatacccgaggaacaaaaacatatctccacataaaaatctgtatgtgaatgttcacagcagcattatttataatagccaaagtagaaacaactcaaatgtccatcagcagatgaataaacaaaatgtgaaatattcatataatagaatattttgcagctataaaaagaaatgtagtacgatatatactacaacatgattaatcttgaaaataccatgctaagtgaaagaagccagatgcaaaaggccacatatatgattccttttatctgaaatacccagactagatagagacacaatgtagcttagtgttcatgtagggctggaatattccagggaaatagggagtgactgctaatgagtatggggtttttgggggggataattaaaaatgttctaaaattgactgtgataaatgtttgcacaactccaagaatataatcgaactgtacactaaatggatgaattaaatcgtaggttaactgtatttcaataaagctgtttttaaaacaatatatacttatttcactcataataaagtccaacaacagacaaaactaatccatggtggtagaagacagtctatgtttaatcaatggtgttagaagacgatctaatggatggtgttagaagacagtctaacattccagaaagggtaccttctggagtgttagagatgtcctatttcttgatctgggtgacaaattatcactttaggataatacatcaagctgtacactaacgccatatatatttttctgtatgtatggcatacttcgttcaaaaagttgacattaggctgggcgcggcagctcacgcctgtaatcctcggactctgggaggccgaggtggatggatcacctgaggtcaggagttcgagaccagcctggccaacatggtgaaaccctgtctctactaaaaatacaaaaatcagccaggcgtgttggtgcccgcctgtaattccagctactcatgaggctgaagcaggagaatcacttgaacctgggaggtggaggatgcagtgagccgagatcatgccactgcacaccagcctggacaacagaacaaggctgcatctcaaataaataaataaataaataaaataaaaaataagaaagttgacattaaaaaggaaaaacactaaagtttcttaatttagtcagatgctcagactctaactcagtttagttaagtcttatttagagccgattctatttatctagttacttaactaaaaagcagattagaaactgcaaaatagtcgggcatggtgtctcatgcctgtaatcccaacactttgggaggccaaggcagaaagatcacttgtggccaagagtttgagaccagcccaggcaacaaagagagacctggtttctaccaaaaatttaaaaattagccaggcatggtggcgcacacctgtggtcccagctaccagagagctgaggtgagaagattacttgagcctgggagataaaggctacagtgagccatgatcacaccactgcactccagcctgggagacagagtgagattctatctcaaaaaaaaaaagaagaaaagtacaggaggaagtaggaggtacaggatcccagaaataggataaagcaagagaaaactagcatgaagatggtagggagcaatgaaaggaaatatcatagcagaaataagaattcgaacaatatagcaatccagaaccactcaatagggcctatgtagtcccactagccccaaaagaaacctccacattacctaaaaggagatcaatcaatgatgttcataacaaccctaagtcaccaaggaacaactgagtatgtctaggattctcaccctggcaaagagtacaaaataatatgatcaagccatctaatcaaaagaaaaggttaaaattgtaaggatctgatgttcaaataagtagttacctcagaagtcacttacgtaaaagactcattccccaaaacgccaggcacatggattatcactgtgttattcaacgacgatacaatggcacagaatgtatcatactgagaagtgagtgccctctccgggacatactcgtcagtgagtcatccagcactagaacactggagatataaataaataccacctcttctaaaacagtctgaaattcaagtggtcataacctagagcatcatggccgggcatggtggctcatgcctgtaaccccagcatgaggctgagatgggtggatcaccgaaggtcaggagttcaagaccagcctagccaacatggtgaaaccccatctctgctaaaaatacaaaaattagccaggtgtggtggtgggtgcccgtaagcccagctacttgggaggctgaggcaggagaattgcttgaacccgggaggtggaggttgcaatgagctgagatcatgccactgcactccagcctgggtgacagaacgagactctgtctcacaaaaataagaaaataaaaaaaaccctagagtatctacgcatcaaaggcaagctataaaacaatcagacttgcaaagctagacccagtgaaagtgtagaggtggaacgtacttctcatcagcacttaactatggtgatattttgcaagatcctttccacacctctctcctaccagcatccctttcttatgtcccagacctgctgtcacaggctgggttggttggtgtgttggttggttgttcttgctaaaatgttttcaccactcaggtgtaaaggagtcaatggttgttaaacaccacgatctgtgaggatggtattactatgtggcaatgaaaaggaaaatatggaaactgaggctcagtgacctgcccaagatctcagctgcactaggagtctcactacattcaaaactcataggctcacagattttcaaaaggaaaagagtagcctctgaccctggatgccctccacctccctcagcaataccctctgaagcttgacagaatccgggaaggggtgggggcagctacaacagcttaaccagctgcctgacatcacaatagagcctgaagggtaactaaccccttcctccagctggatataaaataaaaagcagccaatactcctttctttcccatctgaagggaaatgaagctactctcctttcttcctgtcactattaaaattgtgaaatcattaactagtagatattttccacgagctgttgcttttaaaggagtttgtccttttccttagctaccctagtttattataactttcatgacacaaagactctaaaatgaggaagatttaccaagttgtcactgtactgttataaaggaactcttatttttagaagattaaagaactttccaacttaatgtatctgtgtaattactgggagcaactctggtcagggaataagttcttactattattcttctccagctacagagagccataaccttcaaataaagaaagcgttgaatttccttctctagagtttggaaacagcctttctctgctcccatcattgctcaaagtaaagtaaatagagaagttaattccctgctcattcatttgctcatgaatatgcacacaagggtcacgactagttactatgggggttaaagggaatcatagcagccatacacagtgcctcatgcctataatctcagcactttgggaggccgagacgtgaggatcacttgaggccaggaattcaagaccagcctaggcaatataccaagaatctgtctctacaagaaaaaaaaaaagttttaattagctgagagtggtggcaggcacctgttgtcccagctaccacagaggctgaggtgggaggattgcttgagcccaagtttgaggctgcagtaagctgtgatcgcaccactgaactctaacctgggtacagagcgaccctgtctctttaaaaaaaaaaaaaaaaaaaaaaggctgggcgtagtggctcacgcctgtaatcccagcactttgggaggctgaggcgggtggatcacaaggtcaggagatggagaccatcctggctaacatggtgaaacctcgtctctacttaaaaaaaaaaaaaaaattagctgggcatggtggcgggcgcctataatcccagctacttgggaggctgaggcaggagaatggtgtgaacccgggaggtggggcttgcagtgaaccaagatcacaccaccgcactccagcctgggcaacagagcaagactctgtctcaaaaaaaaaaaaaagaaataaaaaagggactcagagaagtaaaggtctacacagaaatacctctgtctccaactataaaacagaaattgtaacacatgcatctaccttacaacattataaggagcaaataaaataatccactgtgcagggcatgtgataagcactcatacgttagcgacacgaagaaaagcaagaggagaaaattatccatagtgtgctaccatttatctaaataagagagaacatgaatacacacccatatatgaatacacacatatattaatatatacctatacatactgccttatatttaaacaatgaaagaataaatcataaaatttagggagaaaggcaatagagtggaaggatcagagacagagctagatttctgaatagatcttgttttgcagatttgacttcagccatatattgtattttttaatataattatgatgcaacaaaatcaaatttaggataggaaccaatctatcaaaatcaaaagcaaaaaaagaaacaaattgactagtgtggtggctcactcctgtaatcccagcaccttgggaggccaaggcaggatgattgcttgagcccaggagttcgagaccagcctgggcaacatagtgaaacagtatctctacaaaaaataaaaaactagctgggcatggtggtgagcacctgtggtcccagctactccagggactgaggatcacttgagcctgggaggtaggcttgcagtgagctatgatcgcatcactgaactccaccctgggcgacagagcaatattctatctcaaagaaaaaaaagaaaacctcattttaaaaaagattaaaaaagaaacaactgatttttttttgagatggagtctcactctgtcgtccaggctggagtgtagtggcacgatctcagctcactgcaacctctgccgcctgggttcaagtgattctcctgcctcagcctcccaagtagctgggattacaggcacctacctaccactgcgcctggctaatttttgtagttttttttttttttttttgtagagacggggtttcaccatcttggccaggctggtcttgaactcctgacctcgtgatccacccgcctcggcctcccaaagtgctgggattacaggcgtgagccaacgcgcctggccgaaacaactaatattaactatatatccagtgatgacaaaaccacatagagaactattccaagtaactttaaaacacagtaatttgtaccatacggtcctagtagaatatatgctatggacaaaaaaactaccaaataagtcttaagccattttcaaatactaacattgttggtggcagtactgggattattattctgagacttaggagcatactgtgggataaggcaaatgagaatttacgctggtgttacaagtaggattttcagcatgggaggaacaagccacagatacaagaccaatgagggtcaataaaaccccgaagccctgtattggaataatcaatgtgaattcatgatttagctttaaaagaaatcactcctttcttagaaaccatgtgcatccctcatgcctcaactgtggtctctcagtaccgctgtaccaaaggaacctgattccagtatctggaaatgactaattccagatctggtgcaagaaatgatgagcctggaacatcttaagatccttgcattctcgtttgacatgccaggctactagtacagtctcaaaacgacttgagagtcgacttgtcccactggacaaaaatgggacaattttgagcatcaataaggttaaaaactataactgactgaatacatcaaatatgcttaaacccatgagctcataaggttataaaaattcactaaacacaactggaaatcaagtaattattttgaaaactgaaaaataaaggagggggaaaaatcaagcttttatctagcctttcttctgaaaaatttacttcagggaaaccaaataactggacaagagtctctgtagaagtgttccagctaacaagtaaaaaaggaatgttagaattataatttcaccactttcaacccttaataaattaacgggtcagggaacaactaccagtgattcttggcaccacaagagataaaaccaaacagtgcaggctttctgatggaagtttataacaccacgacagaaagttttgccaaaaagaggagaaaaaaacctcaaacttgagtctctaaacctctagctctaactaccattttacaggaaatacatggacagaggaacatcttaattgaagctactggaatataatacaaaaaatcaagactatgaagtttccgttgccagtccatgatgagattatagaaattgagagtaagcatttagaagtatttacaaattaaaccataactttatgtcttctgaatttaacaattttttaatggggctggtcttacatatgccttttttatgtcacttttctattaattcatttgtattgtattttacaaacagcccacaatagattggaaattttaaaaattagtcctaaaccacaaataatttgaagagctctgctctactagacaaacacgcattcaacaaataaactgccagaggaaaaataaaataaatgagagagagaggttgtgagcgacaacagatgtatcaatccattgaaattttggaaacttatttggatccttacataaagtgtaggaaatatatatgcacagttgtacacatatatgtgtacatatatatgtgtgtgacagaaacaatatcagagaaatatgaacactaattaaggaatattagttttccttaggcagacaatggcattatcatttttctaaagcatccttatcttttagagatatatacttaaatatttatgggtgaaatacatttggaagctgcttcaaaagtttggggagaataaaggcaaaggttatacagatgaaataagattgtccacaaattggtagttgttgaagctgggtgacagggaaatgcaggttcatcgtactgctctcccctcttagttatatatagttgaaatgttcacaaagaaaggttttctgaacatttggctattattactattatttaaacataactaagtgagaagtgtacaagtactttaacatggttccatgtaaaatgttatctgctttcaaaggaggaagccataacgtccaactacaggggttaggggaactttaatgtaagagtaatttctaaaactagtaaagtggggatgtactctggacccaggaaggagaaaacagaaaaagcactacaagtgggagggtatagggcacaaacaatagccagcaaagtagtcaggggactgtgaaataataatgctaacagatttctctataccaggcaccatattaggcactttacatacatttctcacctattcctgattatcagtcctatgaagaatgcatcacttgcctcaggtctcagaatctgaaccaaagtctctgatgctacagctctttccctgtgttcctctgcctttccgggacaggggggaagataagatttcatcatgagaaagcttaaataccaagctaagaaatttacatggtactttctgtataaaaaagcaatggcaatttttgaaaaggaaaacatgtaatttcaagtaaactttaataagattcatctggcagcaaccaaaactatcaattaggccaggcgtggtggctcacgcccataatcccagcattttgggaggccaagatgggagtatcacttgaggccaggagttcgagcccagcctggtcaacaaagtgacaccccccccccaactaatattttttaatataataaaattttaaaaaagaaaaactaccaattagaaaggacagagtttagcaacagcggaggggctagaaggctactgcaattgtgtgactgagacataatgagggccggaactacaggagttggaattatgtgcaaagacaaatgctttctctcaaagcaatcccctctccctgctgaaagactcccctagggagtcttccaccaccaactctagacacactacagtttgtcagcccagaaattacatgatatcctaggtttccagaatgacacgtaaacataaaatcctaggtgtggtctgacaggaacagcactatcacccaccaccccagatcaagatacttctttgaaggtagcataaaaaccttaaacatttttggcagatacatcagcgtaagtcacgtgctagtaacacacccaggtcctttcacataggtgctatggggtagttagttcatttttggatccaaatgcaagatgcaggattctattccattttagctgttaattttaattaaagatcttaacggacctgcattctctaacttggagtatacgctatacccgtcaagacatttagaaattcagctgggcgctgtggctcacacttgtaatcccagcactttagaaggccaaggtgtgaggatcactcaaggccagtaatttgagaccagtctgggcaacataccccatctcacaaaaaaatacaaaaattatccaggcatggtagtgtgcacctgcagttctagctattcgggaggatgaggcaagaggatctcaagccctgcaattcaaggctgcagtgagctatgatcatgccactgcactccaggctgggcgacagagcaagactgtctaaaaatagtaacaaattaaagttgtattttattttagttttgtagacacaggatcttgttatgctgccctggcggtcttgaactcctgggctcaagcaatcctccaccctcagcctcccaaagtgctgggattactgtcataagccaccatgcccagccaaatttttgtagaagacatttacaaattcaattaatatacctaggttaggtcctcatccaactcacaggcaaaaatgttgttggggacaggatcaaacacagaaacctgttgtgtcactagagtaccaaaggactgaaatgagcaagcagtaaaatgagtgtagcaatgaatgggagggcatttgatgctgaagaactctaatgaaccataaaaggcacatggaacctgccatcatcagcttgcttttctctctgggcttgtgtacatgaattcactttgtaaatgatatggccctacacaaataagcggcatttccatcactgtgattattattgtttcttaaatctcctgacaatcagatggctctctgccttgctcttcaagatcaaaagaataccaagaattaaagccaaaacatatactgagctagtgatgtgtttacaaagaaggggtccttccagtagaagcagataccaacaaaggcatttcctgaccagtcctatgaaatcttctaaagcgtcaactgtttatttgtggacacactgtttgctaccatccgaacccaacagctggagggaagaagcaacagatgttcagtgactggccaattgctctaggaactgccacagtccatggcttaaaacaatgatttctaaatagagaaagatcacaatcaaacgaaagacaagatatcccgacgtgctccactgcaaaaatgttgtttgttaaacataaaaggtcatttgaggaacagccaatgaacaattaattagcagagcaaacaataatatttttgaaggaagaagcaacagaggacataactttaaattactgaattttgaatgatttattttcccctactaaatataaaaggtttttttttttttttgtggaaactatgaggtcattgttttccagagtctttactataggaaacagctgtggggactacacaaacagagaacactgccttatttagtagcccctcattgtgacgagtgtatagatggggacaggaaaaatccatcaagccacgcacaaatagaacaaaagtagcagagtcaaactaaaaactttaagtcacacaaaggaagacataaaacaactaactcaggaaaagcatctatatgattacagctgttatcttgatttaagagatagttccatgtttagactagatcagttcctttctacatgggtcaccaaaaacttaaatgattcacattgcacagtacctgaaaatggtaacattcaataaatatagcttttaataaaagttttcttgggattcttaggttcaaatactgtatgacccaaccaaaacgaaacttatccacccacctccagaatggctttccattttatttttccaatcgtcaagagtgccatccccaaacaccgttttaaaacctctacgttattttcatctcctcctccttatccactcttcacacacccataaagctgccaaacactgtcaacactgcttctaacatacatttttataagctcaaaagtcagaagaaagcagcaagagacaaagaaaagaaagtaagtgaatccagcccaatccactatgaagcatgtgactgcccccctacagtatcacccaagactctgcttaagcttgtgtgatgataggaaaaatactattatgtgaggcaactcatcctattttcagacaacctgctcataaatcctgtatacgaggcccgccatttccttttctaatttctcctctcccctctcaaagcttaaagcccaagagtaatcacagtcctcaagtgaggtctgacccaagcccacgacagaactggcccaccaccagcacatctacatttataacatcagaggctggggctggctgctctgcaagctgtctttggttgtgccacgttcctctcagattaatcaacacgttgtgcacctcctacaagccaggcacagagattcgatgttgaataagacataatcactgcacatgagggagttggggggagacggcaatggatttaggaaaccgaatcattttgcctctgagactgatttttatatgtttttaaacagttcatacaacatggggattatctgatccttggaagaatgtatgaaaaaatccatccaatcctgctaccctttgagggaacaggcagttctttaatagctttccatttcttcctcagttatcggtcaattcaggctttcctactatagcatttttagttgatattttgtggaaagttgttgattttatcagtgacaggcaggcattcagcaaacgtggttacctgccccaaattaatgcatatatttaaaattaaaattcacacagattggccaggcgcagtggctcatgcctataatctcagcgctttgggaggaagagatgggcaaatcacttcagcccagaagttcaaggccagcctgggcaacatggcaaaacccatctctacaaaaaaataacaaaagttagccaggcgtggtggcatgcacccgtagtccaagctactcgggaggctgaggtggaaggaccacttgagcctgggaggtcaaggctgcagtgagccaatatcatgccactacactccggcctgggcaacacagtgagaccctgtctctctctctctctctcacacacacacacacacacacacacacacacacaaatcgaacagattactttgtttttgaaacttgacaaaatgattctaaaatttagagaaactttaagtagcatgagaaagaagaataagcaacaataacactaaacagcaccagtaaaagaattgatgaaacagaatacaaaattcagaaataaaccgtaactctaaatacagagaaaccttttgtaaataagcaggatgatcataaggttggagtaacaatggtaacaacatcagttagctctcagtgagccctgatggcatgccaggccccctgccaagtttttctctcatttgttttcaaaacagccttatgaaacagatatactcttatctccactttacacatgaggaaattaagcccaaagagttaagtgccaaaggtctcgaggctagcaagtggtgcagccaggatttgaacactaaccactcactatactacacgagatgggaaataccaaaccttaaaggaaatcctcactgtacacattcaccaaagtaaactccatattctaaagaggtaaatattttagaacacagtagaaacaaagctaaaaaaaaaaaaaaaagaaagaaagaaagaaaaattatcctatatacaagaataccattttcagctatatagtaacaaaagcagtaagggaaaaggtcaggttaaaaaatataaattaaaactttctgtaatatacaaaagtaccaaactaaaagaggaagagaatgagggaaatatttttatcaaatgtaccaaatgtttaaagttgttaccttatacacacacacacacacacacacacatattctatagagagctcttataaagtttaaaaatcaaaaacagtcttcaaaatctaaatagacatcataaccaaatgggatttatttctggaatgaaaggacgttcaacatatgaaaattgatcgtaacattaacaaaataatgagaaaaaagcaaaccatgatcatctcagttgatgcagaagaaagcatttgacaaaattcaacactctttcatgatttaaaaaaaaaaaaaaaaaacactcaacaaattgggaatacaaggaaacttcctcaacatgatagaagcaccatataaaaaagcccccagctaacatcatactgaatggtcaaagactaaaagcttttcctctaagctcaagaaacaagacaaggatgcctacttttaccacttctattcaacatagtatgaaaagttctagccagagcaattaggcaagaaaaagaaacaaaagccattaaaaatgaaaaggaagaagaaaaatgatctcttttcacaaatgacatgatcttgtatgtagaaacacctaaagattccacaccaaaatctgttagcactaataaattcagcaaattgcaggatacaaaatcaacatgcaaaaatcaattgcacttttatatactagtaatgaacaatccaaaaataaaacaaaataattccatttacaatagcatcaacaagaataaaatacttaggaataaatttaaccaaggaaggaaaaaaacagtacactgaaaaccacaaaacatagttgaaaggaattaaagacataaataaatggaaagacatcccatcttcatggcttaaaagacttaatattgttaagatgacaatattacccaaatcaatctacatattcaaggcaatctctgtcaaaatcctaacagcatcttttggaagaaatagaaaagtccatcctaaaattaatatggaataatctcaagacactgaagcaaaacaatctcgaaaaagacaaaattgaaggactcacacttcctgatttcaaaacttactactgtacacagctacagcaatgagaacagtggggtaaagatacataaagataatgcctaataaaaacggacatataaatcaatggaatagaacacagagtcaagatataaaccctcgcatatatgatcaattgattttcaacaagggtaccaagatcattcaacagggaaagcacaattttgtcaaccagggtatagtcctgggaaaactggacagccacatgcaaaagaataaagttggacccttaccaaaaattaatacaaaaattaattcaaaatggatcaaaaacctaaacataagaactaaaactataaaactctcagaagaaaacatagaggctttatgacactggatttggcaatgatctattgaatatgaacaaaagcacaggcaacaaaagaaaaactagaaaaagtggacgtcatcaaaattaaaaacttggctgggcacggcggctcacacctgtaatcccagcactctgggaggccgaggtgggtggatcacctgaggtcaggagttcgagaccagcctggccaacatggtgaaaccccgtctctactaaaaatacaaaaaattagttgggcgtggtggtgggcgcctgtaatcccagttaaccaggaggctgaagcaggaaaattgcttgagcccaggagccggaggctgcagtgagctaagatcgtgccactgcactccagcctaggcaacaaagcaagacttcatctcaaaaaaaaaaaaaaaacttttgtgcctgaaaaggcactaccaagagagtgaatgacagagtggaaggtaatagctgctattcatatatctgataagaaattaacatctagaatatataaagaactcttaacaattcatcaccaccactaacaaaaaactaattcaaaaattagcaaagacctgaatagacatttctccaaagatatacaaatgaactatatgcacttgaaaagtgcatcattattcattaggagaatgtaaatcaaaaccacaatgaggcctagtgtggtggctcatgcctgtaatcccggcactttgggaggccaaggcgggtggatcacttgagcccaggagttcaagaccagcctaggcaacaaggtaaaaccccatctctacaaaaacacaaaaattagccaggcatagtggcacgcacctgtagtctgagctactcaggggaactgaagcaagaggatcccttgatcccaggaggttgaggatgcagtgagccattactgaaccactgcactccaacctgagtgacagagcaagaccctgtctcaaacaaacaaacaaaaaaaacaatgcgataccactttacacccactaggatggctataatcaaaaacaaatggaaactaacaaatgttggtgaagatgcagaaaaatcagaaccctcatccattattggtgagaatgtaaaatggtgcagttagtggaagatagtttgacagtccctcaaaaagttaaacatagaattatatgatctgaaaaaagtgaaaacaagaactcaaacagattcaagaaaacaagaactcaaacaagaacatttgtaatactgtttaatgttttatgatttatatggtggtatcacattgataagtgataatttacttattctgtcctcttcctttggacgttttcctccctacataatataacacatgacatatatatatgtgttatacatatatatatatacatataacataacacatgcgacataatataacacatgagaaatcaaaaagatgtccatacgtttttgatgttctaagtatatgtctggaaatgtatcctaaagaaacaatccaacaaagcaaaaagttattaacacgattcatgttcattatagtaaaacaaacaaacaaaaaaaagagtagggaggaaaacgtccaaaggaagaggacagaataagtaaattatcacttagcaaagtgatatcatataaatcattaaacagtattacaaatgttctttagaaacatgtaaaaaatgttttacaagttgcatttaaaaatcataatccaaagtggtctgaccagaataacaaccatataaaatatcgtaagcggacaagaagtacaaaaatgtaaatcaatggcaccttagggcaacgtgttccagagtaagagcatgtatgtcacactgccctaagttcaagttgaagctctgcccctgcaaatgtgtaaagaaccaaactaggtcaaatcagaatgacagatttagtgctagtttacatcgttggttgggaagacattttttaaaaatctcagaattggagtgttataacaaatagaaatctctagccaaaactctatcctaaactaccaaatatttcccctcatgaattaccatgggaccacaaataaaacatgtctaaaatagaagttatcatctttgaacagttctaaattgcttcagtttcccaaatgtaaccagtttcaaagaggctaagatacatactgtttgtcctgaaccaggttctgtcccttcccctctctcatcatcactcaacccatcctccatgtccctagtctgagtgaccattcttttaaaaataaaagaaaaaagacaatcataccacaagcttgtctaaaattatttggtgcctacctctgcagaatgccattctgcaacatggcaccgaaggacttccagatccagccctgctcaaaccatcactcagtgggcctcctcccattctaccttgtaccttgtacccttctgctacaaccaccctagaccttgaaattttctgaagaagccatgttgtttgaggttccaaacccttgcacttacagggtttgctgccctgcaaaggactttcccacctttccactatccacctagaaaattcctaccaaatccttcaagacacggagcaggtattgtttcttcagtcacctcacaggccccattcctccctcaggtgacctcacccccaggtttgcacagcactcgtcctatcctattgcaattatttttatacccatttgtcttcccttctaaaccctgaattccttgagggcatgggccacttcactcatcttcatatccccagtgccttctaatgcaggaccagcacagaaaatgtgctaaataaatctgtagacttaataaatctatatatcctgtctgcaaaataccaacctgatttgtttcttaatgggcataaattgataattcaggctaggcacggtggctcacgcctgtaatcgcaacactttgggaggccgaggcgggtggaccacctgaggtcaggagttcgagaccaccctggccaacatggtgaaaccccatctctactaaaatacaaaaattagctgggcacagtgatgcccacctgtaatcccagctactcaggaggctgaggcaggagaatcacttgaacctaggaggcagagattgcagtgagccgagatcacgctaatcacaccactgcactgcagcctgggcaacagagcaagactctgtctcgaaataaaaaataaagtaaaataaactgatatttctgcagctctacgctgtattcagcgctaagagcaggtagtcaaactgtaaagcaaaccaggtgtcatgactctgccttcctggttttcctgctacctctctgactgccccttaagaggtcctctctctcctcctgtcctctcatttttagtttccctcaaaggcttagtcatgggcctcagaccttctaaatatgctcctggcttcaattatcacctctatgcagctgaatccaagtctatacagctagtcctaaattgcacctgatttccaactgtctattaaggcttcctctcttaagtgggaaggtcatatcctatggctcccaaccccatatattcaaattaaatgcacaatctttctgctcctcatgctccacaaaccacttccctttctaagtgctcaatttctatcagctattaaatttatatcaaatatccctattatttctttatcaccttggcctgaaacctcagtattccctttaccactacgcctcttgtagttttcttaataatgtccaatgtcctccaaaatgtcacttggattcacctttcctcctccttttcctcacttcattcctgtgattgttttctcgctgtatttattttctcctccatttgattcattttcactcaccatcagacccatttttctaaaatcgttttcatcaaatcaatctctctgcacaactcaagaaggctcaattgaatcactactgattgcagcctcaaggctaaactgttgtgacagactctcaaagccatccataatgtgccccctctcctctccccagttatctaaatttatctccccttcattccaaatcagtggttctcaattttgctgccgagggacatttggcagtatctggagacatttttaattgtcatgacttggagtaggggggagtacaaccacatctagtgggtgaaggccagggattctgctaaacatcctacagtgccaggacagcccccaacaacaaagaattagccagcccaaaatagcaagagtgccaaggccgagaatctgctccaaatcaaggctctctgtccccagaccatgctatatctatacctctgctcagaatatttccctagcaacttagaatgtcgtctctcttccccttaactatcaatgttttatttatcttcaaatcccattctaagtctatagcccatggctttaaataccatccagtggtgacgcctccaaaatgtttatcttatcttctgagttccttacccagctgcctactagacatctcctgagtgtactatttaacatatctgaacctgaattcctgactcccccaaaactccttctcctcaaataggtatacagccccagcaatcacccagttgctcaggaaaacaggtgggagttattctggatgctctcctcaacgttctctgctccagtgtcttgccacaaatcaatccattagcaagttctgtcaagagtctacctccagacacatcttaaatccatccacttctccacctccctccaccatcccttttacccagtccatcacaaaagcctcctgactggtctctgcctccattctactcactattcagtgcccagaataaccacttcacattttcacaagatcataccaggactctgtttaaagcctataacagcccccatgactcttggaataaaatctaaaccccttaccttggtctgtaaggcactatagctacacaaggcagactcggcctctgcctacctggcccctgcctctccacctcctccatcccgctctcctcctggctctctagctgcaaacaagatctgtcagactttcaagtgtaccctcagctctttccaactatagcgccttctgcattttattcttcctgcctggtcacacccattattccctctcatacacctatctatttctctttagcatttatacaataatttttttttttttttggacacagggtctcactctgtagcccaggccagagggcagtggcacaatctcggctcaccacaccttgacctcttggctcaggtgatcttcccacctcagcctccgaagtagctggaaccacaggtgtgtgccaccacgcccggctaatttttgtactttttggagagacagggtttcgcctgttgcccaggctggtcttgaactcctgagctcaagctatctgtctaccacggcctcccaaagtgctgggattacaggcacatgccaccatgtctggcctactgtaatttttaatttcatatttaccagtgtttattgaataatatctgcctcctctgtggcaataaaagttccgtaaaggaagggaccacatggccttttacaatttttttaccattatcatatcactttgttttccactatatacaaatgacttgtacaatatgtggcatggagttagaaaatcaaatttgtagatgcttaattgctgacaacaaataaaaggatgaataaatgaaatctttctacttacactttcatacacaatgatctcacctctctctcagctcccagtgaactttcctcatcagtacaacttaaaacagcttctctataagcagctaagttctctgacggcatgaacctagtcctataacctttgtacttaatcctgtattcccagcccctttacctaaactaacaataactgtgcagcaaatgtgattcaggtccaaaatatggagttcataattatcccatgtatttttattcctcaattagtcctcatggaaaatttattgtaattcttacacttcacttttaccaaacttggtaagatgtggtaaacatcagctcaaagcttactggagagagatccacatgtgttgatatacgtgttgaaacagtctgaaaggaatgtgttttaagaaagacttccaaaaacacctaagcctgaggagcaatggcacaaacgtgaagctagctgcagatgaccttattttcactccaattcagcaccacagtctcagaggaaaaaatgttacacgtttcagcacgtcccctctgcccatgtacgtgttatgttgagacctgtcgtttcattgcttgtactgataaggccacccaggcccaggacccagtttgtgcaccagcagtgcaggggtacacagagttcacagtcagtggaagtcagaattctggttctgctccctcaacctctagctagtgggtgaactcagttcccacatcctgaaaggctaggaactactcacaccacatccaagtctgcttccaagtctaaaacttcatgattctatcaactttctccctcagaggtgtggagctttgctaaaactcaagtgatggcatttgatggaccagagaactgaccaggaagggatgtactttttattttatactctgtcacaaagctaaatgtgacctacacaatttcattttttccaagggacaccctgaagtcagtgtgctttgtggaaaacactgaagtatcagtatactaaagagcttgacactaacaagaaaaaaactgtgtaccatgggtttgcagcatagcaccagaacccccagcatgagtgcatggaaaagcaggctgggaaactcagcaagtgtgagcctctgattgccaggttgttcaccactagtctcttatacaagtttattccttttgtgacttgagaattctcactaataaataagcaccacaaggcaccaaagttcaaggaaaaaaaaatgggagagagaattctattcatcaattaccatttgtttcactgcaaatctggaaggagtccccacaattcttttatcaatagatcactctgtgctagctgttctttgccagcacaatttaaaaactgctgccataaaatttatctttcttgcttgaaagatgaccatccatctttttacttgctgcaaaacggctctgagctctaaaactcagaaagcatttgtaagaatctggggcacccatgctcctatgaaagcaataagctgattccctttaaaatggcatattatgtattcaaagtgatttatttactctcactattttactaggaaagtgatgcaagggtcctgccagtgaagcccaagttttaccctagtgctgctgcaaacacatatacacactcagagacagagaaggagaaagagagagggagaggttggggggggggagagagagagaaagagagagcgcgagagataacaaggtaaccattttaaaggctggggaagtaaaaggaaacttgcgctgagtctccaaactttcctccaaacagtttctcagcctcagcactactgacactttggggtgaaaaccctttagtaaggggggctgtcctgcacattgtgtgacatttagcagcatccctggaatctaccaccacatgccagtagcaccctgatcccagctgtgacaaccaagtagggttccagacatcgacaaatgtcccagggggtgggggcagggtggggtgaggacaggcaaaagtgcccgtgttgaaaaccagtgctctaagagtaggaaacaaacaaacaaaaaatctgtgtgaaaagagaaaggataaaggtaatggctagagacattttttacagcatatcaaggttgagctagtcaactcatttcatcctgggaaatgaaaacccaactttaacaaccatctagcccatccaaaaccaaaaaccatctacttggcaagctcctaaaactcaaatcaatgtggttaaaaaggaagaaagaactctaattgaaaaacttacaaagaaaagcattagtaacttaaagttttaagataataaaagcacaaagacatagtaagtgcttttctaacctcaaggtaactatctcaagatggcaaattggttttatctcctctgccaacttcaactaggtggtggtggctgcctggagcccttctagaactgagcaggattctaaggctgaatgtgagcgatgtgaaagtgaagaatatctgaatgaaataacgatgtccaccccaagcaggcgaagcacagtgaggtatgcctcaggtccaccttctggtgtttacctttcttttttttttttcctttttttgaggcagagtctcactctgtcacccaggctggagcgcagtgacatgatctctgctcactgcaacctccacctcctgggttcaagagattctcgtgcctcagcctcccgagtagctgggattacaggtgtgtgccaccacgctcggctactttttgtatttttttagtagagatggggtttcaccatgttgtccaggctggtctggaactattggtctcaagtgatccacccaccttggcctcccaaagtgccgggattacagacatgagccactgcgtcctgccttagcattcaactttctttatattcaaaataatacccatcaaatttagctaaaataaaacctttttttaaaaagtaatcaatttgccagagttacctaaccgggggaataaaaaggggaaaagaatctaattatatcacttccttgcttaaaaatcacctctggattttcaacttgcagaggatgaaatccaaaccagcatagctcacgaagcccttcacagtgagtttccaacactcttctcccaggcttcctgcacccccactgctctctatggtgcagccagccactaaatgtctattccccaaaaccacacgccctttcatgcaactccaccacttccttgccctgcaaatttctattcatctttcagaacactgctcaggagccacctttttggtaatgctttccttgttccttgatgcctgctatacacaggatggtccttgagccaaaagcactggcatcaccagggagcttgttagaaatgcagaatcttgggcaccgctccagctctaccgaatctcaatttcctttgtagcaagatccccaggtgaattatgtgcacactgacgcatgagaagcgctgtctcagggaacttcctagatcctactcgactcagctcttcatagctccctgggaggtaaacccctcctttactcatctcctctgtgaagacaggaaaacccaaatgcccaccctccagcctccgtgacagccaattgacatggttatagccaatgaaatatcagcagaagcctgctgagggggcttctggaagaatttttatttccctaatgacttcctgccgtcctgggtagaatgccaggtgcagtggctgccatcactggacaaccatgaggtgacaaacctaagaacaaaaagccaatgatagctaaaaagacaacaggtggaaatacagaaatggtctgaatccttgttgggcccaacgagccactgaaccatagaaccatccacctccggaatcactgtgtgtgccaattgccaattgcaacgttttcattgcttaaggcactatcattagggattttcctttcttgggctgaaggcattcctaactgattaagtaagccttcaataaatgggaggtgaatgaatgaatgtagagtgaaacctactaaaggttcaggagattacttttaaaaagccaggcctctaagaatctgttcatgtctgccaaagcatgcctataaatcagtctctgtacttctagaattattgacccatttctgttcacagcttaatggataaaaaagtgaacacaaactcataaaaagcaatggaaatgttcacatacaaagatgctgtagaaactgattttcacattttggaaaagaggagaaaaccaaacttaaatactaggctctgacctcgaaaagtttacaaatgctgtggctacttacaggcaattgtaagcaaagaggggcagtgtggggtggggggcggggggtggacctacagtagtcagttctcctgatcattctccctttctaattttgagatctcagctgggcacggtggctcacgcctgtaatctcagcacttggggaggccgaggcaggtggatcaaaaattaactgggcatgtagcgggcgcctgtagtcccagctacctgggaggctgagacaggagaattgcttgattgaacacaggaggcagaggttgcagtgggccgagatcaggccactgccctccagcctgggcgacagagtgagactccatctcaaaaataataataataataataattttgagatcactgacatagatctttttttccagtccctatctcagtcaagtacttccattcaaattgccaagatcaaacagcaacgatttttttccaagaaaaacagcattgagcagcataagatgtaagtaaaaagtattaaacggggagagatgcacactggccatgtagttcgtcagcaagaaagcaggaccttaacaaagcagatcctcagctagatgaccttttcatattttaacaaaatcatctccttttacttaaatgttgttataaagaagctttatagcaccaatgggaaaccagtaccttttgccatgaattgaagacaaatggaaacccaataaaaacataaccttattaaattctagctactgttacctgccaatgcttctagacttgaagcttgttctgtttaaaaaaaaaaaaaaaaatgggtggggggtgaacaagaggtattaaaaacaggctaacatcaagctgagacttcgtcctgggcaagattaggataggaaaaaaaaaaaggaattaaccttctccctgtgtgacttcacgctgtttttgttttgttttgtttttacagatagagtttcctgttgcccaggctggagtgcaatggcacgatctcggctcactgcaacgtccgcctcccaggttcaagcaattctcctgcctcagcctcctgagtagccaggataacaggcatgaaccaccacgcccgtctaattttgtatttttagtagagatggggtttctccatgttggtcaggctggtctcgaacccccggacctcaggtgatccacccgccttggcctcccaaagtgctaggattacaggcatgagccactgcgccccgcccgattccatgctgtttaataccatattcatgtcccacctgaaagtatcccttacacaatctcacatcatgttccccttctgcttagagtaaccgcccaatttcttagtgcatcctaaatggtcccataccatccggtcccagcccaccactcggctctcaaatctcaccctctcactacacttgcagccccaccagcaaacagcaaaggagggcttggccaagggccatacatacccccagggatgtatagctcacccctgtaatcccagcactttgggaggccaaagcggggagagtggcttgaggacaagagttcaagaccagtctgggcaacacagcaaaacccccgtctctacaaaagtgttttaaaaataaaaaataggtaggtatggtggtgtgtgtctgtagtcccagctattaaatactctggaaggtgaggcgggaggattgcttgagcccaggagtttgaggctatgtgagcactgcactccagcctgggcaacagagcaagaccctgtctctaaaaataaaataaaaataaaaagtagcctgtcagcacatcaatcacagcagcaggtttttctttcttcaaaccactatctgatattatctcgttaacttcttcaagtctttaataacaaaaataatagcagcaaatacacatgatatggaagtattttacttatcaggttgaaccctataaaagtgccaatctgtaaataaaaaacggttaaatatgggtaattccacagtgttcgatttaatatattaacttgtttgcagctcacaaccaccttacaaagtaggtcccccagatgaagaaactgtaagaacagagaggctgcttaacttacccgacgtcacattgctagtaagtggcagaaccaggatttgaacccatgctcaacactcccaccccacaaaaatgcaagttccatgaaggcggatagtcttgttcattgcaacgtcactcccattgcctattatcacagagtatgggcacgtatgtagtaagttctcaataaatacatgtttgagtgagtgagtgagtgaataaatgaatgaatgaatgaatctccttaaaatcactggtcgactgcccagaccactcggagcaaccaatgcagaagcctgccgggccaagaggaaccgagggaaggaagacctgggcgggcaggtgccccaggggctcggggtgcagtgggggcgcggcggcgcgcgggctcaccttgaagtcgcggctgtgctgcggggtgtactccagggtccagagggcccgcaccaggtgcgccagctgctcagtgacctcgccctggccctgcgcgccgcggcccgcaggctgctccgggtcaggcgagggctcgggccgccccgcccggtactggcccagcgccaggtactcggcgaagagctcggtgttgctgaggcactgcagcgtggcgttcatgaagcacgtgttgccgtggttgcggagccccgccacgccgggcaccggctcggcggcgcaagcgggcggcgcgggagaggcgggcggcggcgggcacggcggcggcgtgggcgcggcggccggcccgggcgggaagcagctgcggaggccgccgcggtctggggcggcgccctcagagctaaggtgcgagagcgtggacagcgtcttgagaacgcggctcatgaagctgcccaccgagcgtgcagaggagggcgaggagggcgaggaaggcgcggccggcccggacgccccggggccccccgcgccgccgccgccagcgcggccgctccgaaacagccgcttgctgaaggagcgcttctccttcccgctcgccgccgccggcggcccggacccaggcgccgttaccttggacatggcggcggccgcagacactcatcaccgcgcccgcccgcccggcccgcggccccgccacggccgccgccgcatcccgcagcgccgcgcctcaccgggcccgggggctcgacgccccacacacctcaaagcgcagccgagccagcgagcgagcggcggccggcggggccagcgggcgcgcgcgcggtccgcccagctgagccgctcacgtgacgtgcctcccggcgccgcccgcccggcgctgaagccgcctcggccgccatgttcactgtgggacggtagctgcctctccagccggacgcgatgcctggaggctgcgggcgcggtcctgctgcgtgaagcccgagggaggccatgtctagtgtgggcgccgtcccggcttggaggaaaaggctgggctcccgttggatggtggatccccggggtgggtctctgtctttgctggtcagatggcagaggcgggaacgtgcaggaatcaggatgctgtcagttaccagaccgtgcaagagctggtggacatggccctgacaggtcctgggcaagtcagccctgtctggctcccaagggacgttgcagatacctaccctctgggtgccagcggagcgcagtcacagaccctggcacgtcccagcgggcttttcttcctggctgcaccttggagtcccagcgaaacgctgttatcataactactttccttttcattccagcctttaaaactcctccgggctctcccatcattcatcattccattcattcattcactcactcattcattcagcagttactggggatattgcaaagaattaaacctattaaattagaatcaaatgtcatatccccagcggattaaattagcacggtttctacctgccctcttgcagcttacattcctactgggtgtttacaatagctgttgtgttccacacattatgccaagcatgcaatattttctttaatctttaattcaccgtctttgagattggtacagttcttatctgattcaaacccaagttttatttacaacccctatacttgacctctaaaccaaaggtcacgaatccacaaatatcacaggtcacaaacccacaaatgagtgaagaatcctggtgtttgaatcatcatattgactttcaagtgacttgggtctcagtgttgggggaaatataaggaatgatggggactatagcagacttcaaattaacatctttctaaagaggtggctgccactcagctccagccagttgttcccatgtgagaacaggagctcagcgttaccagatcatctgatgttttaagagaaggcagaaatcctatttttaaacgttggttccattaaaaaaaaaatagtgcagggagcaaaaaatagtacatctttgggatgcctttagtccaaaatcaactagtatatgacctcctctctataggctcccctctgctaaaagggctagtctgagtcctgaggcagaagagagaaatcagagaagggagagcccttcctcctttttaaaacatgaaggccaccttacaccacgtttcaaagtaaatggtttttacctttgacctccctccccaatgtaagtagggctctatgatgacatctccagggtgctctgcactgtccctaatcggctccactctcctcttagtcaaaattcttatctggacaccaggaagaaagccatctgattattcacactaaaatgtgaatgcaatggccctcaacttctgggcagtttgatctagactcgagggcctttgctggagccgttccctctcccttgaacctttccttagctaacttagaacctttctacttagctaacttcccctcatccttaaagtcccaccttagatatcaccccctccaggagatgtcccttccacaggccctcttggcacctctcattcatgacactgacttgaccatattgcaattcagtttacaatcatcaccttcactaatatgtgggcttcaacccagtagagacccatcttactcattattcggtacccagtaaggtagccattatataacaggttgattatttggcaactttatacctaaacaatgtcgtgtgtgtgtgtgtgtgtgtgtgtgtgtgtgtgtgtgtgtatgtgtgtgtgatggagtctcactctaacaaccaggctggagtgcagtggcgggatctcagctcacctgcaacccccatctcctgggttcaagcaattctcctgcctcagactcctgagtagctgggattacaggcacttgccagcacacctggctaatttttgttttttgttttttgttttgttttgttttgtgagcagcagcaagatttattgtgaagagcaaaagaataaagcttccacagcgtagaaggggacccgagcgtgttgccctaatttttgtatttttagtagagacggggtttcaccatgttggccaggctggtctcgaactcctgacctcaagtgatccacctgtctcagcctcccgaagtgctgggattacaggcatgaggcaccgcgcccggcctctaaacaatatctgaacttcttggtgggatacctaagaactgccttcccagtctgggcccctctcactaagcttacaggtcttataggtctccactgagcctcaaagtttgacacaggcttgaaaaaattcctcattggaatgttcagatgatcattcttaaagactcaccttgaacattctgtagtgaatctttcattgtccctctctgtaccaccccttacccctaagctcgggaaacgtaaattagaaacaacagtgcagtgaatattatcatgacctataccttgtccatcatgtagctatctccttaggctgaaaccttggatcaaagggtatgcgtattccatatatgacacctattgtcaagctgacccccagaaaggttttatcctgtcagcaactaatgggaaatgcacatttcccaatcccaacatactgttgagttttccagtctttttcacattgacaagtttgatgaacaaaagatggcatattaatgcactttttgtttgtatgagtaaggttgaacatcatgtgccagtctctctgctatccaacatctcaaccaacttcctgtctgcaagggataccaaattaggcaggaccactcaagatcccactatgaaaactgggtagggtggcagggagcaggtattccccttcctacccctggaagctagagcccaggaacatgacctaaaaaagaccaccgccgggtgcagtggctcatgcctgtaatctcagcacaggcagacagagacgggaagagtttgagaccaggctgggcaacatcacgagatcccgtctctaaaaaaataaataaataagcctggtgtggtggtgcacttctgtagtcccagctactcaggaggctgaggcggaaggattacttgagcctaggaggtggaggctgcaatgagctatgatcgtgccactgccctccagcctgggtgacagagcaagaccaactatatgttcctacctagactttggctctagaagtattgatacacggttcgttggagataatgcagtgaattaatgaatctagcagctatatatttagcagtgtggcagtacggtggtgtacagtgtgggggtggtagcagcaagtgtccagctgctactctagtggcaagttcttactggtgtctgtgtccctgggtttctgcccaagcctgtttctctggctctgttctttctgtgagctaacctgataggtttcctgtaaatcctttattggggaaacaaaccagtgtcagtttctgctgtttgcaatcaagaaaacaactaggaataccttttaattagcgattttatttttactggtgtgattcacctgcacacaccatttgcccattattcttttcggtgtattcctttatagatattatctcgtagaagttttttgtttgtttgttttgtttttgagatggagtctcactccatcgcccaggctagagtgcagtgacatgatctcagctcactgcaacctctgcctcttgggttcaggccattgtcgtgcctcagcctcccaagtagctgggattacaggcatgtaccaccacgcccagctgattttgtactattattattattattattattattttgagacagagtcttgctctgtcgccaggctggagtgcagtggcacgatctcagctcactgcaacctctgcctcccgggttcaagcgactctcctgcctcagcctcccaagtagctgggactacaggcacgcaccaccacacccagctaatttttgtatttttagtagagacggggtttcaccatgttggccaggatagtctcgatctcttaacctcgtgatccgcccgcctcggcctcccaaagtgctggattacagtcgtgagacactgcgcccagccaaatttttgtatttttaatagagacagggtttcaccatgttggccaggctggtcttgagctcatgacctcaaatgatccgtctgccttggcctcccaaagtgctgggattacaggcatgagccactacacctggtccataaaattattttctatataaattatattatttttcagtctataccattccctacttccctttcaaccatgtttacagtgttttcatatcatatacagaacttaaattattatttttattttattattatttttgagacagggtctcactccatcatccagactggagtgcagtggtgtgatcatggctcactgcagccttgacttcccgggctcaagcgatcctcccacctcagcctcctcagtagctgggattacaggtgcatgccaccacgcccagctaactttttgtatttttagcagagacagggtttcatcacgttatctaggctggtcgcaaactcctagggtcaagccatccacccacccaagccatccacccgcctcagcctcccaaagtgctaggattacaggtgtaagccactaagcccagcctaaattattttatatagtgaaacagattagtctttttcataaagatttacaatatttttgacatacttagccttcccccactccaagatcataagaatattcatctgtattttaatttagtgcagttctgggtttttttcttattattatgctctccatctggaatttatttttgcatgagaaatgagatagggatcttgccttttctgcatgcttcatggctagccaattgtctcagcaccatttttaaatgtaattttcccactactttaaaatgctgcttttatcacctattaaatgccccgtatatttaagatttttaaaaattctgttctatcccattgataagcctctgtattccaggatagcataggtttagaatatgctgaaatgtttgatagagcattatctcctagtattttattatctgtctgtttgcttattctctcaaatgaatttaatcctttaggggggttaatttatatagattaagtgagggaaaactggcatcaccacaatatttatcttctcatctgagaataaagtctgtcttcaaaaaattatacaagggcttttaatgcccctcccagtactatagtttcctcccataggtcttgcataatactaataagtttattcctattggttgctattatgaatgggatattttatgtcattatattttctgttgtttgtctacaggaaaaaaaatatttttgtaaccagccaccttgatgtactttagttctttctcataattttcagttgatcctattgggtttctcaggaatttatatcaacacatgagataaaaacctcgccactttgtttataatagttgtacctcatctttttttttctcttgtctaattgcccttccagaattttgtctgtaatagtaaggagagtaggaaagcctgcattgtttctgcctttaatagcatttcatccagtgctttaccattaagcatgcttgcttttggtttgagatatatattatttattgcgttaaagtggtatccatgtattcctacttcaggaagggttattatcaggaattggtcttgaattttatcaaatgccttctgggcatcaacagagatgagcctttgcatttttctcctttgacctgtatacccatcgtaagttcttagttgcagacaacataaatgacttttgctaacttaagcagaaaaggagatctttagaaggatatcaacagctcacataactgctagaaaagcttcagaatcagacttaggaaaccaaggaagacagtacatagccaggactctgctccagaaaatgctgcttaagatgtcactgttggcgccgtcggtgaagctggcgccaccttcagacagtggtagccgcaccacttgcctcttagttctgctgtagccactgtgtaaccttgaataacttccaaatgtctctgaacttttgctttcctatctgatagagtttagatatttttcccctccaaatcttatgttgaaatgtgatccctggctgggtgcagtggcagacacctgtaatcccaacactttggaggccaaaggcgggaagattgcttgagcccagagatttaagaccagcctgggcaacatagagggatcccatctgtacaaaaaaataaaaaaaatagccaggcatggtggtgcacacctgtaggcacagctacttgggaggctgaggtgggagaatcacctgagctcaggtagtcaaggctgcagtgaaccgtgatcatgctgctgcactccagcctgggtgacaagagcaagaccctgtctcaaaaaagaagagaatagaagagtcgagaagggaagggaagacaggaagggaaaggaagggaatggaagggaaggggaggggaggggaggggaggggaagggagggaaaagagaagagaagggaagggaagggaagggaagggaagggaagggaagggaaggaaagggaaaggaagggaaaagaaaagaaaaaagaaaagaaaagaaaagagatccaggaaaggagaaataggggaggagggagaggagaggggaggaaagggtccctgatgttgaaggcgggtcctagtgggaggtgtttgagtcacgggagcagatccctcatgaatggcttggtgtagtcctcgaagtaatgagtgagttctcactctgttggttcacaggagatccaattgttaaaaagagcctggcacctcctcccttccttcttgctccctttcttgccatgtgacacagctgagtccctttcaccttctgccataagtggaagcatcagactggcacggtgcttcttgtacagcctgcagaaccatgagccaaaagaaactcttttctttgtaaattacccagttttgggtattcctttataacaatgcaaaatggaccaatataataccttcagcattcttagctcaaaatggaagcatccatttggttgggccctaggtcctaggtctggtcaccagcagctggaaagtagggaaggaaccatcaccttcctccagcttccatagtgggagacaaagctggggacaggctggacgcaatggctcaggcttgtaatcccagcactttgggaggcggaggcgggaggatccacttgaggccgggagttacaggttgcagtgagctgtgattgcgcggctgcactccagcctaggcgacagagcaagatcctatctcaaaaaaaaaaaaatagattttgggggtgtcacagtgaaaatacaaagtattttccatgctaggggaagacaacagaaaataagcaaacacacaaatactgtgtgtaataaaatttcagctactgttaattgcttggaagaaaaacaaaaccaagaaaagagacaggaagtggtgggcagagagtgtgttatgtagaatgttgaagatagcctctctgaggaaggatatttgagcagggaactgaatgaggtgtggcaacaagcacctatggaaatctggggaccatccagacagaggaaagaggaactgcaaaaggcccaagttggaaataagtctggcctgtaccaagaagaacaagcagatcagagtggctgccatgaactgagcaaagcaggaaatggccaaagatgaggtggaggagacaggcaaaggatcagaaaatgtaagacctcgttccaggagtttgagaccaccctgggcaacatggtaaaacccccatttctaaatttttttttttttttgagacagggtcttgctctttcacccaggctggagtgcagtggcacaatcacggctcactgcagcctctacctcccaggctcaagcaatcctcccacctaagcttcctgagtagctggaactataggtgcatgtcaccacaccctgctaattttttgtattcttttgtagagacaggattttgccatggtgccaggctggtctcgaactcctgagctcaagtgatcctcccacctccgcttcccaaagtgctgggattacaggcatgagccaccatgcctggcaggcaaaaacaaaacaaaacaaaacaaaacaagaaaaagagatttgaaaaaattagtcaggtgtggcggctaattaaaaaaaaaaaaaaaactatagtcccaactacgtgggaggctgaggcaggaagacttcttgagcccaagaatttgaggcttcagtgagctatgatcgcactgcactccagcctgcagacagagcaagaaataaaaataaatcacgcctgtaatcccagcactttgggaggccaacgcaggcagatcacgaggtcaggagttcaagaccagcctggccaatatggtgaaaacccatctttaccaaaaatacaaaaattagcctggtgcggtggcaggtacttgtaatcccggctactcgggaggctgttcccggctgtgggctattatctttaacagtgaaatactaaaaggttgtgctcgtgaggtggggcttttcaactcagaggaccaaatgtaagatgttcagaaggaagccagccatttgtgtcagatcctcaaatgtcaccgcatgcagaccttttcagagccttgtctatttctcctgaaaagaatgcccaatttcctgctgtcgcctacaccagtctgggaccaaaaggcagaaatagattaggtaggggctgatgtcttaatctttaggttgcaatcttctattggttccccagttttcagaattatttttctttccagccctttgctaggtaaaggacttgcttgctgaatttggagccttgcttctctgaacttggagctctctagtttaatgtctttgttgactgcacttcatgctggagggctggggctagaagtgtaattgtctggatgtgtgtgataagtgaggttccctaagggtctaaacatacagactttcaactagggtccctatgttaagccccatgcttaagcttacccagcttttgctgcatctgatgcctccaattcccgactatgttagttggggctgtgtgatggttaataccgagtgtcaacttgattggattgaaggatgcaaagtattgttcctgggtgtgtctgtgagggtgttgccaaaagagattaatatttgattcagtggactgggagaggcagacccaccctcaatctgggtgggcaccatctagtcagctgccagtgtggttagaataaaagcaggccgccgaacgtggaaggacttgacttgctgagtcttccggccttcatctttctcccgtgctggatgcttcctgcccttgaatatcagactccaagtttttcggcttttggactcttggacttacgccagtggtttgccaggggctcttgggccttaggccacagaccgaaggcttcactatcagcttcccaatttttgaggttttgggacttggactggcttcctggctcctcagcttgcagatgtcctattgtgggatttcaccttgtgatcgtatgagtgaattcttaataaaatccctttcatatacacatctatcctattagttctgtccctctcaaaaaccctgacta

SEQ ID NO: 1200 - DNA, 24438 bp, Homo sapiens
ttggccacccaaagtgctgggattacaggtgtgagccaccatgcccagacccatctttctttctttttagagacagggtctcactatgttgcccaggctggagtacagtggctattcacaggtgtgatcccactactgatcagcgtgggagttttgacctgctctgtttcctacctgggccggttcaccactccttaggcaacctggtggttccttgctcccgggaggtcaccataataatgttgaacttagtgcagatacccgatgggcatagcacactatagcccagaactcctaggctctagtgatcctcctgcctcagcctcccaagtagctgagactacaggcacctgccaccacacctggcttttttttttttttttttttttgagacaggttctcactctgtcacccaggctgagtggcatgatcacagctcactgcagccttgacatcctgggttcaagcgatctcctcgcctcagcctcctgaggagctaggactaggcgtgcacccccatacccagctaatttcttatattttggagaggcagggtctcactatgttgcccaagctggtctcaaactcttgaacacaagtgatcctcccaccttggcctcccaaagtgctgggattataggcatgagtcattgctcccagtctgagatgtatttcttaatccactgtcaaatactggcccaaacaaattcagtttggcttaggaaatttgtatccactcgtctaggactgctcaatattaatgcttccagtaaattcagcatttatggtctgttatgtgctaaggactgaacaagttacagagagggggaaatgactcaattgtagcctctgtcttctaggagttaaatggtaaggaaacatgataataataaaataatttagaaataataggatagtaataacagtaatagaatgtagaaagtcataaatactattaaatgagtgcaatggaagcattgaggaagaaatgaattacactagagaaatcaggaaagctttttttgagacagggtctcccggtctcacttgggctttgaaggatgagtgcagttttaaaaggagagagggaaatcacgttcttttcaaacttttttttaatttaaaaaatattttggccagacccggtggctcacacctgtaatcccagcagttcaggaggccaaggcaggtggatcatctgaggtcaggagttcaagaccagcctggccaacatggtgaaacgccatctctactaaaaatacaaaaattagccaggtatggttgtgcatgcctgtaattccagttacttggaaggctgaggcaggagaactgcttaaacccaggaggtggaggttgcattgagctgagatcgtgccactgccctgcagcctgggtgatagagtgagactccatctctaaaataaaataagataaaataaaaaaaaaataaaatcggccaggcgcagtggctcacgcctgcaatctcagcactttgggaggttgaggctggcagatcatgaggtcaagagattgagaccatcctggccaacataatgaaacccagtctctactaaaaaaatacaaaaattagctgggcgtggtggcaggcacttgtagttccagctactcgggaggctgaggctgaagaatcacttaaaccctggaggcggaggttgcagtgagccaagatcgcgccactgcactccagcctggcgacagaacgagactctgtttcaaaaataaaataaaataaaataataaatattttgtacagatggggtctcattatgttggccagactcatctggaactcctggcctcaaggcatcctcctgccttggcctcccaaagtgatgtgattacaggcattagccgccttgcccagctggagatcaaaagttcttaatagtcttgggtgaacaagagtattctgtataggaaacatacagctaatagctgggcgcagtggctcacgcctgtaatcccagcatttagggaggccgaggtgggtggatcacgaggtcaggagtttaagaccagcctggccaagatggtgaaaccccgtctctaccaaaaatacaaaaatcagccaggcgtggtggcgggcgcctgtaatcccagctacttgggaggctgaggtagagaattgcttgaacctgggaggtggaggttgcagggagccgagattgtgccactgcactccagcctgggcaacagagtgagactccgtctcaaaaaacaaaacaaaaaaaaaaaagaaaagaaaagaaaagaaaaatacagctaataaatgagcttgctaactcagtatctccaggttttcctttcaggaccaatatacaaagatttgtgatatttagcattcatttatccataaaataggtcaaactttaggaaagaaatttctctataaatcttttccaacaaaaatcatctttctctgtactgtggagaaagcagctttctttcagacttctcagttcaatatctgaaacctttagtgagttgcctacatgtctaggacatatgtcatatactacaaagggtaccaaagtgaggactcagtccctgcctgcctttataggacttaagagtgttggaggggtcaaatatgtatgacaaagtatgtgaaagattctttaaaagaaataaaatgtgatggagatcagaacaggaacaagttagcttcagtggggaaatctctaaagcttcatggaggctatgtcttaaatgtgaatagaattgtcataagcagtgatgagtgaaggccttagggaaagatatagaaggtggatggtgtacgacgtttgagaaaggacatgtaatttggttgactggagggctgggaggtgaatctaatgggagagaagttcagaaaagcaggttgagaacagtcttggaatgccatgctaagaagtttgggctttatcctggaggcagggtggagcatacaatatgtgtttctggaagatagcaatcaaccacagaggggtagatgggaaaagaaaggtgaatttagaggggattggaattgtccagggaagagatcgtgctgctggcattaaccaggaggcaggagctggtggaccaaggaggtggtggatatgagaggcacgaccaagaatgaaccaattgcctgatttttgtgcccttgtaaaaaatttttttaaaaaagtatgaactaaggcttggtgacgaccttgcatgtgaaggatgctttgtggttcctagcttgagaagcgggtagaatgggagtcccacccaggaggaggaacatggagaaaagataaagggtttggtttgggtgttggaggtgtctgtgaactgtccagggcattggagaggcagcattggtagttgagggagaggcccgggctggagataataaatttggggatttttcataaatggctattgaagccgtagaggcactgcacttccctatagggagaccagggttttctcagcctcaaaacaattgccattttggtccagattctttcttgtgagagggtgtcctttgcattgtaggatattttagcaacatccttggcctcaacccaccagatactagtagcacccctacccccagctataacaaccaaaaatgtctccagacattgtgaaaagacccctgaaaggtaaaataacccctctgagaaacactgctctaaaacagagtggttctcttcagaagtcggaagaaagattgccaacgggccgggcatggtggctcatgcctgtaatcacagcactttgggaggccgaggcgggcgaattgcaaggtcaggagatcaagaccatcctggctaacacggtgaaaccctgtctctactaaaaatacaaaaaattagttgggcgtggtggcacatgcctgtagtcccagctgttcaggaggctgaggcaggagaatcgcttgaattcgggaggtggaggtggcagtgagccgagatagtgccactgccctccagcctgggtgacagagcaagactccatctcaaaaaaaaaaaaaaaagaagaaaagaaaaagatggccaagggcagaatctctgtgttctaggggcacattcagagaggaagagggcacattaggagacaggtgggatggccagcagcataacaggctacagagagaaggtttggagacagaaatgaaccttggcagtggtgagaacttcatgatccttcaggaatcaggttcagttgagcctcctgaatgtaccttttccttgttctccagcttttttcctctgagatataggagtaaactgcccacctggggcataaatcagaagactgggatatatgccaagggttatgtacctgaaagtttgcttggttgccttttcaggtggtaatattccctttctcttagtttctcattcagttttctccattagtgtcctttttctcttttctttctttctttctttctttttttttttttttgacggggtttcgctcttgttgcccaggctggagtgcaatggcacaatcttggctcaccacaaacttcacctccccggttcaagcgattctcctgcctcagcctccctagtagctgggattagaggaatgtgccaccacgcccagctaattttttgtttttagtagagacaaggtttcaccatgttggctaggctggtcttaaactcctgacctcaggtgatccacttgccttggcctcccaaagtgctgggattacaggtgtgagcccctgtgccccgccttttttttttttttttttttttgagatggggtctggctctggctctgtgaaccaggttggagtgcagtagggcacgatctcagctcactgcagcctccgcctccaagcctcaagcaatcctcccacctcagcctcccgaagtagctgggactacaggtgtggtcaccatgcctagttaatctttacattttcagtagagacggggttatgcggtattggccaggctggtctctaactcttggtctcaagtgatccgcccgctgcagcctcccaaagtactgggattacaggcatgaaccactgcacccagcctattcttaatcctattttgcaaatgaagtgacttgcccaaaactgcacagccaggggtagtagtgtagaagagcaggaggtcagatgtcaccctagtctttttatcacacagggaattgctaggaagctggggctttatcctggaggcagggtggagcatatttaaatatctgttttgggaagatagcaatcagccacagaggagtagatgagaaaagaaaggtgagtttagaggggattggaattgttcagggaagagatcatgctggcattaactaggaggaaggggctggcattaactaggaggaaggggctggcatggaaaggaggaggtgtatatgagaggcacaaccaagaataaaccaagatttggcccattgcttcttgggctacaactcctataaccaagcagttcagcagtttttccttacaaagtcacttcactgaatatatatatatatattatgtttgaggctggggcggtggcttacacctgtaatcccagtgatttgggaggccgaggtgggcagatcacttgaggtcaggagttcgagaccagcctgcccaacatagtgaaacctcgtctctactaaaaatacaaaaattagctgagcatggtggcgcatgtgcctgtattcccagctacttgggaggctgaggcaggagaatcacttgaacccaggaggcagaggttgcagtgagccgagattgcgccactacactccagcctgggcaacaagagcaaaactccttctcaaaaaacagaaaaagaaaaaagaaaaagacagggtctcactatgttgctcaggctagtctcgaaatcccaggctcaagcaatcctctcacctcagcctcccaaagtgctgggattacaggtgtgagccactgcacctggtctactgaattttttgagtgctaagcacagatgatgaggtaactgaggcttagagttgttatgcaagtttgtcccaggtcatgtaaatattaaggtatggatcagccaccatgcccagtgataagccacattacaatatgtattttaacatttttcactaatcacataatttacatttttctactggccaaattttaaaagtaagagaaacagggctggatgcagtagctcatgcctgtaatgctaacactttaggaggctgaggcaggaggatcacttgaaaccaggaatttgaggttacaatgaactatgattgtgacactgtactccagcctgggtgacagtgagaccctgtctcaaaaaaaataaataaataaataaaaatgaattttaaaaaataaagaaacaggtgaaattattattattattattttttttttttggagacagtctcactctgttactcaggctggagtgcagtggcgccatcacggctcactgcaacctctgcttcccaggttcaagtgattctcttgcctcagcctcccgagtagctgggattacaggcaagcgccaccacgtccagctaatttttgtatttttagtagagacggagtttcaccatgttggccaggctggtctcaatctcctgacctcatgatcggcctgcctcagcctctcaaagtgctgggattataggtgtgagccaccatccccggctgaaattaattttatttattttattaatcttttatttaactcaatatatccaaacattatttcgccacataatcaatatataaaattattattattatcattattagtgacagggtctatctctgtctcccaggctggagtgcagtggcactatcatagctcactgatgtctcacacccctgggctcaagtgatccttctgtgctagctctccaagcagctaggactatggacatgcaccactatgcctggctaattttattttattatttatttattattggtttttttttttgagatagagtctcactcttgttgcccaggctggagtgcaatggtgtgatatcggctcactgcagcctccacctcccgggttcaagcaattctcctgcctcagcctcccgagtagctaggattacaggcatgcgccaccatgcctggctaattttgtatttttagtaaagatgggttttctccatgttggtcaagagctggtctcgaactcccgacctcaggtgatctgcccatctcggcctctcaaagtgctgggattacaggcgtgagccacggtgcccagccaattttatttttttaattttactttatttttattttattattattattattattattattacttgagacagagtctcactctgtcgcccaggctgaattgcaacggtgtgatctcggcttactgcaacctccgcctccaaggttcaagcgactctcctgcctcagccttccgagtagttgggaatacaggtgcccaccaccatgcccagctagtttttgtatttttagtagagatggggtttcgacatgttgatcaggctggtgtcaaacttctgacctcaggtgatccactgcctcggcctcccaaagggctgggattacaggcatgagccactgtgtccaacagttttatttttttatagagacagtgtcttgatatgttgttgcccaggcttatatataatatttgctgagcatggtgggttatgcctataatcccagcactttgggaggctgaggtgggagaatcacttgaggtttggagtttgagaccagtttggacaacacagcaagacactgtctccaaaaaaaaaaaaaaattaactggacatggtggcccttgcctgtagtcccagctaactggggaggatgaggtgagaagattgcttgagcccaggagttcaaggctgcagtgagcttgaacacactgcactgtactctagcctggatgacagagtgggaccctgcctctaaaaaaaaaaaaaaaaagctacaggggtccgaagtttgtttaaagcttttaaaaaggcatttgtggccgggcgcggtggctcacgcctgtaatcccagcactttgggaggccaaggcgggcggatcacctgagaggtcaggagttcgagaccaccctgactaacatggtaagaccctgtctctactaaaaatacaaaaaaattagccgtgcctggtggcatgcacctgtagtcccagctactagggaggctgaagcaggaaaatcgcttgaacctgggaggcagaggctgcagtgagccgagatagcgccattgcactccaacctgggcaacaagagagaaacatctcaaaaaaaaaaaaaattatttgtgtctggatgtggtggctcacacctatgatcccaacactttgggaagctgaggagggaggattacttgagaacaggagtttgagaccagcctgggcaacatggtaagacccccatctctacaaaaagttttaaaataaattagccagacatggcggttcgcacctgtagtttcagttactggggaggctgaggcaggacgatcgctgtagcccaggagttcaaggctgcagggtgctacgatcatgccactggactctagcctgggtgacagagggagactatctcaagaaaacaaaacaaaataaacaaacaaaaaaagtgtttgttggagaagctgacatttcctccttggaactgatttcttctggaatgggtcaagaatgttcgttcccttctgaatgtccctgttattgttcttctgtcttgataaacactgtcaaggaagatcagattttctctggcctggagccaggttagtggaaaaatcctttgccttgggccccctgctctggttcactggggcagtcctctgatcactgactgggatcaattacctctgcggtagcccctaaagggaaatgcagaattgctgaactctggaagggaaggagaggtttggtgagccatcattatagacactgtgctagtggcattgcactgcacatgctatctttttgcttctttttttttttttttttttgaggcagagtcttgctcttgtcacccaggctggagtgcaatggcatgatctcagctcactgcaatctctgtctcccgggttcaagcaattctcctgcctcagcctcctgagtagctgggattataggcaactgccaccacgcctgtttattattttgtatttttagtagagacagggtttcgccatgttggccaggctggtctttaactcctgaccttgtgatctgcccgcctcggcctcccaaagtgctgggattacaggcgtgagccaccacgcccggcctctttttgcttcttaccagcaccatctgagctaagcatcagcacctgcaaactccacagaggtgaaaagtttccctgaggggcctgtaactagtaacccagaactttctgaatcagagcccaggatcacagtattccagacttcagggattttagtgctttctgccacccagggacctgggaacaagtgttatccagcaatacattttcataactgcattttgtttccctgtgagctaggcctggcatggttgatctcagtctctagaaactggagtcagatattcaagacattacaaggagatggctggtggggcatcatggctcctaggactttgggaggttgaggtgggaggatcgcctgagcccaggagtttgagaccagcctgggcaacatggtgagaactcgtctctatttaaaaaaaaaaaaaaaaaaaaaaaggctgccctttctagatcaggaggtccagcctctggaaacctcggagggctgcttgatctttcttttctaattcctgacaagttagaagacctttggcttctgagaaccctattactttaagtttaagctcttgtttgggaagccactgggaggacagtgaagaatgcccgcctacctggggaaacctgagttaggtgtggctggagcgactcgagatgcgaggtgggcgggggcaggctgaaagttggagcaagcaggaagtgaactgagggccaccctgggaggaagccgactaggcgaattcacttactgaccggcctgggctgctctgagacatggtgagccaactgggaactaggaaagggctggtttaaagaggagccagagggggcttgggactgggggttggctgtgtcgggggaggagagttggtggcaaagttagagggctgggccagtgctgctatggcctctcttctttgacaacttggctgcaaatagctctgagctgtcctggcaggtgtttctactccttctccctccctcccctgacctctgtgctggtggggagctgggcttccgtgccagcgccgatgggggctccgaattccaggcaaagagttgttgtgccttcctcctccagggagcccgaggcgggtgttgtgacaccacaccaggcagcgcctgggcagttcccagttcagattccagcccagcggcagaagctctcctctccggcctttcactttatccccacacagaaacacaaaggatttgtgtgtccactgagtcctttgggtgtcctttctccattaacatggagaagagaactaaaggtttataagagaaccagaagttggttctctgtgataatgtagttctgacccatgccactggcctatttttggaggtcaagcggggaggagctaaatactatttttctctccttgttcaaaaaccttgtcatgaagcctccgagatgagacatcagccagggaggactagtcctccatttcccccaacacccaggcgggtatttttatttaatatctgcataagcaggcggttgcttggtgcctgcacgtgtcgcccagtggtggggaaagcagaagtgtgtggctcaacggctccaggcgccttctgggatacttggttgcctgttgttctgggtcacagcaatggcattgcggccagggccgtgctccggcagctggcttagagggacagatgggtggggctgggtgagggtgttctgctggccagcacagacactttcaaccagggtcccaagaaatcaggaaaggggggtggctctgggaattgtaaatagtggcgggctctgctctggaagggaacattgtgagatgctggccctgctgtattctacggccctctctagggagcaaggaagcagtggggagggatttagtgatgtgctgcttttccttgtcaggggccctaataaccccaaaagaagtttgatctagtctgttcagcatcacatctcaccttctggggcttacaaatgcatttatttttgattacagaagtaatacatgaaaacattctctttgtaaacatttcaagcattttacaaaaagcttaagtctgcctgaggccttaccctccccagatctctgagcccaagtctccagttcccccaccacttggtctaattaaccccgtgttgccgcacaggaggaagccagtgaaggtggaggaaatgatcgtgtgcggaacctgcaaagtgaggtggagggagttaagaatattatgacccagaatgtggagcggatcctggcccggggggaaaacttggaacatctccgcaacaagacagaggatctggaagccacagtgagacagggagcccactgggggctggaggaaaacagggagggagggaatttctttttggtggggcaaaatggacaggagggccagaagtttgacatttctgttgcctttcacctggtttgggagctgatgtgagctgagtctccacttctgaatctgctctgctccacagattgttatggatcccagggaatggatcccatgactggggcttgaggtggcagctcgcccatagaggcatgttctgagaccgaaagctcagtcagcccatgcattctcaggcttctctcccgggaaacttgttttccctttgaagcctgcccatgacaatcatctgggtctgaccttcccagggcagaaatattggctctgaggaaacccccgctgtggcctctagccttctctaggagctgttagacaaggggtgggaaattgctggcgtcttgctgagtaggctttaaaaagaagggggaaagagcagtgaaatgctttgatcccagggtcccctgctagatgaaggctaaaataatatctcccacacatcttgctagacctcattcttctctctctccagccaggggctgaggccagctgtttcagggaggaagtaactccaaagttgagcaaagtctggagcctcaagttctgtgttcagcggggaggctggctctggctttctgagtcctgtgtgaactcttggctcttgggtattgctcccttgtctccctggggctcattgcctgtttctgtagcttaattgtagcttaatttggggagcatggccccgggaattttttttttttttttagacagagcctcactctgttgcccaggttagagtgagtgcaatcttggctcactgcaaacttcacctcctgggttcaaacgattctcgtgcctcagcctcctgagtagctgggattacagtgtgcacccccacacctggctaattttttgtatttttagtagagacgaagttttgccttgttggccagggtggtcttgacctcctgacctcaggtgatccacctgccttggcctctcaaagtgctgggattacagacttgagccaccatgtctggacaagccccaggaaatttagtgtctataacttgaattgctgggcatggggaagagtgggtggaggaggaggagttcccttacttccaaccctctatcctgtcctggtccctcctccagcctcagcagtcccgatggggcaaggagtcctggagctgcgagatgtgcccacctggagcctgcacccctcagtcccagggtctgccctcccaagggcagattttgctgccagtgttgtacccttgggtgtaagcaggtgtcgaggacccctcagtgtgcaggggtaagaagagaaaggggacccctagtcatatctaggtggagacctcctaggatcctgagaattctaaatttcaacccggccttccagatttttaggaaggtacatttgtcaaggtaggcagatacagcatttttttttttttttttttttttttgagatggagtcttgctttgttacccaggctggagtgcaatggcgcaatctcggctcactgcaacctccgcctcccaggttcaagtgattctcctgccttagcctcctaagtagctgggattacaggcgtctgccaccacacccggctaattttcttgtatttttagtagagagggggtttcacaatgttggctaggctggtcgcgaactactgacctcaggtgatccaccaacctcggcctcccaaagtgctgggattacaggcgtgaaccaccgcacccggccagagcatcttttatttagcagtttgttacctcagcttacagtgtcagtattaagatgtatggcttgagctgaacgtggtggcatgtgcctgtagtcccagcactagggaggctgaggtgggaggattgcttgagccctggagatggaagctgcagtgagctgagattgtgccactgcactccagcctgggtgacacagccagacactgtctcaaaaaacaaacaaacaaggccaggcgtggtggcttacgcctgtaatcccagcactttgggaggccaaggcgagtggatcacctgaggtcaggagttcaagaccagcctggccaacatggtgaaacctcctctctactaaaaatacaaaagttagctgggcgtggtggtgggcacctgtaatcccagctactcagtaggctgaggcaggagaatcaattgaacccaggaggtggaggcagcagtgagccaagatcgagccactgcctgagtgacagagcgagactccatctcaaaaaaaaaaaaaaagtatggcctgtgggctgcacttgtactcttataatcttgttccagtgggaggagccactgggtcactcactctgccttttccccaacagtctgagcacttcaagacgacatcgcagaaggtggctcgaaaattctggtggaagaacgtgaagatgattgtccttatctgcgtgattgtttttatcatcatcctcttcattgtgctctttgccactggtgccttctcttaagtaacagggaacctctcccacctgcccttctcttcagggacaaccctccataaatgtgtgccaagagggtctcctttcctgtcttcctctacagagaatgctgctcggtcctcctacccctcttcccgaggccctgctgccatgttgtatgccccagaaggtaccttggtcccccggaaggagagaaaaaagagagatggactgtggctgcatttcttgggtccttagagtgggctggagagacctagagggcccagcatgtggctgggaaactgttggtggccagtgggtaataaagacctttcagtatccctatatgtgtgaggcactttctctcttcccattttgcctttggcttttctatttcttttcttcctgaggataccttctggctaaaattctctcatctgaggtccaagttgttggaagggcaaagagtatatgtttggagaagaaagttggagcccccaccctgtctttattcctcccagttccattcattgtcacaggtctcaagaacaagaattttctgggagtcttggcatatggaaagttcaaaaccttcatagcattttggggtggtatgcaagatttttaagtgttcccattgggtcctgccatggccctgtagtactcttcttctggaattgttagctgaggcatgaagctggttgaaatcctcctgcctcttccaccagagccatctctcttcaacgaccctgtagtctagagccgaggggtggaggaaatggactgctattcctttccttgtgcttctgcatgttttatttgtcttttctctgtccttgtcttctgggacttagcaaggcctctgggtctcagttgtcctgagggggcaagcatctctccttggcatcccatggctgggcacagtcagtcagtcagtgtcacaggacagggccaatggctcttcttcccctctgtgcacaataagcctttctgtcttcaggcccccctcctccctaccaggttccaccatcactgtcactttttccagtgcccagtccgccttggtttgcagggagggttcttgctatctctgttcctgtttcctccacaggctttccagaattggaaacaacctgttgtcaggaagaaggggaagggttgagagtcagggtttgggaccagattggcaagtcaggctctggaagaatcatgctctgaaatttggggagggaggaggaaaggtcagaaaagacccttgtgatatttttatttttattttttcagagataggatcccactttgttgcccagactggagtgcagtggtgtgatcatggctcactgcaacctccatctcctgggcttaagagatcttcctgcttcagcctcccctgtagctgggaccacaggtgtgtgctaccacacctggctaatttttgtattttttgtagagacatggtctcactgtgttgcccaggctggtctcaaactcctgggctcaagcaatcctaccaccttggcctcccaaagtgctgggattacaagtgtgagccactgtgcccaggcttggggtagtctttgctacaacatgttaatcctctctctcctggattcaaggtgtaaggaactgaagtgaagcttctgccttgggacccaggctgtccaaggtgggggtgagtgtctgtgaaaccctcttggtctgggacttctgtattcacagaggctcagccccagagagggaaactttcaattctgttggtcaagagaggcctcacttgagggaccaggcccagtggctcacacctgtaatcccaacactttggaaacctgaggcagaagaactgcttgaggccaggagttcgagaccagcctggtcaacatagtgagaccctgtctctctcaaaaaaaaaaaacaaacaaacaaaaaaaaaaaaacgagggaccttattttaagatgtccgaggcagcttggagtagtggagaacaggtagctggtggtttctctgtagcagtgagaggacaggatgggtagattcggctcaggaaggctctgaagtggtagtagatacaccagcctcccccatcctctgactgaggagcaagtgcatggcgggtgcatgacagcacagagctgcacttgccctcatggtgaggaaagacatacagaaaggctagagctagtactttgcccatgtggggctgctttctttttgaatagaggtgaaagtcacacaatgtacagtttgttattttaaagtgtacagatcagtgacatgtattcagaatgttgtgcaaccaccacttgtctttagtttcaaaactttttgggtgcctgtttttggttctgggtgagatgcactcaccagggtgataaagaccctgcctggcttgttcatggcgtctccaggacctagtatggtgcctgaccgtggcactcatagggtgtttgttgagtgaatgaatgatgccttttcagctgaactcgagctagaagactccagggctcactccactgtgcccattccacagatccggccccgaggtgtgcccgttcaccaggcagaggtgtcatccgaattcaggctcctggggcccgggagggtccgactctacggacccaggtcgctgtggcccatcgctttcgatttgacttggtttctgtcgccactcgcggaaggcgcgccccccgccctcgctcggcggcccgccccgccccgcccctgctcttcctccggggccgctggcactgcggccgctccgcaggcagagaagccgggagcgggcgaggcggcggcggcagcagcgatggtgagggcccaggcggggccggccagccctgcgacgggcagagggcgagtggcgagggtgggagagaggagtccaaagtccgcgggctggggcctcccctggggcccacgagggccagacctgaggcggtgaccactgctggagcaggacggggcggaccctccactccctgcgcgccgcatgggagagaaatgcgtgagccccgtcctggctgcaccgcgcagagcgagcgggactcgggctccccattctcctgaagcaaagcggttaagagcaccgactttggagtcggactccgggctgggatcccagctctgtgacccgggacaagtcacttaacctccctgagcctccttttccgcgtctgtgaagtggggtcagtaatacctgccttgttgggtccttgcgaggttaaaggagccacagtggcagagacccgcctggcactcagaacccactgctaagaagtggtaggaaatgtaacgacctcgtcagccctttccgcagctgtgaggagccaagcctggctcaggagttggaaacttgagcagatggggtggcagaggccattccagccccatggcagggtgttggagggcgaactcctcccctagagaaagagaaagggagatgtttactctgaaagttccactgaagttatcagtgtatggcacaggcctgactccctgctaacctctacctagtgacacattcctgagttgagtcatccccactcctgctgcagatcctggcctttgtcctcacttgccatctccaaggcaaagatgtcaggaacagctggtgccagtttctccctttccctagggctcctgggaaaatggactgggcaggaagtaggcttggtgctttaagattttgccttggagaaactgacagaggtgtgatggatgtggcctggctaggggtcaatgcctggatggccttatctccagggaacttggaggcaggaagaggaagtggggcaggaaggtagcactgagctctgaggccaggccaggaagctgaggaaggctctgagaatagggcagagcccagagcccacttaagggtgtgcagggcaaggggtcaggcaggggtaggggtgggcttcagccggcccttagctctttgggagaagctcctgaagtgaaggctgaaggcaggatattttattgggggaggaggatactgggaaacctggggattctcacgggtacatttgaggcagtctgtggaggagaggctggggaggtcgctcctccacccatccatctcctagcctcttcctgtttcttctttcactcttgcccctttagcgctttccttccttccacccatcccctttccctccctggtccttcttcctttcacttttcttttcttctctatgactcattcaaccaacaaggatttcttggaaatgtccttcatgccagcatggtgacaagtataggggacagagcaggaacaaagcagtgatgggaaagatggaaatggaatgaataattacttgaattcattaatcttgtagatgatcctctctccaaagaatgtgtgtgttgagccacaggcctccctcatatgcacacaaattaggttggtagcatcaaccagattctttagccaatcagctaaagtgtctgacctccttgtacctgcatctaatttagcacacgggttacaaatgtggtgcctggagtctgtgttggttcaactcccagatcttctactcactggctctgtgatcttggacaggtgatttaacacctctgagccaaagtttcctataaaactgggaaaaggccaggcgcagtggctcacacctgtaatcccagcactttgggaggccgaggcgggcagatcacgagttcaacagttcaagaccagcctggcaaacatggtgaaatcccgtctctactaaaaatataaaaaaatagccgggtgtggtggcacacgcctgtagtcccaactatgcgggaggttgaggcaggagaatcgcttgaacctgggaggcggaggttgcagtgagctgagatcgcgccattgcactccagcctgggtgacagagtaaggctgtctcagaacaaaaacaaacaaacaaacaaacaaaataactgggttaataatatggccttcaatgggttgttgggtgaggattaaatgagacagagcaaatgaacagcaagcagcatagtgcctacctcagagtatgtgcccattggatggtggctgttattcttgctcaagatgtaaaacctcaacagcctgccgtgccagatgaaaataaactagatgcagccgggcgcggtggctcacgcctgtaatcccagcactttgagagagaggccaagccaggtggatcacgaggtcaggagttcgagaccaccctggctaacacggtgaaaccctgtctctactaaaaatacaaaaaattagctgggcgtggtggcaggcgcctgtagtcccagctaccctggaggctgaggcaggagaatggcgtgaacccaggaggcagagcttgcagtgagtggagatcacgccactgcactccagcctgggcgacagagtgagacaccatctcaaaaaaaaaaagaaagaaaataaactagatgctagttaccaagttaccaaaagcccatttaaagttctgagccacaggttagaaacaattatgtgtactatgtgtacaagtttgccatagggaagagcttgcttggctgtgcattttataaaacgaagaggttttactgaccacctgtattacacaattttttttttttttgagacagaatctcgctctgtcgcccaggctggagtgcagtggcccttagttcactgcaacctctgcctctcaggtttaagtgatcctcctgcctcagcctcccgagtagctgggattacaggtgcccgccaccacgcctggctaatttttgtatttttagtagagacagggcttcaccatattggccagactggtctcagactcctgaccttgtgatccacctgcctcggcctcccaaagtgctgggattacaggcgtgagccaccacacctggccatattgtacaattcttgagatctgactgctaaaaaaaaaaaaaggagctagggaaatgtgggccacatcaatataatagctcttatttattgagcatttagtatgtgtcaggcgttgtgctaagcttttgatttacaataagtcacataatccttagctaacattattatcagcactttacagaagaggaagtggaggtcagaaaggtcatatcctcagtctcagtcactcagctggtgagtggcagaagcaggatttcaacagacgggtgcaaagcagagccctgctcctagtctctgagctgagtgccgacttagggaggcaatgttataccggtacttgcgcccattcatctgacgacagttagaacagtttcttggatactagacaggagatggggagacaaggagagttaggatagggaggtttttttgtttttgtttctttgttttttcttgagacagggtctcactcctttgcccaggctggagtgcagtgcgcaatcttggctcactgcagcctctgcctcctaggttcaagcaattctcctgcctcagcctcccgagtagctgggactatgggcaggcaccactttgcctggctaatttatgtatttcttggtagaggcatgatctgcccaccttggcctcccaaagtccagggattacaggcatgagccaccgtgcctggcccagatggtgtggttttgagaactgcgttttcataggaggaatcaaagagattgagcccagaaaaacctgagaggtttgagtgtcatagaggggatattctgtacagggggcaacagtctgtcaagaacatttcctgtgtaactgccactctctggcaattacacaactgctcccctctcgccctggctcaaaattccaagccctgcaggcttctggcctcaggtctcagaaatgcctgtctcacccttcttcctttctccacgctctgcttgtcacccctctcccgcctggtggccatctcctggcagtcttgctgatggtacttctccacccctctggctggcctctctgccattttcttacttctatctgtgcctgtctaccaccaatagagaaattatcctgaagcacttcttcactgtcacccgtggctcaaaaaccacactagctcttaagttttatcagtcgcttggagccagtcttctctacctgaccttttctgccttctgtcctgccccatccctcccatcctctgcctggtcctcactgtcagggtgtatccctatctctcagtgcaagaatgtccctgctccatgtcatccttcaaggggtcacccgcccccaccatggcaccctctctgtggcagctctgatacttactatctgtatcgcacagtgtaactctttactcttctctaattgtattacatgtgtcttttccccagggcaaagtggtctctttaagaataggcacaattaggccaggcatgatggctcatgcctataatcccagcactttgggaagctgaggtgggaggactgcttgagcccaggagttcaagaccatcctgggcaacatagcaagaccccatctttaaaaatataggcaccatttattcaggaactgtttatcacatctctgctgtctgcagacattatgctgagtgacagtgtggcgtaaggcagtatggcccttgtcctcttgcttacctccttccagggtccctggagctttatttctcacagtgccagcagagacctgtgtatatagtcagtgtcctttttcctctggttgagtgggggccaaggagggcccgagacttgagtctaaggcctctgtgttccctggagcgaatgtgttcttttaggcctgggtccatcttggctccaggcaggcctggcttcgcattgggggagactggtccagattacagctggaagcacagccagctctttggagaatgtgacccaaatatcaccccttgttgaaaaataaggtaacaacagctgtagcatttagaatagaaaataaaaagataatatccagcattttcccagtctctagcagtgactcttattttcgagtatttatccattctcaagtttttgctttggactatttaattttgttttttgttttgttttgtttgctgagatggagtcttgctctgttgcccaggctggagtgcagtggtgtgatctcggctcactgcaacctccgccacccaggttcaagcgattctcccatctcagcctcccaagtagctgggattacaggcatgcaccaccatgcctggctaatttttgtatttttagtagagacagggtttcaccatgttggccaggctggtctcgaactcctggcctcaagtgatctgcctgcctggggctcccaaagtgctgggattacaggtgtgagccactgcgcccagcctgccttggagtatttgaatgtggggaagttcaaaggattgaatgatggagccttgttgaatgctatagtagtaataatagtgatgacggttgactcaggaaaaggtgagagtgcagtttccctgctctcttcgttgttcctctgtgtttcctgcttactgcttcctccagcctgtgagcgcagcctcccctacagtggtttgcctgacctctcttgaagcaggttgcttttctagctcatgggtaaatattgacctatttgggtttcaaatgcctgcccctcgaaactcatgcagggctagaaaaacatgctgggagaacatctcttgagaataagaattgcttttggttaggctgtatcgtaattggcccactcactgattccttgcttgcaatggtcagcactgtgctggcctcccggtgggatggtggtggacaaaggcagggcactgctccctgccctccctctgggagtttgtggtccagctggggagataggactcatacagtgggaattcttggaggctgtataccaagcagctgcaaggatcctgaaggaggattcttggctgagtgggaggtagccctctgtgaccaccagatctcttctaacacttaagttttctggttttaagtggaattcagtcaagtgccaaaatgtctgttgtagacaatgggtgacgtgggctggcaggaaaagaagcttgcccttcttgtaaggaggggaagggaacagggatgggctgtggggaagtaggctaagaggaaggagtttctgtggtttgctaatccactggtattcatctccctgaaatgtccctgctcctaggcttctggcttataccagggcctcctgcctggtgtctctctctgttacgtgcacccaaagcccagtgcctttcttgcacatgacccagactttctctctcccctgtcatttcaaccttccccagcttggatccaagacctcccttcccagtcctctgaaatgagctggtgttttctgttaggcaaagctgccccccaggctgggaaatccaagagttagtctcatctctgtaagttggaccccagtgaggaccccagctgagtggaaggctggaggccaaaaaccggtaccactgaggttcccagacggagagggaagttggagcagtgatatagggagcaggatcaggccaggaggcagaactggcctgaccagtcagaggcccaaagaggaagatctgagcttctcagtttggggatagaggggttaggcagagactatgatgtgtgctgcttcaaaattacctttctagcctgtagggtaggtctcctccctgtgtgttccagccaggtagcttggttacccattctttgctgccttcttaggccagtgggaaaccttagggcagctgtgcattgattgggtagacgccattctggagcaggtgagaaaagaatcagctttgtgggagggtggggtcctgggaagatcccaccttgggacagcttagaggaagctgaggtgctggaagccgggacttacctaggtcctaggccctgccttgacgtgcaaggggaggagcctgtgagacttaaggtgtgccgcactcaccccgaaggccagaccttcactccgcacacatcatacccttacacgaaggatgctgttactctcatgctgtacccacctacagggggagaaggaggcttctagatctcaggggcagatgagggccaggtgggggcctcatgcagccctgacctcgggcttggtgtccaggcaggaatagagttggagcggtgccagcagcaggcgaacgaggtgacggaaattatgcgtaacaacttcggcaaggtcctggagcgtggtgtgaagctggccgaactgcagcagcgttcagaccaactcctggatatggtgtgaggcctgggggagcatggaggggaggggagaggattgggaaagtctctcttgggctgtattcaggatctccagttccttggtggggttgaggccttcttgagggccagtgtggggcctctgggtttcctcaggcacccatagcctagacatgcaacagatagac

SEQ ID NO: 1201 - DNA, 23076 bp, Homo sapiens
tggctccgtccctcaccgggacgagaggtgcctccgcgtcgtcgtggtcgacgctggcgagaaggctccagctccggccgccgcacagagcggctttgccaccgggccccagtcagcgaccgggaccaccagcggctgcccacggccaggggccgccgggctgtacaggctgccatgtcccgcccgagcgcccgcccggctgctgacacagagcccgacccgcggccgggcggttccgccccagtcccacactgccccgcgcggcgtcccggccctcttggcccgcctggtcccaccccggagctcagagcaacttccggtgcgcttagcgttacttccggcgcgcggcgggcggaagtccgggttggggtcacctgaccggagagccggctagatatggcgtcctctttgcttgcgggcgagcgattggtgcgtgctttgggccccggcggggagctggagccagagcggctaccccgaaagctgcgggccgagcttgaggccgcgctggggaagaagcacaagggcggtgatagctccagtggcccccaacgcttggtttctttccgtctcatccgggatctgcaccagcatctgagagaaaggggtgagccccagtctccagtccggggtcccctccttgtgtccagatcgattccctcctgaggtcttttcccatcattccccttcttctacggagcactcatctagacaagtcaagagtcactccataaatcccagggccacccactttcttaactcccatgggaatttctcgtggatgacaaatttgcttgtgcagtttctgctcttttgagagccccctcttcacttccaggcacacctaggcccaattcacccttgagaaagtctaggtttttaccaaatacaaatatcacaggttttgtctcttctttttctccactttaggaatcagcttagcatagtgagcttgtaggaatccggatttctttccacctcaaaagcaagagtggtgaaatctgatactttgttttgtttgtttgtttttttaatataggatggcaaaagctgtgttgaaagatctggcctgagagtagcatgtgagttccagtcctagctctgtcactaatcctttgaaggagtcatttctcctcgctgggcctcagttcccttatgtgtaaagggaaggaacaggacaaactagcacataaggtattttgccagaagtaacatagaccagccagaagtgcaaagggtagactgctcaattattagaactagaaaggaccttagaaagagattgcctagtattagtgtcctctgagcatttagcatcactatgacctaaacttatttagggaagagctgttgtggccacagaactgatctaacccaaaggcacaagtaaatggcttacttgttagttataacactggcaggataattgagagctgacagctaaagtcacctgcgcagcactgggagatacctacatggaattatccaaaattcttttcaattgaaaatgatcctggaaatggattaatgtagagatggccctgttttattttggtagaaagaagggctacacccctcttgatcttaacccttcaacctcagctcgtggatcattgtgtttgtgaaaccttttcttctcagattccaaactatacctccatgagctcctagaaggcagtgaaatctatctcccagaggttgtgaagcctccacgggtatgtaagggatatgtttgtgagagtggttattgactgagttgggcttatccatgatacactgaacttataaatcaacttttaggcttgaaaaattgtttttgaaatctttgggatctgggggagccagatattgtcctccccatcagctgtttggaaaattgagatcaaaaaaaaaaaaaacagtttcaaagcactggagttacgactagtatgtgggtctcctgatacctttagcagtgctttacccctggaaccaatgattgtgatgtgctttctaacaagctgggaatatcattcttctcatttgatttttctgcttcagaacccagaactagttgcccggctggagaagattaagatacagctggccaatgaggaatataaacggatcacccgcaacgtcacttgtcaggtaaggacatgctcttcagtacgtggtctaggtagcccctcagagtagggccctgcagtggaagaagatacagagtttagaaaaaacatggaaacttggtttctatactgttcagggaccataggaagtctgcatacaaacaacacagttcccatctcattcactgagactctgggctgagatggtgaccaagttttaaacgtcatagaagtgggagttagccgggcacggcgctcatgcctgtaatcctagcactttgggaggctgaggtaggtggatcacttgaggtcgggagttcgtgaccagcctggccaacatggtgaaaccccgtctttacaaaaaatacaaaacttagcctggcgtggtggcgggcacctgtaatcccagctactcgagaggctgaggcaggagaatcacttgaacccaggaggcggaggcagaggctgctgtgagccaacactgcaccattgcactccagcctgagcaacaagagcaagactccatctcaaaataaataaataaataaataaataagtgggaatgaatcttggaggctttttttcttcttcttttttttttttgagatggagtctcactctgtcacccaggctggagggcagtggcaggatctctgctcactgcggcctccgccttccaggtttaagtgattcttatgcctcagcctcccaagtagctgggattacaggcatgcaccaccacgccaggctaattttttgtatttttagtagagaccacgttggccaggctggtcttgaactcccagcctcaaggtgatcctcctgcctcggcctcccaaagtgctgggattacaaggtgagccactgtgcccagccattcgagcatttcttctgacagggctccctactactctatggcatgctcctaccctggaacaggagagtagatgggtactggcagcctatgtcctctctccgaaatgcctgctctgtagtccagaaaagagtcaaaatggttccagacaaaagaatccatggggagggcagagttaatatgttggggaatagagagggctgagccagactgtcaatggatgctctctgagctgcttctattctgaatcatcttctttttctttttcccaggatacaagacatggtgggactctcagcgacctgggaaagcaaggtgaggtactaggagatcaggcttctaaaaccttttcctgagatgggtcatgacactcaggcttgttgtttgactgaaacccagttggtgggggagccatgagataagagcacctcctagagaatgttgaactaaaggtgccctctctggctcctccccaaagtgagatcattgaaggctctggtcatcaccatcttcaatttcattgtcacggtggttgctgccttcgtctgcacttaccttggaagccaatatatcttcacagaaatggcctcggtgagtaggcactgggcagggcagggtgccctggtgggggtgttagtgggtaagggaggacgtatgtgaaagtgccttgcacaggttaggtattgaacagatatttatgccattaataaggggagcattagagctttccagcagtcacgggaggttaggtaataaccccaggagaagccacattctcttttcttcccctcccccaacttagagggtggttggggggctctccatcctcattaaagttgctggggtacagagctggttgttggcctgcatcccttaagcctggttctccccatctccagcgggtgctagctgcattgatcgtcgcctctgtggtgggtctggccgagctgtatgtcatggtgcgggcaatggaaggcgagctgggagaactgtaactggtgcttcatcatcaagtctagagaagactttgggggcttcaggctccaattggcagtcaccgactcagtcaacccatcagactttttgtattcagctccagttagtcagaagaccagcccaggccagctgctgtttctgtggggagccctaatcttctgtgaatttccaaagggagcattggaggagattgagataacacatctttaaaacagaaagaactggtcttggtctatcagtacctcttcctgaatctggtacccatctgccttctccagttcattctaaacactgctgggactagggtttttccatcaggagcaaatggaatccaggccttcccagaagtagaccatactgccttgaacttgtccatatgtacaaactgatcaccagctttctccatacatttttaatgcagacctgtaattgagttcagaagcctccaagaaaacagaaaggatcccctttctccagtttgtgctggaagaggagctgatcagagacatcaaataagagaaagatgggttgctagaggatggtagaactggaagcaaggcagctacctttttgcaaaaggaaatggtgttaggccccttttccagaagataagacagactcatagagattaaatgatcactatggtccttcttctgttaaatggagccaaagacgcctatgttgttctgaagtcttgtaatgtttaacttctgagaacttagattagtggtgtgatgatagagtctgtataacgcattgaaaagggtatcaggcttagttatttatccaataaatatttattgtatgcagggtattcctattttaactcctgtgacaacacaaagcatagcgatttccatagttctaactgttcagggtctgctcctcctggtacactctttttggttcactgtatgtactcctgttgtctttttttttttttccaaagcacttttctgttttcataaattatatactcattcactcagtggacacttcctctacaatgtttgccagtttctgttagttgggagaagtgtcagctgtgaaaagaaaaagtaggtggcattttacagtgtttccagtaacctgagctatataaaatttgtgttaaaaagctacactgggccaggtgaggtggctcacacctgtaatcgtagcattttgggaggctgaggcaggcggatcacttgaggttgggagtttaagaccagcatggccaatatagcgaaaccccatctttactaaaaatacaaaaaaattagccaggcgtggtggtacatgcctgtaatcccagcactttgggagaccaaggtgggaggatgcttgagttcaggagtttgagaccagcctgggcaacatggcaaaagcccatctctacaaaaaaacgcagaaattagctgacatggtagcgcacgcctgtagtcccagctactcaggaggctaaggtgggaggatcacttgagcctgggaggcagaggttgcagtaagctgagtaagccaagatcatgctattgcactctagcctggatgacagagtgagaccttgtctcaatgaaaaagcagggggcactgggaggggagaaccaaatgccctatcctccagttctcagcatatagaagggagctctctcatctgctagccactcctgcctcactgtgccatgctttctgtaatgcactctgggtccagggactgcttggcaggaggtgggaagaacaagaagtttagggccttcccagtttcttagggcctgtctggagagggaactagcgtttactgagtttttacgatgtgttacacaccatgtaaagccctttacctacattatttcttataccccaaacagagagcaaataagtatccccattttttagtcacatagagttccagagttgccacagttacatcgcaaagtcaggatttgaatccagtgcagaccgcaaacaccatggttttctctccaaagcagagcagctccagaggtggaggtgactggaatgtcctagattcagtgggaccaggagctgggggtgctagcagaggctctcatctccccagggtcttgtcagtcagagtcctaaacccttcaattaactatccctctaatcccagctgaagcctgggtaatacctcccaccaagaggtatctgtgtggaacctggccctatttagggattaggtgatggagataaatttccatggcaaacggccctcgtccccgttcgtttgcagagcacaacaatccagattaaggtacagagtttgggttttatttggagattagttggtattacaggtgatggtgataccaaaacccaatgctgctatacctgcctccatcccagatctgtcaggttgtctccacagccccacatcagagggcatccaatctgatctttgtgaaaattaaatcaacataagccccagcttcctatctttgcttcattactttaatgccactccctcttcacatccgtagttctgattaatttgtccaggtggtcgatggtcaagagagggggccctgacccataaagaagttggctctccagcagtctagatgaggagcagcactctcctctcctacctcacttagcagttagcaaggtaatggcctggagagacctcaggagacaggagcctgccccttcagaaggaggaggccatcagctggtgagaactggggaccaggcctggcaagagtggaggaaaacatgaccctcatctcatccttctgaaggtaccacctgccacaacaatgagcatatgccccaaaggggtcagggtgtggggtggcaggagccaggccccagtctgcttaggacctgcatctaggctggcctggaggccagtggaagggagggatgcctgagctaaactcctttcccgtagggaatccctttgcataaaaagtggggccagggaatccacttctgatgtgttcaatcccaggaggggcagggtgggccacaggagtcagaggaggggccttgcaagttctggacaaagactaggagtggtccacattgacgacaatggccaaggcatagatgaggtcagacaggctgcctagtgaagtctggggagtagctcgctctaaagaagggtggacctctgaagccccagctgatccccatggggctacagctttagccccttcccagccctgccgtggactcaagccaggagctggacaggagctatgtcgacacactgaggtgcgctgaggtgtgccgctggagggtggaggttggcctggcatttggggatcccagggctgctggagggtgtctggaagagaacaggagctctgggggcactcagacccagggcttagaattcctgacttcctgttcttgattattttggcccagcgcttctggaaccacacctgctaggaaagaagaaggggtctgttctggccccagcatcccctccacccagggacaggggaaacaacctgaaggcaggctacccagcgaaggggctgtgggccaagcctagatgttggctgtgtgagaaggggtcacagctcacctgtaccttggcctcaggaaggcaagtgacccaggccaggtgctcatgggtgctgatgttggggtagggccatgctgcaaacgccctctccagctccagtagctgccctttgctgaaggtggtccgctttctccggtgggaacccaacccgctgccaccgtctgcaggccatggtgggggtcaagctgggactccctgcaagagcctccacccagcctcaaagccctcaatcaaccccgaagtccctactcccacccctctccaaccgtcctcatcctaccatggcctgcgttctcaccctgcccacacttcccccatcagatcacctgctgaggatgcatccacagggctgggcatggagctggcaaagggtaaggtgccagagggccgtgccagagggccatgccaggctgtgcccacaccagacccccccatttgggttttatcatgctcagggtggctggccccgccttcaggagtggagaggtttagagtccagctcaagcaaggcagagaagtctcggtggggaagaagggaggctggaggccgggttgggcttatgagggtatgggtggggcaaattgtataccccctgcccctccaaggcctcgcaaaggaagctggacccagcatcccttctcaaacctcaaactggcagtctgtgcctgaaatcctatacttcatgaaaatcctcccaggggtccttccaggcagccaaagaaaaccatctctccagtgctcccaggcactggctgccccttctggagcccttagtgctctgaacctggctaccttcaggggagagggagtggagtcctctcccacaactggggactgggctggtgaagtgggacaggatgagaaggatggtagggtgtcaacgggatgaatgggagccagccgctgtcagcaggactggggaacagatgtcaccaccagattgccctcaggtctgctttagagctttgcctcatctaaccctttctctctctggcccctcaagagccagatggacttcctggggttcggaacctggaaccagaggaggttccacaggtgcagttgaggggttctaagaaagatgataaagatgtttatgtgtacagtattctcttccttggatatattctgagccactttttcttaaattttgaaaatttttttcttttttctttttttttcaagatggagtcttgctttgtcacccaggctggagtgcagtggcgtgatcttggctcactgcaacctccacctcccgagttcaagcaactccacctcctgcctcttcctccggagtagctggggttacaggcgcctgccaccacacccggctaattttttgtatttttagtagagacggggtttcaccatgttggccaggctggtctcgaactcctaacctcatgatccacgggccttggtttcccaaagtgctgggaccacaggcatgaaccaccgtgcctggcctaaattttctttttctcactctgttgcccaggctggagtacagtggtgtgatttctgctcactgcagcctcaacctcccaagctcaagcaatcctcccacctcagcctcctaaatagctgggactacaggcacacaccacccataagttgcccagctaacttatttatttttgtagagatggtgtcttgctatattgcctaggctggtctcaaacttcgggattccagcaatcctcccaccttggcttcccaaagtgctggaattacaggcatgagccaccatgcccagacaaaaattcccccccttttttattttgttctgtttttagagatagagtctcactctattccccaggttggagtgcagtggtacaataatagctcactgcagcttcaaactcctgggctcctgggccacttttccacaagaagtgtgtgcttttgaatttcctttcagtttctgcccttcactatctctcctggtcttgctgctccccatcctagaccctagacagagacctcaagaaaggctcaccctaggggtgggtttggggaagcacagtgactggttccccaagtgctcaggagtcagagctactaggatttcagatcaggatggacaaaaaagctgagccagaaccccaccaactcttgccccttctctctcctccaagaccctagtcaactccaaggggcaaagcaagcctcacccacggaggctggcctggtaactttgtcatcatcagaggagttcaagtgtctgcttagctgctggtgggttgctgggggctgcttagctcaagaggaagggtagctctcaggaggccttccccagccccaaaccggttcacagagaggtcctgagcacagagaggtcctgagcccaacatgggttggacacggcgaggcccttctctgtcccttctctgtccccctcaccaacccattctgacagtccagcttcctctcctttacccagacagggatgtgtctaccccagtcagaacaataattttaaactcggggctaagggacctttattgggctgggggaaggagatgggaggagggagctacagagggcccggccatgtgggctctgactcctacagatggccaggagctgggcagcccagccagtactgagcgatggagcgtgggtagggagggtccacagtgtccactcgccgtgtgcgaagattgactcggtagtacttgtctggaagagaggaaagcagaggatgcgtgaggcccagcctggccctgcccactcttcccttgagaagtctagggtctctcccagaagggaaagtgaacatccatgatgcagctaaggacttctggcctggctttctgtggtcactacttgcaggctgcgttcagcccttgtgcaccagggacagcaaggaaaacccaagctagaccagcttcaggggtggcagcggctcctacctccagagaagaagaagacactctggatgggttcacaggtggcaggcacaagccagtccatcctgtagtcatcatagttgttggctcccaagttgctctcctcactggagaacaaggacagccacgtggcgcgggatggccggcgggagttctggttgcggccacggctgtggcctcgttgtgaacggtagcctttgcggttgcgatgcctaaacctttgtttcttggccaaggaggggcggggtgccatgcctgagatgtagatgcggccagccatggctgcgtccacttgccctggcacaccgtgccagtcccggctaatgaactggggctgtctggtaccagctgtggcagggaaggggtgaatgagaggtcttgggggtccgaatcttgccccttccagcggggccattagagttcatctgctgcaccttgcccaaagacacacagcagcgaatggcagagccaggcctttgactctcagtccaattcccttccccctgtgctttccctccaccatatcactggtgtctcgaccccacccccccaggccccctaaactcctcagccacagcccctccctctgctggctgtgctctcagctgtgctaggcaaagtccaaggtgtggggtccaggtagagctgagctttccccaaaaggtcaacagaagcaaagtctggcctgagcaaacagactttgatcgatagctccacaaccacagccccctccagccggcctggctctaccaataccaaggggtttcagcccttttgagggagaagcaagacttgccctctctccataccagaggttctgccccagaagagaagctcgaagatgtcctcccagctgtcccgctgcatcatggcaaagtgttcaaacacagccgacagggagctgccttcacactcctcctgactgggctggtgctggaactggtactcccagtactgtttccctgaggagcagggtggtgggcattaggagggctgggccagggcaagactggagatcccagaggctgttgaagttaggatctcccagcatgaggtgggggtcaggggtgggcacatgctgaggcctgtccccagtgaaatgtgaaaggaatccaagactgctccactgcctgctcagtctcccaccaccccctgagtacccttgaagaagtagacccgctcccggccactgtagctatgggcagggagggccaaggctgcatccacgttgtccgggatgccatcgaagccgtcagagatatttcgggggtaatcagggtccaggacaccatcctcaaagcgccagtactgactaccctaagaggtggggaaagtgaaaaggggtatggaggccgctggctgggcacagaggcagagtcccttgccctaaggcagccgttcccaggtccaggttcactgcccaggacctggagtcttggggctgccctgtgctcacagagctcccaccaggtcctgcagggccctgggtccagcttccctgtccaccctgtccctgggagcaatagctctcaaaccctccctagatgctttctaccctggcccacagcccctggcaccttgaagaggtaggtcttcccctgacagttgatgcgggtgaaggcggcatcgatggggccctcgatgccccagacatctcggatgagcttggggtacccaggcctcactgccttttcgtccagttcatagcagtactgccctagagtggaggagatggtgtgagagcagggacgctcctggggcagacccgcatccccagtacctgccctggattcacctcggaaggcaaagagggaaccgttcttgaggtcggtgaaggcgtcgaagggcttcccactgcacagctcctcctctgctgggggctgaggtctccctggatgaagggtctcaggccttgagtctatcccctcaggcttagaggcgcccacctcaggcgcaggggcctcttcctcaggtttcagaacaggtgtctgctcaggattccctttggactgggcctggaggtcagaggtcagggaggggccccccacctgttcatggacagtggcattgtttttctcctcgccatcgtcatagaccgtgtactcatcctccggcatagtgaacacatccccgcgagtcactgcagagagtggatggtagtgagtctccagcagcagggggcaccccagcccacccacctgggctctgaacacaccttggggcttgcactcagccgtatagtctgtgcagcagctctggtagtaagagcagagctcgtcacactggcacttcttgtccacgttgaagccctcagtgcagcggcccttgcatgactctatgaggaaggagtgtcagtcggtgccaccaagcccagaccaccctcgccctccctacattgacccagatggccaccaacactcccctgtaccttggtcagccagagcaacccatgccagcagggccagtatgagaaggggtctcaggggtgccatggcagggcttctagctcagtgcctggcaagctgggctctggtctccctgaagtctccgctctgatgcctgaggaagggagggagaggcagagacagggaaggagggcactggagaagaggaactgccttttctgctgctctgtttgctcaacctccagcccatcccctctgccccctccagcggctgctgcagcaaaggtcacattcctggaacactgggcctgggcgagctgggagataagacctttgccaagctcagaatcattaggtcatcggaaggggaattagcaccgtggatctggagggcagaaagaaggctcattgggcaacagctttatctctctgagtcttagttcattttcagtaaaataggattaacaaagccttgcttcatggggtgttgggagattacatgaactggaccagacaaaatgcccagtagctggagcagccacaaattccttctccaaacatagctattgatccatgattgtttgatcagacacatccctggctgggtgctcattcgccattatttatttagggcaggaaaaagggagtgggaggagagattgtaagcactctggggaattttattttttagcataaaagaacaaagtttcatttctgggttcttctcttgggtgcatcaatctccccaggctggaaatttgggtaaatatcaacccactggactggatttaatttctgagtcttttctgagcaggccactccctgtccccaggctcagtctccccatctgtaaagagtgggcttgttcaacacacttttagactctcgagagaaatatgatccctctacctggaaaatgcccactggcatgaaacacctgattttgtgcccaatttcaggtgtccacagaacttctgaaatcctcccatcacctgaaaaaagtgatcctgagattttagctgactttttctgttctgtaatcagaggggactgtgatttgggccaatttcttcctcatgggcttcagtggagtcagctgtggaatggaacatcaattcccaccccataggcatgttgtgaggtttcgctaagaaacagccataaaagggccttaagagttatgatgattgttttaaccatttagtagggagggggcatccagcggtgttgctcccacgtaccgatgtcacgtggggcggggaggcggggcggagaacggagagcgtcctctcattctccacccccttcctccaagtccagcgcagggggaggtggctgcgactgactgaggggctagggaaggctggccaggggcgtgggcgtggctggggacggcttgggggtggggctgcgcaggaggctggaggagccccgcgggacccagaggcggggcgtcggcccggggaccactgctcctccggggcgtggctgcaggaggctggaggagccccgcgggacccagaggcggggcgtcggccggggaccgctgctcctccggggcgtggctgctgccgagcatctcccagctcagccgagcccgtgcccaggccacgctttgttccagccgccgcctcctctaccctacggcgtccggagccatccctcgcctgctcgctctctcctttcgcccactccctgcatctgggcctgcatcacctttgccaaccgctcccccgatcctgccgacactcctcccccaaacttctgaccggcacccttgcctggtacccttctctccattcctccccctccatcttctttccccgacccctctcgggtccctcttttcccaaaacccgggtctctccgcgtggccccgcctccaggccggggatgtcccccgcggccccgcgcccatggtcctgacgctgcttctctccgcctacaagctgtgtcgcttcttcgccatgtcgggcccacggcggggcgccgagcggctggcggtgcctgggccagatgggggcggtggcacgggcccatggtgggctgcgggtggcccgggcccgcgaaagtgtcgccgggggcaggcaccgaggtgcaggacgccctggagcgcgcgctgccggagctgcagcaggccttgtccgcgctgaagcaggcgggcggcgcgcgggccgtgggcgccggcctggccgaggtcttccaactggtggaggaggcctggctgctgcggccgtgggccgcgaggtagcccagggtctgtgcgacgccatccgcctcgatggcggcctcgacctgctgttgcggctgctgcaggcgccggagttggagacgcgtgtgcaggccgcgcgcctgctggagcagatcctggtggctgagaaccggtgagcgcgccaggccggggttgggagagcgccgcgtggtgtggacagttaagcgcctgcgttcccgtgtgccttgcgccgtgcctttgcctccctcacctctctgactgcctgcactacatctctgttaggggtcagcctgtctgtttcacagataaggaaactgagccttgggaaagtttagtgacttgctcagtggatcacagtgaactaagatttgctcccagggctagtggggtgaggaatggagttacaggacaggagtccgtccctggctctatggatggagatggcatcctattgccaattctccctctcccccgccccccaagcccacagctctccttcccaccggcttgggttcccgtctatgacaccttctctcgccatcatcccatccctctcccaatgagagaagaagggaaacacaacgctcagaaaagagggagggagacctctcctttccctcctccccaggctgtaaggcgtgctggcctgaggctgcttactcccttcttgccgccccaatccaacttctgctccatccttcattctggttcttgcaacaggccagacatgatctcattctgcagctgctgatgggaaacagttttctgctgggaggcatgggtgggggaagaggacaccggggtgcagagcccggcggggaccaggcagagtgtgtgttctctcccttcaccccacttagcaccaagatgccgcaagagggtcaaacagaggcctggttgccactcttgcatgtctcttgggatctctcctggagtatgaagacctccaaggactcactttccctcccttctgatgccagagcagaccaagctgtcacactccagtctcatgctgaagtctccagcttctcaagcttagaagagtttttggaagagtcactttcagctcatgcagctctcacaagtgtgaagggagtgggttgggggtgttttccttgccattttcgaaaagaaaaaaattacctggtgattggtggaaagatacaactgtcaaaaatgcatgaatgaagcaatttaggttgggagaccaagatagggttctgcttatttggcaagccattaacctcccatctgacatccgttgccatgatggggataggccatgaatttggagggggtagcaaataaaatatgtgctcactgggtgtggtggggtcaaggctggtaggtgtgccctgcaggcttgctatgtggagtcaggagctataactacaatccctggagagtgagtacagccagcagcccaaggagaggagggttgcaagatgcaaacagtactgctatatctcaaggttaaaaatggcaattctcacctggttcagagttaccgagagaagagtcactaaccagtgtccctggtctcaagaaacgcacgctggtctcttcaggaccaaggacagagcacaacgtgcgtggttgctatcacaatacttccaaagaaaggcaggatccccgccaggcgccgtggctcacgcctgtaatcccagcactttgggaggcccaggcgggtggatcacctgaggtcaggggttcgagaccagcctggccaacatggtgaaaccctgtctctactaaaaaaaaaaaaaaatacaaaaattagctgggcatggtggcgggcatctgtaatcccagctactggggagactgaggtggaagaatcgcacagaacccgggaggtggaggttgcagggagccgagattgtgccattgcactccaccccacgctggatgacagagcaagactcgtctcaaaaaaaaaaaaaaaaaaaaaaggcactgtctataatcctagcactttgggaggccaaggcaggcagatcacctgaggtcaagtgaaacacaaaaattagccaggcatggtggtggtgcgtggtgtgtgcctgtaaccccagctactctggaggctgaggcaggagaattgctggaactcggcaggcagaggctgcagtgagctgagagcgcgccactgcactccagccttggcaacagagtgagactccatctcaaaagaaaaaagaaggggagggtccctgcaccccttgtaggctgcatgagaatggggctggaaagaagagaaggggagtgacacactgcgaatttatgaaatgtttttctccttcaccaaccaagcccccactgcctcatctcaaagaaggctcttctgggcaagcatggtggttcatgcctgtaattccagcactttgggaagctgaggtgggtggatcacttgaggccaggagttcaagaccagcctgggcaacatggcaaaaacccatctctacaaaaaatatacagattagccgggcgtgatggcatgcacagtcccagctactcaggaggctgaggtgggaggatggcttgagcccaggaggcggaggtcacaatgagctgagatcatgccactgctttccagcctcagtgacagagccagaccttgtcaaaaaaaaaaaaaaaaaaaaaaaaacaattccatcagtgtgcctacccctttttgccacttccctcttgctttcttcttctcaggatgctattgcacccattgtcaaggagcctaggtcacagttttcctgacttccaactaccagaagtccaacagaatatggctcttcaaatctggccccacaacacccagtgaggtccccatatgactgctagccctctatattcacagtccacccccttcagggaatcttaatgaagctatcctcagagtagttaaatggctttcccaggaatattcaatgaataaatggaggagacaggtttttgaaatcacagaaaggcggccaggagcagtgtctcatgcctgtaatcccagcactttgggaggcccaggcgggagattgcctgaggtcaggagttcgagaccactctggccaacatggtgaaaccccgtctctactaaaaatacaaaaaattagccgggcttgatgacgtgtgcctgtaatcccagctactctggaggctgaggcaggggaattgtttgaaccagggaggtggaggttgcagtgagccgagatcgtgccgctgcactccagcctgggcaagagtgagactccatctaaaaaaaaaaaaaaaaaaaatcacgaaagccattgcacataaattcaaaaaagtggaaaagcacacaaaaggtatacagttaaaagttattctcagccaggcatggtggctcatgcctgtaatctcagaactttaggaggctgagacagaaggattacttgagcccaggagtttgattgagaccagcctgggcagcatagtgagagccctgtctcaattttttaaaattaaattaaaaattttttaaaagttcttctcaaccagaccccctctctggagataaaccactataacaagtttcttgtatatccttccagagagagtctctgcatatacaggcatttgcatgtatattatatagacatgtttgcaatatatatacaatcttcccctcctttggagctgggatttgaatccagacctgtgtaattctaaaatatctgcccatttcaccagacccacagcctctcagaccacagaagaactgggagctgggtgagtagttatcacaagagtgcagcacagttccactctgtaaaggtgccaggtgcatagggaaaagtgagggctggggcatcaggagactcaaaataaagtcctaggtctgaattgatatgttcctgagcaagtccttcccttcgctgggcctcaggtaagtcctctgaaaatgagagtgttggctggccaggggcggtggctcacgcctgtaatctcagcactttgggaggccaaggcaggcgaatcgtttgaggtcaggagttcaagaccgcctggccaacatggtaaaactctgtctctactaaaaatacaaaaaaaaaaaaaaaaaaaaagagccaggtgtggttgtacatgtctgtaatcccagctacttgggaggctgagacatgagaatcagttgaacccaggaggtggaggttgcagcgagctgagattgcgccactgcactccagcctgggtgacagagtgagatcctgtcaagaaaaaaaagaaaagaaaaagtaagggtgttggattagataatttccttcttatcttttgtttttgtttttgtttttggtagagacagggtctttctatgttgcccaggctggtctcaaactcctggactcaagcaatcctactgccttggcctcccaaagtactggaattacagacatgagccactgcattcagccagattaaataattttcttattttatttttcattttttgagatggagtctccctctatcacccaggctggagtgcagtggcacgatcttgggctcactgcaacctctgcctcccaggctcaagtgattctcatgcctcagcctcccaagtagctgggattacaggcacctgctaccacgcccagttagtttttgcatttttaatagagatggagtttcaccatgttggccaggctggtctcgaactcctgacctcaagtgatctgcccacctcagcctcccaaagtgttgggattacaggcgtgagctaccgcacctggccacattagatatttcttaaacatatcctggctcttacattctaggcatttatgcagtcagatgtctagaaacgcaaaatgaaggtgaaggatcttgaactctggagacaggcagatctgggttcaaatctcagctgtgcctctcagaaactgtgtgactctgggcatgtcatgtaccctctctgagttttggttttctcattggtaaaaggaataactgggccaggtgaggtggttcatgcctgtattcccagcgctttgggaggccgaagtgggaggattgtttgagcccaggagtttgagaccagcctgggcaatataatgggatcctgtctctacaaagtaaaagaaaacaaaacaaaaaaaatcagccagacatggtggtacatgcctgtagtcccagctactcaggtggctgagttgggaggatgaatttaacctaggtggccaaggctgcagtgagctgtgagcttatggcatgttccggactcaggtaggttctgcagtggacacaaaatcacatgcactatggtcactgtggtgccctttgggcaaggactccattgctggctaggcctctacctctttggcagtaatgtcacctgtggaggacatcactttttttttttagacggagtctcactgtgtcacccaggctggagagcagtggtataacctcggctcactgcaacctctgcctcctgggttcaagtgtttctcctatctcagcctcctgagtagctgggattacaagcgcacaccactacacctggctaatttttgtaattttagtagagatggggtttcaccatgttggccaggctggtcttgaactcctgacctcaagtgatcctcctgcctcagcctcccaaagtgctgggattacaggcatgagccactgcgcccggccatctgtggaagacatcatttgtggaggtcagtaaggcaggaagcctgaacctctaccaggatgtggcaactctcccacctgctcagcaggcctccaagttctctctgttggatctgtcctctccaccacagccagagtgaattttctaaaacccaaatatggccaggccactcccctccctgagagttttcagtggcttctctttgacatcaagataaactacaaatgccttgaggtgcctcaaaaggtccccaggtccgatctcttttcacactctccccttgaatcttctgcctcagccatggaagtgtgggcagctccccaagtgcaccagctctccaacacctccaactctttgcatatacctgtgcctgaaatgcaactgaaatgcaatctctccttctcctcctgactaatgcccacactattctcttgccctaactccataaggaaccattcagtatatctaatgtgtatctttctatctgtgttctgctaaaatctttaaatctttattcttggtcttgtgtgcatgtatttttaatgtatattaatagtgctgtgtcatatagcacattctatttcttactttttcccactcagtgttgggttttattggtttttttgtttttgtttttgttttttgttttttgggttttttgtttgtttgtttgttttgagacagggtcttgctctgatgcccaggctggagtgcagtggcccaatcatgactcgctgtagcctcaacctactgggctcaaactatcatcctgcctcagcctctcaggtagctgggactacaggcctgtgccaccatacatggctaatttttttgattttgtagagacagggttttgctatgttgcccaggctatgttgtccaggttcgtgttgctgtgttatcacctgctcagtcacttggacctccctgcaaatcctacagagtaggcacctgcccatgttacctgactctccccaagcttgatactgattgcctccaacttcctcacactacaaatgacactgcagtgaacatccttgtctaagtgcttttctctatctatatgacaatctctttgggagaggttgcctgtattgttcagcttctgattttgcccatctaacaggtgtaaagtggtagctggttttctgtttgcttgttttctgccagtgaacattttattcaaggtatgtgtgtggagagtggtcagggacaaaggagagtgggaatggcctttgaaataaaataaaatgatttaggtgaagaaactctaggaaagggtaattttctccatttagatctttttttttttttttttttttttttttttgagacggagtctcgctctgttgcccaggctggagtgcagtggtgccatcttggctcactgcaagctccgcctcctgggttcacaccagtttcctgcctcagcctcctgagcagctaggactacaggcacccgccaccacgcccggctaattttttgtatttttagtagggacagggtttcaccatgttagccaggatggtctcgagctcctgaccttgtcatccacccgcctcggcctcccaaagtgctgggattacaggcgtgagccaccgcacccggcctagatcattttaagaaagaaaatgacagataaggtttctggtctatggaactaacaaacaagtagactattaatataatatcagatattaaatgccctgaagacaataaaataaggtaatgagttagaaagtgatggggaaaagcctttagattggatgattggaaggaagtaacatttgagcagacattggaatgacgaaccatgaagcggattttgttgaagaacatttcaggtagcgatagctattgttttaattttcatttctctgattactaatgagttagagcatctctttatctggtttttcaaattttggatttcctcttgtcaattgcctgtttatgtcctttgcccattttcttttgaatttgttgcctttttcttcttgatttgaatatttgctgatatattctacatataaacccctcattgatttttttcttttcttttttttttttttctgtctctctctctcttttttttttttttcttttgacacagggtctcactttgttgtccaggatggtctcaagtgagcctcccaccttggcctccatgtgccaggcattgtgccaagcattctacaggcatgagccaccttgcccagcctggttttatattttccctttttggttttagacatcgcaatacctctggcattctttctattcctcaaacacgtcagctcctctgccctcaggccttcatccttgctcctctctctgcctgttatgctcctccca

SEQ ID NO: 1202 - DNA, 44638 bp, Homo sapiens
acataagaaaacataaagaagttcatctactttgacctaatcatgtaattccccagaagcatcaaaaagatatattttggttgagtgaggatattcattgcagttttattttaatcacaaatgattgaaaacactccaaaaccccatcaattaggtgaaaaactacataatcatttaaaatgatatagaaagattttcattgacttttaaaaatggtcacagtatactgtaaatggagggggaaagcagcttaaaaatggtgcatgttggccggatacggtggcttacgcctgtaatcccagcactttgggaggccgaggcaggcggatcacaaggtcaggagtttgagaccagcctggccaatatgttgaaaccccgtctctactaaaaaatacaaaaaaaaaaaaaacttagctgggcgtggtggcaggtgcctgtaatcccagctacttgggaggctaaggaggcaggagaatcgcttgaacctgggaggcggaggttgcagtgagccgagattgcaccactgcattccagcccaggcaacagagagagaatccatctcaaaaaaaacacaaacaaacaaaccaaaaccaaaacaaaacaaaacaaaaaaacggtgcatgttggctgggcacatgcctataatcccagcactttgggaggccgaggttggaggattgcttgagcccaggagttcaagactagcgaccccattgctacaaaaaataaaaaaataaaaaattagctgggcgtggtggcacatgcctgttgtctcagatactcagaaggctgaagtgggaggatcacttgagcccagaaagtcaaggctgcagtgagcccagattgcaccactgcactctagcctgggcaacagagcaaagaccctgtgaaagatagaaaagaaaaaaagaaagaaaagaagaaaagagagggagaaggaaggaaggaaagaagaaggaaggaagggagggagggaggaagaaaggaagggagggaaggaggaaggaaggaagggagggagggagggaggggaaggaaaagaaaagaaaaggaaagaaagagagaatgtagcataagccagattttgtaaagcataatttatgtataaagactgcaagaccatgaggcaaaatgtcacaattttatctctgggtgatggccactcatgttttcgctttcttcttgcttacattttccaagttctcaaatatgtattacttttgtagtaagaaagttcacttagaaagtaagttaagtctgagttttctgcaaccagggtatccagaacttaaaaagataagcaggtagggcaggtaagaagtcagtcatgacattgtaagcattgaaataaaaataaaataagtcatagccaggcatggcctgtaatcccagcactttgggaggccgaggcaggcagatcacttgaggtcaggagttcgaggccagcctggccaacatggtgaaaccccgtctctactaaaaatacagaaattagccaggcatggtggtgggtgcctgtaatcccagctactctgcaggctgaggcaggagaatcacttgaacctaggaggcggaggttgcagtgggccgagatcgcgccattgcactccagcctgggcgacaagagcgaaactctgtctcagaaaaataaaataaaatttaaaaagtcatggcttttttccaggtcactaattgtctagtgagtctatgcattatcataatgtctgtgggtggtcaggctaaggagtgctttgccaacagtgaaaaatttttccagggagatacccgggagagatagtgaggcatctcaggaacttgagagttaaactaatttataaagttcatgcttgtgggggcaagatcagccatctggaaaagcacctcacctaagcagtaccttagacccgggtgagtgaagagtcatgagactcggtggagcccagccaatgtctggagcagaggcgtggggtggttttaactcatctgggaaggaagaggtggcagagggcagaaggatggagaaaaggtgatgagtgcagcaggtttagaatccggcatggtcagtgtttagcaggccccagtcaagggcagagggcaactctccctagggggccaccatgtcatcatcactcagagccttgcctgaggcttgtctagcatttaggacagttccggcagcataggcatcacttagagattgttagaaatgcaaaatctggccgggcatggtggctaacacctgtaatcctggctctttgggaagctgaggcaggcagatcccttggggtcaggagttcgagactagcctgggcaacatggtgaaaccccatctgtactaaaaatacaaaaatcagctgggtgtggtaatggacacctgtaatcccagctactcgggaggctgaagcaggagaatcgcttgaacctgggaggtggagattgcagtgagccaaaattgtgccattgcactccagcctgggcaacagagcgagactacgtctcaaaaaaaaaaaaaaaaaaaaaaaaagaaagaaagaaagaaagaaagaaagaaagaaagaaaaacagaaatgcaaaatctcagacccactccagacctacggaggcagaatttgcatttttacgagatccctgggagattcagagacacattcattacaagtgaagagtactgatttaggagacatacctccagtatatactccttgatgccttctgattatattcagcttcagattcataaaggctcccaaggacctgacaccttaggcagggcaacgtgaatcccagcctggggatgggcacccccggcctctgctgtgtgcagcatctgaatttgctttccaagtcacaatcccttattcaaaacatttggttccaagtgtgtttcagaattcagaatttttcataattttaggaaggtaagatgatgcatttgccaactctcccaattctcccagtgggatctggggcagtaccctatattcaaacattgatatcttgcagcttattatgaatattgacaccgaaaagaataaacatcacaagatcaggtaagttttggcaccaaatttaatggaaaaccttagttttcaggctgggtgcggtggctcacacctgtaatcccagcactttgggaggctgaggcgggtggataacagggtcgggagtgcgaaaccagcctggccaatatgatgaaaccctgtctctactaaaaatacaaaaattagccaggcgtggtggcacgtgcctgtaatcccagctactcaggggtctaaggcaggagaattgcttgaatctgggaggtggaggttgccgtgagccgagatcgtgctactgcactccagcctgggcaacagggcgaggctctgttgcaaaaaaaaaaaaaaaaagacagcaaataaactcacctaaaactttagacacagagataattgcccacacatttggattatagcttttgtctctctttacattttaaatatatattttatatattttaaaataatatatatactttatataatttcatataaaatgtcacactgtatgtagttttctagcctctgtttttcacttttcatctttttatataatcaaagagtcttctacagccttttcttcaaaatcaaggtagttttattgtattttggttgtaaaagtgataataggaaaaaacaaacatatatttgcttatatgtgcataaagtctctaaaaggatacactagttgctggtcacactgtttacctctggagggagccagatggaaggcagacagggacgagagaagaatttttattgtataatcttttagactcttgattattactttgtgaatgtattctctatttcaaaaataaaattaaaaaaactggtacatcctcactgcaaaagaaatcaagcaatatagaaaggaacaaagaagaaaataaattcatctttaaactcaatacccagatacaacactgttagtatttttgccacatttcttccaagtctttatctatgaatgtacagacatgtgtatggagatatttttaccaaaataggatgatgctgtacgatggtttttgttacctgtgtttttcatgtagggtgaatcacagacagcttccatgcagcctcattttaaacatctgcattgttattgcatgaagttagccagttaccaaaaaattaatccaggtgaactgagtccagcatctgaatacgcagtgccaggtaacaccaaccccctgatccaaagctgggattttcttttcttttcttttctttttgttttttttttgtttgtttgttttttgagacagagtcttgctctgtggcccgggctggagtgcagtggtgcgatctcagctcactgcaacctctgcctcccaggttcaagcaattctcctgcctcagcctcctgagtagctgggattacaagcatgcaccaccatgcctggctaatttttgtatttttagtagagacggggcctcaccatgttggccaggctggtctcgaattcctgacctcaagtgatcctcccaccttggcctcccaaagtgctgggattacaggcgtgagccaccgtgcccggcccaaagctgggattttcaatttgctgtctgtaggatcttgaataggcaggatgttatgttccagaacctggagagataacatatgggaacgggctggatgttccttctgtccatggtgtttaaacccatgtcgcttattccataggtacaaacacctctacctgcccccttcccctcagcctttatgcccactaccaccaggatgatgccagagagggccttggtggccagagccagtctgcatgtcaaagacccgagctcccatttgggctccaccacacactgagtgatcctgggaaagtcactttttcttctctgtagaacagagataataatctccatgatgcctttctcagagtgttgttttgttagaagaatcagataaggttatgactgtgaaagtagtatgtaaaatacagggcactctacacatagaagtttttattgttaaagtctggcctcttccctggagctgtcagggagaaggtagatgccaaaaccagctggcccagcttccttccgtgattggctcatggagcaaacattccccttgtgcacttttcaacatctacacactcatctttaaaatggagtgttgtaaaggtcaagggcacaaagcgttgacaagggcgtggaacaactgaaactctactaatgcttctgcacagctgctgggaagtaaattggtacaacctctttggaaaattgacagtatatactaaaactgatcatgtgaattcccctatgtacggcccagcaagtcctctgctatttatgtaataaacacaggtattgtggatgttcaccagaagacatgttattaagatgttcatagcagaactatttgtaagggtcccaaactagaaactacccccaaatgtccatcagtaattaaatggataaattacaatattttcatacaatggaataggatacagcaatgagagcgaatggtattcaactacatgcagcaatatggaacaatcttacaaacgtgttgagcaacagaagcctgaccaaaataagagtacatacttgtttcactaatctatacttgtttcgctgcataacaagtatagatcccaaaacttaatgtcttaaaacaacagatagattacttctcatgagaagatgggatagctgtgcaatttctcttctgatttcaccttagttgagtcataaggctgcactcagatgcagatttggctgggtgggaaggtctgaggtaccctcacgtgacctcattctggtgatgctcagttctttcccaggtggcctagaccaccttccttacacggcagtctgggggcagcatttcaagagagtgaaagtagaagctgcaaagttttaaaactaagggttgtaactatcaagagttgcaagggcccagcctcaggagcttcatcgtgtccatttctctgcattctattggtcaccccataagtcaaaaggccagcctagattcaagggtgtgaaaatagaccctacctctccctgagtagaagtcacattgcaaagggtcatgcatacaggaatggaagaaatctgtggtccatctaccacaataccctgtgattccatttatagaaagtagaaaagcaggtaaaatccactgaagctgttataaattctttgacgaatgggcctggagaggagtatgagagaccatctgggttcctgatgtgttctgcttcttcatctaggtactgatgactagaatgtccagtttatgaaattcagcaagctattaacttaagacatctgaaactttttacgtgattactatacttgaattgaaagtctaagttacatagtggttttaaaagaatgcagttcatttccctttccagttacagttccatccatcaggctggtggagctgctcatctcctcaatgttcctcaggacccccgcttccttctttcttgccatgccatcatcttgtcctcatcgagagttgaagctgttgctggcagtctgcattccagctagtggagaggatgcagaggggtagccctggacaagcacattccttgcaagctaataaggtggaagttacacacattacttccactcacaatccactggcaagcactgattctcatggcctgcctagctgggaatgtagtcttagctgggcagcctgtgccaaggatatgtgccaatttcagggaaacaactagcagtctactgcattttttttttaatggagtcttgctctgtcgcccaggctggagtgcagtggtgcgatcatggctcactgcagcctctgtctcctaggttcaagggattctcctgcctcagcttccccagtagctgggatcacaggcatgtaccaccacatctggctaatttttgtacttttagcagagataggaattcaccatgttggtctggctggtctcaaactcctggcctcaagtgatctgcccgcttcggcctcccaaaatgctggaattacaggcatgagccaccgcacctgccacagtctactacattactaataataaagctgctctttaataattatgttttcagaaggccatttggaaatagtttttatctcactgttggattataaaaacaccaagtgacccgagttctacacttttctgtgccaaaatgaagaacattaataataagtatccatttcccctcaagtatatatatttaaatcataaatatgtaagtaaatgtatacatttatttaaattttaaatatgcaattggccaggttccaagggcttatccaccttcctggaaaaaaattgtctttggaaaattccttgatatgattttagagggcagcctctaaaatgaagtgttcaatgaatgttcaaggaatgaatgaattttagcaacctgtatcttaggtgctgagagtatctgattagggcatatcagactaaaaaaagtcctctacaaacactagaatttactaatctattttctacttaaaatgcatagataatttgacatcaagcacatgtacagtttatggaaacaattttattggtaacagaaccctactaactcatcagagccccactattttctcccgtgtactttccttctcctggcagcctgtcccccttccctgggaccccctcccaactcattcccgtgaactttctgacttgctgcctctctcccttctgggaaaaagtgtcagctgctgcactaataatccagcacatgctacgactgtccctgagacagctgtctactgcccctaggcacttgggcaggggatctccttggagccagaaagttaataactggtcttgaagatacaaacaatgtcatggtctatgactttgtgacacgatgcaaaggaaagcgtttgggctttgagtcaggcagacccagattcatacctcagctcttcttaatatgtgtgtgactttgggcaaagtactgcatgtttctagccctcagcttcctcatctgtgaaatggaaatcacaatacagagaatattgggaataacaaatgagaataaatatatttagccctctgtagatgctcagtgaccgggcttcctctcccactatctctttgtctttccagagttgaaagacccataacaaggaatcaaaggagagtgaaacgatgactaaaggtttagaggataagatctaagaatggatgaaggaggccgggcgcagtggctcacgcctgtaatcccagcacttaggcgggcggatcacgaggtcaggagattgagaccatcctggctaacacggtgaaatcccgtctctactaaaaacacaaaaaaattagccgggcgtgatggcgggcgcctgtagtcccagctattcgggaggctgaggcaggagaatggcgtcaacccgggaggcggagcttgcagcgagccgagattgcaccactgcactccagcctgggcgacagagcaagattccatctcaaaaaaaaaaaaaaaaaaaaggatcaaggaatggtaaacgtttattttattttattttattttattttattttgagatagagtctctctctgttgcctaggctggagtgcaatggcacaatctcagctcactgcaacctctgcctccccggttgaagcgattctcctgcctcagcctcctgagtagctgggactacaggcgggcaccaccacacccagctaatttttgtatttttagtagagacggggtttcaccatattggccaggatggtctcgatctcttgaccttgtgatctgcccgcctaggcctcacaaagtgctgggattacaggcatgagccaacgcgtccggcagaatggtaaatgtttaatatggaaaagggaacatttagtctggacagagaggacaataaataattatggctaccatttgtcaccacctttcctggcatttacttatttatttatttattgagatggagtttcgctcttgttgcccaggctggagtgcaatggcacaatctcggctcaccgcaacctccgcctcctgggttcaagcgattctcccgcctcaggctccccaggtagctgggattacaggcatgcaccaccacgcctggctaatttttgtatttttagtagagacggggtttctccatgttggtcaggctggtctcaaactcctgacctcaggtgatcctcctgcctcggcctcccaaagtgctgggattacaggtttgagccactgcgcctggcctttcctggcatttaaaatagctatgtccagtcttcagaacagccctgtggcgaggtatgatcatgaaacccacgttataaagtgaagaggaaacagattttataacttgcccaagatcatccagctaaatggagaagtggagattcaaagtcgggtctgactctttgtactagcttaagaacagactctcagctggatgtggtggctcatacctgtaatctcaacacttaaggaggccgaggcagatggatcacttgagcccaggagttttagaccacacaaacacacaaaaaattagccaggtgtggtggtgcatgcctgcagtcccagctactcaggaggctaaggagggaggattgattgagccctggtgattgaggctgcagttagccatgatcacaccaagagagggaagaaggaaggtggctgtcagtcactggtatcagagacaagcagaggacagagaagacaaatgcaaaatctttctttggctgggacttgtcagaaagggaatctccagtgttggtgatggtgtcaccaacagcctcatgtgccttatgtgtgggcatctctgaaggcagaaagaactccattttccctggaggaaaatggaccagtgagcatgaggctgaggtctgactcctgggggccacacaggcaggcctgagcaccttgcccctcctcactgaagggggcttaatgtctggggcacagttgactccatccctctcttttttcctgtatgtggttttttgtttttttttttttcaagacaaggtctcattctgtcacacagactggagtgcagtggcacaatctcagctcactgcaaactctgcctcccaggttcaagtgattctcccatctcagcctcccgagtagctgggactacaggcacgcacgtacaggctggtcttgaactcctgacctaaagtgatctgcctgcctcgtttttcctgtatgttctaatgttatttcagggatcccctttgcctcactctggccattccaaaacatatatatgtttcatttatataaatccaaatgaaaatattaaaattgcaagtgagatatttttggccttaatctttgaatttcaatgttttcttatctgtagagctggtgtgctaactcctgtaattctgggcaatgcccatgtggttcttggctgcttcaagccatctcaggtctgattttcacacaagctcagcagcactgggctagaagggtaccgccctcccactctgctgccactttgaatagaagtccaagctttcgctttcttgccctgactttgattcttcacattgctgaggagcagtgattgaagcttaatctcattgtctacagtccgtctcctctatggagctgcactattctttcccatctcaattatttctgatgtaaccaaaacactctctctccccactgccttttttcttttgtaaagacttgcaaagggtcagttccagaggctcgagccctgtgttctgactttcacagacagaggcctgccactcttacatttacaggtcatcattctgagcaatacactttttttgaagagtagtcctaaaagctcactaaaaagttgcatttgtatttaacttaaatagagaaccttatgtgtagtccatgtttctggactctatacctgattttgaatcactggacttaaattattggacttacaacactgatacatcttgtaaatgaacctaagcaaagaataccagccctacatcccactcccctcaagataactgggaaagacacaaagccatgctgaggaggagccatggtttgatattgtccagtgagtgtctcttggcctcagaatgctgccacttcctgcagttccagcccttggctgtggtccattctgagtaagtgaattcctctgttaaaacttgcacacaataaggagatggcgtcaccaacagccagagaagtcaagggtcctgatccatccagagacaaggtgaaaaggcaggctgggggggaaagggggaccagcagattaggccaagagtgtagcatcatgaaatgtgatgtcttcatgagaaatgcaaggaaataaagcatttgctgtacatatctaacccgtatgagagagaccccacttcttcagaggaaagcataccagggaggtcagaacttgggccaactccatgacttcaatggtagagaatggcacacgggccaaacaggatgcataccatcaccaagaagtgtcggggtctcaccggctaaagacatgttacaaaggtgccctcagtcacctgcccagagaataaagcagggcccaggcagggaaaaacacacaaggatactgatctttagctgctggcttcctggggtcttgatgccttggagatggaggataatgggagagcccgaaaggcagtctttgggggtttcagctgacccatctccctccatctgcatcttagaggccactcttctaaaaactacaggcgcatacctggtgggcagggaatctgtgccacttggtcaggtcaacatttccagatctcgttctccctggtcagatttatgatcattaagtctaaaacatctgctctttttcctcaagcaacagttacacctgagtggctggagaagccactccaggtaacagtacagcaggctgtccttactatggaagtttggcttgtggccacagctgtttgcagaatgcccacaagacatggtcctgcctctattctctgagggaactaccctgtctcccttgagaggagctgagttctagaagactgttgtaggacagatttggtttaaagttctttaaggcaatgctgtttctgtctgtggcagaaccctgtgtccaggacagaatagatggaggcagtggggtgctggtaaaccagctttctggaagagaaaacaccaccaccaccgattcatagcacttgttaattttcatcatgtaaatacctccatcatgatcagatttcaggctaccaaaggtttaaaaaccagttcacaaaaaatcctgaatatttaacaatcggccagcaggggctggctccatccagcagatccaggactctggggagctgggttgcataagacatcttttttctctgatgctttgaaatgttatgagcttactgtgttcttaaacttcagctacagaatcaaaacagggcagagactttctgaaagtatccttactcccccttaccctcaccaagagctggggctttcattttagtccttgaaagaagacttgaaaagtcacaattcttgttctcttttccaaatattttgagtgtcacaagttagaatctgatgaagaacttcaggtagaaagaatgtaagagccaaatctacgtgagttctcaggaatgagtctatacaacatggtaccaggggatacaggggatagcatcttgacatcacctcttaagcatgagactggacagtggcagaagatgggtggctttgtaatgctgagcaatgggaagaaggagttttaaagaaggttttaggacttcatgtatcttttgaggagaactaacagcaggctgcttacctccagtatcttggttccaaatcttcaccttgcaatcatgtgatgaggtagcaattaaaggcatcaaggccaatgctcttggtagaaagacgcaggatgcgacagtctggaaatgccccttatactcacatattctgtttcgagtctgtcttaggtcccacaactgcaaagtaatgacatggaccagctcatagtcacttgtctagcttcatccatgaatatctatctccccctacccccatgatgcacctattccctccacttacctgctcacgtagctaccccttatcttcatccatccacagacccaacaacccatccatccacagacccaatgacccatccatccagtgattattttaagcctcaactatgtctcaaacaaccctggttaagaatgtgtcatatgagtttttgcctttttagtggttagggaagtaaaagctcccagtcctacagcatgatggtgttccatcatggggaacccatggggagccccaaacaacagtatggggttgtttgctttcatggcaactcaagagctgccttatttcaacctcttggcatctgtgggccctgtggggaccccgtagttagaagtaccccatagatataagtacatctaggtgcagacattctgatttaatgcctagatgctgaaccttgatgtgtgaagactagcgtctacaagagggaagtgccagtcagtgctgccagtcccactctcattgatacagatcagatcacagctggagaataatgttcagggaggagagcaaattgaattatgtccaaaaagataatgaagttattggacagcatgttatccagggaatagctgtaggagctggaaatgtttcacttagaaaagagatgctacattcaaaggctgcaacaccccaatctaccatttactagggatgtggtcttgtgcaagagatgtcaacttgccatgcctctatttccttgtctgtgaaatgggaattataatagtacctaactcatggggttgtttttaaggattaaatgagatattacatgtaatgtgctcatcccagtgcccagcacacaagaaatgttcaataaaataggaggcataattgttctgtttgaatactagataacccttttaatggatattctacaattatgaatctaaggtgctttggaggagcctaggcaatctattccaaaattaaatgtaaggaaggtacatgagtaagggatggagtaggccctggaccaacactagagctccaaatttcctaaaaagcttgagcttcttttactgtggccacgcctataatgggaataaatctggttcttcaaacagtccctcccctctctaagctctgctgggagtagagacatcagcaggctggttctgtgtttagctcctccccatcttgactctcatcccattcctctttcctactaccaattcagagagccctaagttgatgaatgtttcttttattttctttctttatttttttgagatggggtctcccttgttgcccaggctggcctcaaactcctaggctcagttgatcctcccacctcagcctctgaatagcttggactacaggcacatgccaccatgcccagctaactttttatttttttatagagacagggtcttgctctgttgcccaagctagtctcaaactcctgggctcaattaatcctcccgccttggcctcccctatgaatgtttcttaaatgaagcaactggaatgcaaaggatcactcacagtatgcttttgaaagaggcctgagccattagcaaagcccgcctgtgtagcacagctacaggcatgaggccagagtaagtgatctgttcatcagcaaccagatacctggacctcacacagtctcctaccgtggcttcacagccttctcctccaaagccattgctgcaggagatacacttgtgtccatccacactgacttcacagtaggtctgaatgtgctgctttgcaggaaacatatgagctacctgcagcccccgactgtcccataatctgaaagagattagggcaggaaattagcttgtagtaaatgtggctgaaatacacccgtattgtcccactaccaaaaaagtcttggctctttgctgcataggccagtcagattggaatggcatgatttacctaaaaacggcagcatgaaccagatcaatctctgagactctaaagttggcaggaagtaaccaaattgaatgacatctgagttctttctattttgagatcagttaatagaaattgagaccaagcatcttaattgtacaagttaatttgttaatttggtcctttgagacactgctttccgtggacaaaaggatatttctgtgcctgtgacttaaatttttaaaaagatacttattatgatatgggaaatcagtcatcattcagaattagttacaaaagatttacatacaggtcatggccagccttggctatggggtccactggggagtgttttgttttgcttcttatttcatttttacctctttaccccattcctaccattttctaaggagaatctcttctgagatccaaagtttctagttatcctctccggtctaagaactattggctttactgactcccctgatgctgatttcaaccctgcttccccagggagggcttcagctgaaggctgggtgactgagaacaccaggagccatgcaggggtagcaaggagagccaggcagcccaacagggtgggacaagcaagtgactgattctggggttaatctgaacaccttcacacagcaggagctggctgaatcagatgctttggaaccatccaaaacaggggcttttacttggcctgatctcatgacacacaacctctaccttaatgatccatggggccaaagcagagaggccccagcaccagtgaagggcagaggaacagaaggctctgggaagggcagagcaatgtggagaatcagagtgggaatggagccatgtatgcatgggagccacaaacctcacaagaaacactttcacagctgctcagtaagcccacctgagggttttatcttcagaggtctgtagtatgtatggttctctggggacccagcacaggtgagtgacctagaaaaagcaaaatgttcagaacttctccacaccaagtcattcctctgctgtaattcctgtcaaatgtgctaactagcatcactgtgcctcttctcaaggattctgaactagcaaattcatttacaggcatcttaggttttgcagatacctatcagtcatgctctacctgcatctcctaggttatcagcagcaagataacagctgggccagttgtgagcaccaaaatacatgcaggcaccctaagagtgcctgaaaccccagctgtgtggcagatagaacagctcctgttgtaaggtgggttcactgaaactctagccccaacacctcatggggatcaggaagagcattcatgtttctctttatccctgcaggtccctgctggataggcataaaatagtttccaaaataacccgaaataacaggattttcttttcttccagtaacctccaccaatatagagggcatggggcaagcatatctgaccattggcagtcatcttcaaaattagaaaagatgactgggactgaaatttgacaaccactaaaagaacatctagtatgggtcagacacaatgtcaggtatttcacatctagtatctgaattcatcctctgaagaaccttagcaggtgatagaattctccccattttataaatgaagacacagacactctaagagcttaagtaacttccttgagataacataactggtaagtaatagatccatgattttaacctgagtataactgactccaaaggctctccaatttataccagtctgctactagaaaacaactggtccttcaaaagcaatgcaaattctacataaagcaaaaggtaatgcttatttctccacatgatgttacacatatgaacatacaataagcataagctgtgaggtcctggaagacaggaactatgttcttggtcactaaccctgttcctagcacagtgtctggcccacagaagaaacagaataatgaaagaaataatgaagacaccattttaaattccaatataagtgagtaaaatcattgtctggagcagaagactcaagggaacatctaatctaataaccctgagaggccagggtctcacagcaggttaggggacagcaattgggacccaggctctaatttctgctcatgggcctcctgatttatctcccgagcctttccttcaccccatgctcctttctgctgccctgttctgtaccaagtttgagttcataccacgttcctggagacagatgctctttccacactctgtcctgtcaccacatcccacagaagcagggtgttgtcccgagagccagtgcacagctgtgatgagtctttggaaacaatggtgagaagacagcctgtgagtggggacctgaacggggcttttcagaaagcacaaaggcattgggaagaggtccgctttgttttacctggactcacagccaatccggtgaccaccatggcatggccacacaattgctgccttggttgtgaggaaccgtgcaagtcccacatcatgaccatcctgtcacgagaggcactgaagaactggctggatttgggaatacaggctacctgctcagggaaaaaacaacaacactgaaatagctctggtatgctagttggactggactttaaattgggggaaagatgagtctgcataactccctccccacacacacttcttttctttttttttgagacggagtctcactttgtcacccaggctggagggcagtggtgtgatctcagctcactgcaacctccacctcctgggttcaagcgattctcctgcctcagcctcccgggtggctgggattacaggcaccagccaccacgcccagctaatttttgcatttttagtagagacagggtttcaccatgttggccaggctggtctccaactcgtgacctcaggtgagccacccacctcggcctcccaaagtactgggattacaggcatgagccactgtgcccggcccccacacacacttctcaaaagagtaatacctaagcttgaaatctatgaatgcacagcatgggccagtctgaatttccacctttatcaatgttgtgctacctttcctttatgtagcagatttcctcctgtccttcagggtaaggttaaaaatctcacctcctcagatcatgtcaccttggtgaggatgtatcccctcttgggcttcctatagaacttcctcctgtgggattccttttgcacttgatcatcaccacaccccaaaaatggatgctgtactgttatgacaggtgattctgttatacttacgaagaatttgaagtgaatctctgttccattttatgctttttaccttgaatacaactttgcttgatattattatcatcccaactcctgctctgtttgtttacatttgcctgatatatctttgctgacctactcttcctgttctgatctcttccatcgtgtttctttttttttggaattgtggtaaatatacataaaacttaccattttaaccatttttaagtgtacaactcagtggcaacaagtacattcattgttgtgtaaccatcaccactatcatctctagaactttttcatcatcccaaactgaaactctacaacctttaaacaattactctccattttcctctccccgcagccgctggcacccaccattattctactttctgtctctatggacttgactattctaggtacctcaaataagcagaatcataccatatttgtccttttgtgtccggctcttacttagcataatgttttcagggttcagccatgttgtaacatgtatcagaatttcattccttttttttttttttttttgagacagggtcttgctctgtcacccagactgcagtgcagggacctggtctcggttcactgcaaccttcccttcccgggctcaagcaatccacttgcctcagcctcctgaatagctgggactataagtgtgcgccaccatacctgactaatttttgtattttctgtagagacagggttttgccatgttgctcaggctggcctcgaactcccgggctcaagtgatctacctgcctgggcctcccacaatgctgggtttacaagcacgagccactgtgcttggcctatttcattcctttttaaggctgaaaaatagcccactgtatgtatattaccgcattttgtttatccatgaatctgtcaaaggacatttgggttgtttccagcttttggctattataaacaatgctgctatatatatatatgtgtgtgtgtgtgtgtgtgtgtgtgtgtgtgtgtgtgtgtgtgtacaaatatctgttctatatttactaactgttttactttcaatcttaaagctgttttgcattagatatgtcttattttttatttatttattgagacacagtctcactctgtcgcccaggctggagtgcaatggtgtgatctctgctcactgcaacctctgcctcccaggttcaagcgattctcctgtctcagcctcctgcatagctgggattacaggtgtgtgccaccatgcctggctaattcttttttttttttaatttttagtagacatggagttttgccatgttggccaggctggtcttgaactcctgacctcaagtgatccacccgccttggcctcctaaactgctgggattacaggcatgagccatcgtgcccagcctagatatgtctcttttaaacaatgtacaggtggctttagtttttaactcagtaagagtactgcctttcaataagtgaatttatcccaattacatttactgctatcatatatatgtttgatcttgttccttccatcttttctgttggtttttgaaaaacactttgtcatattttcattgtcttctttttctataaaattgtatatttgtttttagagttatttttccctttatatttttaatttaaataatatggaacttaagttcttctcatgatacctctgtatatgtattaatatccttaaactcatattctcaatgtattaatttcagaaagaaaacagaatctcctgtaaggaaaattttttttttctttaattagcacaattatattacttctggctcgttcccacttttgtaagtactctcttggatttttatctagtctattatcatattattaatattttgtattttatacatataaatttttaaaagaattaaaacaattacatttcttctcatagccctcgttttgacaattctttagacataattctgtgtttaattggattgaaggctcatacagtgaattcagtttggaacttctttaatattcattggctttattattcatcattcattcacattctttattttttattttttattttttgagatggagtttccctcttgttgcccaggctggagtgcaatggtgtgatctcagctcaccacaacctctgcctcctgggttcaagtgattctcctgcctcagcctctcgagtagctgggtttacaggcatgcgccaccacacctggctaattttttatttttagtagagacggggtttctccatgttggtcaggctggtcttgaattcctgacctcaggtgatctgcccgccttggcctcccaaaatgctgggattacaggcgtgagccaccgcacccggcccattcacattctttaataatataccttcaactatattattgaggaatgctttgcatatggcaagattttacaaatttaagaatgtcttcccattgcctttacacatgaacaacactctccgcacatacagattctttttctttcttcctttcctttcctttctttctttctctttcttttctttctttccttctttccgtccttctttctttctttttctttttctctcttctttctctctctctctctttcctccctccttctttctttctttctgactgggtctcgctatgtcacccaggctggggtgcaatggcacaactatagctcactgcagcctccatctccctggcttaaacgatcctcttgccttagcctcccaagtagctttgactataggtatgcaccactatgaccaccgaatatatttgtatttttatttatagtagagacaggtcttgctatgttgcccaggctggtcttgaactcctgagctcaagcaatcctcctacctcagcttcccaaagtgttgggattttaggaatgagctaccctgcctggccaatttttactttttaataatattttttcctcaaatattttctctcccagataattcttctattgtcttacttttttttttgagactaagatcttgctctgtcgccaaggctggatgcagtgaaatcatcacagctcactatggcttcaacctcatggactcaagtgatccttccacatcagcttcctgagtagctgggactataggtgcgcacaactacatccaactaattttttaattttttgtggagatggggtctcattatgttgcccaggctggtctcaaattcttgggctcaagcaatcctcctgccttgccttgccaaagtgccagcattacaggcatgagccactgcacctggcttgtcttattttttcaatttcttgtttcatagagtacatgttctcttaatttatagagagtaaaaagcattaatcaaattttatctttgcttcttgagtagttcttccttcaaagtgtattttcatctgacattagcttgttatatgtatatttaaaaaaatctaggcatataggcctcactttggatcctttctgcttattaatcttttcatctttgaatgaggataagtccaatttttggcagtaaatccaataaggcttgatacatgctcaagtgttacatgcacacacacacacacacacacacgtgcacacacacacaagtgcatgcacacacactcacacacagtcaattctctctcactttctttccttttagtccaaggtctactataacttgacttgtcatgctgaatattgatggttgattatgtcttgatttgtcatcctgaatattgatggctgattatgtcttgtctaaatagctgagactacaggtgttcaccaccatgcctggctaattttttttatttttggtcaagatggggtcttgctatgtcccaggctggttttaaactcccggcctcgggcgaatcacttgaggtcaggagttggagaccagcctggccaacatagcaaaaccccatctctactataaatataaaaattagccgggtgtggtggcacatgtctgtaatcccacttacttgggtggccaaggcagaagaatagcttgaacctgcgagatggaggttgcagtgagctttgatcacacaacggggagagtgagactctatctcaaaaaacaaaacaaaaaattcctggcctcaaatgatcctcctgcctcagcctcccaaagcactgggattacaggtatgagccaccatgcctggccagtccttcggcattttagggtgaccagaagaaggagaagcaagctggcagcagtctcaattttgttacattgtcttgttttactggtaaacaatctatatctttagtcctcatctttctaaataaagggctgttgggaggaccattcaggaccagctcttttagtgacatctgcactctgccaaatatctggggataagtgcattacagcatggtgttctctatcagtctagttcagaacacaatgtatctggcaagcaaatatcatattctgtgctatgggattgtggctgatgcctagtttcattataaatgaagtgtgtatcttaatttttggttcatttaggcggacttcagagcggggaattatataaattggcattctctatcatttttgctggaagctcactctggtctgtaatgctatctaacaaataaatttttatttcattgttattgaatgttcattaaatgtccccaactagactagaaggttgctgagcacagggattttgtcactttcctagctatggtaagcacagggtaagcccaagccttcagtacagtacttgttgagtcaggataggtcaagagttgttatcagctgtgttctgtttactacctgtgctattaagggcttaatgacaaaagaaaaattgtgttcgatatgcctgtaacaacaactaagtgaatggtttgctctgtttctcctgaagtaggatttcacagcatcaaacaaacctttgcatttttccttaagaccaaagattcaatcactcttaatatctagaactattagctatcctttattcagttccagattgccttcataataatcatttgaaaattaccttggtgatctcatgttcatgtcctttgaaccttttcaccacatttccagttttccaattataggccacaactgtctgaagagagtgaagattgtagtttcattactcaattcttgttaaagtgacactagcctctactgcattctcaccttactttctccctcctcactcactccctctctgctcaggaacttgctcaaagcattcggggttccctgttgtggccgtccctcctcacgtgcccctcctttgagtttcttttctttcctcctggttgttctctgtctccctccgacactggaccactgctctaaacttactgatgggtttgggctaacattccccaaggagaactgattcccctggaggttctgactgtagatggtgaaggagaattccacataaggttagatttgttttccctatagtactgtatttttttgttgtggtgtttttttttttttaatctaccatttcaagctgggcgcagtggctcatgcctgtaatcccagcactttgggaggccaaggcgggcagatcacctgaggtcgggagtttgagaccagactgaccaacatggagaaaccccatctctactaaaaatacaaaataagccaggtgtggtggcacatgcctgtaatcccagctactaaggaggctgagacaggagaattgcttgaacctgggaggtggagattgcagtgagccaccctgcctggcctagattttaagacaaaatactgccaattaaactatgatacttcgatgcatcctgatttcagaagtgttaaaatgtgaaaagtgaaaacagggccaggcacagtggcgcacgcctgtaatcccagcactttgggaggctgaggcgggcggatcacctgaggtcgggagttcgagagcagcctgaccaacatggagaaaccccatctctactaaaaaaaataaaatacaaaattagccgagtgtggtggcacatgcctgtaatcccagctacttgggaagctgaggctggagaatcgcttgaacccaggaggcggaggttgtggtgagccgagatggcgccactgcactccagcctgggcaacaagagcaaaactctgtctcaaataataataatataataaaaataaaataaaatgtgaaaacatgcatcttagaaccagtggaatgcagtatgcaaatggaatttgaagattctaaaaggctattgaaaatgagagacattattattattattttttgagacagagtcttgctctgtcacccaggctggaggacagtggcccgatctcggcttactgcaacctccacttcccaggttctagcaattcttgagcctcagcctcccaagtagctgggattacaggcaagcgccatcatgcccagctaatttttgtatttttagtagagatggggcttcgccatgttgtccaggctggtctttagctcctgtcctcaagtgatccgcctgccttggcctcccaaagtgctgggattataggtgtgagccaccacacccggcccattattagtattattcactacaaaaagaattagcagttgtactaccagtatcccagctgtgagggctatgatagatcctaatatgaaggagagaaatgtgagaatgggaggaaggaagacaaaaacacagggaggaatcatgatgcataccagtgtagagagcataaaagaagagattagacagttccttttgctgacaattaactcctgtgtctccatgtaggtgtaacatgggattggtggtaagtataatctttgccatttatagaaagcatgtgggtggtcaggcatagtgttaagatctcacctacgttctttgatttaatctttaataaccacctgtgaggtggcattattattcccacttaacagataagactgaaactcaaaaaaatttaaagacttgtccaaacgaatgggaagtggccaagcagggatttaaatccagtctttctaactctaaagccaatatttttacacttgtcaaccctgctccagaaatgcaaatcctagacttcctttcaaaatatcttcctttccctgcaataaagttcatttcccgggaaacactgcaaaccccaccttatctttccctccagagacacaaaggtctgagttcaaagcagccacgacagagacggtatccatgtgagctgggctatactcttgaaaagctttagtttgaattctctcttctataatttcatcaggcctgctaaaaagagtatagaaaatgagagacccaatggcatgggagtggatgggggtggggtggggtggggtagggagaagaatgtgggttaagaaggcaattcaggccagactaaggagaaatatttaaaaaggagaagagaagggagacccatttacattgtcagcaatggtattatttactctgaaaatgtgcagaatgactgaaggactggaatctgataaagggggatcctgaagccaagaagccaggagtctttctttgctcacactagcaattaatcctgaagatttagggcccctctgtgtatgggtgcagacactagctaataaacttgactgtttctttcttttgagacagagtctcactctgttgcccagactggagtgcagtggcacacatggctcactgcagccttgacttcctgggctcaagcaatcctcccacctcagcctcccaagtagctgggactacaggctcatgccattatgcccagctaatttttgtattttttgtagagatggggtttcgccatgttgccaaggctggtctcaaactactgagctcaagcaatctgtccccctcgggcttccaaagcgctgggattacaggtgtgagacagcacacccagccctgactgtttcttatccaaaagaaaacacactaaactattcagggaaggccaactattcagggaaggccatcaacattcgccctgggccttctctttcttcagtggagagttttaatggggcatgataaaacctgggctcccaggggaggattgcagtacccgtatttataagtgctgtgtttgagtttgctttgctgtttccccatcacgacacaaaacctaaacgaaaccttctgtggaggagcttgtttcagttggcacctgagtagcagcatcccttgtggctgctggaagttgtgttccctgtttaataaaaagaagaatacatgttgttaattttgttaggcacaatagtatgatgttgaaaataaatccttttttagactaattaattgtatgcttttgcttttcctcctcaccctgcttcacacttacagccctgaggttgcagacacacaaaaacaaaactgattttaaaaaagactaagaagtcctgtaataagtaaaacacagaattgccatacggtccagccattctaatcctgggtttaaggccaaaaacacagaaacagatgttcaaacaaaaatttgtgcacaaatgttcacagcagcactgttcacagcagccaaaaagtgaaaacaactcaaatattcatcaacagatgagtggagaaacatcatgtggtcaatccacacaatgaaatattactcggccattaaaaggaatgaagtactcgtacatactacaacatgggtgaatcttgagaacatcatgctaagcaaaagaagccagacatgaaaggctacacagttcatattctatgtatgcgaaatatccatagttggcaaatctatagagacaaaaagcagattagtggttggcaagagctggaataaggaagagactggggagtgactacttaatagatacagatagaatgtaatacagagtatcttaataggctagatatagtttggatatgtgtcccctccaaatctcatgttgaaatttgatccccaatgttggaggtagggcttagttggaggtgtttcggtcatgtgaccagatccctcatgaatacttggtgacatctccctggtaattagtgagttctcactctattagttcccacaagaacgaattgttttaaaaaagcctggcacctccctcctcacctggttccttcctctcttgccaagggatgcctgctctcctttgcctactgccacggtggaagcttcctgagccctcaccagaaacagaagcctgcgtcacacttttcatacagcctgcagaaccatgagccaaataaactgcttttctttataaactacttagcctcagttatttttttatagcaacacaaacaaacaaagaggcagagtttccttttggagtgatgaaaatgttctagaactagatagtgatgatggttgcacaacaatgtctctatatactaaatgtcactaatcataaattttatgttatgtgcactctgccacaataaaataaatactaagaagatgtaatcaaaaataaaaaataatttacactactgaagcttcttgaaaaagaaaagcctcagttattctaaaaggttataaccttccttggttgttggattttttttttttttttttttttgagacggagtctcgctctgtcgcccaggccggactgcggactgcagtggcgcaatctcggctcactgcaagctccgcctcccaggttcacgccattctcctgcctcagcctccccagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccggatttttttttttttaataatttcactatggcacctctcagtgtgccagaatcatgaaatagatgttctgagatgctagaaataatgccactaaatgagacaatgtaggtaatgacctagactagcagttcttaaagtgtgatccatggaacatgggggattcctgagagcctttcagggagtttgggaggacttctgttttccaaccacatctctcagtgaggcccttcgctccctccctcccttccttcctctccttttctctcctccttcttccttcttccttctcctccttctccttcttctttctttctttttccttctccttctcctttctttttttttgagacagggtctcactctatcacccaggctggagtgcagtggtgtgatctcactgtaccctcaacctcctaggcttaggtgatcctcccacttcagcctcccagggagctgggactacaggcttgcaccatcatgcccagctaatttttctgtgttttttgtagagacggggtttcgccaactcctgggctcaagcaatccacgtgccttggcctcccaaagtggggccttcttttcttttaatacctcaacataaacaatagattataatagactgaatgcagaagcagatatcagagtccaattgtctcctttttaaggcaaacattagaaatttgcaaaaacataaagcaataccacttcttccaattaaatattttggttttggaaagtatatttatttttcataaaatgatgttttatgttaatatgcaataggtttattgctatttcaaaattaataagtaaatgtctttaaaatttgttttttaaaattaattaattaatttacttatttattttatttttttgagacggagtttcactcttgtcacccaggctggagtgcaatggcgtgatctcagcccactgcaacctccgtctcctgggttcaagcgattctcctgtctcagcctccagagtagctgggactacaggcatgcgccactacatcaggctttttttttttttttttttttttttgtatttttagtagagacagggtttcaccattttttggcaaggctagtctcaaacccctgacctcaggtgatccacccaccttgacttcccaaagtgctaggattacaggcatgagccaccgcacctggcctcatttatttatttttaaatttaacaaaccctgcatgtggcattcaatctcagttttaatgtcaaatgatggtagcagagcaggattcgaactcaatctataacctacataaacaaaacctctttgggggttcttaattttgaggagtgaaaagaagttctgagaccaaaaagtttgagagccagtgacttagaatttaaataatgttaatattggattatatattagaattaaaagaataatgaaacattttccagatttacttgtatcatccccctcaactaacgaggctagaactgaaaagaaagagaatgaattatgcattcaaaggtgctcctccactcattcagggaacacctcctaagcaccttatttgtgtaggtcctataccagttgctggtgaaactgaaaaaaagagaaacctgaagatgtgaccagcatgaacatttgctgggaccgaaggaacctaacgaaggaccagtctcaactactccatgtcatgtgtcccctgcgactggctgtgatatcagatagctgagggaagtatggggggcagtgggagcacccagtccccatttcttctgaggttctgcctaaaagttctaggaaataagtttcttatgggcatgaccaacctaattctaggaagaactgtctacaggaagaactgtttacagaagagaacagcagctaaaacgcaccaacttaatattctcattcataccattagcattaaaaaaatggagttttccagaagaatttcagcctacattttgagaagttgctagaattgacttcctgacgagaataggtaaccaatacagaaaagcacaatgcaatggaaacaatgtgagtggcatcaagaggcctaggatctaccccagccctgcctcatcccattatgtgtccttgagtagctccattccccactctggcctcagcctccccagctagaaaattaggacactatacgaaatgatttttagtagactatgtgtataatgagagaaggtctctcgttattcatctttgtaccccaagtggcttgcacagtactgtacaacaaaaatacttgtgaagtggcaaatctaaggtcccttccacttcagatattccaggattttctataagaggccacaagatgtgctgagaggcaaaattcaggatagttttcaaaaagtttgggatgtggtattgtttacagatagagggtgcagggcttcttatctgccagcctaacctatttttcaacattgtcatcaaaccaatgacagatgccattcatagatctaggtcactggaaattgcagatgctataaatggattagctctgctcaaaactgattggtatagtcagagagccatacttcccaagtaaaccatattcatgggacattctaaggaaaagataacttttagaattacttacccccaaaccaataggatcttcttggttagctgccctattcaataatttgtaatgtgtatcctttggaaaatagttcaggcagccacttcttaatctctgtaattagtgggaagccactgaagttaatctcttctctgtctaagcatgtttgcactgaaaagagatttacaaggtaaataaagaccttgtttattaaagagatggttaggtgtagttttccctcacaaagaaagaaatattttacaaaattccaagattatctctctcacatttccacaattcaggaaagtatactatagtgttaattatatatctatttttaaatatgcaaaatatatttaaatacattgttaaacattttgattttgctcataacatagtacttctattcatcaaaaatcttgagttgactgcttatttcagagtttactgcttttgtgaaaaaggcaatttctcctgttttaaataattctcctagaatttgagatgggagagcttttcaaaatcaccatatataaaccatttatttatttcaagatctgcagagtaagggtagaaatattatttgctcaaaattataactaagaccatttattgaaagatctgcagaataaggatagaaatattatttgctcaaaattataactaagtaaatctcttgacttctagtccagaatttccattataaatgtctacaaagaataaacagctttattgcattttaataactcaattttaagaattcaattaaattctaaatattgattgacagtgcagcttattctgagaattaagggcagcacagaatagtcagaacaacatttcattaaatgcattagtgtctgcattagataggactagttgtgaattatagctcaactgtggccttgggcaagttgctgaacctctctaagtctcactttcctatgtgtaaaataggataataactctatcattgacttctgtgaagattaaaaatagcacttaaaaggtaccaggaactgctctatgttttatatttattaactcattttatctattccacaagcctctgagatactgttactacaggttgagcatctaatccaaaaatccaaaatccaaaatgatccaaaatctaaaactttttgagcactgacatgacattcgaaggaaatattcattggagcattttggattttttttttttttttttttagacagaatcttactatattgcccagactggagtgcagtggtgcaacctgggctcactgcaacctccacctcccaggttcaagcaattctcctgcctcagcctcctgagtagctgcgattacaggtgtgtgcctccatgcccagctaagttttgtatttttagtagagatggggtttcaccatgttggccaggctggtctcaaactcctgacttcaagtgatctgtccacctaggcttcccaaagtgctgggattacaggcatgagccaccgtgcccagccacatcggagcattttggatttcaggttttccattagggatgctcaacccttaagtatataatgcaaatattctaaaatctgaaatttgaaacacttctggtcccaaacatttcagataagggatactcaacctgtatggccattttgcagatgtgaaaagtgaggcacagagatatcaaatagtttgctcaagtttatactgcaaataagtggcagagctgaaacttgaatccaggcagtccaactccagaggccctgttcttgaccagcatattatactgcatctctacaaaagctggtgcatataaagcttttggttcaatctggcaagttgttaacaataaattatggttactagcatgattgcaagattaacagtgatcatactggaagcagcattttcacccttgttaatactgttcataatgcacaaatattaatgcacaaatatacacagagaacacatacaaacggatatatgaatctagaggatattaaagctgaagcaaattatggcctctgatcagagtgattggacccaataaagctaagaattcattatgttacatagcaaggcaattaaaaagtctcaagaacaaagtatatgaatttgggttatatctacgttgttgtaatttatcatgagtagaataagaaataaaagtactactaagttatcttccactatttttattaggaacatgtaatatacttgagaggaggtataatttctggttcatttttgtatctatgatttgaccttagcctaggagaatgaacgcaaggcaaataaatacctgttgaatgagtgaatggaatactaagatgaagagtcggcttggtggtacgctattttttttttttttttctgagatggagtttctctcttgttgcccaggctggagtgcaatggcaccatctcagctcatcacaacctccacctcccaggttcaagcgattctccagcctcagcttcctgagtagctgggattacaggcgcctgccaccacgcccagctaattttgtgtttttagtagagacaggatttctccatattagtcaggctggtctcgaactcccgatctcagttgatccgcccaccttggcctcccaaaatgctgggattacaggtgtgagccaccgtgcccggcccagtggtacactttttagggacccaacaacataagcgcccttttaacctgcccaacaacatatcccttagagagcagtcaccctgtttcatcccaggctccagacccagaaaggctggagaggacatgggaaaatctacagattcagttatggctctggatgtccctgttggttccagttggaaccaggcctcggtctgaatcccatcacttctttctattccaatctgctttccaaaggccttgggatatccagtagtcactctaaaccaccctaaacagaaagcagagaattctcttttaactctccagtgcaatattccttgatatacaccagtacctatccgactgttctattccatgaagaaactgggactcagagggctgtgacttgctgaaggtcacaggggcagagccgggtggactggaccttatttccctggtcccgttaatgcaaatgctgatatcttatctccctccgtctccccaaatctccctctgcacacttctgtcttacactctgggagaccaaggcatctttagtcgccaaaacaatgctcaaagaaagaaaagtatgagtagaaacacctggaagctggtctggttcgaccctctaatggtacagataggggaaaccgaggcccagggaataagagggtcttgcctagagtcacacagggagccagttctaggccaccactctcacggttgcctcaaattttggggacgacttgtgtgcagtttttcctttctgtcgcttcagatggcaaatgctcctctccctgcccattatatgaacaactaaagcttaatttgtttttgtttttgttttcaagagacggagtctcgagtctcgctctgtcacccaggctggagtgcagtggcgcgatctcggctcactgcaacctccgcctcccgggttctagcagttctcctgcttcagcttcccaagtagctacaggcgcacggcaccactcccggctaattttttgtattttagtagagacagggtttcactgtgttgcccaggatggtctcgaactcctgagctcaggcaatccacccgcctcggcctcccacagtgctaggattccaggcgtgagccaccgcgcccggcctaaagcttattttttatgtgtatgtggaaagcggggagaagagtccccgaagatgggaacctagcgccacccagcccaaggttggccctcataaccgctctccgcttcgaccaaagggcgagggttgcccgctcctagtctgccgctatgcccctttctcccacctcaggctcagtacccaccggtgggctgcggggctggagctggggccggcgggaacgcggagcctgggggtgggaacagcctccgagccctcccgcgcctccgcccctagcagcaggcgcacgttgctagggcgggagtgctggagaaaagcctccgggcaccctcgcaggccgccgaaccgcagttccgttcgcctaaagctgggacgggaactgagcgcccggcgctactctcttcgtgatcaggtccagaggagaggacgcttgtgcccaggactccgctgccagaagaatctagacaatccaagcaaaacgggtacctttgtaatagctatggagaaagcacttaataaaggtcatcttttaaattattggtcgctcagacatacgtgttgccgtatttctttggagtttccctgatttcgactagaaattcctcctttggacactcccccagctccccactcctctattcctttcgttttttttttttcattgaaccattacagcctagtaccatagcaagaagagacccctcagtaccttcttgagatccaaatgggaagacagttgtagaaacacagtttttacagctgcggtcgcattgctaccagactagagtctattcatctccgtattcctggtgcacagtatggggcttggtatatagtaggggcttgttgaatgtttgttgaatgaatcaatggcagggatcctagccaacatttatttatttttaagacggagtcttgctctgtcgtccaggctgaagtgcagtcgcgcgatctcggctcactgcaacctctgcctcccaggttcaagcgattctcctgcctcagcctcccaagtagctgggactacaagtgcgcgcctccatgcccggctaattcttgtatttttagtagagatggggtttcatcatgttggccaggctggtctcgaactcctgatctcaggtgatccacctgccacagcctccaaaagtgctgggattacaggcatgagcctccgcgcccggccccaacatttattttgaaccctagtaggtgcctctgcagtgttgatctggcaaaacagccttcaatgaagatttgtggagtttctgaaaattgggtgcctttgagggggtgggaatggtgagagaagtttgcctccacatactggctattgggtctgttttccagtccagggaagggatcccctccatggcatccctgatgaagtatctgtagccctagttgatgctcactctgtaatgatgggctgattactttctaagctagtgacctattgttgggagatttccttctggcaggagaaagtatctacccgtatgccacttgaaactctgatcttcgctcagaaccaatggctctccttacagacttaatccctttcccccacaacagcctggcaagctacaaccaggatagactcactgctttgtcctgggacactgggctaggctcagtgcagctacagaggtgagttactagatctctgcacccaagatgttcctgctctggggatgtttttccctctgagagagaggctttaggcttcaggcacgaaagactcccaaactggtacctgtagccaggcctctccctgagtcggacctgtatatccacctgccacccgcccatctgcaactggcagtttaaaagacacctcattcttgacatgactcatactggaaacatcatcttcccctcaaacctgttccccctcttttccctgtaagtgctgggcactaccattcaccaatcacccaagccaaggatctaggagtcatttgtaactttacccttgcttcctcgttcaagaacaatccccgagacttctcaattctgcctcccaaacattataaaaataaaaaccttctctctacctaccagctggattcaggccaacatcagggtgtgatagattaaaaacgaccacaacttctttgtagctcttcccatcaaggctggctttgtaacttgttttgaccaatagaatgcagcaggagtgacatcgtgggacttctgagtttaagcttcaaaaggccttgcagtttctgctcccatcctcttggcacactgccagcatgggaagaggaccaggctagtctgtttcagagacatggcccatccaatagctagcaccaaatgccagccatgtgagtgactgttgcccatgctggagtgcagtggtgcgatctcggctcactgcaacctccgcctccttggttcaagcgattctcctgcctcagcctcctaagtagctgggattacaggtgcgtgcccccacatcccggctgattctcgtatttttagtagagacggggtttcaccatgttggtcaggctggtctcgaactcctgacctcatgatccgcccgcctcagcctcccaaagtgctgggattacaggtgtgagccactgcgcccgcctcagtgttataatcttatgggaccaccaggtacatgcagtccatcattgatcaaaatgttattatgcagcatacgactttatcctcagcttagaggccatctccctctctgcccccaagtcttccctacccattcctccccttctccagactgggttaactattcttcttctgtgcttccaaagcccccacactttacaccacatagtataacttttcatttacttctctctctcactcaactgcaagcaacagaggcagtgactgagtctcatttacacttgtattgttggtgtctaacccagggtctggcacagcactgcaacagaactttcaacaattatggaaatgttctatacctgcattgtctaatacatcagccactagccctactagctattgagcacttgaaatgtagctagtgcaactgaagaactgaattttacatgttatttattttaattaatttaaatttaaatagccacatgggcctagtggctatggtattgaacagtgtagggctagcacagagtagatggccattgaatatttttgaacaaagattacaagggaaagacagtcatgacagaccgttaggacatgatagaatgctatgggtataagcaacataatttcatatcgacctctcctggctcctcacttcacatcccctcaactttacactaccagtgcctttgtcttagtccattttgtgctgctgtaacagaatactacagactgggtaatttattatgaacagaaatgtatttggctcatggttctggagactgggaagtccaagatcgagaggctgcatctggtgagagccttcttgctgcattatgacatggtggaagacatcacatggtgagaatgcaggagtagtgagggaaggggacaaacctatccttctatcaggaacccactcccacaataacatcattaatccatgcacgagatcagagccctcatgatctaatcacctcttaaaggtcccatctctcaacactgttacaaggggaattcagtttccagcacatgaactttgggggacatgttcaaaccacggcagcctgtggctctgccttatttaaatataatcctagtttttggctctttatggcctgagttggttgttctctcctggacttgcccagattgataacaccccttctgtgacatgggctggtctgaagagccctctggagaagagagctgttctcatctagtttagtctggcctgagcagagagcactctgtcattgggaggcttggacttcatcatagaggacccatgtgatctgaatttgtctgcatggcaggctgccaaatccctcttaaaagtgacagttaaagctggctgtactgtgaaaacaccccaggaggaaaagaagccacagtattggtagtcttattgctgttcctggaaaccatgcaaaccccagtcagatgacttccagccctggcaccagagatattggatcagtgtctgagaaggaaggaggaatggacacaggcccaggcagaagggggctgggctgggccaggccagggccccaccaggcaggcagaaaaggctgggcctgacaccgaggagcaggcctgagggaaagtaaaggctagggaagaatagtcctttccaaaagactttccaaaatgttcattaaaataaaaagtttaggccaggcctggtggctcacacctgtaatctcaacaatttgggaggttaaggtgggaggatcacttgaggccaggaatttgagaccggtctgggcaacataaaaagactcaggtctctacagaagttttttttgttttatttttatttttatttttttttgagacggagtctcgctctatcgcccaggctggagtgcagtggtgcaatctcgtctcactgcaagctctgcctcccggattgatgccattctcctgcctcagactcccgagtagctgggactacaggcatctgccaccacacccagctaatttctttcttttttttgtatttttagtagagacagagtttcactgtgttagccagggtggtctcgatctcctgaccttgcgatccacccacctcgacctcccaaagtgctgggattacaggtgtgagccaccacacctggcccagaagttattttttttttaaagttttttaaaaaagatccaagccaaatgttataaatgagcaagtgaaagggcaggttagagagcaggttgtacacataatcccaattttgtaaaataaatatgttccagcttgtatcatatagtgggagctaatgaatgctttaacctatgtgtgaggacctgtaagtatatttgtagcagtttttcacacattgtaaatcgtgtgaggttctttgaagattggggagcagagttcatggtacagaaagacatcttgcacttgctagtcctctgtctggaaatctcctccccagatgttttcatgccttgcttcttccagtgccacttacctgagaggacttctacaccatcctttctacaccagcacctccatcatgctctttttcttgtaatacttgaatctttttcatagcccttatcattactgacattatattacatatccatttgttgcattttatttgtgcatgaaagtagactttgttcttcttgactgttgtatccccagtgtctaaggcctggcacattggcaggggctcaataaatctgttgaatgactaaaatgtaacaatggtgtccattcttctctccctagctcagagtgcctgaagttcaagtacagccctgcctatgcccatgaagcctccagaggtcccctaagagctctaagcagctttcaaatttttttgacctcataaagaagtacattcattctccacggtgcatatgtacgtatatataggccaaagacaaaattacaacaaatgtagttgagtgatcttattggcttttattagcacttctagaatcaggcaacacctaattctataaaacagaatgttccaatgagctgaacagaggacatgggctttataggtagaaaagagctggaaaaaaaaagaggattactcatttcaaagttactttccttttagggttaaaacagagaggacttccttatcatgccagctaattctgtactgtttggggattttaatatgctctctctttctctttttctctcccaatttcttggaagttcagataaactacttagttttggtttggtgaagtggcagtttagcatgagtaactccattttgttttggtttggtatggtggggcctagtgtggaagcccagtccaaaacaacgaccttccatccattttgtttacctatatatatgtaattgaaacaacaaaaaccttactaagagcatgttttctgttctttattcttttctttttttctcttttggagacagagcctcactctgtcacccaccacccaggctggagtgcagtggtatagtctctgctcactgcaacttctgcctcccgggttcaagtgattcttctgcctcagcctcccaagtagctgggactacaggcatgtgccatcacgcctggttagtttttgtatctttagtagagacggagtttcaccatgttggccaagctggtctcgaactcctgacctcaggtgatccaccttcctcagcctcccaaaatgctgagattacaggcgtgagccattgtgcccagccttttctttctttttataaaagatgctgatctccaccccttgaatttcttgatatgccacctaataaagggttgccactgccttagggcagtgtttctagaaacagtcaaggggctcctttgcatcctagtcaaggagtgactgccacagatgcagcttcttggcttcatcccagacttaatggatgaaaatcttaccggaaagtctgcgtgttttacaactcctcctctttcccctcctgaccatcccctgtcctccaacgattccgaagcctgataaagcttaagagctataaccggggagtttatgagtatcccagatgtgtcctgcagggcttgatgaacagatagggaaagggcgattctccagttccagtccaacttggctcataagtggtgaaacagaggaacccgacttgataaaagtaaatctactcctaccttagccctttgcatttgctgatgccactacctgaaagtaattctggtgatttaggggctgttttccagatcctggacctggtagggccaatgactgctctagggccacacccagtgaaggcccccctcccccccccccacctttccctaaggattttaacccttgttcctccccctgccctccacaacctcttttctttcttttcttttcttttctttctttctttctttttttttttttttgaaacagagtgttgctctgttgtccaggctggagtgcagtggcgcgatctcagctcactgcaacctccacctcctgggttcaagcgattctcatgcctcagcctccccagcagctaggattacaggtgtgcaccaccatgcccggctaatttttgtgcttttagtagagacggggtttcaccatgatggccagactggtctcgaactcctcaagtgatccgcctgcctcagccttccaaagtgctgggattacaggcatgagccactgctcctggccacacaacctcttttctttttagccttcacacaaaaagcacctcctattttctttgttttcaccatagggtttaataattccccatccccagtccttagaaggaaaaaattctaaccacaatctctaattaccatggcctatttccctccccacccccagaggagtgtagatgctgttatgaggccatcaccctcccactgggatgcactggaaacttctttagatgccaggaaagcagcacccctgtcgccaaagaacctcacacaatttacattctgaaacctgctacaactgtatttacagatcctcacacatataataaaaccttttattatcccctactgtatatcagacacccaaagtaaatactttgtagacaagatctcatttcattcttgaagtagccctctaaggtagatgatagtattattatcacctctgttgtagagataagaaaacagacacagaagctgtgagtaacctgaccaagatcccatagctgtaagctgcatagctgggatgaaaccaatgactatatttcactcagtgttctctctaatcatatggtgtaatattgtctatctggggtgacaatgtgtccccattggatgatgacaccactgtgtaccgctctgggtagctctggggctgttagctgcccttacccctcaggtgctaaagcagtagtggctgagaaggaaagggttctatctcctttgtgtggccattgcttagagaagcttcagagtagaggtgctagagcccctgtgagctatgggatgtaatgtttctctttcggtttagctcccgcctgtgttcagttctgatgcactcagagtactctctgacacctgaaggcctgggcccttccccttttgagagagtgcccagctttctgccaagactcctaagaaagaatttggggttggtggccgggcgcggtggctcacacctgtaatcccagcactttgggaggctgaaggggggagatggcttgagcccaggagtttgagatcagcctgggcaacatggcaaaaccctgtctctacgaaaaatacaaaacttagctgggcacggtggcatgtgcctgtagtcccagctactcaggaggctgaggtgggaggatcacttgagctggggaggtcgaggctgcagtgagctatgattacaccactgcactccagccagggtgacacagtgagaccctatctcaaaaaaataaaaaaaaataaaaaaaaaaaagaagaagaagaatttagagctggagagcagcgttctccttgtatgcccagacagactagactggatccccagcagagggctcaatctgggctcagactaatatataagatcctgagggtgggaaaagccctaaacagctcaggaacatgttagcagtttttctttctggggtgggagtgggtggatttttcttccacatgcttatttgcatattttgttttcttcgaaataaaaaggcattactttttttcaatgctagtttaaaaagaaaactcaaatattcaaattcaaaaagtttggatgtaaatactttgggaaaatcagcctaatacagatatttctcactgggcctcaatgttcaatttaaaaaattattaattatagtaaccttaagtcacactgcctaggttccaatctcatagctaccaattagtaactgtgacccttggcaagccacttaacttccataaaaatgggatcctaatagtactttcctcgcactgttagtagacacttagcgattgcagctgctatgttccagatattgttttacgtatttagcgtatttactcctcagacgtctgggaggcaggtactctcaccccattttacagctggagttcccacccagtgagcagccaaacgggatttgaaccaggcagtttctcagcagagccttgcttgaagctaggcatctaaagctgcctctcaaaaagggcagtggtcgggattacataacagaacgcttgcaaagctctcagcgaaagcctggcacttaataagtgctcaataaagtttcctacggtcacagtaatatttggagttttatgtttgttgtagaacaaatacgcatacaatcgcgatttcattcaacaaggaatttaaagagacctgctgccccgggcgggatgggagcgcgggttgggtgggaggaggcgcagctgcggggcgcgctggcgcaccgggagggccgggggcggggtcagccaggccccgcccgccgccacctgcgacaggtggagcgcacggggcgggcgcacggccatgtccgccgagggcgcggagccggggccggggtccgggtccgggcccgggccggggccactctgccccgaacacggccaggctctgagctggttctgcggctccgagcgacggcccgtgtgcgccgcctgcgcggggttgggcggtcgctgccgggggcaccgcatccgccgggcggaggagcgcgccgaggagctgcgggtgagcgggtgtgggcgccggaaggcgagggctccggagaccccgggcgcgcctggcgggacccggcagggactggggagcctggggctgggcggactcgacacccggccccggagcctaggctcctcggtggctttggctgtaggactaggcggttaagggtgtggcctctgaagtcaggctggcctgagttcgaatctactccctgtgagtcacgtaactctgagcctcagtgtcttcatctgtagtttggggacaacaacaataataatagcgcgtatttattagagttgtgagaaataaataagatagtgggtaaaatgcttagcgataaggggatccaggctccccaggccccttccattgctctgttgaggaagctggggctggcatgaaaggctcagctgctccagttctcagcgcagggtgtgccccagctcccgcccctgtggaaactgacactgataaaatccagcgcgaccgtatcccttaacccctggactcaaa

SEQ ID NO: 1203 - DNA, 26119 bp, Homo sapiens
tttctttttgagacagtgtctcacttaatcgcccaggctggagtgcagtggtgtgatcatggctcagtgcagccttgacctcctggactcagcctcttgtgtagctggcaccacaggcatgtgccaccatacctagctaatttttttttttattttttgcagagatggggttctctgtgtattgcccaggccggtctcaaactcctgggctcaagtgatcctcctgccttgacctcccaaagagctgggattctttcttgcccccaaaacaactaactcccataaaatactctaataagactcagacatagatttaattatttcatatgtcatttatgtctcctcaggtagattgaaagatttttcagtttggggcttatgagttaaaagaagtaacatggttagtgattaaaagttcaaaacttggagtcagagagacctgagtttaaaccttgatgatgaaacagcactaagtgtatgattttaggcaactgactttgctgtttgttcatctgtaaaaattgggttactatttaccacatgactttattgtagggatgaagaaaaatgaaatctataacatgcctatcatattgagcaggtagtagagctgttttttccatcatcatcaatattaccttaaacttcatccttcttcctcacaggacttaatacaatacaggtgcatagtgcccttgaagaggcaatgtagaagagtggacaggagcccaggctttggagttacatggcctggttccattctttgctccattacttagtagatacatgactttaggtaaattacttaaatctcagccatagtattcttatcagtaaaaaggataataatatccacttcatagggctgttgcaaagattaaatgacgcaaagcttgcatagcacttggcatggtggctagcacagagtaagcacataagtgacagctgttcttgtagatcctggctacttgctgctcttctccttattgtaggccgcaatgtttaccgaatgctttttaagagcaaagcatatgagcggaatgagttgttcctgccgggccgcatggcctatgtggtagacctggatgatgagtatgctgacacagatatccccaccactcttatccgcagcaaggctgattgccccaccatggaggtgagtgaatggaatcctgagagcctatcatgtgagcctcaagcctgggaatcagcctggcctctgccccgtgtcccttgtccaccatgtcaccaagtgctgttcacttttacctcctaaatctcaactgaatccattcacttttccactttttcaccaataacattccagtctaagctataatcatttgctggaactattaacttactatttttttagagaccaagtctcactctgtcacccaggatggagtgcagtggtgctatcttggctcactgcaaactccgcctcccaggttcaaacgattctcctgccgcagccttccaagtagctgggactacaggcattcatcaccacacctggttaatttttttatttttagtagagattgggttttaccacgttggctaggctattcctgacctcaagtgatccatccgccttggcctcccaaagtactgggattacaggcatgagccactgcgccagtcctctggagctattaaaaaggcttctaattggtttccgcacttccactctggtttccgcacttccactctgatttgttattatatcttgttattgaggtgttattcacatgccatataattcatcctttaaagagaatttttttaaaaatttttgtggatatatagtaggtatatatatttatgaggtacatgagatgttttgatacaggcatataatgcataataatcacatcatggaaaatggggtatccatcccgttaaacatttatcttttgtgttacaaacaatccatttatactcttttagttgttttagaatgtataaattattactgcctatagtcaccctgttgtgctatcatgtagtaggccttattcattctttctatttttttggtacctattaaccacccctacctcccctacccttctaaaatatacagtttggctgggtgcagtggctcacacctgtaatcccagcactttgggaggctgaggtgtgaggatcacttgaggttaggagttcaataccaggtgggccaacattgtaaaacctgatctctactaaaaattagccaggcgtggcggcatgtgcccgtaatcccagttactcggaaggctgaggcatgagaattgcttgaacccagaaggtggaggttgcagtgagccaagatcgtgccactgcattctagcctgggcgacagaatgagactctgtctccaaataaataaataaaatgtaaatttttgtctcactacagtttagaagcttttagtagtatctcattcttaggataaagagcaaaatctttaccatgactttgagcctctgcaacatctggcctttctagaatgttctagactcctgactttcttgaatggtcttgattcattttgatgcagggcttttgtgcaggctgttttatctctggaatatcctttcacagcacttcgtttccctcccttcacctactgtattgtaattcagtctttagtttgttaagtgaatgaatgaataaatgaagagatttctgctgagtggtttaacattcttgtttcttggtattttcaggcccagaccacactgaccacaaatgacattgtcattagcaagctgacccagatcctttcatacctgaggcagggaacccgtaacaagaagcttaagaagaaggataaaggtacctggagggttagagagagaagccttacccacagaggacgtttggggataaaaccaaggtctcctggagctttctgtctccagaatattgagaggctcctgggaagcagagaaaaatgggagtactggagcattggcaaggagacagttacagccagattctgtctccttaacctacctaagaagcagtggtcaggtctgaagcatgagggatggagagtgggtagcttatgtcctatttatttattttttttaaaagagattttttggtgaaaaccagaaaacctagacagattctaaaaaggctctaatacttgaccgacattttattttattttatttatttattttttgagacggagtctcgctctgtcacccaggctggagtacagtggtgcgatgtctgctcactgcaacctctgcctcccggggtcaagcgattcttctgcctcagcctcccaagtaggcactataggcactataggcacgcatcaccacgcctggctaatttttgtattttcagtagagatggggtttcactgtattggcctggctggcctcgaactcctgaccttatgatgtgcccacctcggcctcccaaagtgctgggattacaggcatgagccactcttcctggccttattttattatttttatttatttatttattttgagacgagtctcgttttgtcgcccaggctggagtgcagtgatgccatctcggctcactgcaacctctgcctcctgggtttaagcaattctcttgcctcagcctcctgagtagctgggattacaggcacctgccatcacacccggctaatttttttgtacttttagtagagatggggtttcaccatgttagccaggctggtctcaaactcctgacctcaagtgatccgcccgccttggcctcccgaagtgctgggattacaggcgtgagccaccgcacccagccttgacccacgttttaaacagaagatgtttaaaagggcattaagagctggagaggatggtgaagttcagtggaaattaactgaggagtatgttcctgactcctctctttaaatttcagggaagctggaagagaagaaacctcctgaggctgacatgaagtatgtatcctagcccctggcatctgatcagagggagggggtctgtacatttcttgtgtctggcattttggggaggtgctgacatgagaatctggagaaatggtcagggggagtgaaggtgtatgtgtgaatttggccagctagtgatctccattttcccagtatttttgaagacattggggattacgtaccctccacaaccaagacacctcgggacaaggagcgggagagatatcgggaacgggagcgtgatcgggaaagagacagagaccgtgaccgagagcgagagcgagaacgagatcgggaacgagagcgagagcgggaccgagagagagaagaggaaaagaagagacacagctactttgagaagccaaaagtagatgatgaggtgagatgtgggcccttagtaccaggtgatggagttgcccctctctggaaatgtgagcaaggttgggtaaggaattgtttcaaacttgggggagggatgagtaggaatctctcatggtaacactaacttcacattttgtgttctttccagcccatggacgttgacaaaggtgagttgtacacacagcatctcacagttgctctagcagtcctgctttcccctggtagggctcagagctggcaacggtgggattgggggacctcctggttctgggttcttgtaagaactgtgtcttgctttattgaataggtggagttccctccaccttcctgggccatggcagggcatatttgctcttagatataattcctgtggccctggggttctgaggaggtgaggtagaggtcaagtatggaatgttctggataccctaccctcatctcaaccagagtgactcattaattggagtttgtttaaaactttgttagacaaaagggttctatgccttaaaaatgttttttaagtgtgttgtggggaggaggttgtgagagcctcagttcaaggtctgggctgagttctcttttctcctaggacctgggtctaccaaggagttgatcaagtccatcaatgaaaagtttgctgggtctgctggctgggaaggcacagaatcatatcctttattttaatacgttcctgggttccagagaactggtctctttactccaaccccccctgcctccctgctccctcctaccctgcccctctccttcccttttacgctgaattttgacagaatgaaaccatcccttgttccttcccagagcacccataacagctcacagcccactcagaattttcatgttggggcttctagcccttggccccctcctggctgaagctttacagcaataggtagaatcctgtgtagtgttttctttaacatagcatatgctgaagaagccagaagacaaaaagcagctgggagatttctttggcatgtccaacagttatgcagagtgctacccagccacgtatgtgaaacctggttaaggaagggaggctgggatgattgggaaacaagttgggggtgaaatggaaatttgattcgctaagtcccagggctacttcttttttttttttttttttttttggagacagagtctcactctgtcacccaggctggaatgcaatggtataatctctgctcgctgcaatctccatctcccgggttcaagcgattctcctgcctcaccctcccaagtagctgggattataggcatgcatcaccacacctggctagtttttgtatttttagtagagatgaggtttcaccatgttggtgaggctggtcttgaactcctgacctcaggtaatctgccctcctcagcctccaaaagtgcggggattacaggagtgagccactgcgcctggcccaaggctacttcttacttggatgaactattttattaggctctaagtgggaggtctagggggtggtcattcctatgcagataacctcttagtcgggtaggtttccagatgaagcatagggtcagggtatgcaacatctgtttaactcttgcttctccttaggatggatgacatggctgtggatagtgatgaggaggtggattatagcaaaatggaccaggtatgtagttagaaggatggtgggcgcctttgggcagttattatttgttttacatgtatctccttccccactcctaaaaaatctatctcatttactgggccccaccctcctttagctgcagcagtagaaacagcagcattgagggtcatgagcagcttaactatttcagagtctttgcacaagatcaaatgacatagggtcaaaaatctattttttacttcctatagcaaagtgccaggctttgattcccatggtaggcagtaagcaagcatcaatgcataagtagaaagggcagaaaaaattgcagtctttggaaaataactaaattttattctagccaggattgaagttttcctctaagtcttaagcaaaattaaaaagaaaaaaaccactaatgccactaatagtgaagaagtctgtgttcttcccctgagttcactgtattgaaatagcatggtttaatcttggagccttgtttaatcctgcctctactgtttattagttttgtgaacttgccaagttctttcactgtttatgcctcagtttcctcatcaggaaaatggagagaaatatagttccctcttcatagattttatgagaattaagtgagatatgcatttagtgtacagaataatgcctgtcacatagtaagtatgtaataagcatttattattacttatcagggtatgatttatgaattgtggaacctgggattatgggagagtctggcttcaatcaagggctgaaattccatttccactgacatctcttccttccccatcccccgattctgtcctgcaacagggtaacaagaaggggcccttaggccgttgggactttgatacccaggaagaatacagcgagtatatgaacaacaaagaagctttgcccaagtgagtcggtactgaatatgggcagggtgtgaggaggggtgtggggatttggtggaatagtgcatataaggttagagggtgtggtctggctgagatgttccccactaagttctttgcccacaggactctgggaaaacctcgccactgctatgcaatctctgatgcattctttcccaactgcttttttcagggctgcattccagtatggtatcaaaatgtctgaagggcggaaaaccaggcgcttcaaggaaaccaatgacaaagcagagcttgatcgccagtggaagaagattagtgcagtaagtaggatggccccttgggtgggagggtttcagctgggagaagacattagcctgcagattcaggaacaggcaaggggctggagagccatggaaatgagaggtcagccttgggcctcaggtgagcttagatgggcagcttggtgatagactatcctgttgtttttgcagatcattgagaagaggaagaagatggaagctgatgggtgagcggcattattcttcctctgtgggactggtgggaattgcttagtgtattgatcttatactgacccatttctccttccattgcagggttgaagtcaaaagaccaaaatactaatcactagttacaaccagagatgctccacaaggatatgctccccactgttttctttctacaatttccaaaggttgcaagatgtttttttgtggatgaatataaaattttattgtgtaattacttggttccattaaaattggttaacttgctattttctttgttgagcatgtcccctccagtgcccttgaagcaccaagaacactaattccactggttgtgtaaaatcacatgcagaaagtcatcagtcctttcctgagctgtggttctagattcctagacagtaaggatgctctctagccagtgtgcccagtagagaagagaataatgatcctcactgatgggcaagaggtggatagaggaatgtaagtatgattggtctcaaatgtcagactcattccggcccatcttcaggcctagtccctggggaaagatttcctggggattgctgtcagcctgatgggctgctaatctgatctccaggctatgaaggactgggctctggatgaaggcatctaatgaaaatcacttatgggtgggaaccaaaaccttttatgagtttatgtactatgagctttattaatgttgagtacaaatcactgtctccttggctaaaggtgtaaccttagggaagtgctttgggtttagagctgatatagtgtggccctgcaggtacaggaattcctatcctagaccagaagggtttggtgcccttcatcaccctgaaacatttgccaaggcccagaataggtctgttgacctttgaatcacaccattcccttcccttttcttcccttctgctcattaccagcactttggcctggtgctcatcattaggtgtcactactgcttcctggctggatgccacgctgccactgtctaccctgagcccaagatttgtggcctcaccagatccaagaaagctagaaagtcaccttagccattaccttgtctttgattatattcaccttggtaggacaggtttttgtgaggaagccagtattgtgcatggcatgtaagaggctgaaattgggccttgctgcaatagcacctagaatggctaatttcagacaaatgacaccatggttctatggatgtaggtaggcagtcccaattattaaaaatggtcacagagacatggcacaggtgaagacatctggagagtcactaaaagcaagacctggagattgtgggtttgaaattcagtttctgaggccaggctcgatggctcatgcccacagtctcagtgctttgggaggccaaagcaggagagtctcttgaggccaggagttcatgagtctatagctatgcaggaggatcgaaccgaagagttcaaggctgtagtgagctatgatcacaccactgcattctgagcctgggtgacagagcaagaccttgatttaaaaaaagaaattcaggggctgggcgccgtggctcacgcctataatcctagcactttgggaggctgaggtgggaagacacgtcaagagttcaaggccagcctgggcaacatactgagtcctcgtttctacaaaatatacaaaaattggccaggtgcggtggctcacgcctgtagtcccagcactttgggaggccaaggcgggcggatcacgaggtcaggagtttgagaccagcctggccaacatggtgaaaccctgtttctactaaagatacaaaaaattagctgggcgtggtggcatgcgcctctagtcccatctactcggtaggctgaggcaggaaaatctcttgaacccgggagacggaggttgcagtgagccgagatcgcaccattgcactccagccagggcgagactccgtctcaataaataaataaaaattagccaggcgtggtgccgcgtgcctgtagttccagctactcggaggatcgcttgagccgagcggtgatcgtgccactgcactccagcctgcgcgacagcgcaagaccctgtctcaaaacaaagcaaaacaaaaaagaaaaaaaaattcttggtaactgagcactgcttgtccagcccattgagtttctgtagacaaattgtaggaactggcacagcaaactggccacaaagacgttaggggcgtggacaccagctgcttgagctgcctgctgtcccagactcccgtatgtcatcgcgcagcgtgggattttgcggcttcctgacagcccaggctgtcgcttgacttgatcttgggtttcaccaagccacgaaggactagcgtccctctctcctatcccaagggcattaagcctgtctggatgaagtaggagaggaaagatttacacgcagttctcaactttacgtgacgtgactagggagggaattgacggtcgcaccgtctacctagcccaaacggggtcacagcaggacaaggaagtagccgatctcccagatgcggtctcttcgctccgctccacccgcaccagcagcggcccacccacctctcctgtaagaggaagaacgtcccggagacacttccggccccgccccccgaggcggaagcggagtgccaggctactcctcccgcagtgtgggtggttccgaggctgactaccctgcggcggcgcggctcgcagtccttctcagcatggaccgcacttgtgaggagaggcccgctgaggatgggagcgacgaggaggacccagactccatggaagccccaacccggatccgggacactccggaagacatcgtgctggaagctccggctagtgggctggcgttccatccggcccgtgacctactggctgcaggggacgtggacggggacgtgttcgtgtgagagcggggcagggccggggcgccgggtctggaagcttcccgggggtggacctgggaacaggagagatgagagaaagttgcagggagacaaattttgcaagattctttgggtccaatttattcagtaacattcggctcttctatcacaccaatctgttgaaagaactggaatgtcgtgacagagcccagataccgtagtaggccaaaaagccctttaaggccttgttatttcccaccgattattatttatttacttacctatttatttttgagacggagtctcgctctgtcgccgaggctggagtgcagtggcgcgatctgggctcactgcaacctcccccttccgggttcaagcagttctcttcctcagcctcccgagtagctgggattataagcgcccgccaccacgcccggctaattttttttgtatttgtagtagagacggggtttcaccatcttggccaggctggtcttgaactcctgacctcgtgatccacctgccttcctcccagagtgctgggattacaggcgtaaaccaccgtgcccggactcctaccggattattatattgtgcccgagacaggctcagcaggcccctttaagtgatttttcaaaccacaaatcttggctcacgcctgtaatacccgcactttgggaggccgaggtgggcgggtcacctgaggttggagctcgagaccagcctgttcaacatggtgaaaccccgtctctactaaaaatacaaaaattagcccggtgtggtggcgcgggcctgtaatcccagctacacgggaggctgaggcagaagaatcacttggattcgggcggtggaggttgcagtgagccaagatcgtgccactgcactccagcttggacaatagagtgagacactcccttgattaaaacccttcaatggtctgcttttaggatttagtacaaatttctcaatcctgccttcaacgccctgaccatctgtgctcattcatccataccttttaaaaatacgtcttgggccgggcgtggtggctcatgcctgtaatcccagcactttgggagaccaaggtggggtatcacctgaggtcaggagttggagaccagcctggccaacatggtgaaatcctgtctctactaaaaatagaaaaattagctgggtgtggtggcgggcacctgtaatcccagcttctcgggaggctgaggcaggagaatcgcttgaacctgggaggtggaggtggcagtgagccgagatcgtgccattgcactccagcctgggcaacaagagcaaaactccatctcaaaaaaaaatctcgaaacctcagcccatttgcatgtgctattctgtccggaaaactcctttcccctcacttttacctactatctctgagtttccaggatctcttccctcttcctctctccccagactaaaattggttacctgttagatgctgccatggcaccaggtgccatggtacctttcccttaataatgaatggttggtaaccatatgtccatttgtgtaattatttgaatgctgtctccttcactaatgtttttcaaacgtctttgaccttgcctcacagagaaataccttttacattatatatgatgctctgtgatacaattgctgattttattctattattgtgtacatgtacacaaaatgctgatcgtagcttactagtccgttatatgactagaatgtgaaaaaacactgttctggagtgtaatctgtcatcggttttgttctctattttatctccaacctctagtctagggtagatgctcaacacatgtttgattttgaacaaaagatacaggttagaggcagtggaaaagttgaagatgttatgcttatcagatttacttaatgaatttaaacctcaacccctcattagctgtaatggccttgagcgtgttaacttctgtattttcatctttgaaagggggaattatacctacccttgcagaggggacaagtttgcagtacagcacctaagcagctcttcaacaaatgtaggttcccttctactactatccatatttatggtgccaggcacttgggagttgccctagacatccacctttcttcacattccacacaactttgttgcttcccttgtcttaaaaaaggttctggaggaaaattcttggttctccccttccccaccctcagccatgactattgtgaaaaggttccttttccgaggattaaattcaaacttctgcttggctcatgtggtctcatgcccaccccagcccatctttctagattcagtcatgctactctcctgctacaaggaaccctcctcattccttatctctgctgcctccagtatctggcccttgctctctgccaggcaaattctactcttgtatgatccaacccacatgtcaccaccttagctttccagggctctcttctcccttcccaagtattcattcaatttgtgaatgtttattaagctactttttcacgttcagcactgggatagagaaaatgagcaggctcagttctgcctacctggaactcactggcaattaagcatgtattcattctgccctttttgaggatctgctctgaggcaggcacttgggggtattccataaacagtactcacctcaaagttgtttacaggctggtgcctctcccccacctccattttgatcttgcctctttttcagcacgtactctcaatgtactgtaattaattgtggctttctctagctcctgcagacctgaagtgcaagagcctgctctaccttactgatttttagatttctaacttctggggctggtcttttgtcattgatgtaacaaatatctcctccacagtggtccagacccaatctttgtccaggctggggctttcaaagatgataaagaggggttgggtgggatcacaaagaaatcttgcgcaaatataccttgaactaacatatattgaaaaaagcaggacctaacatttcaaactcactgaaaatggagaaatgagatggtaaactttttgggcttagaggtgtagaagcaggaactcttaggtaggtgggaaggctgctctgtctagttggtctctgcactcaatgcaacccaggctgggtctggagtcatttaccctccttgccctctccccagcttttcctactcttgccaagagggagaaaccaaggagctctggtcatcaggtcaccatctcaaggcctgccgagctgtggccttctctgaagatgggcagagtgagtactggggaagacaaccagcaatgtggtggaagggagcagtgagcagcaccatgacctgggcaccttttccccagagctcattactgtctccaaggacaaagccatccatgttctagatgtggagcagggccaactggaaagacgtgtttccaaggctcatgggtaaggagagcagccaattctgtgtatgtgcatggaggtgaagggtaaggaccaggaggtccccactgggacagagatgctccaagaagttctacatctgtgtctctagtgcccccatcaatagtcttctgctggtggatgagaatgttctggccactggggatgacacaggtggtatctgtctctgggaccagcggaaggagggccccttaatggatatgaggcaacatgaagagtacatcgcagacatggctctggatccagccaaaaagctgctgctgacagccaggtacaacttcaaagctgccttgcctcccctcccctccctgtgtgaaatgtcttcctcaaatagaccttgcgtctaagcctactgctctactctctacagcggggatggctgccttggcatcttcaacattaagaggcgtcggtttgagctgctctcagaacctcagtctggggacctgacctctgtcactctcatgaaagtacagctggttatggtgggatggaggggtgtgtgctgggggcttagtctgaggcagcttccacattgttttctctatttccctgcagtgggggaagaaggtagcctgtggctccagtgaaggtaccatctacctcttcaattggaatggctttggggccacaagtgaccgctttgccctgagagctgaatctatcgactgcatggttccagtcaccgagagtctgctgtgtactggctccactgatggagtcatcaggtgagggaagcctggacagcccttaggtcacaggaagggcagacccagctagccagtactcaacactgttctttccctgcccagggctgtgaacatcctaccgaaccgagtggtgggcagtgtgggccagcacactggggagcctgtggaggagctggccctctcccactgtggccgcttcctggccagtagtggccatgaccagcgcctcaagttttgggacatggcccagctgcgagctgtggtggtggatgactaccgtcggcgcaaaaaaaagggaggaccactgcgggctctgagcagcaagacttggagcaccgatgacttcttcgcaggactgagggaagagggagaagactccatggctcaggaagaaaaggaggagactggggatgacagtgactgaaggaatgaattgaatcttgagacgggtcctcaccaggcaagagtcttgcttattgggctgcatccccagagaggatatgaattattttttgaaaagacagggttttgccatcgtccaggctggagtgcgctggcttgatcttggctcactgcagcctcaatgtccccaggctcagattgtccttccaccttagcctctggagcagctgggactacaggtgtgcactaccacaccaggccaatttttgttttttttttttggtagaaacgggtctgttttgcccaggctggtcttcaactcctggactcaaatgatccacctgcctctgcttcccaaagtgctgggattacaggcacgagccaccacacctggccaaaaaaatttatattttttgagacaaggtctcactctgtcacccaggctggagtacagtgggttgatcatggctcactgcatccttgacttcctgggctcaagtgatccacctcagcctgcctggtagctgagacttaacaggcatctgccaccatgcttgactaatttttgtgatttttttttggtagagaccaggggtttcactatgttgaccaagctggtcttggaactcctgggctcaagtgatcctcctgccttggcctcccaaaatgctgggattacaggcatgagccactgtgcctggctggatatgaaattttttttttttttttttttgagacagggtttcgctcttgttgccagggctggagtgcaatggcgtgatcttggctcactgcaacctccgcctcccgggttcaagcaattctcctgcctcagcctcccaagtagctgggattacaggtgtctgccaccatgccaggctaatttttgtattttcagtagagacggggtttctccatgctggccaggctggtctcgaactcctgacctcaggtgatccacccgcctcagcctcccaaagtgctgggattacaggcaaaagccaacacacccggcctggatatgaatttataataccctacagtgcaacacaagaagatgcactcaaagcactgatgtgaggaagtacttgccccgtagcagctattcactctaccagtgtaaacaaactctaagctagggcaagacagcacagacacaagtatatactaaccaggggtttaatataaatacaaccagcatagaaagacccaaaactatacagaaaccaaaaccagaatgccatgtggtggaggcaaagggcagaatttctgacccctttggctcagctgcccttccccacaaataaaaaccaacaaagaggacaaatcaggacaataaagaagattcatgctaagctgtggcagaggggggaaggtatgatcgggtgggggtgggacaaggaacggccatggaagatcactgggtcaggttggaccctgggctgggagcgggagggcaaggcccctcaccacaacttaacccaaacctaagctgcccccaggtgccataggtccctgtcccagcagggaggctgatgggcctgggcccatgcccctccccacctttgggggtcagaaagtggccacccaggcctgctgggatggggcctgacacaggctctgcatgcccattcagggtgcctgtggagaaagaatggagtcactgtttaaccatggtacctgcctcagccccagcagaccacaggaggttggccccagactcactgagtgcctgcagcagccgtacagacacagcatccttggccacctcatgcccatcccggccatctagggtcagcacaacccagatgaggccgctgaagggcaccggatgcccaggaatcaccacctggtaccagaagcggtgccagccagcaggtcctatgcccaaacacttggtgaggaacacagggctgcccagcttcattcgttggcacagcaactgcagggtagcccgagccccttggaaccctaacttgtcccttgccaaagccaactggctgccctctggctgtggggaccgcaagaagggacccacaagctgctggcgaagtcgctgcttcaggtctggcttgagccactccacagccacctgctctccacagaggtgtgactgccctgtaggaaaaatgcaaagacaagggcaggtctaaaccctgggcccaagcctccaggtggtgagccctttggagctacacagtcctgttatttgtagccttcccatttcctggtagtgtgaccatgggtaagaaaagacaatgaagccttcagcctccattatttgcaaagggagtataacacactgctaccttacaagtttccttggagaagtactggttaattgcaggctttgtctgcctcataaccatcataatggctaatctttactgggaaaacttgctgtaagtcagtcagtgtgctaagtaccgtacacccattatgttacttaattctcataacagtctgaggaaacagattctatagtagtaaaaagctcagttggattcccttgagcaaatcaatttctctaacagtttcctcatagcttgagggtcctgtgcctattttgcggtgtgggggtgggggaaggttgagaattaagtcaggaggtaatgctcgggaagtgtcacaaatttaggtaagcggtggtggtagcaccattggaagttttaaaaatctgagatcaaatagtaaaaggttgcaaattctggcatgtttgactctaagatcttgtaactttaacagctatgctcagtataaagtgccgggcagaacgcgtttggccccaaccagcacccccgccccagcctaccttccaccagggcctttttggccatggcagcggcccggtgcgagctgaatttgagcagagcgatctgcccgggcgccggtccggggctgggcagcagccgcgcctcctgcaagccgggacccagcggctgcagcgcgagcagcagcgcgctgcgggtcagattcggcggcaggccgtcaacgctcagctcacacttctcggtgctgcggcacacgagcagcgggcaggacggccgcagcggatggttgtgcagcgtggcgatggcggcctgcgcgccgcgcctcgagctgtagcgggcataggcgaagccgcggttcaggccgctgaaggtcatcatcaggcggaactcgtagaggcggcccacgcgctggaacagcgggataagctggtgctcgtacacgtcctgaggcagccgcccgatgaacacctctgacccagctggcggcgggctgcccacccagcctgtgggaagagggtatgcaaggccaccgtcaggcgacgctttcgaattctgagcccacggacccagcgcgcgggggtgggaggcgatgtgaacaaaggtctgtgaaatgggtttacacccgtaccctgggtggttggcataattaggtgactgcgctaacaagggggctggcacagagtaggtacaccttgagattggccccctccctcgacggggcgggtggacgtggagccacagttcctcctttgctggggggtataaatccgggtagttcgcagtttctgacagtgaaggctcggagcagcccctcccccaaagggggctggtgtagccggacaggcggaggggctgggactaccgtacctgggggtggcccgccatacttcctctgcccgttcacctgcaccaggcggatgcctgtctccctgacccacgcctccagcgccgccttgttctctggattcaccctctcacaccacagctgagagggaaaggaaggttggaatggcggatcgccaagcgcgcccccacctctcctgtggtactggggtccctaaagccgacccccgctccggcggggctcgccggcccccaagtcgccagccgcttacctcacaatcccgcttggactgcatggctctccagctggccccctcgtaccctctttataacttcctccccaccggcctctggaagcttccctacccctccaccccgcaagctctcattggctctgagcgcgaccccgcctcccaggggggtggaggtatccactgcacgtgcgccgcccgggcttcgctcagaccttcaggtgaaagctgcaaagtcgcgggtgcgtatgtacgggggctgcctcccgaggaggagctcccaagccgcagggtggacgctggagacaagaacctcagggtcacaagtttactgtttttctcccttttccatccctacattggtctgctggggaaggcggggctaggcatcactgacacacgcagactccgtggttgaggcattttattggacctttggcaattggtggtggggaggcatctgctccaactggtgcggggccctgcagatgggaccatctcaggctgggtccttgtagcccaggagcacagactggactaagcctcctgggccttgtatgaaaaaggtgttgtacctggccgtttttgccagtaataatcaataaaataaccataataaaaatcaaaggctctgttctgaccactcttcaggtcttccgctgaaacggaaaagtgcaaagcaattgaagtacatatgcagtttgtcttaacctcaaatagtgccagtcccacttcctttcctctgatagtttgttcagttcagcagatgcagaggggctggcctgttctccttttgatttcctccacaaggtcttctcttcggacatccacctggccaggatgggagaagaaggtggtataagcatcttccattccactgctccccgagtgcctagtttcctctagccctctaggcatcaggcttgtctcagctgggagcaggaacctaattaaacacctcaggctagagtgtgcctcttgggggagccaacaaaccataaggtatatgcagggatggagatctcaccctactaagaccacagtaacaggttaagccctcaaggcttttatgagttgtactaatatcaatgccaggctttttctcaggtcttgaatgggcatgggcctgccaaaatggcatacattctctgtcccttagccttcctgcccacctccctcacctcttccctgctcgtcactgaacggagcttgatgaccccatccttgagttcctgctcgccgatgatagccaccagtgggatgcctgcctcctcacagtactgtaactggttcagtagctttgggttcttcttgtacagcagctcagcctgcaggggacaagagcagaagatgaaggctggcttctgctgtcctcagggacagagggtgtccaagctggcaccctgttcttagctctacttttgagaagtaatggcaggatccattatgggtgagcttttattcagtttgtgtccagcacacctaagtttgctgccaccctggggcttgcctcccataccttgatcccagcatcccacagttctgagacaagctttagtctttcctctagcagcttcttctgtgcagatgccacaagcacctgtgtctccgtggtccgtatcttctcctccaaagcctggggaaggggcagataaaagagagctgggctaacaccttcaaggagcaaacaaagcaggctctagtcgggattttgagaccaggcccaactcagctctaccagggcaggggccctgtcttctcatctagcaccttgggcataaaggtagcttttagtagatatgaggactgaactgactgacttgtacataggacgtatcagaataaataacttagggcaagagtaaaggtagcttttttacagtaacttcaagcttatctccatgtagtaccttttttttttttttgagacagggtctctgtcatccaggctgaagtgccgtggtgtgatcactgcagcttcgacctcccaagctcaagtgatcctcccacctcagcctcctgactacaggcacacaccaccatactcagctaatttaaaaaaaaaaaaaaatttttttttttaatctgtagagacagggtctcatcatgttgcccaggctggtccatgtagtaccttaagggtccaccaaagcattcacacagaagtactactatgagcccaccccaattagatcacccttgacagttttagtccccacttactatctacccatttatgacactgtgcctctcacacttcagttacagggcacaggcgtgtatatgggtgtggggaaaggagaatgctgctgctgcttcccttgtctttttcaggaaaactattttcatagttcttagaatgtaagatgcctactggaaaaatgatctcaactgggaaatgggtggtttccaccctagagaaaaggcataggactgtggggaggttgccagagcatttcccagaagatgaaatgcaaccagccacttaagaccagcagcaacaaaggagggcttgaggctacaagaggcttccttggtgttactctaggtgctagagagtcacggtagccatctgagggatcccagggcctcagacacatgcttcccatttagagacagtattgcagtgtggttagtggcaagactttggagtcagactgcctggattcaaattctgaccctaccacttacaagtttcatggccttaagcaaattatttgatctataatgcttcagtgttctcatctggaaaatgcaattaataaaattagctactctcacagggctgtagtaacaattatattttgataatgcatgaaaagcaccaagcacagtgcctggcacaaggcagtaaaatgttaagtattccgtatcatgaggaagatctaagtcttggatacaccagcccaggtttgtgacagccctgaaggaagtagagacccagagcagaggattgagtgcagaaagattatggattaaagatccataaaacttacatataatggggtagaaatctgtgaaaaagagcaataatcttttctccatttctgtgagatgctccctgcccaaagcagcaccacttgctcccttggagatcagatagcttaggtgccaccacctgctcagactatcttctacctacctcctaggacctacctctagtctctgttccacgatggagaaaatccgctccaccccaatgctgagccccacacatggcaccttgcgccctttggggtcgaacatgcccactagcccatcatagcgtcctccagcagccacactgcccacacccaggggctcttcccctgcctgggctggggtctgtagcagcactgcctcatagatcaccccagtgtagtaatccagccctcgagcaaggctcaggtcaaaggagatctgtggagataagaaaatggtcagtgccagattaagatcagggacctgaagccccagagctcagaagggatcccgtccccaacttgactcactttgtcatcaatgccaaatagggtcaggtactcaaagagcaacttcaggtctcccaggccctccaaggcctgcttgttttgggatagtttaggatcctggagcagctgttccaccagggataccccacctggggagacagacttgtgagtgaggctgacaaggaaacaaaaaaggtaaggagggttgaccttcttgcctggactctagtcgcccatgcatgtgtgtgtacatatgcatagacacactcactcccctacatacataacacagaacagtttcaactttaggactgagggcagtgggacggctgctggggaggcttggttctgttcctcaccatgttgctggacatagtccccaatgcggtcagccacctcaggtgcaaggcccttctctcccaccatctcattcttcacctcttcccaggacacctaggcagacagacaccagtcagggacccctgggcagcttccgcaccacagagcaagtgtgtactgtcctcggggaaccgttttagagcagtagctgcccatgagcctacatcctggggctaaccttcctctggtgggtatagaggcatgcacctctctctctctcaatcttgttttccatttcccaaggcagggtgggatctgggaaaagaagtcaagtacttgggttgttaccttgtccagcttgtctactgaggagcagatggtacggaacttgctgtcagaaacaccacagatagcaaacatcccatctagaatgcgtcgatcgtttacctgcaaggaaccaatgcatagtgaggggggaatctcttttcttacatgacctgcaatagtcatggtcacttaggctactggtccctctgcacaaggatcttctcttgtgagaggccaggcccaactttgccctcccagccttgtcagctctgaccttgaccaggaagtcgcctatctgaagtgaactcaggatctcgcacatgatcttcaggcactctgcatcagggatcatgggatcaaagttcccagcaatgtcaaaatcctgcagggagagggttagccagcggtcttcagggattcacctttctgaaggggggactctgggagctctgtcctctaggaaggcctggttgcactcaagcatagaatttctctttcattttctgatcatcagcccagaggtaaaccccggcatctttgggcttctcaccagttttggtttcctttccatctactgggctattccttcattttctacttcatcatcttcttaactcctcctactggatggggtgattatatggctttagtgcttagccattttccctattcatccagaagccctggcatcagtctggatgatttgatgtatcaaagctaatttccttattctctgctgtgatcctatcactgtggtttaaaataaagagcactggaccaagagttctagtcctgactttgcctttcttatccctatgatctcttcatgggctgggtatcaagtttactcatatgtaaaatgaagagactttattctcctcccccaccacagggattttgtgaaatctgcatgaaaacaccatagaagaggctgggtgcggtggctcacgcctgtaatcccagcactttgggaggccgaggcaggcggatcatgagaccaggagttcgagaccagcctggccaacatggtaaaaccccgtctctactaaaaatacaaaaaattagccgggcatagtggcaggcgcctgtaatcccagctactcaggtggctgaggcagaagaatcgtttgaacccaggaggcagaggttgcagtgagccaagactgcaccactgcactccagcttgggcaacagagcgagactccgtctcaaaaaaacaaaaaacaaacaaaaaaaccaccatagaaaccctaagagcattatctgggtcatccaatttgctcaggacaccgtgagtactcaatagattctgctggcttgagagagccccaagtaactcatcctgccccacggtttcccaacactcacacactggtagaattcccggtatcggccacgggtcatggctgggttatcccgccgatatacctttgctatgtggtagcgtttaatgttggtcagtttattcattgccaaataccgagcaaaaggaacctgatgacaaagagttaaggagaaagcccctcctatcactgtctgcaagttgattatcatcaccaacagaagctggggtctaacccctccctatgtgggtaaaactgccacccataagattaatagcacttacaaacatcagaaagcatcagctgtgctaccacatgaggtagctgaaggctcaaaaaagattaaggcacctttcccttttgtagtgttgactggacttttttgagcatggcaaggggctgggcaggttggccacagaccagaaaaaggcgaccagaaaaaggcccccatatgggatttctaagcagatgattctctgtgtagcttggagacaagggaaatgtgttgctagtccattaagaagaattttgttcactggacagggcaggggagaggtattctggagccaggggatgactgtagagttggaactgggccctgacatcaagctgaggtctcactcaggattcagaagatttctaaggatgtgtatgctctgtttagccaaagttccactcctggtttagagaaataattcccctaatcgccaaaggcctcatatttgatcctacctactctaccattcttaaacctgagccaagtgagtgccaatccatccaaagtctcaagagcccaagtttagaaagatacagtgaggtcatagcgaagggacaggagctccccgccctggtccttcaggtcatagataagcttggagtcttccccatactttcccatcagtgtttcctggagaaaacataaataaatgtggtcataataataaacataacaatttaaaaggaagttttgaaaacaaacatgactgattccaacttgtctacatttccctctgctctttatcccaattcttaggtgtctgatgtagttatcattaaaaggaaacaccaattttgtgtttttttctattttgattttgtaacagagctgaagtatttttcttacacattttcctcttaaaaatcttttttttcttcagacttctcagcatgaagtttgttttttttttttgaaatggagtctcgctctgtcaccaggctggagtgcagtggcgtgatctcggctcactgcaacctctgactccggggttcaagagattctcctgcctcagcctccagagtggctgcgactacaggcgggtgccaccatgcccggctaagttttgtatttttagtagagacagggtttcaccatgttggccaggatagtctcgatctcttgacctcgtgatctgcccgcttcagcctcccaaagtactgggattacaagtgcgagccacagcgcccggcctgaagtgtttttaaaagatgcataaattccagtgagaagaagctctgtacttacttcctccctcatgttatactgttaggtgtttaggttattctaatttaaaaaaaaatttttttaggccaggcatagcggctcacgcctgtaatcccagcactttgggaggccaaggcggatggatcacctgaggtcaggagttcgtgaccagcctggccaacatggtgaaaccctgtctctactaaaaatacaaaattagctgggggagctggtaggcatctaatcccagctattcggaggcttaggcaggagaatcgcttgaacccgggaggcagagggtgcagtgagcagagatcgcaccattgcactccagcctgggtgacgagagtgaaactctgtctcaaaaaaaaaaaaattccccataacatttcaatatctaatatttaggtatatagctctttttttttttaaaaaaaagtatttttcttgatgataaactactaggaataggttatca
